United States Patent 8,781,750 (CELL-TYPE-SPECIFIC PATTERNS OF GENE EXPRESSION) - sequence listing, part 22

SEQ ID NO: 36660 - DNA, 524169 bp, Homo sapiens
atggataagtacgatgtgattaaggccatcgggcaaggtgccttcgggaaagcatacttagctaaagggaaatcagatagcaagcactgtgtcataaaagagatcaattttgaaaaggtaaagttaagttcaaatttctgttaattttcagtgggatattcagctggcttttaatccaatataaaaaggaaatttttattttttataatttcgaattttaagccataattgatttttgttaattcaacctcctaagtccattgtccaaacagcaaccaatgatctcatttttaaaaagaggctggacgcactggctcacccctgtaatcccagcactttggatggccaaggtgggaggattgtgtgaagccaggagttcgagatagcctgggcaacatagcaagaccctgtccctgctaaaaaaaaatttttttaatgaaaatagaaaagaaataagatcacatccctgtggctcctatggccctccttagggtgccctgcaaggccctgtgagatgccagcctcctctgttgccctgacttttctctgtggtgcacttcctctctccttattcaggtcctctacgaggggttttctgcaaacatcctagctagagtagacccccagccacaatcacaccttatcaccttatcacaccaccttggttcctggtttcttttttgttttcttttcttttctttttttagacggagtctcgctctgtcacctaggctggagtgcagtggcatgatcttggctcactgcaatctccacctccgggattcaagcaattctcccacttcagcctcctgaatagctgggactacaggtgcatgccaccatgcctggataattttttgtatttttagtagagatggagtttcaccatgttgcccaggctggtcttgaactcctgagctcaagtgatctgcccgccttggcctcccaaagtgctgggattacaggcttgagccactgcttctggcctggtttattttcttactagcatgtataatgctctgcaattactttgctctcttaattattcatttgtttattgcttgtcttcctcagtatgcagaacagttcctgtcacataataggtgctaaacacatttattgagtgcactgaatgaatagagaaaaactatatgtaattgttggtctaatgattttggaaaataaatatagttaattaaaaattaataatttttgctaaatccaccttggtcagtgtttatgtcaccctctttagtgatatgttcatttcataatatattgggacaacaatgtccattgtttgctagaattaattctaaggcaagtcttgttggtcagcttctagaggatttataaatgagagtagcataaaaagttccatacaaagtgtgtgcaaaatggactacccaagttacaccatatgaatatacttaatgccattgaactgtacacttaaaaatcgttaaaatgatataaattttatcttaccacaaaaaattgcaagaaaacctacccaaacttaaagctcaagagtagatgactggcttccagggataatgatttatttcccaatataggtctctttttgtgaatccatggcatattcataataatgtcctcttattctagtggcccgcaatagcttcctcccatgacattattctgctcactctcttttgtttatctgactgctctccctcaggcttatctctgtcttcgccctgtgtatgtcctcaaccatgtgtccttttctgattttctttttctgtccattgtcacctaaactgccccacttcagtgtttaccaataagtagatctctcttaaatctctgtctctacccctggcatctttcagtaccctagttctgcatttcttctgccagctagataacttcaggtaatatctgtggttttgttttgaggtggagtctcgctctgtcgcccaggctggagtgcagtggtgccatctcggctcactgcaagctctgcctcccaggttcatgccattctcctgcctcagcctcccgagtagctgggactacaggcgcccgccaccacgcctggctaattttttgtatttttagtagagacggggtttcactgtgttagctaggatggtctcaatctcctgacttcgtgatccacccgcctcggcctcccaaagtgctgggattacaggcatgagccaccacacccatccaacatctatgttattaatctattgctgtgtagcatattaccccaaacttagtggcttaaagaataaacatttattgtctcagagatcctgtgcatcaagaatttaggatgacgatcattgagaccaccttggaggctcggtatcacaattgtacccaaaaacaagtattaatagtgattcttccttgttgtaagcagacccacttcacctcctatgtgctgcgctgtattaatgtcatcagtgtccttatggttgccagcctgaaaaccttgggatcgtttgtgagcttattccttctccacattcaattatttggcgaatactgttgactcttcctcttccttgaatttgcttcagtccttttgtcgaggccctgggtcacttggatccttcaagtggctccagcccaattttgataatgctccagccatgcccccaaaccttcactgggacagaggctgtaaagaaagagttgcctaggtttgactacataaaaatagaaaacgtttgtatgtcaaaacaaacactataaataaattcaaagaaatcgagaaggtgccaaaaatatttgcaagtattgacttaatggtgttagccttttattaaatcaataaaaagataaaatccatatatgaagtcatggtacaaaaatttgaaactcagtagaaaactaagaaattaggagtttattcaaagaaaaaccccacagataaacagttagaaaacaaatgtccaacagtaggtaatttgttaagtaatttataaaaaactaagtggctattagcaatcatgttgtaggtgaagcattgacatgggaaaatttcaatgtttgcaatgtttgagaaaatagtaagtgtaaaataatataatctttggaaaaatatatatattctccatatatatgtatacctacaaatatgttcatatatgtacaaagaaagacacaaattgttattattgaggtagaaagtggggtttgccttgtgcattttttttgagacaggatttcattctgttgcccaggcaggagtgcagtgacatcatcatggctcactgtaaccttgaacaagccatcctcctgcctcagcctcctgagtagctaggactgcaggcatgcgccaccacacccagctaattttgaaattgtttttagagacaggatcttgctatgttgcccaggctggcctcaagtgatcctcccactttggcctcccaaagtgctgggattacaggtgttagccactgtgcctggtctgccttgtgcttttatattgtttcactcttcagagaagttttgagaccctctctgatttgctccaaaactacagctcctatcacataccctactttttttccccactccagcctctgcatttgcttctggggctacttcttccaaggtcgttgcctgctgatctcccagcatcaagatcccacttgttcaaggctgagctctaccatacctccagaatcctcccactctaaagaatttatccttctctgtaaacttgcataacttttattggaacctctgttatagtactgactgctttctttctggacatgctttggctgtttattttgtgccttctcctccttatttagctgtaatatgttctgtgaggaccgagtccatgtgtgttttgtgctggtattccacacagcacctaatgcttggtgccaggagatattcaataacttcttattggatagatgattcactggacagatgctttcaggccctcttgctctactgtgaagctggtatatacttaggaattataaaaccattttaattctatgtaaagagaaaatatttgagaggtgaatctctataaaaatgtacattaacattactgcatttcatagcatctctcccattctttagtataatcaaaaattgactatatttttctaatagagcaccaatttttcatcactttactcatgaactactcttgtcactatgccataaataagtagaatcttatattagacctcattattcttgttttcccatatctgtttatgttatcgaatttacctataacatctgtgtcacaatattaacatttattacttctttcttcctatctactctcatgtagtttttcattacttcttatctagagaaatttatatttcttctctctaatgcctccctactccctacactagaccccagaactaaattgcttgttttcttacaggtaccaaaaagctaatatttctcttatcatcctaccattatcaagcatgttcttttccttctgggctcaaataaaagtgttttatctttcctcaattgtgaaaataaaaatgttcgttgtagaaattttgaaaagagccaaaggagaaaataagaccatttagaggaaaataaaaatagcatataacctctttcttaatcactatgaacactttgctgaatttctctctagactatttttaatgtataagtatataagttattagaatgattggtgtcatggtagatatactcttttttttttttgagacggagtctcgctctgttgcccaggctggagtgcagtggcgtgatctctgctcactgcaatctctgcctcccaggttcaaacaattctcctgcctcagcctcctgagtagctgggactacaggcgcatgccaccatgcctggctaatttttgtatttttagtagaaacaggctttcactatgttggccaggctggtctcgaactactgacttcgtgatctgcctgccttggcctcccaaagtgctgggattacaggtgtgagccactgcgcccagcccaggtatactcttttgtaacagttttttatattagcaatatattgtgaatatttcctcatctcattcaatatttttatataataaaatgttgtcatttaatgatattaaatgtgttcacactaatgataaagggaccacctgcagggtgtccattatatgtcacaccatcctgggtgttttattatgtatatcaactcaatttaatcttcacaaccacttaaaaggtagctctcattactctcactgtacaagtgaaagagctgaggctaaagaggttaagcagttagctccaggatgcacagtaatcagcagatccatctaagtctttctctgctctttccatgatactacattgcctccctttatttttaatgactgcatagcattaaagtggtagcaggtcaaaaataccataatttagctgggcatggtggcaagtgcctgtagtcccagctattctggaggatgagttgggaggatcccttgaccccaggagttaaaatccagcttagacaacatagcagaactctgtcttaaaaaaaaaaaaaaagctagcaaaacacccctgtaatttatttaactctttttctattttcagataattacattgtttggttggttttttggctacgattcaatagcatttaatatgtaaagtatgattcatttttattaaacaaaactatgtatatatgcttgcctatatatgcatgaaataaaaagctctaactattaacaacagttatccctagggaatatagtattaggttggcgcaaaagtaattgcatttttgccattaagagtaaggttaccacctatgggctttcgtctgtgggctagatgagaaagaaagagggaagtttcacttttaccttattcacttctatttgacttaaaacaagcgtgcattattagagtaacttaaaaactagcaataaaacactgtaacaaagtcttttgtatgagaactcttctgtacccttttattatcttctttggataaatttctagaagaattagtcaaaaataggaacatttccctcatgcctgtaatcccagcactttgggaggctgaggcagctagatcacttgaggccaggagttcgagagcagcctgggcaacatggtgagaccccatctctactaaaaatacaaaaaattagccgggtatgatggtgcttgcctgtggtctcagctactcaggaggctgaggtgggaggatcacttgagctcagtgggcagaggctgcagtgaaccaagatcatgccactgcactccagcctgggtgatagagcaagaccttgtcttaaaaaaaaaaaaaaaaagatttcttcagcaggatacagaccccccacaaaaatgaacattttaaagattcatattatatattgtaaaactgccttcccagaaatattttatcaatttgtgtagttttaccagaaataaatgagtgtccattttgctgctttctggccaatagtagttattgacattcttttcatctttgccagtttcatacatggaatactatattacattttgttttagcttttattcctttttttttttttttgcaatggagtcttactctgtcacccaggctggagtgcagtggtgtgattttggcttactgcagcctccatctcccaggttcaagggattctcctgcctcagcctcctgagtagctgagaccacaggtgtgtgccaccacgcctggctaattttttgtgtttttagtagagacagggttttgctatgttggccaggctggtcttgaactcctggcctcaagtgatctgcctgccttggcttcccaaagagctgggattacaggcatgagctaccacacccagccaaattttgctttagtttttattcctttgattactgcatgagattgaatattttttctatcagccatttttatttctctttttttttcgagttgactattcttgtactttgctatttttctgttggggtgtttgcctttttaaaaattatttgccatcaatttttatattataaatatatttgtcatatatggtacaaatattgtatcttatccttttgtttgtcttttaattttgtttataatattcttttaaataaatagtagttaggaattttttaagttgctaaatgtatccagctggtaggagtaatttagctgtttttgttttgaaactcctatgtactgactatacaatttaaattggggcaggaaacactgaagcttagaggggtttaaggaacttactgaaggatccttcagctgagatgtagggaagctagaattgagaatattaatttttaagaagttcttaagtctaaatgagaatgagaaatctggccaatgttgaagacctctaatgggtggaggccccgtggacatcagaaaagcggggcagtcaggggctggaagtcagggtagaaatgacaagtcagcaaagcatcaagagtgaggaagaaaaagtagaaatgaggtgtggccactggtactggcaccaaaccccttggcaagtattgtctataggtgaaagtagaacaagaaaatacacccaaatacttctaaaatgaagtcatgcaagacaatttttatttgaaaatgaaaaatgtagtcatcttaatacaaaattttactgacctgatttctgtgggatatgacacattttctttttttagatttcatttgtttcttctcagcagtgattgctcctggaatgttgcatttttataaagaattccttcgctactgaaagatagatattaaaatatggctccatatggctagataatgaacacggtaccaccagtccaacttttaatatagcaaaacttcaccagaaatatttattttcttgatgatggttgtcaacaaaccattgatgagatgtagggcactctgctaattctagaaatgttgtttcctgccattgaaagatcgttttcaaagtgacattaaaagccagtgaaatcctagagaattttagatggaaatgagcagaaagcatgttcttgaaaccaagttagctttatagactactctgtctcttaatgtaatttagatgcccatacaagaaaaagaagcttcaaagaaagaagtgattcttctggaaaagatgaaacatcccaacattgtagccttcttcaattcatttcaaggtttgattttctaatattcgttaagtatttttataaagtataggcatgttgacatatgtaaaaagatttgttcctaaggactgtgtataaattaatttttgtaaatgggtcatttccccatttacttaaattgcagcttgagacgtcctcgttatttcctctctagtaagtttttgtagacggctttcttatgttttcttgtttttctgcctctccttaattctcactctcccaaaaaattaatgactggcttattagcttctttgctgtagtaacaacccccaaatttaagtgacttacaataagacacatctatttctcacttacattacatgctagctgtggtgggctggggtcttgagtctggggcccaggctgaaggagcagctcagataaggaaccagctgttctcataagcaagagaagaggggaaaacacagagcccaccacactatcgctctcaaagccctgctaggatgtgtgtgtttgtgtgtgtgtgctggggggtactctgtttacatgagatcctgcatatcctcaggcaacagatgggactgtgtaatcctcttacagagagccagcaaacagccacgcaccatagcctagcacactgccacggagagggggagaactttagggaaggaagtaccttcctctgtacacctgaatacaattctgctgacaactttagggaaggaagtcccttcctccatacatctgaatacaattctgcctccacgcatcactgtagtccaaaggtaaaaaataaataataaatgaaggagcattggtcagacagcattcattcactgaactgatacttattgagtgcttactctatgccaggcattgttctaggtgtcaggaatatagcagtgaacaaagcagatgaaaatccctgttttcatgaaatttatattctagtgggaagagatagacaataaacaaatctacagtatgtcaggtgtgtcttaagttgtgacagggctgtatgtgctgacagttttatgaagggtcattccccagcccagcccccagcgcagggctgttttaagactgataattagttcatggagcagaagtgttaacctcaatatcttcaagcatcatcagttgggtaaaagtcagtcaataaataaatacagccactgtgtcttgagtatgtaaactgtgcagagcactgtgttccttactgattaaaaccgctacattcaaggtacttctgtgtgtatggcccttctttggcttctgggtatttaaaaagagctcttgggactcttctgaggtcttcctgggagcagaacagtacacatggtctggaattgggttgcatggaataactttcaaggaaagccactgaataaagtgccctgcattcctgtccattggatactgataatgctataagatgatctttctcttctttattttgtttgagattattgtgactctctggctaactcctacttatcctcaggccttttctgaactcacaattcaaattacagctccctttggttctcttccacagcagttgtacttacatatgtctatttatataattatgaatttgtttcatatttgtcgccctttacatggtaaacttaatgaattttggggctccatctgttttgctcaccacttgatccttggcatgtagcacacaatggctgctcaatacctatttactgaatgagcaaatggactggaccacttttagagactggagtatttccttataccatgtgagattgatttttgaggacagtttaccactggaagcttttgcagaactaaggtcatttttacagtatacataacctctgctgtgtttgttgatactgtaagtttacattttcttatgactctttttaagtagagcacccctgtgtttaggaaagctagagctattgtgatgcctttgagtttgcttggctgattgctgggacttgaactactgagcttatctaaaagcctcagaggccttgtagcctctgtcttttagagagtgtaggtaaaggcttgttttccctcaaatcgcttatctctgatcataagaaccatggctctaatgtttgtctatagaaaatagaatgttttggccgggcgcagtggctcatgcctgtaatcccagcaccctgggaggccgaggcgggcagatcacctgaggtcaggagttcaagaccagcctggccatggtgaaaccccgtctctactaaaaatacaaaaacgtttagccgggcatggtggtgtgcacctgtaatcccagctacttgggaggctgaggcaggagaatcgcttgaacctgggaggcagaggttgcagtgagctgagattgcgccactgcactccagcctgggcaagaagagtgaaactctgtctcaaaaaaaaaaaaagaaaataggatgtttttattggtttgaagcaacataagaaaaataatgagaatgtagtgatattttcctaagacaaaattaattccatgtatattccatcaataaacattcactaagtgtctgttatatgccaggcatgttctaggtcttggagatatatcagcaaacaaaataggcaaaaattcccatgctgttgtatttgttttctattactacataacaaatgaacacaaatttagtggcttaacaacaacacctatttattatctcttgatttctgtaggtcagaagcctgaggttggcttagctggattctctgcccggagtctcagctagttgaaatcaaggtgtcagctgggactgttatctgtggctcatggtcctcttctaagcttatttaggttgttatagatttcatttacttgcaattgggttaattggatcatggctcactgcagccttgaactcctggcctcaagtgatcctctcgccatggcctccaaaagtgctgtgagtactgtgcctggccagaaagagctcttttacatttatttaaacacagagttttattttatattactctaatgcacacataaaaaagaaaatataagcaaacaaagttggttaaggtattctaaaaattatttaggcagtgaaaacattaagcctgccgggtctacagcaagtgattggaagatgccaatgtctgtaagaaacaatcttgatttttttttttttttttttgagacagtcttactctgttgcccaggctggagtgcagtggtgtgattacagctcactgcagccttgaccttctgggcttaagggatcctcccacctcagtctcctgagtactgggactacaggcatgtacccccacacctggctaatttttgaatattttttcattatagagccaggttttcgccatgttgcccaggctggtctcaaacacctaagttcaagcaatccacctgccttagccttggcctcccaaagtgctgggattacaggagagagctgctgcgccaggcccttgattttttaaaagtgcattttagaatgaattataataattgtttaataaatgttggaatttgacaaataaaaaggttatttagtgcccctcaattgttttgaagtgtcagtgatccatgagctttacagcagatggaaaatttgagagcataaatgatttttccagacacttccaataaatataaaattaacagtggctaatgggggaaaatccttattttacagtcagataatgctaattgacattaagtagtttcttttttttttttttttttttttttttgacggagtctcactctgtcacccaggctggagtgcagtggcacaatcttggctcactgcacctccacctcccgggttcaagcaattctcctgcctcagcctcctgagtagctgggattacaggcgcccgccaccatgcctggctaatttttgtatttttagtagggacagggtttcactatgttggccaggctggtctcaaattcctgacctcaggtgatccactcatctcggcctcccaaagtgctgggattacaggcatgagccactgcacctggccagtagtttaagctatctctgtcggccgggcgcggtggctcacgcttgtaatcccagaactttgggaggccaaggcgggtggatcacgaggtcaggagatcgagaccacagtgaaaccctgtctctactaaaaatacaaaaaattagccgggcatggtggcgggcgcctgtagtcccagctactcggagaggctgaggcaggagaatggcgtgaacccaggaggcggagcttgcagtgagccgagattgcgccactgcactccagcccaggtgacagagcgagattccgtctcaaaaaaaaaaaaaaaggtatctctgtcatgatgaatttttagtcagtttctttcaccaaaagccagtgtaaggttgagtgagttggaggttggtgaaaaggaagtgagatgaaataatgtgtctcctctgtttcattattctgattcttccatggttttgaaattgccatcccttcattgctgtggcagaccttttactgactgagcttcaatgacaagaaacatcaattctcctaaaagtaacacattcctgaaaataaccgatctctagacattaaggcatatggggaagcatcttctcagaacccttcctagatctccagtcttacttgcatgcgctttctcctcaccctccagcctacagacttcttcacagcacttctcacccaatgctgagggactccccaactagacttcgcctccttaacagtagaatggatggcttctttgctttttattcctacacagcattccttgcttttgcatgtcctcaatagaagtttgttaataactgaatggatcgtctcttaaagaagagaggaggaaaaattgaaatatgtgaaagaagatgcatggtttgtgaattagaagcaaccaagggtagacactgccaggttactgatatccacagtaaagttggttagggtactttaaagagtaggatagcaaaagatagatatttggcaagagattttggcatttaatgggtactacaggggaaaatgttatcaacaattgcttataagactgattttggcgcttatgttttgtgttccttcagggtttttttgtttgtttgtttttaatgaatccactcaacaaacatttaagcccctttgatgtgctaactactgtttaggtacaaaagaatgaagtgtagacaaacaagtgagtagaaatccttcttttctaacaagatcccagctgttagttggttggctaatgaagaaagctggttagagcagaaaatcatctgttttagtctattccagcagctataacaaaataccataaactaggtggcttataaacagcagaaatttatttctggcagttctggaggctgggaagtgcaagatcaaggtgcaggcagattcagtgtctggtgagggttcactttctggttcatagatggtccgcctcattgtgacttcacatggtggaaggggagagggttctctcttggacagcaatccattaatgtgggctccaccctcatgacctagtcaccttccaaaagccctatacctcctaataccatcactgtgggggttaaaatttcaacatatacatttggggaagacaaagacatttggatcctagcaattatacagacatattttaacataagaagacataatcatcctttgagtggaaatggccaggaaaaaaaaaaagaaaaaaaatttaaggaaatgacaagcatttgttaaaggataatttcttttctttaatacggagcaagtgtttgtggataatctgtccacaatccttttagaagttttctagttatatttcattcatttcattcaacatttaggtcaatggttatttatttatttatttttaaactcactgagtcctccaaaatattcagcatagcttttggaggaataatcacatctttcattttctattcatatttcatcagtttatgtaataaagacaagaataactcactacagttcaagaaaattcagaattatagttggtagattatgagtccactgactatagttctgaattttctttcttatgtaagttatgtgtcttatttagaatttctagtctcttttctttaatgtggagcaaggatttgtggatagtctgtacataatccttttagaagttttccagttatatttcattcatcccatcaacatttaggtcaatagctattttttttaaaaactactcacttttactgagtcctccaaaatattcagcatagcttttggaaaataatcacctttcattttctattcatatttcatcagtttatgttacaaagacaagaataaatggcgtaaacatatttgggaaaaaacaaaatgatcttggtaagattcagttcaattggtaagagcagaggtacttggacatactagagagcctagtagtatttagtggtaacgttgatggggcaatagcaatggagagtgtcctgtaatctagtgagtggtttaggcagaggtcagttataagagtttctattgtattcaacaacatagataaataagtgccatataaatatggctttatgcccaaattcaagaaggggctattaattcttcctggggtgttatgaaagagtcacagctgctatttttacagcagatttctaacctctcaaaggaatgtattaataaaaatagccaacatttcttaaactctcattatgtacaggcattattctaagcatctgacatggattaactcatttaatctttccaacaatccaaagaagaaatttctataatatttccattttacagatgaggtaatgaggcacggagaagttaaagtgacttgcccagagtcacagagctaagaaatataaatggtatagtggaattagaacccagtccatcttgattccacagccagaacatggctgataaatatctgaaatccttccagcaccaaatgattccttttcttacagagaatggcaggctgtttattgtaatggaatattgtgatggaggggatctcatgaaaaggatcaatagacaacggggtgtgttatttagtgaagatcaggtaaaaacttctaatttgctttttaattttatgtatgtgtggtggggggagaattaaatttataatgtcataagtagtagactatgttgatataaagcatgtgttttggtagacagattgaaaccataaaatagtggatcaatattcttggtagattcagtccagaacaagtttgcaattgaacttaaactgaattgttttttagagagtgagattttcttgagaaaagataatctgtttggaaaatctcatgtaggatgcctctgagataagtcttcatggttaaaaaaaaatctgaatgtgagtgttccttagccatttaacatgtaacatatttatagcttcactgttttctcttttaccatttggtgctctgttttaaactagatatcccactttgctagggaggatagaagcttgtcttggcaatgcctatttagtttcattggttattaagagggggagataaaagatgaagaataatggcctctcccactttctctttgcacaaatgtatttctcttctatactccaagcctccctggaactctcttgggagtggtactcatgaaggagacaggtttgtatgtgtggagaggaatctgaattagctcctttatgattgatggtaaggccattgcctcaagaagcacacaggaaaggcccaccatctttcctttggccattgtttctttgttctattttagcatgtaagagcatcatgcccatataatttcctcttaaagttgaatattttgaatatatgaaggattaaaaaatcaatatctctaacttctgtaagattaatcaagcattctttgtatgctcatttatattatatattaaattccatattgatagaaactcttttttcttatctaggtattattttgccacattttataaaaatgcttctcatgacaaaattttgagttacatttctttttgttgggaatgaactaaaattacaactgaatattaatgtctggaatatagctttattcctattattttcctctttctgtataatttggcagacaaagaaccagtgaaattttagaatagtttaaataaatctctgtaggcatagaacacattttcataaagaggctcatggtcaacaaagataaaatcaaatcatgacttagaaataaaactaaacttcaaaggtaaagtatttgttggttttatattagatatactgatattttattacaattcctaacctcacagatcccccatttcttcctctttctctccccacccttgtcaccctccttccactgtaaaggaagaaccaatggcttccaggttatcaggaaacagggctgcttgtgtactattcacgatgcagttagcaccccagggttaagtaggaaaaaaagaaaaacatgaacggcatgcctctttcccttgcttctacttatctttttctgcatgtggaatttcccttgattttaccagtgatatttggattacttttctgtgcctccatttttttagttgtagaatgaaaataataatatgataaagtgtacctattaacttcattcctataaatacacatacactatatgtgtgtatgtgtgtgtgtgtgtgtgtataatttctatctttttgcatgttaccatgaagacatttcagtgactaccaggctattcagtggctttgttttgtgttctctctatagatcctcggttggtttgtacagatttctctaggactaaaacatattcatgacaggaagatattacacagggacataaaagctcaggtaacagctcagagagaagactaagacagaactgatcttttcttgaagtacctcaaacaacatgacattttctccatttatagaacatttttcttagcaagaacggaatggtggcaaagcttggggactttggtatagcaagagtcctgaataagtaagtactttgaaaataatttttctttctagtcaaaatagcccaaatatgtatttttagatatcatggattaagaagatattaaaatcttggttgtctaaataattttaggtagctttatgtaaatgcattacatcagatggtactttgagattaaaattctcaagataaattgtggtgtaatagaatgatgttgctaatattctgtagtgtgattccagtttctcaaatatggatgtgactgtaatatgcataaagctagagagaatttcgtgaaataggcaggtttacacttcttaatgaaaaaagtcaaactctataaaatatttgaagagatttattctgagccaaatacgagtgaccaaaggtccatgcctgtgacatagccctcaggagatcctaagaacatgtacccaaggtggccggtctacaacctggttttgtacattttagggagatgcaagacatcaattagatgtacatgggtttggtccagaaaagcaggacaactcaaagctgggaagaatgggagggagcttccaggtcataggtagattaaaaacttttctgattggcaattgattgaaagagtctatctgaagacctggaattagtggaagggagtgtctgggttaagataaggggttgtggaaatgaaggtttttattatgcagatgaaatctccaagtagcaggcctcagagagaatagattgtaaatatttcctcttatcggatttaaaaaggtgccagactcttagttaactttttcctggatcaggaaaaagccttggaaaaagaagggaattttcttcagaatgtagattttccccacaagagatacctttgcaggactatttcaagatatggacaaagaaacatgatttggggtaaaatattttgattcctttcaggcctgctatctgtcatgtgatgttatactagagtcaggctggactttggtatcttattgctacaaggagtctgctttgtcagtcttaaggtctgttttaatgttaatgctggtcaactgtgcctgaattccaaaggggaggaggagttaatgaggcatatcagaccctgcttcccatcatggcctgaactagtttttcaggttaactttggaatgtccttggccaaagggagggtttatgagttggttggggggcttagaattttatttttggtttacacactttctagcaaaataaatttgtgcacctgtttggaagacaatttggtggcaatatgtaccaagagatttttaaatatcctgtttctgggacttcttccaagggaataatttgaaatttggaataacgtaaatgcctaaataattgggaaatggttaaatttaataaagcttggcatggccatggccatgtacctgaatatatcataaacatttatggttttgaagacttcttgataactttgttatactaagcaaagaaaatggaattctgaattttaaatacattgtgatcacggttatatgaaaaatatgtgtggaaagaagacaggaaggaaatatatcagaattttaacaatagttgttttaggtgctaagattctgggtaacttttttctcccttattcatttttgtattttccaagttttaaatcatgaggttgcaatttgataatctctacatctgagagatttttataacatgacaatttcatctctttgtggagtctttaagccataaaaaatatattttaatgtgtaaatttttgggaggtgaattgtaagtttaaaaatcagctgatttagttactttatcaacatacagtgttttgctttcttctaacacatgtatgcatcaaatcttgtgttatccattttcacattttttcttgcatgtccatgtcttaagacttttcttactccaataaaaaatcatgctgatttattatttaatataatttactagttccatggaacttgctcgaacttgtattggaacaccttactacctgtccccagagatctgtcagaataaaccctacaacaataaaacgtaagttgctgactcttagtttgaaagtgtcagtaaaatctgatggatgacactgaatgaagattccagaaactaaaattcaaatctcttctttctttcttatggtacttttgtaatttcatttgcttcatgtgtgaaattgttctggaccaaactgagggttgggttgctatttctcgcggtccaatacgagatgcagatgaactggggaggaagagagtttttatttctgtaaccagtacagggagaaggcctggaaattatcaccagaccgactcaaaattacaaagtttttcagagcttatacaccttctaagctatatgtctatgtgtaagtgtgcattcatttaaagacatactgattaactccttttaatctataactaaggtctgagtcctgaagactttcttctggagcctcagtaagcttacttaatctaaatgggtctaggtcctggggtgattacccttattttgtctcctgctaaatcatggaggtttagggagttcctgcagacctccaataaacttgtttgtggaggcctggggagtttcttcagaccaccaataaaacttgtttaatcttaaaaggctccttgttaagaattccttcattattttgtcatggtttaaggcccaggaaaggcctaggcaaaactcttggtgggcttttgttacattacagcctttgtataagggcactggcttttttttttttattttttgagatagagtcttgctcttgtcacccaggctagagtgcaatggcacgatctcggctcactgcaacctccacctcccaggttcaagcgattctcctgcctcagcctcctgagtatctgggattacaggtggctgccaccatgcccagctaaagttttgtgtttttagtagagatggagtttcaccatgttgtccaggctggtctcaaactcctgacctcacgatctgcctgcctcagcctcccaaagtgttgagattacaggtgtgagccactgtgcctggctgggcactggcttttttagcttttaatatttaacttcaccactcagtatagaaacagttgtgatggaggcctgcattggtaagacctggcctgccacaaaatggggatcccagtgactatctctgagcagtgttacctgaaggtttcaaacttgtttagaagaaagccatttctcttcatttaaagatacaagtggtataaaaaataacatcgaaaattgcagtcactgtgatgtccatttttgtattatatgttcatatctttgaagcactgtttagtctattgcaagaaagattgaagaggatgaagtagaagacaatgtggtctggtgaccgctcactggattaggagctaggaatcctagtcttggctcagttgctaacttgaccaagtcagttgacctctgtgggcttcagttccctaactcataataatgagagtattgactaggtaatcttcaaggtgtcttccagctttaaaacccagttagtttttatgtatgtgatatcagagtctggttctcagcaataattttttttttttttgagatggagtctggctctgtcatccaggctggagtgcagtggtgtgatctcggctcactgcaatctctgcctcccaggttcaagcaattctcgtgcctcagtctcccaagtacctgggactgcaagcacgccccaccatgcccagctaatattttgtatttttagtagagatggggtttcaccatgttggtcgggctggtcttgaattcttgacctcaggtgatctgcccgcctcagcctctcaaagtgctgggattgcaggtgtgagccaccgcacctggccctcagcagtaatgctaatgtatactgcaagaaaaggtgaagaggagcttttgcttcctataaggagaaggaaaaaaatttcatttttcaaagctggctgccattgaacaagttggcgataaggaagattgagttccctttggaagttaattgtccttttgtttaggaaaaaatgcccaagagatacttggctattggactttgaaggagataaatggaaggcaaagctcagacaatagagatttacaaaaagaatagtaagaatttctctgcataataaaataacagggattttttttttttttgagacatcccctggcaccaaggagtttggcctcaagttagttgtgcaggaattcaggtagggtgtgttggacggaaagtaggctgttcagagcagggcatgccacagacagccttgggtcagctgcattgttttgtttgcttgtactgcttttcaagaatttgaatcaacatttaaatgctgctggatatggtggctcatgcctataatcccagcactttgggaggctgagggggatgattgcttgagtccaggggttcaagaccaacctggacaacattgtgagaccctgtcactacatccaaaaaaaaattaaatattgaaagactttaaaatatgcatagtttgtacctctgaaaattggaagatcttagcaataatcaggtgggtagccgctggctccattagaggactggttcaccacagtcctcaatatgcagagtggtctcaggcctgcaactggccccacccaacccccaggtggctgcagtactgcctgagccctgggggcatatgaattctctgccctggctgcagagggtcctctgggaacagaagagaagtttgggtctgtggaagccctagtaaagacaaaagtctgtgtggtgtgaaatggtcagtgagtttctagaaggtctagaaagttcatgtttgtttcctgggtcaggtgcaggcggctcacacctgtaatcccagcactttgggaggccaagaagggagtattgcttgagctcaagagtttgagaccagcctgagcaacatggtgaaaccttgttaatgaaaaaaaaaattattaaaaaaaatcccacaaatttgtttcccaccaatcttaccgtctattgtacttactaccatcttttgtactcaaacttttagtatgagtctatctctctctccttctctctgacacacacacacacacacacacacacacacacacactcatgcacaaagcattgctgctagaggagccatttacctcactcctcactttaatgattccttcttgctttgactccttgacttctgattagacattttttgatcttttagatttaattgtgctttttgttctataaaataactcctcaaaccaatcacatataaatatttatgaagtactaaatctgtaaggagcaaagctcatgatatatattttaagtatatttttaaatgtttattgagaatcagatactatgtttatcacataatataactttggttctgtcaaaagccttgagtaggatatatctttcaaaatcaaccaaatattaccttttgagtcaaaacaaatccatgtttgagttctgcctgcctcctccaaattgctcaacatttcatcatacatacattgtttttgagcaggaagctgaactaaatattaagccaccaggttgtagcaaagtttgtgtgcctttctttgactagaaatctgacaaactacaaatggttttcattttacctcttatcttctaataagaattgatgatatatctgaaagcatttgtaaaagctgatcaacttacataaaattgtaaagcgacacaaatttaaggcactgtaaggataaaagcttttattaagaattatggatattttcttggcatgtaaactcttatcttctttagggatatttggtctcttggctgtgtcttatatgagctctgcacacttaaacatcctgtaagtatgctcattgtcagactaatcttgaattattggaattgtagaaaagaaattaacttctgggagaaaaaggttaatgtttggttttattagattgttaaaaattatatggataagctacttaaaataatgatagatgacatggaaagctgtccaagcaatattataaagtaaaaagtccaagttggagaatagtatgtgtagcatatttccattaaaaataaattgtgtgggcttggcgtggtggctcatgcctgtaatcccagcactttgggaggctgaggcgggtggatcacttgaggtcaggagttggagaccaacctggccaacatgatggtgacaccccgtctctactaaaaatacaaaaattagccaggcatggtggcatgtgcctgcagtcccagctagttgggaggctgaggcacgagaattgctagaacccaggaggcagaggctgcagtcagctgagattgcgccactgcactccagcctgggtgacagcgagactccatctaaaaaaaataattaattaattaattactgtatgaatagatacgttcagcaaaagaaaaatgtacatgggcaaagttcataggaaaccaggcacaagcttttaagagtcttttcccagaggtcacatgggatgtgccaaatcctccagcattgttacccacgtcacctgtgaaatgtgatctataagaaagctcatcggatatacccagtgcccaggatttttactggggactggtcacataggcaccctctacctggcatatgccaaacttccagactcctggaaagaaagcccgtgttcagcataaaccattttgttcacataaatagctgaggcaaagatagccactcttgacattcagggaatggtgggaattcttctgaaatcttagttcccagacaccagccacgggccaacattgtaagcaggcctttctgaggagagcttgctacatcaactcttttctccacagctgtcatcattgttattaattattgtcaagggttgcacagccagtgtctgaccaaaatgtgtactccattgtttttttgagatggagtcccgctctgttgcccagactggagtgcggtggcacgatctcagctcactgcaacctctgactcctgggtacaagcaattctcttgcctcagcctcccgaggagctgggattacaggcacccaccaccacacccggctaatttttttgtatttttagtagagtcagggttttgccatgttggccaggttggtcttgaactcctgaccttgggtgatctgcccaccttggcctcccagagtgctgggattacaggcgtgagccaccatgcccggccaatgtgtacctttattgctacaccatggagttgaatattattatgtataaataactattggtttcatacaatagaagatttctggtctatgaagcattttagaggaaattaaacgatgtttatgttaattttaaaaagcaagagataaaatttcatatcaatatgacctcaactttgtaaaataaacatcatttttaaaagagatcagaaggagctatacctctgagtggtaaaattatacatattttcccctgtctttataacttcctataccttccagtttttttattatgagtaaacattattttgataataagacagaattaaaacaaaataaaaacttgttttaaataacatggcatcttgttgaataactgcagtatctgctcatgaaagattagttgatgaaaacaatttaaggtggaccacagtgcttcttttttattttttgattgagacagggtctcactctgtcacccaggctggagtgcagtgacgcaatcacggcttactgcagctttgaccgcctgggcttagacaatcctcttgcctcagcctcccaagtagctgggaccacaggctcatgccaccaagcccagcaaatgtttaaaaaccatgatttggagagatgaggtctaactatgtttcccaggctggtcttgaactcctgggctcaagtgatcctcctgccttggcctcccaaattgctgggattacaggtgaccctagtgcttctaactacaatttaaaaacattgttttgcttcttggtatatttgttactttaacacttttattatttgttactttagtaacttttctctgatttagtgtcatttctccttgtcctttcagtttgagggtaacaacttacagcagctggttctgaagatttgtcaagcacattttgccccaatatctccggggttttctcgtgagctccattccttgatatctcagctctttcaagtatctcctcgagaccgaccatccataaattccattttgaaaaggccctttttagagaatcttattcccaaatatttgactcctgaggtaagttttgaggtgactgtttggattttggcagagattttgggttgcaggtccttgacacgtgtgttcggttttaggtcattcaggaagaattcagtcacatgcttatatgcagagcaggagcgccagcttctcgacatgctgggaaggtggtccagagtaagtgtgactttggcatgcaatcaaaagtatttattacacatgtctcacacagagagtaatgcaaggaaatttcaccaaacatattgaaagtggacattttaaaaaatacaagcagtataagcaggagaaaaatcatcttgtcaaatggcaactagtgagtgtgcctgaaagttgtatatctagctcatgcatgacctgcagggttccttctcgttagtcaggaaacctccatgaagcagaggacatgctaatagagatgcttgaagaggttgagcccaaacttaacttttgtgtagtgaagggacagagtgggagaaggttgcagatagacatggatgatgagatgaaacttatttttctaaaagaggatagactggcaattaagaattctgttgcaaaggaccattggagctgaagttaggatcttggggcctaattgataacagtaagaactgttactttgtggttcccaaagaaggcaggagatattttatggtagtaataaatacagaaaacttttttttttttccgagacggagtctcgctctgtcgcccaggctggagtgcaatggcgcgatctctgctcactgcaaactccacctcccgggttcatgccattctcctgcctcagcctcccgagtagctgggactacagccgcccatcaccactcccggctaattttttgtatttttttagtagagacgaggtttcactgtgttagctaggatggtctcgatctccggacctcgtgatccgcccgcctctgcctcccaaagtgctgggattacaggcgtgagccaccgcgccaggccggagaaaactattttagtcctggtgtcaagaatcagctaagctgtgtgtcagagggaggggtacgttaagaaagagaaaattactaattcatttgatgctgtgaaagtcaaagccccagaatttagctgtaactgaatgcctggacttacaatatcaggaggagcagaaagcctctcaaaggaatccatgacagggaaatgttatccattgagacagagattctaaaatcaaggaaagttaaagagaaagtgaatgagcctctttgccatttaatttgactaacattgttgtataccagtctagattgagaatgtttagaaaatagacaagtacagagtatgggactgtgtattgtccatatttctaatctaggtaagataggagaacaagaacaattttttttttattgagatggggtctcactgtgttgcccaggctggtctcgaactcctgagctcaaacaatcctcctaccttggcctcccaaattgctgggattacaggtgcgagccaccttactcagcccaagaacaaattttgatggagataaagacaagcattagaagatctactcatacctcagtcctggcactttgggaggccaaggagggcaggtcaccggaggccaggagtttgatgccagtctggccaacatggccaaaccatgtctttactaaaaatacaaaaattagctggacctggtggcccatgcctgtaatcccagctccttgggtggctgaggcacaagaatcgcatgaactcgggaggtgaaggttgcagtgagctcagaccctgccactgcaccgtagcccgggtgacagagtgagactgtctcaacaaaaaaaaaagagagaagatctactcataaattccaaacaatgtggcatgaatggagtggcctgataacccaagctctaatgaccaaatttaataacttttattattaccccatacatattgtttctgtaaatgttaatattaatttctatttttctgaaaaaaagtgatgttatatattactagaaatatgcaaagggactctgaaaaaatggtttttttcatttaaagaaattgcatattaatttttcatcagtactctcactgtgtgtaaaatatctctggctaaaaagtaaacttactgtgttatgaaatgtagcttatgtttatactcttacaagtatcagtattaatggtgtacaatttttaaaaaattgaagctgttttattttggttaattaagagtgtaaaatacaaaaagtgagattccagggaaagtgcccaccaagatcaaggatatctgtgccaattaaaaggaatgctatattgcatagaaatgaatggagaccaccagctggagcccagaaggccagatctgtaagtcattctaaaccctcctttgtgttttttagctatggtatatgctttttgtttgtttgtttgtttgttttgagacggagtctcgctctgtcgccaggctggagtgcagtggcgcgatctcggctcaccgcaaactccacctcccgggttcaagcaattcttctgccccagcctcctgagtagctgggactacagacgtgtgccactatgcccagctaatttttgtatttttggtagagatggggtttcaccatattggccagaatggtctccatctcttgacctcgtgatccacctgcctgggcctcccaaagtgctgggattacaggtgtgagccatggcgcccggccccggctaatttttatacttttagtagagacagggtttcaccatgttggtcagactggtctcgaactcctgaccttgcgatcagcctgcctcggcctcccaaagtgctggtattacaagcataagccactgcacccagctgttatattctttttctttaattttttaattaaaaaaaaaatttttgtgggtacatagtaagtgtatatatttatggggtatatgagatgttttgatacaggcaagcaatgtgaaataagcacatcatggagaatagggtgtttgtcccctcaagtatttatcctttgagttacaaacaacccagttatactctgtaacttatttcaaaatgtacaattaagttactattgaccataggcagtctattgtgctatcaaatagtaggtcttattcattcttttgtttttttaacccattaagctatggtatattctgacagacctatctgcacatgttcatgaggtacaagcttattgtttggagtccacaaattttgtacttaaaatgaagtattctgtactgagcattataatggtattttgttggacaacttctagtttttatattttatgaaacaatgctgtatgctcttataagtatactttaggcttaattttctttttataactgaaattcttctaatttctaataaataagatttttctgtataggaaaagtgagtaacatagcaacagaaaacactctgcatttaatattcttaattctaacatattatgtataggattgagaagtttttatgatataataattgatatttccctagtgattctttgtgtttaattatttgaattcacttcagcagagtgttgaatcttttaggtcatactagtgaaatgcttctggtatgtaaatgataaaatggctactgtcttttaattaaagaattgtatttttaaagaaggctcatggttaaattaagaaccatttggaagtgtatttactaagtgtttacttgatatatagacattttagaaaatgtgttggtatataaacatttttttaaaaaccgattgtttaagttattgcccttcatttgataaagggctttatttatttatttatttatttatttatttatttatttatttgaaagagggtcctgctgtgtcacccaggctagagggcagtggcatgtctcagctcactgcagcctggatgtattagtctgttctcatactactataaagaactgcttgagactgggtagttgataaagacaagaggtttaattggcttacagttctgcaggctgtacaggatgcattgctggggaggccgcaggaaacttataatcatggcagaaggggaagcaggctcatcttaaatggccagagcaggagaaagagagcaaagggggaggtgctacacacttgtaaacaaccagatctctggagaacttactatcacaagaacagtaagagggaaatctgtccccataatctaatcaccttccaccaggcccctcctccaacatcagggattacaattcaacatgaaatttgggcagggacacaaatccaaaccatatcattccacctttggcccctcccaattcccatatccttctcacattgcaaaatacaattatcccttctcaacagtcccccaaggcttaactcatttcagcattaactcaaaagtccacaattcaaggtctctctgagacaagtcaagtcccttccacctgtgaggctgtaaaataaaaaacaagttagttacttccaaaatacaatgagggtacaggcattgggtaaatacacccatttcaaaagggagaaatcagccaaaacaaagggtttatagaccccatgcaaattcaaaacctagcagggcagtcattaaatcttaaagctccaaattcctttgaccccatgtctcacatccagggcatactggtgtgaggagtgggctctcaaggccttgggcagctctgctcctgaggctttgcaggctacagcccctgcggctgctctcacaggctgctgttgagtgtctgcggcttttccaggtgcgtggtgcaagctgtcgttcaatctaccgtttttggagtcaggagaatggtggccctcttctcacagctccactaagcagtgccccagtggggactctgtgtggaggctccaatgccacatttcccctctgcactgccctagtagagggtccccctgaaacaggcttctgcctggacgactaggcttttccatacatcttctgagatcttggtggaggctcccacgcctcaactcttgcactctgtgcatctgcagacttaacaccatgtggaagccaccaagatttacggcttgcaccctctgaagcaatggcctgagctgtaccttgggccgttttaaccatggctggagctggagcagccacaatacaggacaccatgtcctgaggctgcacagagcagtggggccctgggcttggtcctcaaagccattcttccctcctaggcctctgggcctgtgatgagaggggctgcctcaaaggtctctgaaatgccttcaaggcatttcccccattatcttggctaacaacatttgactcctctttatttttgaaaatttctgcagctggtttgaattgctccccagaaaatgggtttttctttctaggctgcaaactttcctaacttttacactctgcttctcttttaagtataagctctggttttacatcatttatttgctcacaaatatgaccatagggtgctagagcagccaggccacatcttgaatactttgttgcttagaaattttttctgtcagacgccctaaatcatcactctcaagttcaaagttccacagatccctagggtagtggcacaatgcctccaacctctttgctaattcataacaaaagtgtcctttgctgcatttctcaataagttcctcatctccatctgagacctccttagcctggactttattgaccatatcactatcagcattttggtcactatgattttaagaagtctctagggcattccaaactttccatcatcttcctatcttcttctgagccctccacgctcttccaacctccgcccattacccagttccaaagtcactttcacattttcaggtatctttatacaataccccactcctggtatcaatgtactgtgttagtccattctcatactgctataaagaacacctgagactgggtaatttataaagaaaatacatttaattggctcacagttctgcaggctgtacaggaagtatggctggggaggcctcaggaaatttataatcatagcagaaggggaggcaggctcatcttacatgcaggaggaaaagagtgaaggggtagccgctacaaacttttgaacaaccagatctcatgaaaactcactcactatcacaagaacagcaaggggggaatctgccccaacgatccatttaccaggcctcgtctcccaacattggggattacagtgcaacatgagattgggcagagacacaaatccaaagcatatcactcgacctcccaggctgagacacaaatccaaagcatatcactcgacctcccaggctcaagtgatcctaccgtctcagcctcctgaatagctatactaccggtatgcaccatgatgcccagctagtttttactttttgtagagtcagggtctcactgtgttgcccaggctgttcttgaattcctgggctctagtgatatgcccgcctcagcctcccaaagtgctgggattataggcgtgagccactgtgcccagcctaagggcttaattttattaaagaaataagaaaagtatgttgtgattcagaggactctttatcagacctgtagaagggaaaacacatctaaaagatttgaggatgaattaaattacgaactgttgaacacgctgacatttttccagttccttgaaaaggtaaaattgatttccacaggaactacctctgatattcctattactgttgggatgttagagaacattttaaagaaaatgtttattgcctttcaatacttttctatattttttaccacttttcaacaagtcattagtagcattttcttctaggttgtatataggtgaaattgtaaaacaaagaaaactacttcttgttttaaaagattttaaaaataggcaggtgcagtggctcacgcctataatccaacactttgggaggctgaggcaggaggatcatttcagcccaggagttcgagaccagcctggtcaacacattgagaccccacctctacaaaaagtaaaattaaaaaaaaaattttttgttttttactggacacagtagcatgtgcctgtagtcccagttacttgggaggatgaggcaggagatccctggatcccaggagtttgaagctgcgatgagctatgatcacaccacagtcctgcaggctgggtgacagagtgagatcctgtctcagaatttaaaaagaaaagaaaatattttaaaaataaacatataatttgtatttagattaatgaactaaattttatacatttacttaaatatttaaatagaactatatgaaagtgccatttttctagattaattatggtcaattctgggcaatttctttttttgagacggagtctcactctgtcacccaggctggagtgcagtggtacgatcttggctcactgcaagctccgcctcccgggtttgtgccattctcccgagtagctgggactataggcacccgccatcacgcccagctaattttgtttttgtgtttttagtagagacggggtttcaccttgttagccatggtggtctcgatctcctgacctcgtgatccgcctgcctcagcctcccaaagttctgggattacaggcatgagccactgcgcccagccaattatgtgcaatttcatatggtccaatctaacatatatgtgaaccatatagcagtaaaaacaacaaagaatataacatgttacctctttacatgaggacattttggttttaattgttcttgttattcatattcccaactattagttcctaggtctttccagtagttttatctttttttctctttttattattaactgtaaactgtaaactagacagagttgccacgctttaggttaaattgaccccactttgctctttagcaagaaggtcttgactggcttttatatcttaatttgatctgtttcttgtcttctagctcagtggcttctactcagttggaagataaactgtcatttctggttctcctattctcattctgttctggttgggaagggtggtgagggctgggatggtgatatgcccatcatggctgttatatgaccttttttaatattttctctggaagaatgattctgattcagcatcttctttcctttaagtcatgatgccattttgcatttagtcaatttatcagaaactaaaaatgttgcaaatccccatatgtgtgagtttcactatgctttttatttccctgtaaagtatggtaaggtataaatgagtttatgaaaaatagaaaacaataattctgagtttagttttggatcttgggttgcctgggcatactcactagctaagtatttttcacatactagccatgaagtatgcatgattcatatccataccttagcaaaattgtaaaccactatactatctagtacttaggtctttttgtactctaggatttggggactcttaagattattctggaaaaaaaagtatagaagaaaaacagcaaaaatacaccttcagtgccttatcttagctatggtcactgttatattgtcaagtattataaatttgtattatggtttttttttttgagatggagtctcgctcacattgtgcaggttggagtgcagtggcatgatctcagctcactgcaacctccacctcctgggttcaagtgattctccttcctcagcctcccaagtagctgggattacaggcgtgcgccaccatgcctggataatttttgtatttttagtacagacgaggttttgccatgttggccaggctggtcttgaactcctgacctcaggtgatccacccgcctcagcctcccaaagtgctagggttacaggtgtgagccactgcacccagcctgtattatggtttttaaaaacatcccctcttgttttcttcagataaaaatgatagaaagacccaaaattgctgctgtctgtggacattatgattattattatgctcaacttgatatgctgaggaggagagcccacaaaccaagttatcaccctattcctcaagaaaatactggagttgaggattacggtcaggaaacgaggcatggtccatccccaagtcaatggtaatattgtggtctagcttaagctttggttaatctaaaaatatctttatatattaacatttattattctgaaatccaaattctcctaacacaaataatccaagaagaactttccaaatcttcattttaaacacatagttcccttgacctttttcttttgtttgcttttgtagacagtctcactctgatgcctaggctagagtgcggtggcgcaatctcagctcactgcaacctctgccttctgagttcaagcgattctcgtgcctcggcctctccagtagctgggactacaggcgtgcaccaccatgcccaactgatttttatatttttagtaaagacagggtttcaccatgttggccaacctgatcttgaactcctgacctcaggtgatctgcccgcctcagcctcccaaagtgctgggattacaggcatgagccaccatgcctggccatgttagtcccttctttctatgtcagccctatacctgcttgttagttggttcttcaaattctcaggtaccctctcaccaggcagccactgacctcatgtgatccacctgccttggcctcctaaagtgctgggactacaggcaagagccactattcccagcctttctttcttttttttttgttagaaagattttgtttttatttccatcagaatgtcatatatgttacacaaatcaaatctgttgacatctcaagcttataacaattacgtgttcttataaattacgtgggaattacatgtactgtgagaagtgttgtaattatgatgtaatgtatattataatttagcctacagaagtaacaaagtcttgtaattaaataaagcaataaatgtgttgatagattattacaattgataagtaattgataaattatcttctttttcctgtaacccttcttcatctcaagtctgatctagcttattttcttattcatagagctgcttaactgtaggcacagacccatacccttgctcttttaatattctttcttcctcctactaaattccactatatggcaggtgaaaaaatagttgtgtatatttcatttctcaaagaggttactaatatgaatcaataattgaatcattaaaatcaaatgatcatttgagacattttgagaaataagatatatttcattcggcatttatgttctagggattttcaaaatatggacatgttagaaagaaaatagtattcttaaattggtcttatggtagattttcaaaaaatttactccataatagatttctgcagatctacaatattttcaaatttttttcacactgatgttgacattcctgtgttcagaataattgacacctaacagaggcctgaagacttaagtctaagagttctattttaaaaatgttttgtcatcaattttttttgttcagggttaagaatttgttactttggcgactctgattgtttattgttgaaattttggatgaattatgaaaaacacaagatactatgggatggcaatctcattaatagtgaaaatgagataagcaagaatgataagagaataatttcttcagaaacatataacgggaaaagcatatgttttatctttaaagatattgggcactgttgtggtttttatcgatcttcataacacatttttaattatctccacaattatcaaaagttatgtcttctgtccgttcaaattgtaatatccatattggactcaattagtgagggacatagattttacagaagaactggagcagccacaaaactccctttctcttttctcaaccactgggaaaatatatcttccactctttgtctagatttgagagctgtcaagctatcaattattttgaccacatgtgattttatatctcccaagctctcacatgaaacagtaggaagggtccttctctttcctggatgcccctttgatgcctggtaacccctcctctttgtatactccctcatccccagctttctgtctgctggaggtccaattacaggccatgggatggaggaaaaggattttttttttttttgagacagagtctcgctctgtcgcccaggctggagtgcagtgacgcgatcttggctcactgcaagctccgccccctgggttcacaccattctcctgcctcagtctccagagtagctgggactacaggcgcctgccacgacacctggttaatttttttgtatttttagaagagacagggtttcactgtgtcagccaggagggtctcaatctcctgaccttgtgatccacccgccttggcctcccaaagtgctggcattacaggcatgagccaccatgcccggccgaggaagaggaatttgtataggatttggggggtggagagggaataggtagacagagagatagagaatgtcttttggacagcccctgggtgttggaatcatttttctcatgaagatattgatacatgtgccagttaggcttatgagacagatgagtgctacaatttaccctcatttgattcaagaactatctgtgtgtcaggcacttcacagccctaatctcttctaatcctcgtatcaattcctgtgaaatggtaccatgcccactttacagctgaggaactaagactcaaagactttagcttgtcatttcatcctatttctaaatccctgattattaacttgcctctttgtaaattggggatgcttatcatgatgttccttcctaaaggagttatttctgaaattacagttctgtctttggagccttagaagttactcgtattccaaaaaacttatggtctgaaatgcggtttttatttagcaaccaataattacagaaatgttttacaggaaattctgccaaaaaaaagatacataaaatgtgagtataaacttgaaaattgtttgactggaattgactaaaattgtgctggaaaaataccttaaacatttggagagacagctaaaccattatttctttcctcattaagcatttatgtgcggagataaagggatggatggagggacacattctgctctcagggagctcagtatgtggtgcaggaaacagatatgcagccattcttttttttcttttcttttctttttttcttttttttttgagatggagtctcactctgtcactcaggctggagtgcagtggtgcgattttggcttactgcaacctctgcctccctgctcagcctccccagtagctgggattacaggtgcccaccaccacgccccactaattttttttagcagagacggggtttcaccatgttggccaggctgatctcgaactcctgacctcgtgatccacccacctcggcctcccaaagtgctggggttacaggtgtgagccaccacatctagccactattgttaaatcaggagcgacaacctgtacattagacacctacacaaagcgtgagaacttctgggtgtgggtctgttttcctccccacaacatattatagagaatggaaggactgaatcttgtcctgaagaaaaatcactggataagaatatttttctgtttaatcctctcctgtatccccacttgttactcttcatccttttttccttttgattccaaaattttcttttccaatgtaaagattctgtaactgtgaactacttcttgaacttggaacttcaagccactggtgaattgtgaatctcattactaaactgaaaattactcgtcaaattggtgcctaagatttgttcaagtttctacttaagctgaacattcttattttctaaggcctgctgagtaccttcagagaaaatttgaagctcaacaatataagttgaaagtggagaagcaattggtaagtaaaataccaaatatgggaagcaattaggaatttcctaatagtttttctgttcacagattttcaagtcaaagttcattccaccagaaggtcaagaatactctctactagtccccagttttttttgtttttgtttttgttgttgttgttttctgagacagagtctcgctctgtcaccaggctggagtgcagtggtgtgatcttggctcactgcaacctctgcctcccaggttcaagcaattctccttccccagcctcctgagtagctgggattacaggcgcccaccaccacgcccagctaacttctgtatttttagtagagacagggtttcaccatgttgtccaggctggtctcgaactcctgatctcgggtgatccacccacctaggcctcccaaagtgctggggttacagacgtgagccactgcacctggcccgagtccccagtttttaatagctaaataaaataatgggaacaggcttgaatcagagtcttagcagtccggtttcttccttggctctatctcttctgtgggaccttggacagttcattcagcctatctgagccttaatttccttttctataaatgacaatttttagagtagatgagcttcaaatttccttgcagtgctgtagtgctttggttctattttgttaaagattctgctgcacattaaaaaaagtgacaaggggccaggtgcggtggctcatgcctgtaatcccagcactttgggaggccaaggtgggcggatcataagatcaggagttcaagatgagcctgaccaacatggtgaaagcccgtctctactaaaaatacaaaaattagccaggcatgatggtgcacacctgtaatcccagctacttgggaggctgaggcaggagaattacttgaacccaggaggaggaggttgcagtgagccgagatcgccctactgcactctagcctgggcgacagaacgagactctgtctcaaaaaaaacaaaaaaaacaaaaaccaacaacaaaaaagtgattaggccagatattatggctcatgcctgtaatcccagcactttgggaggctgaggtgggtggattgcttgagcccaggagttcgagactagcctaggcaacataatgagaccttatctctaccaaaaaaaacaaaaattacccaggtgttgtggtgtgtgcctgtagtcccagctactgagggggctgaggccggaggattgcttaagcttgggaggcaaaggttacagtgagctaagattgcgccactgtactccagcctgggtgacagagtgagactctgtcttaaaaaaaaaaaaaaaaagaaaggctgggcttgatggctcatgcctgtaatcccagcactttgggaggccaaggcgggcagatcacgaggtcaggagattgagaccatcctggctaacacagtgaaaccctgtctctactgaaaatacaaaaaattagccgggtgtggtggcgggtgcctgtagtcccagctactcggaaggctgagacaggacaattgcttgagcctaggagttggaggctgcagtgagccaagatcatgccgctgtactccagcctgggtgacagagtgagacgctctcaaacagaaaaaaatatatattttttaatgctttataattaagaaaattctactacttaccacaaaaaaaactcccaaatactgagtttgcttagtgatataattcttatttataggaaaaagtcaatgtcaaatcagaagatgtttccgaaatcaaagtatgcattataaattatttcattcaataaatagggtcttcgtccatcttctgccgagccaaattacaaccagagacaagagctaagaagtaatggagaagagcctagattccaggagctgccatttaggaaaaacgaaatgaaggaacaggttaaaaactgtttaattccagggctacccttgtatttctttgtattactgtcttttgtactgtaatagggagttacttctatttcctacagtgcccctgaatatgtcaacaccatgctgagtgttataggggatacagagttaggtatttcactttctcagataatgcgatatggctaagttcataaagcttttcaccttgagattcatagagtaactgtccatcagtaacaggtttgggatttgtattagtttcctgggctgctgtaacagagttcaacaaactaggtggcttaacacaatagaaatgtattgtctcacaattctggaagagtggaaatagaaaatcaaggtgtcagcaggaccaagtgccctctgaaacctgtaggggaatccttccttgcctcttcctagcttctggtgcgtcactggcaatctttggcatttctttacttgcagtcgcatcactccattctctgccttcatcacatgctgttcttcctgtgtgtccctgtcttcacatggccatcttcttgcaaggacatcagtcatattgaactaagggcccactggtatgatctcatcttaagtagtctcatctgcagcgaccctgttttcaaatggggtcacattctaaggcactgggggttaggacttcaacatatctctttttggggaggaacaaacttcagtgcataagagggttatatataaaagtgggatttataaagtaagtgtacatcatgaacacatttgggttatatataaaattgagctctgtagctaaagccactgtctcacagggagtgaagtactgcagccaaaacataaggcagattatcatctttaggagcaacatatttttctaaccttattttatattacacacttttgaaattgtaggctgcagaaagattatttttgttatggtgttcataaacatttaaagtttctggattgggtttgctttccaggaatattggaagcagttagaggaaatacgccaacagtaccacaatgacatgaaagaaattagaaagaagatggggagagaaccagaggtaaattcattcttctaggggaaacattgttctatcgatttagagctaactaaattgagctggtattaaaagtaatgatttccttatagaaaagataaagttttatcatagagataatcatgtagacttcttttttaataggaaagctgtcagacctcattggagcttcagtttattatggtttatgagagactacacaagataataaggatatctgagattctcaggaatggctattattaaaagtacttattgattgtttccttcatgaatcactcaatacatatttattgagtggcaactttagaccagagctggattagatgcagaaagtccaaaatgagtgtaagttcatgcccagaaggtgggaaaaaaacaaacccaacacactagcattttttcaactctctgcagggtaaggttctaaaggctatttaaggcaaaatctgagtgcagttgaactgattcttaaaaatctcttaaaggcgccacattggaaattcatccttccatctcccaagaaggtctctagagttggcacagatcactgcttcttcagaagagcttcacatgaaatagccagcctgtgtttggaaaccatgttgtaagaaagacacatggctattgaaacactaggaacacactcagtgccctggaatgctctcctaggagaagcttgcaggcactgagacagctgtctcccatcccacatgcacttggccacacactcattgagtagagctaccatgctgctgaaattgatctctctctctctttctcccaccgcagtgcatacagataaattcatataagtcaaatgaatgtatggtgcaattcagttgtgtttgccaggccatgaactagagctttcacatactgtattagtctgctctcatactgctaataaagacatacccaagactgggtaatttataaagaaaaagaggtgtaatagacgcacagtttcacatggctggggaggcctcacaatcatggcagaaggcaaaggaggagcaaagtcatgccttacatgaaggcaggcaagagagcttgtgtaggggaactcctatttacaaaaccatcagatcttgtgagacttactcactaccattaaaatagtatgggagaaaccaccccgatgattcagttatctccacctggccccacccttgacaaatgaggattattacaattcaaggtgagatttgggtggggatacagagccaaaccatatcacgttcatactttcttttatttacccctgtacagagaagttaagtagctcatccaaagtcacgtagctattacaaggcagacgaaatatttaaatatctgactctaggctgggcacggtagctcatgcctgtaatcccagcaatttgaaaggctgaggtgggaggattgcttgagcctaggagtttgagaccagcctgggcaacatagggaaaccctagctctaaacacacacacacacacacacacacacacacacacacacacacacacacacacactctctctctctctctctctctctctctcactctctctctctctctctctctctttaaattagccggacatggtggtttgcacctgtagtcctagctacttgggaggctaaagcagaaggattgcttgagctaggagctaaaggctgcagtgagccatgattgtgccactgtaccccagcctgggatacagagcaagactcggtctcaaaaaaataaagtaaaataaaatgaaaatctgactctaaaacccctactcatgttcatgcctgtaatcctagcattttgggaggccaaggcagaaggatcgcttgagcccaggagtttgagaccggcctgggcaacataatgagactccatatgtacaaaaaatttaaaaaattagtgggtcatggtggcaaatgcttgtagtcccagctactcaggaggctgagttgggaggctgaggttgaagctgctgtgaactgtgatttttccactgcactccagcctgggcaacagagggaggccctgtcccaaaaaataaaaaaatacaattataaccactattctttctggcatatgcagttctacttataaatggttggaatgacgagacacatgtataaaacaatcatagagtaagccctgtaggtgcacaggagccaagatgagcagaatgagcaggtagcgggtatttatggaagaagtgggtggggcctaaagagtggaatttggagaggcagagttaaaggaggagagtgggcattctgaaagaaccatgcaaaggttgggacagaggactgtgtgtgctgggaggggcagcctggaggttgttctctctggagcagaggcctggctcatgggcagcctggagccatcatcagccttatgtctaaggctgatctgggatgggcagcctgagccctgcaaaaatggatagcagacattggtcaggcgcggtagctcacgcctgtaatcccagcactttgggaggctgaggtgggcggatcacgaggtcgggagatcgagatcatcctggctaacacagtgaaaccctgtctctactaaaaagacaaaaaattagccaggcgtggtggtgcgtgcctatagtcccagctacttgggaggctaaggcaggagaatggcatgaactcaggaggcagagcttgcagtgagccaagatcgcaccactgcactccagcctgggtgacagagtgagactccatctcaaaaaaaaaaaaatggtggatatcagacatttctacagaggctatggaggaaggatttgggaaatactgaagctgtggcggggaaaaggagctataaaaagggttctgtccagccatttcatcattgatcgcgcatcagccaagtagccttcagagctcactcagaaccaatcttgttgactgtgtataatttgtgttaaaggagaactcaaaaataagtcataaaacctatttggtgaagaagagtaacctgcctgtccatcaagatgcatctgagggagaagcacctgtgcaggtaatgatggctatgatcagatgtgtgtgcttgcagtgtgtgtgctctaccccaagtggctcttacccttctctgtgcagcagaaccacgtagggaactttttttttttttctatgagacggagtctcactctgtcgccaggttggagtgcagtcgtgcgatcttggctcactgcagtgtctgcctcctgggttcaagtgatttcctgcttcaggctcccgagtagctgggactacaggcatgcgccaccatgcccagctaatttttgtatttttagtagagacaggatttcaccatgttggccaggatggtctttatctcttgacctcgtgatccaccagcctcggcctcctaaaatgctgggattataggcatgagccaccgcctttttaccagaacttttaaaaactcagatgcctctctctgccccagatggtctgggatgaggcccaggcattctgtctgcagaagcttgctgggtgatttagtaagcagccaagtttgagaactgctgctatttagtataagaacgttccactctctggagggtctaagtcagtgtatcagacacattggtcaggaaatctgagtcaagttctcttccatttcaaccttatgtttttggtggaggtaagagcctgggcagagttgaaataacaaataaatctcaagagagtttttttcccttctgagaaaagataatgcaattataatacaagatgaatctgttgatttcaaccaattctgagaattattaaacctgtgaaatgacctgataaacaatgcttttatggttacataaaataattacataaaatgttttactttccaaggagttatatttattttgcgaataagaagcccaagtgtgcttttatttttgcttagtaagaagattctcaatgatttggcccatactaagaattattattatcttttttttttagatggaatttcgctcttgttgcccaggctggagtgcaatggcacgatcttggctcaccgcaacctccgcctcccaggttcaagcgattctcctgcctcagcctcctgagtagctggaattataggcgcctgccaccgcgcccagctaatttttgtattttagtagagacagggtctcaccatgttggccaggctggtcttgaactcctgacctcgggtgatccacctgcctcagcctcccaaagtgctgggattataggcatgagccaccccgcctgagcgaattattattatctttataattagagtaattctctgtgttttaaattatatttattattagagcttggtccagagtcaactagaaatggaaaatcctcaaggtattataaacttgtcatttaaaggtgccagtaggatcacagtcacattccataaaaacacggctcagatgttacagacatgtttttctctcacattttttaacctggttagagtaaatccagtgccttaaagtttttaataagtcaggtaattaaaaataaaccactggaagcctcaaaaagtttgtatcaggaattgggtgaataaaatcttgtatattttatgcaagaggagtaactttgaaagaaaacacaccaaaatgccaatggtggtaattggtggtatctggattggtgtgagtaggaatgattattgtctctctactttttagattttttataagaaggttacagaacttttactacaaatatgtataataaagtatccgttccttagttctgtcagcactctaatcaatatcttcaaacaaaaaagccatctgaaagacagaaatggtggcacgagactatagttccagctatttaggaggccgaggatcccttgagctcaggagtttgagaccagccttggtaatatagtgagaccccatctctaaaaaaaaagaaaaggcatctgatatttcctgaaggctcctccagagcaatccagcagcagatacctttgcaaacttttgtaaaggaaataattatcacttaatttgtctaatttttggatttaggttttaattatcttttttgaagggaatatgcagctatataataagacactttaaaaaagtctctacttgtagagttatctttccaaaatactgatttgaacattatttctctacacgacaatcaatggcgactgccatttctcttagcatggcatgctagacttttgtgagttgttcctaacagaatgttccagcctcattgctcacatttcccccaaacatacccaaagctctaaatgtctcagattaccttttttttttttaaatgacatattttttatttctttaagtgatttttttcactgtggtaaaatacatataacatcgcctttaccaccctaaccatttttttttttttttttaattgatcattcttgggtgtttctcgcagaggggtatttggcagggtcataggacaacagtggagggaaggtcagcagacaaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagggcacagggttgggggtaaggtcacagatcaacaggatcacaaggcagaagaatttttcttactatagaacaaaatgaaaagtctcccatgtctacctctttctacacagacacggcaaccatccgatttctcaatcttttccccgcctttcccctctttctattccacaaaaccgccattgtcatcatggcccgttctcaatgagctgttgggtacacctcccagacggggtggtggccgggcagaggggcttctcacttcccagtaggggcggccgggcagaggcgcccctcacctcccggacgaggcggctggccgggcggggggctgacccccccccacctccctcccggatggggcggctggccgggcggggggctgacccccccccacctccctcccggacggggcggctggcctggcgggggctgacccccacctccctcctggacggggtggctgccgggcggagacgctcctcacctcccagacggggtggctgccgggcggataggctcctcacttctcagaccgggcggctgccgggcggaggggctcctcacttcttagacggggcggttgccaggcggagggtctcctcgcttctcagatggggcggccgggcagagacgctcctcacctcccagacagggtcgcggccgggtagaggcgctcctcacatcccagacggggcggcggggcaaaggcgctccccacatctcagacgatgggcggccgggcagagacgctcctcacttcctagatgggatggcggcggggcagagacgctcctcactttccagactgggcagccaggcagaggggctcctcacgtcccagacgatgggcggccgggcagagacgctcctcacttcccagacggggtggcggccgggcagaggctgcaatctcggcactttgggaggccaaggcaggcgggtgggaggtggaggttgtagccagccgagatcacgccactgcgctccagcctgggcaccattgagcactgagtgaaccagactccgtctgcaatcccggcacctcgggaggctgaggctggcggatcactcgctgttaggagctggagaccagcccggccaacacagcgaaaccccgtctccaccaaaaaaatacgaaaaccagtcaggcgtggcggtgcgcccctgcaatcgcaggcactcggcaggctgaggcaggagaatcaggcagggaagttgcagtgagccgagatggcagcagtacagtccagcttcggctcggcatcagagggagaccgtggaaagaggggagagggagagggagagggagagggagagggatcagattactttttaaagccctacttatttaaaaagacatcttccttttaacctccaggcttttgtaaaatgcttatttctctactgaaatatcccttccctctcttctcttcttgcagaacacatctatcagacctcctggtgaagtttctagcacagcttttttctctttctcccttagaattaataactgcctcatctgtatttccacagcatttccaagtacttcatacaccagcctgtgtcagtttgaagcattattagctatttgccctgcaaacttgggaagggtttttctgccttgcagtagtatgaagtctgaaatcaggactatgacttatctatcttacttatatttgtgaagttggttgtctgatttgcttggatagtctggtcatctcaattgtacaataagtgctccattactttactttccttaaaatacaacgatctcagattccaaccccaatctactccagtgggtgggacattcaaccttagtgtgctgtcaagctctccagggtcatgtcatctgaaaggccctcttggccctgtgaagactgattaactgtgtagccatggagtctgggatcttgaggcaggaactctaggctggtgtgcagtctcttgctcactactccaatgtactgccacagattaggacttgagtccgccatctctttaaaaaaaaaaacagttttattgagatataattgatcataataaaccacacatatttaatgtatatactttataaaatttggcaggcacacccatgaaacccatcaccacaatcaatatagtgaacatatccatcacctgcaaaagtttgttgcgcccttttgtaaactcctctctcttattctccctacctctcctcccatctcatccccatgcaatcacggatctgctttctgtcgctgtaggttggtttgaattttctagatttgtttggattacataaatggagtcgtgctgtatgtgctcttttttctggctactttcattcacataataatgttgagatttatctatgttgcacatattaatagttcattattattctttattgctgagtatattctattgtatgaatgtatcaaaatttattgatccattcactgtagatggatatttgggttgtctccagcttttggctattataaataaagctgctaggaacattcatatacaaatctttttttttttttttgagacaagtttcgcccttgttgcccaggctggagtgcaatggcacaatctcagttcaccacaacctctgcctgctggattcaagtgattcttctgcctcagcctcccaagtagctgggattacaggcatgcgccaccacgcctgactaattttgtatttttaatagagacagggtttcaccatgttggtcaggctggtctcgaactcccgacctgaggtgatccacccacctcagcctcccaaagtgctgggattacaggtgtgagccactgtgcctggctatcatgtacaaatctttatgtggtcatgtgcttcttttctttcttttgggtaaatacattggactgggatggatggatcatatagtaggtgtatatttaactttcagagaactaccaaatggtgttccagaatggtcgcactgtgttacactccccttgacattgtatgagtgtttcagttctctctgtgcagctctctcctctttgggtctttgtctttcagactctagcaccttaataccccccaagccttgtcttatcaactcagggagttggccacactcatcttcggtttccatccctgcacctcttcagttccccatccccgcaccatggcttgcaaactctctcaagacaggaggctggggcagttgcagggcttgtctcattggttttctgtttcttagggattactgtctttcattgctggatgtctaatgtattaaaaaccatttatctattatatgtttgatttggctctttggttgtttcaggtgcggaattaaatctggtttctgatactctgtcttggctgaaagcatacgttttcagtgcccactgctggagaggggtggagggcactcaagagttccatttggacattgagttagagaagttgtgagagtttacatacctgctctggagcctttaccccactgttccctctgcatggaaaatgctctccccagactggcatatgccaaggtccaatatcattccagggcttaaattgattgccagataagctttgcctgtattactctcactccctactcattttctgtcctgttatcctattttgttcccttgatagcacttaacactttctgaaattatgtcattcgttaactcatttattacctatcctactccagtaaaatgtaattttcgtgtcagcagggacctttctggtcatgtccactgtgctaacccattttgagggtttctggcccctggggagtgctcagtgtgaatttgtggagtgaatattaagatgaagataatgctaagtaggcagttggatatgtgagtctggagctcagaggagaggaaaagtgaagcctgaagatacacatttaagagtctctgcttaacagtggcatttaaatccataggaatgaatgaaaccccttgtattagggaatagaagagcagatggcccaagataggatgctaagaaacctccgaatatggagttcacatctcagttgtgcctttgaaattcttgtcatccacttttagttttcttctcttcctacttgaaattgcctaccaattttcagagccctctccttcctttataccgtcatgagttgcgcactttgcttattttcctgattaagatcataagcctcttaagggaaagatcctgtagtcaaaattacattcttgaattgaattgggttggactggagtggactggagtgataagtattgtcacattatagaattccacccactgaagtgcaagtgttaaatgtattaatatttcaagttaatggatactctgcccaagtttttagttaattattattaactttccattataaaagcttgtttttgttattaaatcaatcatcagatttaacgcagaaatcaactcatgtaaacatacagtgagagaattgtatttttctctaaattttcaggacattgaaaaagacttgaaacaaatgaggcttcagaacacaaaggaaagtaaaaatccagaacagaaatataaagctaaggtaagaaatacttttgtctttgggttccatattaaatagctggctggggagccaccttgtgatctcggttgcctgcatgattttccccctagtattttatagaattgctctattttgtgatatgagaccaatggttttaagaatctataatgtcaaacaaaattgacctagggagttgtaattttaaggcttttactgaattgctaaactttttttttttttttgctttctcctagaagggggtaaaatttgaaattaatttagacaaatgtatttctgatgaaaacatcctccaagaggaagaggtatgccattaagtctaaatttccattagtaggtatcagaaaatgcatatatcttaatagcatgtttcatgaaattatttcacaggctgtagggataatttttttcaacttttattttagattcaggtggtacatgtgcaggtttgttacctggatatgttgtgtgatgttgaggtttgggatatgaatgatcccgtcacccaggtattgagcataatacccagtagttagtttttcaagccttgcttccctcctttcttacccccactgtagtagctcccagtatctattgttgctatctttatgtccatgagtacccaatgtttagctcccacttataagtgagaacatgcagaatttggttttctatccctatgtaattggttttctatccctatgtaatttgcttaggatagtagcctccagctgcatccatgttgcatggacatgatttcattcttttttatggctgcatagtatcccatggtgtatatgtaccacattttctttatccagaccaccactgatgggcacctaggttgattccatgactttgctattgtgaatagtgctgggatgaacatgtgagtatatgtgtctttttggtagaatggtttgttttcttttggatatatacccagtaatgggattgctgggttgaacagtagttctaagttctttgagaaatatccaaactgctttctacagtggttgaactaatttacattacatttccgccaacactacataagcattcccttttctctgcagcctcgccaatatttgttttttgactttttagtaatagccattctgactcgtgtgagatggtgtctcattgtggttttgatttgtagttctctgataattagtgatgatgagtattcttttatatatttgttggctgcttgtatgtcttcttttgagaagtgtctctttctatcttttgtccactttaaaatttgggttgttttttcttgttcagttaagttccttatagagtctggatattagacctttgttggatgcatagtttgcaaatattttcttctattctgtaggttgtctatttactctgttgatagtttcttttgctgtgcagaagctccttagtttaattaggttccacttgtcaattttgtttttgttgcaattgcttttgaggacttaatcacaaattctttcccaaggcccatgttcataatggtgtttcctaggttttcttttaggattcttatagtttaaggtcttacttttaaattgttaagtcatctttagctgatttttgtatacagtgaaaggtaggggtccagtttcattcttctgcatgtagctaaccagctatcccagcaccacttattggataggaagtcctttccccattgcttatttttgtcgattttgtcaaagattatatggctgtagatgagtggctttatttctgggttctctattctgttccttggtttatgtgtttgtttttgaaccagtaccatacagttttgattactgtagtcttatggtatagtttgaagttgggtaatgtgacgactctggcgttgttctttttgcttagaattactttggctatttgggctcttttttgtttacatatgaattttagaatagttttttttttctccaatcctgtgaaaagttacattggtagtttgacaggaatagtgttgaatctatagattactttgggcagtatggccattttaatgatattgattattccaatccatgcatgtggcatgtttttccatttgtttatgtcatgtatgatttctttctgtgttgtgtagctcttcttgtagagatctttcacctccttggttagatgtactcctaggtattttattttattttttggtggctattgtaaatgggattacgttcttgatttggctctctgcttgaatgttattggtgtataggaatcctattgattattgtacttcgatattgtatcctgaaactttgctgaagttgttcatcagttccaggaacctttgggtcgagtctttgggttttcaacctatagtatcataagcgtgaagagatggtttgacttcttcttttcttatttggatgcctagaattttagaaaatatttctagaaaaatgtttggtgctcaaggccagggaacggtggctcacagctgtaatcccagcactttgggaggctgagacgggcagatcatgagatcaggagattgagaccatcctggctaacatggtgaaaccccatctctactaaaaatacaaaaaattagctgggtgtggtgtcacccacctgtagtctcagctacttaggaggctgaggcaggagaatcacttgaacccaggaggcagaggttgcagtgagctgagatcactgtactgcactcgagcctgggcaacagagtgagacactgtctcaaaaaaaaaaaaagggaaagaaaaatgtttggtgttcaaatgagtcctccaaatactttttattctcccattttattttattggtgttatttctttagataaattattacattttaatttacttttctttaaataaaagagctattttactcataatattaatttttatcatagccaaattaaaatagaagacctgatacattgtcaacaactaatatactgacctaaaaaattgaacaggtaccctgaaaccaggcacatttattttaggtcttaattagttattgataactttaagtaaatctcatttatgcatttgggctctccttgccacagcaaggagtaaatacagtaaatccaatacagtaaatccaaatttcattttattagttgatttcaaaatctttttttatcctggttttatcagacctataacaaatgtcaaaattaattggtttatttttccattttaccttttctgaattcaccttttaagtcaatataagtatgaataattatacctgatgctcagtttttatttaatgttctttattagcttaaaacattttcatgttagcatttcttatttttatgagcatttgctacataaagacttcattagagtggtgatagttagcattcacctctgttcaaccataaattcctaaatgccccagaggtgagacatcagagtggagcagatctggggacctgcttctgagtgggaacttgagaagtggtactctcacagagcttctgtgaagtgaggtgctgacgttgccctgctgaaatgaaagaatggagtccaaaaagttttaactgccactctttcttattctttgctttgatctgcgtgaaacagaagtggtcattttggtattgactacaaaatactaggagcagatttagggagctggttaagaatgttgtacacttaaaacagggcatgaatgagaaaagcttgagagcactgtagaatggagctgaagtggaatactattgaagtcagaaagtctagataaaattaagttgccttatgaccagtgcttgacactgttaacatggagaagaaatgaaaacatttctgtttttatctaacatagctctagttttaaaactctatggatttatttgtttagtaaacatttgttgaatatttactatataccttgctaattaattttactaggaacacgaaaatatggtttttctttctttcaaaatatggctaatttatcatgaaacactgtggaattgatttaggcaatggatataccaaatgaaactttgacctttgaggatggcatgaagtttaaggaatatgaatgtgtaaaggagcatggagattatacagacaaagcatttgaaaaacttcactgcccagaagcaggtatgtgtttcttgaaagttgtaaatgagaaggaactgttttattagcaacccattttgaactctgtccccatgcatctgcctcggctccactgttacttgacccctttctgccctctctaagcaaggcagaaacacacttattattctcctgccacccatgcagtggccacactccctgagatccagccctcctctcctgctccatacccactccctcttgcagctttggcttctcccaggagctccagacttaccagtctttctcattgtcttctgggaagctccatggacaagtgttgccagtatctgaaactcagctgtgtaaagtcaagctcttctgtgctcttcccagtgaccctttattttggttagtgtcacagatgcaactggctggggccagtgttgtgggcagtaaaagaatttatcaacacaattgtaagtaaagaaaggcagatttattaaagtacagagatacgttgcaagagtgcaatgggcagcacagcagagaagaggctgtctgctaagaggcaggggctagagggaagttttatagggtcatattggaggagctacatgctgataaggtgtgcagataaggttttgctgcttgggctacatgtggaaggaatgaggtatttgggaacaggatgtgacagcagcttgtctgtgatgagtcatctctcagaacagttgttcccccatccccacccccaacctgggacccctccctttttgttgtttacttatcttatgagaacttcacagtcagtgctgtcaccagggtgcacccttagcatagtgtctattctgagatgtctctggagtcttcctcttccttcattctctctgttactggtttagggctctgtcatctctcagtagtgtggtgtaggcttcagagacagatgggaattgaatctcagctgttgctgccaccttctggttatgtgacctttctttcacaagttattccaacactgaatctcagtttcaccttaggaacaggggataatagtagtaggaataaccacacagggtaattgtgaggaccaaagtgagttttgatgtataaacgacctggcacatactaggtgcctaaattaagtgctgtcttttcattttcccttttccttccccttgctgtattgccttatttgcttatgtgaccttctttctctagtatttccccttcattctctaaatggttactgtattagtccattttcttgctgctgataaagacatacctgagactgagcaatttacaaaagaaagaggtttaattggacttacagttccacatggctggggaagcctcacaatcatggtggaaggcaaggaaaagcaagtcacattttacatggatggcagcaggcaaagagaaagaacttgtgcagaggaactcctctttttaaaaccatcttatctcgtgagactcattcaccatcacgagaacagcatgggaaagatccgcccccatgattcaaccacctccctctgggtcaccccacaacacacaggaattcaagatgagatttgggtgggacacagccaaacgatatcagttactaaagttatcttggcatattattactctgctcagatttttttttggataatacctgcagaataaggtccattccacatattatcacatttaacactacatggcctaattctgctgtgacccacttttctcatcccagcatggcctctttccttccatggaaaatgggatccatacagcctgctggaatgcccattttctcctacagctggaatgcccattttctcctacagcatttacagaactgacttggctcagtttcctcttcctggaatactctctgcctcatttccttctggaaaaatctccattcagcaggcatcttattgaggatctcctttgtgccaaagactgctcactggtagggagctcaaagatgaatgaaatctgggccctgttctcaatatcacagaagtgttatgagcaaaaaagtcacaaaacatgttttctgagcctgaaatgttaatcactgtttgaagtgcgagctgggtggagagtcagggaggtccgcactcctccagggcttcacatgccatcatttttgtgattgagaaggatcatgctggctgcagagcaaaggatggcatggagggcaagactgaaggcaggagaagagtccaagtgcatgagccagagtggtgcagggagaatagatactgagtgtgggaactgaggaagagaaggggctcaaggatattcccagttttctaattcaaatgcatgaagctttcatcaaccaaaaatacatcacatggagggtaatggggtcgggagagacaaggtagtgatctaaatttggaacatgttgagatttaggtctatagagcatcagttgcagattctatataagactgaaggcctggggcatatcagggataaagatatagcttggtggcccttagcatatccgtggtttttaactttggtgatggtcaaaatacctatgcagaaggactggagtgagaaggaaatggagcttaggacataaccctaccactatataaacaaactttggagaatcaggagagagtaaagccaaaggaggagagacaggtcatggaggaggcacaggaattggcagcatcaactggaagagaaaggccagatgaggtgagtgggatttggcccttcaggagccgttaatggcctcagggaaagcagtcaactgtgtaaggggtaaattcaatggttatctttgcatcagtttgctgggaaaagcagagggggttggctgttttttagatgaaagaaaaaaaaaccttcatcagtagtatactgaaaattgtctctcattttaatctgtattcctgtaattattatttaggctgaaggatttttccgtatgtttgttgaccattcatatttctcctttttttttcttttttctttttttgttttttttttgagagggagtctccctctgtcgcccaggctggagtgcagtggcacaatcttggctcactgtaacctccgcctcctgggttcaagcgattctcctgcctcagcctccctgagtagctggcataggtgcgcgccaccacgcctagctgatttttaaaatatttttagtagagatgaggtttcaccatgtttgccaggctggtatttgaactcttgatctcaggtgatctgcccaccttggcctcccaaagtgctgggattacaggcgtgagccaccacgcctggccaacccttcatatttctgttatgaattatgtactcatgcccttcatccttttttctactgaaaatggcatgtttgtttttttctttataagactgatttaaatcaaacctttgcctgtaatatgtattgcaaatgttttcctcagttggttgtcagatctcatttatagtaataacagcaaatatatatgagtgtgtgtgtgtgtgtgtgtgtgtgtgtgtatttgtgtattcatccacttaggaataaattttatgagaattgtgcggcatatagaaagaaaactgtaaaaccttactgaggtatttacagaccacttgaataaatggagagaaataacggtgctatatattggaaatattttttccaaataaatattgcagtatcgttgtctgaggtattacccagaactctttgtctcacgaccaaaagaataaggagggtggacagtaagggtgagtttggaccgaaaatttaataaacaaaagaggaaagctcttcactgtggagaggggacccaagagggttgccatttcacagctgagtacaaaggcttttatgaggaacctgatagggctgggggtttcatttgcataaggcatgaatttctggcagctccaccctgttctcctagtatgctgactggctaggggttgtttttggaaaaggcaccactcagaaaatgacatgatggttgaccaggcatggtagttcatgcctgtaatcccagcactttgggaggctgaggtgggcagatctctcaaggccaggagttcgagactagcctggccaatatggctaaagcccatctctactaaaaatacaaaaattagccaggtgtggtggtgcacacctgtaatctcagctacttgggaggctgagccacaagaatcacttggacctgggaggtgaaggttgcagtgagacaagattgtgccaccacactccagtcacactccagctgggtgacagagcaagcaagactccatctcaaaaaaaaaaaaaaaaaaatgacgtggtgtaaagaccagttggagccttggcccacaaccagctgagtgttggagtgatggttcacagaggcttggctcacagtccaaagtatgccccaaaaaggaaaggaatgtgctcactggggcccaccatgtacatgcccacaaaaggagaaggaactatttgctagaggcccactgattgcacaaagaacaaaggcatttctgtgttggactttgctcccttatctgtgcagctgtgggcatgttttaggcaagcttcctgtgctagttcccttatctgtgtctgcagcttgatttttcagactgttcttttgtttgaaagaattctgaggacctgccctaactgcctgcctaactgattctttctttctcctccctcaatatgtggatttatggctatttcaatcaaaaccacagtaggattttttttttaatggtatagggagatcttggcaggttggagaatcctggagcttcttaagtggccaaaaattttgaaaaagaagaacagtgaagtggtacttacatttccaaatgtcaaaatatattacagaaattatagtcattcacacaatatgatagtagcacccaaatagttaaaacagtgagaagagaaagttagaaacagatcctagtatgtatcataattcagcacaaatgaaaagtaacatcacaagtcagcgtgaaaagaaaggattattcagataaatgctgctgggccaattggttaacagtttggggaagattgtgaaatcagaccctatataatatgatacaacaaaataaattttttaaaaaagagttatatgtaaaaagttatacattagaaaatgaaataaaagaacataggtcatttttttttttttttgagacagcgtctcactctgtcaccaaggctggagtgcaaaggcgtgatctcggctcactgcaaactccgccttctgggttcaagcgattctcctgcctcagcctcccgagtagctgggactacaggcacccgctaccacgcccagctaatttttatatttttgatagagacggggtttcaccatgttggccaggatggtttcgatctcttgaccttgtgatccgcccgcctcggcctcccaaagtgctgagattacaggcgtgagccactgcacccggccgagttaattttttttgaacagggaagagctatctgttcaaaatacatagaaaaaaaaaccacagaataaattagtaataattcaactttaacaacaaaaagctgtaataaagcaaatcatactaacccctagaattgtcattttcaataatgtatctagtttaaataatcataaatgtccacaaaaatttagctacaaatgaggtcattatataatggtattatttttaatagtgaaaaatcactagcaacctaaaaatctggcaggaaatgattagttatattacattcataaagcagaatattatgattgctttaaaacagctgtatagaagaatacttaataacctggatatgatctgtagctgattgaaaaaagcaagctctgagaggacatgtagtatgtggtccaattttttgtttcaaaacaaagcaaaaaccatatgcagaagggaaaaattgaaattattatagtctctggacagtgagattatgggtgatttttttttttcttctacctacctgattttcagattttctatagtgaaaacagtaataaggaaaaagacagaacaagttattttttaaattaagaaaatggaacagattttgtttctgtggaaaaagactagattgaaagttctcatagatgcctcaaggaagtccatttgtgtcactgatatttccttagcatttagcaatattggctagtcagtcaaacactaagagtaaaagtaaaacagtgttgacacctttttgtcatttcagtcttatatctgttagaacaagggtggtcatttttctggttttgaacatacctgctgataaactgcctctgagttcctaagaagtgtttgggacaattagtcacactttgactgctttcgaattaatgagttgttttcttacacccagggttttccacgcagactgtagctgctgtgggaaacaggaggcagtgggatggaggagcgcctcagactctgctgcagatgatggcagtggccgacatcacctccacctgccccacggggcctgacagtgagtctgtgcttagcgtcagtcgtcaggaagggaagaccaaggacccgtacagcccagtgctcatcctgatgtgatagtctacttctcactatacaccctatagatcttgtatcagacactttcaaatatgttgttttgatatctccctatgcctaaagagacttgcctgctaattatcctggacaaatgaccactctagacatgcacatataaaggaggaaaaatccaggatgccaccttcctcagagtgagggaaaatgcgtgaggaaggacagctgacttgatttaccttccaaggccagctcaacaactttttttgcgatttcatagggtcatttttttttttttaatttttattttttattgatcattcttgggtgtttctcgcagagggggatttggcagggtcataggacaatagtggagggaaggtcagcagataaacaagtgaacaaaggtctctggtttttctaggcagaggaccctgtggccttccgcagtgtttgtgtccctgggtacttgagattagggagtggtgatgattcttaacgagcatgctgccttcaagcatctgtttaacaaagcacatcttgcactgcccttaatccattcatctctgagtggacacagcacatgtttcagagagcacagggttgggggtaaggtcaccgattagcaggatcccaaggcagaagaatttttcttagtacggaacaaaatgaaaagtctcccatgtctacttctttctacacagacacggcaaccatccgatttctcaatcttttccccacctttccgccctttctattccacaaaaccgccattgtcatcccggcccgttctcaatgagctgttgggtacacctcccagacagggtggtggccgggcagaggggctcctcacatcccagtaggggcggccgggcagaggtgcccctcacctcccggacggggcggctggccaggcggggggctgacccccccacctccctcccagacggggcggctggccgggcggggggctgaccccccccacctccctcccggacggggtggctggccgggcggggggctggctcccccacctcccggacggggcggctggccgggcgggggggctgacccccccacctccctcctggatggggcggctggccaggcagaggggctcctcacttcccagtaggggcggccgggcagaggcgcccctcacctcccggacggggcggctggctgggcggggggctgacccccccacctccctcccggacggggcggctggccgggcggggggctgacccccccacctccctcccggacagggcggctggccaggcagaggggctcctgacttcccagtaggggcggccgggcagaggcacccctcacctcccggatggggtggctggccgggcggggggctgacccccccacctccctcccggatggggcagctggccgggcggggggctgacccccccccccacctccctcccggacggggtggctggctgggcggggggctgacccccccacctccctcccggacggggcggctggcctggcaggggctgacccccacctccttcccggatggggaggctgccgggcggagacgctcctcacttcccagacagggtggctgccgggcgaaggggctcctcacttctcagatggggcggttgccaggcggagggtctcctcacttctcagatggggtggccgggcagagacgctcctcacctcccagacggggtcgcggccgggcagaggcgcttctcacatcccagacggggcggcagggcagaggtgctccccacatctcagacgatgggtggccgggcagagatgctcctcacttcctagatgggatggcggctgggcagagacgctcctcactttccagactgggcagccaggcagaggggctcctcacgtcccagacgatgggcggccgggcagagacgctcctcacttcccagacggggtggcggccgggcagaggctgcaatctcagcactttgggaggccaaggcaggcggctgggaggtggaggttgtagcgagccgcgatcacgccactgcactccagcctgggcaccattgagcactgagtgaaccagactccgtctgcaaacccggcacctcgggaggccgaggctggcagatcactcgcggttaggagctggagaccagcccggccaacacagcgaaaccccgtctccaccaaaaaagtacgaaaaccagtcaggcgtggcgacgcgtgtctgtaatcacgggcactcggcaggctgaggcaggagaatcaggcagggaggttgcagtgagccgagatggcaacagtacagtccagcttcagctcggcatcagagggagaccgtggaaagagagggagagggagaccgtggggagagggggaccgtggggagagggggaccgtggggagagggagagggagagattgtcattcttaatagtatgttattactgctgagcacagtaatagccatagtagtggtagctgctgctgttgtcattgttgtcgggtcatttttttttccaccagtaaaataagaattaaaagagtagctatctctacaagatttcgagagttaatagttcaaagatacatataaattgctttgaagccaatgtgctatttaaatgttaggagtgtttaggatatgattatgttttctacctaaattccatcatttacatttgaacctctcacatagcctttccttagaagaggatcatagcaggctgggtgcagtggtttacgcctgtaatcccagcactttgggaggctgaggtgggcagatcatgaggtcaggagttcaagatcagcctggccaacatggtgaaaccctgtctctactaaaaatagaaaaattagccgggtgtgatggcacacacctgtaatcccagctactcgggaggctgaggcaggagaattgcttgaacctgggcggcggaggttgcagtgagccaagatcgtgacactacactcctggctgacagagtgagactctgtctcaaaaaaaaaaagaaagaaagaaaaaaaagaagagggccatagcagcctccaacctctggatgttatcttcacaggtggtaaagatttttattacttatttcctatgttcttgataacatgggctgagagggagctaaaatttgtacatgtgctgtaagttgaaatatgtaagtatatcactgaaatgagcaattatgtctataaattgagtttcccctcaattgtcttattaagttataaatcaatttaaaataggcaaatagaataaaaattgttatcacaccaaaatggccagtttacaaagcaatgaatgactcttcccctcatcagctatgtgacaagaagtcactaaacttttctatatctcggcttctttattaataaaatgagaggtgggattaggttacctccaaggttttaacattctttgatcttatacaaatgccagtgaagaagcatttttatttttaataacactttcctcttcagatggccaagttattgtgattgaaggcattccaggaaacaggaaacagtggcggcatgaagctccaggaactttaatgagtgttttggcagcagcacatctaacgagtagctcattttctgccgatgaagaatttggtatgtagtttatttttaacaacataaccagtcctcagaggaattttgtcaagacttgcaaatgctgaaaggggataaaaataccttcagctgggagagagaattgggagggtgtctagccttttcagaagctgatttgctttgtccaatcctattccaaatgctactaacaaaagacatgagctttccaggagagtggtgtaattttctttaatgcaatcagctgacaactggtgaaaagtttaagtagggctagtggctttgtagctgacgatccagtattgttttgctctacctgagtcagtttatttctgacagctattcagtggactcaaattactatcccatggacaataaaaatacaacataatatcatttgtttttttcctccaatttttagcaagattctgcttttgtttactttaaggcaggagcccccaaccctcgggccgcagaccagtaccagtctgtggcctgttaggaaccaggccacacagcaggaggtgagtggcaggcaggtgagcattactgcctgagctctgcctcctgtcagatcagcagctgcattcagttctcatgggagcatgaaccctattgtgaactgtgcatgtgagagatctacgctgtgtgctccttatgagaatctaatgcctgatgatctgaggtccccaaaaccactccccttccctgcccccatggaaaaattgtcttccatgaaactggtccctggtgccagaaaggttggggaccactgctttaagggaagccaaccatcattttctaaaatttgaggggcctgggtgtaatggctcacgcctataattccaggactttgggaggctgaggcaggaggatctcttgaggctaggagttagaggatgctgtgaactatgatcactgctctccagcctggctgacagagcaagaacttgtctctaaaaataaaaaataaagtttgagggaaatcacatcataatgagggtttgttcttatatcagatattcaagtgtgaagtgctacaagaaaagctactgcaggcaagcagggatcccaggagcatctgcatgagtgtgaggtctgggacctggttttgtggtgaagtgaggttgaaaaacaagtagaaaaactaaggtactagatattcttggaggctgataaatgtttacaaagttaggctgggcgcggtggcttatgcctgtaatcccggcactttgggaggccgaggcaggtggatcacctgaggtcaggagttcgagaccagcctggccaaacctcgtctctactaaaaatacaaaaattaggtgggcatggtggcaggcgcctgtaatcccagctacttgggaggttgaggcaggaggaacgcttgaacccgggtggcggaggttgcagtgagccgagatggcgccattgcactccagcctgggggacaagagtgggactttgtctaaaaaaaaacaaaaaaaagtttacaaagttaattaccactacaaaaacatagtaatttttaactgtcagttgagtcccaacagttaatgaatacacattttataatattttgaaagaggctttctaatggaatttttttatgtggaacaggacattttattaacacatctaagtatctttgtttctctgaagtatgaagccaaaagtttaagattataaactcataattagtcattaatatcttagcattatatgttatttggagatgatctagataatgaatacctatcatttaatttagcttagcaaaacttgaggagaaaaagttaccaaaaggatttgaaaaaccttttttaagtaaacacattagaaaacctaattattattatgattattattatttttttatttttttattattatactttaagttttagggtacatgtgcacaatgtgcaggttagttacatatgtatacatgtgccatgctggtgtgctgcacccactaactcgtcatcaagcattaggtatatctcccaatgctatccctcccccgtccccccaccccacaacaggccccagagtgtgatgttccccttcctgtgtccatgtgttcttattgttcaattcccacctatgagtgagaatatgcggtgtttggttttttgttcttgcgatagtttactgagaatgatgatttccaatttcatccatgtccctacaaaggacgtgaactcatcattttttatgggtgcatagtattccatggtgtatatgtgccacattttcttaatccagtctatcattgttggacatttgggttggttccaagtctttgctattgtgaataatgcctcaataaacatacgtgtgcatctgtctttataacagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaaagcctaggttttcttctatggtttttatggttttaggtctaacgtttaagtctttaatccatcttgaattgatttttgtataaggtataaggaagggatccagtttcagctttctacatgtggctagccagttttcccagcaccatttattaaatagggaatcctttccccattgcttgtttttgtcaggtttgtcaaagatcagatagttgtagatatgtggcgttatttctgagggctctgttctgttccattgatctatatctctgttttggtagcagtaccatgctgttttggttactgtagccttgtagtatagtttgaagtcaggtagtgtgatgcctccagctttgttcttttggctcaggattgacttggcgatgcaggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatagaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatacacaatcatgtcatccgcaaacacagacaatttgacttcctcttttcctaattgaatactctttatttgcttctcctgcctcattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattgttttgagatacgtcccatcaatacctaatttattgagagtttttagcatgaagggttgttgaattttgtcaaaggccttttctgcatctattgagataatcatgtggtttttgtctttggttctgtttatatgctggattacatttattgatttgcgtatattattgaaccagccttgcatcccagggttgaagcccacttgatcatggtggataagctttttgatgtgctgctggattcggtttgccagtattttattgaggatttttgcatcaatgttcatcaaggatattggtctaaaattctcttttgtggttgtgtctctgccaggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagatcctgttattggtctattcagagattcaacttcttcctggtttagtcttgggagagtgtatgtgtcgaggaatttatccatgtcttctagattttctagtttatttgcgtagagatgtttgtagtattctctgatggtagttcgtatttctgtgggattggtggtgatatcccctttatcattttttattgcatctatttgattcttctctctttttttctttattagtcttgctagcggtttatcaattttgttgatcctttcgaaaaaccagctcctggattcattaattttttgaagggttttttgtgtctctatttccttcagttctgctctgattttagttatttcttgcgttctgctagcttttgaatgtgtttgctcttgcttttctagttcttttaattatgatgttagggtgtcaattttggatctttcctgctttctcttgtgggcatttagtgctataaatttccctctacacactgctttgaatgcgtcccagagattctggtatgttgtatctttgttctcgttgggttcaaagaacatctttatttctgccttcatatcgttatgtacccactagtcattcaggagcaggttgttcagtttccatgtagttgagcggttttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtccgcttggtgcagagctgagttcaattcctgggtatccttgttgattttctgtctcgttgatctgtctaatgttgacagtggggtgttaaagtctcccattattaatgtgtgagagtctaagtctctttgtaggtggctcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaaccctgcctttttttgttttccatttgcttggtagatcttcctccatccttttattttgagcgtatgtgtgtctctgcatgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttatttcgctcgttagttggtgcagtttcttcgtagtctcgatggtctttacattttggcatgattttgcagtggctggtaccggttgttcctttccatgtttagcgcttccttcaggagctcttgtagggcaggccggtggtgacaaaatctctcagcatttgcttgtctgtaaagtattttatttctccttcacttatgaagcttagtttggctggatatgaaattctgggttgaaaattcttttctttaagaatgttgaatattggcccccctctgttctggcttgtagagtttctgccgagagatccactgttagtctgatgggcttccctttgaggataacctgacatttctctctggctgcccttaacattttttccttcatttcaactttggtgaatctgacaattatgtgtcttggagttgctcttctcgaggagtatctttgtggtgttctctgtatttcctgaacctgaatgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcgtttctttttattcttttttctctaaacttcccttcttgcttcatttcattcatttgatcttccatcactgatacccttccttccagttgatcgcatcggctcctgaggcttctgcattcttcacgtagttctcgagccttggttttcagctccatcagctcctttaagcacttctctgtattggttattctagtcatacattcttctaaatttttttcaaagttttcaacttctttgcctttggtttgaatgtcctcccatagctcggagtaatttgatcgtctgaagccttcttctctcagcttgtcaaagtcattctccgtccagctttgttctgttgctggtgaggaactgcgttcctttggaggaggagaggtgctctgctttttagagtttccagtttttctgctctgttttttccccatctttgtggttttatctacttttggtctttgatgatggtgatgtacagatgggtttttggtgtggatgtcccttctgtttgttagttttccttctaacagacaggaccctcagctgcaggtctgttggagtacccggccgtgtgaggtgtcagtctgcccctgctggggggtgcctcccagttaggctgctcaggggtcaggggtcagggacccacttgaggaggcagtctgcctgttctcagatctccagctgcgtgctgggagaaccactgctctcttcaaagctgtcagacagggacttttaagtctgcagaggttactgctgtctttttggaaaacctaattattattaaaacttctacctggccaggctcatgcctgtaatcccagccctttgggaggctgaggcaggaggatcacttgagccctggagttggaggctgccatgagccatgattgtgctgctgcactccagttagtgtgacagagtgagactccaactctaaacaaacaaacaaaaacctcttatttcattacatttatttattccttcataacaactatgtttggaaattttcaggaaacattggacaaatctagccatcatcttatttctttattaatcatttctacagtttgtgaatgttaggcagtcaccaccaaagcaaaagccctaaggttaatacatggacgttttgctgatcaaatgacactgctgctttcattaaaccaaaaaactagtcttatttaccaaaaatttacccaagttacaagaattaaaaggcattttagtgcatttctacttttctgataaaatatttcatttaagcacttactttttctttaagccaattaactatagctctttcatatattttggtagtgaaatatcaacaaaacacaagttcagctgccctccgcttgcaaaattgaataacaaggacaaggtgcagtagaaggaaagtgcctttatttttcagcgctagcagtggggagatggttcaggctcctgccttaataaaaccacttcggaattctcaggcaaaatgctagggcttaagaagaggatgtttggtatggagggtatgtggggcgagatggtgcaagtctacgtgacttgttccaatgacttatcttgagttattgccccatctggtgaattgggctggtaccatctcgggcttgtctgggttgtaaattagctgcagccttgaagttcctggtgggggagaatttcatatgcatctggattgtctcaagattcaatctctggaacttctaagcaaacataattagataagccagcaatgcaagggagtgcttggtggaaagaaagtcaagatttttatttcattactaaaaagttaatacagagggctgcaggaggaaaaaaaaattaaaaatagggcactcagttacaaaatcacatacacatgatacatataaacatacacacagaagcaggttttgtagcttcataaggctttcatttgccagttttcaaataatttttcctccaactttattttttattttatttatttatttatttttgagacggagtctcactttgttacgcaggttggagtttcggctcactgcaccctctacctcccaggttcaagtgattctcctgcctcagcctctggagcagctgggattacaggcgcatgccactatgcccagctaatttttgtatttttagtacagactgggtttcaccatgttggccaggctggttttgaactcctgacctcaagtgatccacctgcctcagcctcccaaagtactgggattacaggtgtgagccactgcacccagcctgagccaccatgtcctccaactttagactatcaatctcttgattacctgttccattgccctaaacaattgttagcaagccaaccctaaatttgtacttctgaaaggatgactcttaagggcacagaacttagatctaaacactattgtttgctggaaaaaaaaaggcacagtcaaggtttagtcaagacaagattgccaggaaaggtgtctggaacaaaggtaaggtttgttatgtgaactttaaaccaatgcctttcccatcttaaaaatttctggtggcttgggtgtagagggaggccttacaaatgaagatttcctttatagatataaatcttttttttttacaaagaattttaaaacagggcctaatatttaatatgtgaaaagcaggcaaaactcgaaggcagtgcatctaaatctttcaaaatcaaggatctcacttctatattgaatcctgggtcccccacaaagagggaaacaccatgagtctgtgctccttgctgcaaatacgttcccctgaggctggtgggtaacctaatgccagtcaagctactctgtgagcagcccatccccaataggagtcttataccttggtggtgttcccataacctccaagtgttcaaacctgtctttcaatctaaatgcacaaagaagtaagtagccccatccagtaacaaccattcactgtgtgtacccaaaatatctgagataggtctcaatttagaaagtttattttgccaaggttacagatgcgtctgtgacaaagcctcaggaggtcctgatgacatgtgtccaaggtggtcagggtacagtttgcttttatacattttagggagacatgagaaatcaattactatgtgtaaattgtaccttggtttggtccagaaaagaggggcgacttgaagcagggcgggggtggggtcggggggagggcttccaggtcataggtagataagagacaaaagtttgcatgcttttgagtccttgatcagcctttcactgaatacacaatttagtctggctcagtgaatctgcatttttacataaacaatagggcagaagcaatcagatatgatttgtctcaggtgagcagaggaatgactttctgtcctgcacctgtgaagatcagcgatcagtttacattgccagggtgaaattcaacagaattgttttagggtaaagatcctgaggcctacaaggaacttccctgtgggcaaattgtgagggaggtatgtagcttttttataattgtagctatcttatttaggaataaaatgggaggcaggtttgcctgacgtagttttcagcttttctcttgccttagtgataaatcggtcccgagatttattttcctttcacaaccgcagccgctgtcagccacttccaaaactacagcttttatcagtgactcgtcagccattgcacacacaaaaatcagttctctctcacagtacaatgtaatccctggtaccccaaagtcagattgatcaagtaacttactgcaaaagacagtagagctttagatctgagaggaacctgcccatgactctttgtactccactaggaaaacagaccaacctaaggagggatgaatggcaccttttctgcattcttcgaggggttttagagtcattagaagtctcctgcagattccttcacgtgttattgaaaatggcaaaagggaggaggagcagaagtggaaggaaatagaagaacaagtcatataggagccaatttggggaggtttttaagctaactaaaaggccagtgagaagttgtacatttttctcagcagaagtcatgccaaaaagataggaagcaactgaaaaaaaaaattctggaaacagcatccaaaagaagaaaaagcagaaaaggcctttaaaaaacgtttatagcctaaatattaaacttttaattaacctgacttctgaccagagttctaaaaaaaaaaaaaagcccctgccttataattctttgtggtattaaaaaacgaacactagggccgggcacggtggctcacacctgtaatcccagcactttgggaggccgaggcaggtggatcaggaggtcaggagtttgagaccagcctgaccaacatggtgaaaccccgtctctactaaaaatacaaaaattagccaggtgtggtggcatgtgcctgtaatcccagctactcaggaggcttaggcaggagaattgcttgaacctgggaggcagaggttgcagtgagctaagattgcactattgcactccagcctgggtgacaaagccagactctgtctcaaaaaaaaaaaaaaaaagaaaaaaacaaatgaaatattgtgctatcttcaatctagtccttttcccaagaggaaaaataaaaagcacattttaagtaaaaaaaaaaactgcaaaaaaaaaaaaaaagatgaaggtgtgtgtgtgctttgggttttccctacaggcattcatgatgaagtctaaccatggtgggagactcaggttatagaaacagtggagaataagagtggtccaactgtggtaaatcttttttttacacaaagattttcttaatttttctaatacaatgaaagcatctaccccaaaagtggaggtgttttatctcttcctctctgatccttattcctgtcacttttacttgtctggttgtgttatccctttcttattctctgttttgatggaaatggctaaaaggtttaccattatactgatgttcactatcaggtttttggtatatgcccctcattgggtatataggctgggatgctttcatatctttctctgtcatttctttagcaatgggaacattaaaacaatggctacccaaagaagaagatgaagggaaggtagaaatggtctctggcattgaagtagatgaggaacaactagaaccaagatctgatgatgatgatacgtaagtagatcatttgccgatacctaagtcgagcactggtacaaagtgaaaatgctgcagttgagacattcaaaatagccaactgagacctggctacaaagatcaagttttacaatgcacgggtttggttctgggctctccattcttctccaatggcatcattttctacatttgcatcagtgatactctgtcttaacttccatggcttccattgtacctcctgatacctggtggggccagtcctcacatattgtgctagcagtcttcacagcattttcttcaaaattatcttaactattgttgcccattcctcatcatacacagtatatcaagcttgtccaagccacagcccaggacagctttgaatgcggcccaacacaagtttgtaaactttcttaaaacattatgagatttttttgcaatttttttttttttttagttcatcagctgttgttagtgttagtgtattttatgtgtggcccaagacaattcttccaatgtgccagggaagccaaaagattggacacccctgctgtacctctttgcattctcttataaagtatgagaaacgttgttgggattttggtgggaatgacattttatttattgattaaattatgggaattggcatatttgggattatgaatcttttaaaattattattattattattattatttgagacagagcctcactctgttgcccaggctggagtgtggaggcgcaatcacagctcactgtagcctcgaattcctgggctcaagcaatcctcccacctcagcctcccaagtagctgggaccacaggcacatgccaccatgcccagctaatcttttttattttttgtagacatgaggtcttgttatgttgtgcaggctggtcttgaactcccagcttcaagttgtcctcccaccttggccacccaaagtgctgggattacaggtgtgagccactgcacttgtcctaaaaattatttttaattggcaaataaaaattgtattaatatatacttacggtatacaacatgatgttttgaaatatgtacacattgtggaatagctaaatcaagctaataaatatatgtattacgtcacatgcttatcatttatttatggtgagagcacttaaaatctactctcagcaattttcaagtatacaataaattgttattaactatagtcaccatgctgtaccatagatcttctgaaattattccacctgtctaagtgaaattttctactctttgaccaacatctcctggctttcccttccaccttctcccaaccccagcccctagaaaccaccattctactctctgcttctatgagttcgattgtttttgattccacgttagtgagctcatacagcatttgtctttctgtgtctggcttatttcacttggcagaatgccctccagggttattcatgttgtcacaaatgccagaatttccttctttttaatagctgaatagtattccatcctgtatatatacaccacattttctttatctattcatgcattgatgtgattatgaattttaacatccataaatatagtatagctctctatgtctcttttttctttgtatttttaagtatttttataattttgtttatggcataggtaccacttaattttgttgttgttggtattttaaatgggatttttttgtattttaattttatttattttttatagagatgggggtctcacagtgttgttcaggctggtctcgaactcctgggctcaagtgatcctcccgtctcagcctcccagaatgctaggattataggcgtgagccactgtgcctgcctaattttattttttaattgaaaaattttgattttacatattcataggatacacagtgatgtttcaatacatatgaagtatagcagtcagttcaaggtaattagcatatccatcatctcaaacatttattgtttctgtgtgttgggagcatttaatatcttccttctagtgatttaaaactatataccatattactattaactatagtcatcctacagtggtatagagcactagaatttattcctcttatctagctgtaattttctgtcctttaacaaatctctcccttttttcctcttgtgttttcaagaggaatgtatagaactactgctactgtatagaacactactgatgtatcctgtaactttactaaactctcttattagttctaaattttggagtcctttgaatttttaaaattttattataatttacttaacatttgttttgagacaggatctttctctgttgcccaggctggagtgtggcagcatgatcatattcactgcagccttgaactcctgggctcaagtgatcctcttgcctcaggctccagaatagctgggactacaggtgtagcatgccaccatggccggctaatttttttgttttttgtagagacggggtcttgctatgttgcccaggctcatcttgaactcctggcctcaagtgatcctcccacctgggcctcccataaagtaaactgtgagccagatgctgggattacagcatgagccactgcacttggcccatgatttacttttaaaatacgtcccaaattttttaagtagacccttttcagtcttcctactacctaactctttacatcagctacacagtcctcctccctacagtcaaccaatctaatctgcttcttgtgtatacttctccagaggaattccatacaaatataagcaaaaatatatttcttgtgtaaatgtgtctttttatataaatggttccatagtgcactgtcctataatttgctttttttttatttaacagtattatgttgaatacatattattgtttcaaaaactagtatatgtatagtttaaatttccagaacaaaaagtattgggtcaaagagcatgtacacttgtaaattggatatcataaaattgtccttcacagaggttacacctattaacatcagtatctagaagtgcctatttccccattctcttgctcagtgtgttgtcagatttttggattattgcataattgataggttaaataaaagtcagttcatgatagttttaattggcatttcttttgtgagtgaggttatctttccatatgctaaagagccatctttatttcctctttcaggaaaattcgttcatgggccatttttaaaatttgggtattaacattgtattgatttgggaactttctgcacttcagggaaattagtcttttatctgtaacatgattcaaaaatattttccttggtttttgccttttattttgtttatggtgacttgtgccatgttatttttgtttagttagattaatcaattattttataaaacaaagattctaggatttttttttttttgagacagggtgtccgtctatcacccaggttggagtgcagcggcatgatcgcacctcactgcagcctcgacctcctgggctcaatctaacttcccacttcagcctgctgagtagccgggactacaggcacttgccactatgcctgactaattattttattttttattttttgtagagatgaggtttcaccatattgcccagactggtcttaaactctttcttcttcttcttcttctttttttttttttttaaacatacaggatcttactttgttccccaggctggaatgcagtggcccgatcatggcttactgtaaccttgaattcctgggctcaagtgatcctcctgcctctcagcctcctgagtggctgggagtataggcatgcaccaccatgcccagctatttttttttttttttgtagagacagggtcttgccgtgttgcccaggctggtcttgaactcctagactcaagtgattttcatgccttggccccccaaggggttaagattacaggcatgagccactgtaccttgtcaatcccaggattttaaaaatatatttattatttaattttctctatagtaaaatattttattcatctttaactttattcatattacactacaaagtgtggatccaacttttttttttttttttttgagatggagtctcgctctgttgcccagactggagtgtagtggcatgatcttggctcactgcaacctccacctcctgggttcaagcgattctcctgtctcagcctcctgagtagctgggattacaggcgcacaccaccgtggctggctaatttttgtatttttagtagagatggggtttcaccatgttgttcaggctggtctcaaacccctgacctcgtgatccacccgcctcagcctcccaaagtgctgggattacaggcgtgagccaccgtgcaggtcccaacttttttttttttttttttttttgagacagagtcttggtctgtcgcccaggctggagtgcagtggtgcaatcttggctcactgcaagctccacctcccaggttcacgccattctcctgcctcagcctcccgagtagctgggactacaggcgccggccaccacgcccggctaattttttgtatttttggtagagacggggtttcaccttgttagccaggatggtctcgatctcctgacctcgtgatccgctcgcctcggcctcccaaagtgctgggattacaggcgtgcgccaccgtgctcggcccccaacttttttttttccccaaataactcctcacttattccagcaccatttacttaaaaaggttttttattctggccgggcgcggcagcactttgggaggccgaggagggcagatcacaaggtcaggagatcgagaccatcctggctaacacggtgaaaccccatctctactaaaaatacaaaaaaattagccgggcgtgggggcaggtgcctgtcgtcccagctactcggcaggctgagtcaggagaatggcgtgaaccggggaggcagagcttgcagtgagccgagatcacaccactgcactccagcctgggcgacagagagactccgtctcaaaaaaaaaaaaaaaaaaagattttttattctaatttgaaatgctactgttatggtacgtttttatacgtatttgcattcaattcctattctttctagtctaattattgatttataaacacattgtttataatatagtttattattttgagggctaggtcccctaaatactcttccttagagttttcaggcttgttttgcttatttttccatatggacattagaatcaccttgtctagcaaaggaaggaggaaaagaaggagttttcttagcctccttgccagcagaattttggaatccaaaggcctcttttcgtttcatactgtctgtgtccctttcattccaacctggttatgcttctgtatatatatttctttcaaaaatcttagaggtctctgcaactcttatggggaggcacttcgttagataacagccagacccacaaatctttttgatataagcccttctctatcttgggctttggcttagactacagagaaacaacacccttaaattgcctagaaaccctactgtttgagaataattttgagacttattcatgttgttgtatatattgatagttcatttactttatattgctcagtagtatcccattgtgtagatataccacaatttgtttgtagattcacctgttggggacgtttatgttgtttccagatttgggctatgaatatttgtgtatattctgtatgtgaacctaagttttcatttggctatgaatatttgtgtatattctgtatgtgaacctaagttttcatttcttgtgggcaaacacctaggagtggaatggcggagttgtatggttggtgtactagggttctctagagcgacagaagtaatggaatataaaggggagtttattaagtataactcacacaatcacagggtcccacaataggccatctgcaggctgaggagagaggagagccagtccaaattcaaaaccgaagaacttggagtctgatgttcgagggcaggaagcatccagcataggagaaagctgtaggctgcgaagctaggccagtctctcttttcacatttttctgcctgcttacattctagccgtgctggcagccgaatagattgcgcccactcagattaagggtgagtctgcctttcccagcccactgactcaaatgttaatctcctttggcaacaccctcacagacacacccaggatcaatactttgaatccttcaatccaatcaagttgacactctgtataaaccatcacagttggtaaatgtttaacttactgttttccaaagtggttattctatttcacattcctgtgaacagtgtgtaagagttccagttgttcaacatccttaccaacacttggtatggtcagttttaacatttttaacccatctactaggtgtgaagtggtgtctttataattttaaaattatttatatatctttgctactagttctttgtcagatatctgctttgctaacattttctcaccatctgggtatttgtgttcattttcttaatggtatgattcaagttggaaatttctgactaatgtatttttttaagcacttttttttcttttctttttctttttctttctttttttttttttttgagatggagtcttgctctgtcacccaggttggagtgcagtggtgtgatctcggctcactgcaacctctgcctccggggttcaagccaattctctgcctcagcctcccgagtagctgggattacaggtacctgccaccatgcctggctaatttttgtatttttagtagagacagggtttcaccatcttggccaggctggtcttgaactcctgaccttgtgattcacccacctcagcctcccaaagtgctgggattacaggcatgatccactgtacccggccttaatcactttaaaaattgattttttttaaagtgtcctttaaaaagtaaagtgtcccttttttacattgtcacttttttttcctattaatgctgtttgcattaagttctatttggtctgatacagatattactattctaacttctttatttttttaagtacttttataatatgtatttttctattcttttattttcatcatttctttgtgattttgttatgctgtatttcttataaagtgcatgtagttggtttatgtgctccttgtcatgtgaaaatgtcttttaatgttaatttagtaaaatttattataatgttgacaaatttggatttcactctaccataccattttggttttctatttattatcttttcttatttcttttttacccttctttcctagccttttgttggttgacaaacttttctatattaattttccccccataataattttgaagatacagattatatttctaatcttttaatggttagcttttatacactacctacaaattgatctaacaaattcaaaagttgctcagtattccttccttcctcccaaatatgaaaaacacaattttaatcaccacaaaacccttttattctgatattttaatatagaagtataattttacttaaaaagcttttttattattaaaaatttcaaacatttatagtgcaagtagagaacagcataatgaaccctcatgtatccatcatctagcttcaacaattatcaacattgtttcttttctgtcttcatgtcccccacacttttttttttgtaagtgtggaatactttaagtctcagatatcaaatcatttcatccaattttaccttttttcaaacaaaaatattatatatattattatatgtattaatatatacatattctcaaatgtaactcactttgccaatttagtttatcatttttctgaacttgccatttttttcctatcccgtgctttccctctgatttcagtttttttcttgttgatgtatattctttagtaattatttatgatatgtcagtgagtagtaaactttcttattcttttcatatcaaagattgtttttgttttgacttgagtcttcagcagtaattttgctgggcatataattttaggttgacaactattttttctcctggcttctattattgttgatgacaaatcaactatcatctcattatttttcctttatagggatgctaactttctccctgatacttttataatttttttaattccttacattcttatgtttcactatggtatgtctaggtctaaaaatgtcttttatcctgcttgcttcactttcttttgagaacacatgactttctttagttctggaaaattttaatatttgcttttcttattgcatccattttgattctccaattagatattagatatattttttatcttctcaattatctccagtagtacctaattgtactttcatattttttattctcttctttgttcctttccaggtgaatttttttttttttttttttttttttgagacagagtttcgctcttgttgcccaggctggagtgcagtggtgtgatctcggctcactgcaacctccgcctcctgggttcaagcaattctactgcctcagcctcctgagtagctgggattacaggcttgtgccaccacgcccagctaatttttgtatttttagcagagatggggtttcaccatgttggccaggctggtctcgaactcctgacctcaggcaattcacctgcctcagcctcccaaagtgctgggattacaggcgtggatgaatccttgaatactgttttctaagcctatctgggtaccatctattgagtttttaatttaaatgattatatatttcatgcccaagataattattttttcttatatttatatggtcttgtttcattaatgcataatgatttctcataattaaaaaatttaaatgctttgctttagtttatctttttgggcatacttactttaggagacttatcaaaatcctccataaaaaataatttcatctggagttagttcatggtccaatttttttcttttattaattttatgccatctgtcttaccattagatttattcaggtgttagaattttagtttgtgggctcattttgttttggagggtttaaaattgctttttcttcctttcctgcctcttcctgtatacctcctaaatatctaatagggtcttcttccttaggtccccctccattcttgctagctgggacccttgaagagcaagtgtggtctagaaaaaaaataccagtaatgtggcttgtctgttttagcccaatctctggaagaaaaattctccctaagacatttataaccatagatttgacttcacttgtgtttggagcttgaattacaatacttgtatgggctggaaacatctatgttgagaaattaacactaaaattaacattaaggggtggtaatactcctgggatttttagaagtaaatataagacattctggagggataaatgttggattttttcactgaagcactggtgaagatgaacttacaattgaacatttaaaaacagaatccactatgagagattgcaaatagaacaaatgctgattagatcataaagaatttcagataatataattatcttaggaagactataatactgtatatttaaaattatttaatttaattaaattcaggaatccaaacataagaaaaatatagtccctcggtaaagagcaggaagtttctcttagcctgtttgggctactctaacacaataccttagatgagttaacaaaaatatcagaaatatacttcttctagttctagaggctaggaagtccaagatcaaggtgccagtagaggctgggtgcagtggctcacgcctgtaatcccagcactttgggaggctgaggtgggcggatcatctgaggtcaggagttcaaaaccagcctggccaacatggtgaaaccccgtctctactaaaaaatagaaaaattagctgggcatggtggcaggtgccttaatcccagctacttgggaggtagaggcgggagaatcatttgaacctgggaggcggaggttgcagtgagccgaggttgagccattgcactcaagcctgggggacaaaagtgagatttctctcaaaaaaaaaaaaaaaaaaaaagtgccagtagatttggtgtctggtaagggctagcttttggctccatacacagcacctgctagctgtgtcctcacttggtggaaggagcatacaagcttccttgggcttcttttataagggcactgatcccactcatgagggctgtgctctcatgacctcatcacctcctaaaggctccaccccttaatactatcacattgaggattaggtttcaacacatgaattgggaacaggggcacaaacattcagaccatagcaaaaatttttataattcactagaacttctggaagttgaaaaaaatctatgaatagaaattaaaattcgactgatggtttaaaaaacagaataggtgcagataataaaggagttagtaactggaagataggtctaagtaaaaacatgatggaaaatgtgacagagaagttaagaggcatgaagtcaaatgtatatgaaaaggagttccagaagaaaagaatatgagaaaacaatatgcaaatcaattccagctgtgaactttctataattatttgaagccagtaatcatcatatctgggaaataaaacaattatcaagcagcaacaacgaaaataaatttatacctagacacagcatagtttagtagaggaacaaagacaaaggaaagatctgtgtaaagcacatatctcaggaatggtaacagtaagtgggagttgcacttactggtccacccaaatttatggtctccagttttagtggggtcctccatgatgactggcaatcctaagcctggtcagcttccttcccagtgtatcagtgattccaaaccctcatccctcagctcactcccatccacacacactcatcgtgtgactgtgcctcctccttcacagagatagtacgcgttctgcagaatcagttttctagctccataacttctctatatccatgagtccttctctccttctctctccctatcttctttttcttaggaaaaactgtccctcttcctgctgaaagcccatgctctgcaggtgctctaaaacccagcctcttttcagtgacctggctcctattggttattccacctgtctcctgttttgaatatctactacctcctttcctcagcatataaacatgcccaactctctcccattaaaaacaataaccaaaaaccattgcccccatgttctctaaataataccattcctttcggagttaggctcgctgaaagaggagtttaaattcattgtcaccacttttttttttttttttttttcagatgagtgtcttgctctgatgcctaggctggagtgcagtggcatgatcatagctcattacaactgtaaactcctgggctcaagcaatcctcctgcatcagcctcctgagtagctctcccagcactttgggaggctgaggtgagaggattgtttgaacacagtagtttatgaccagcctgggtaacacagtgagacctcctagctgctaaaaataaaaaacctgggcatagtggtgctcacctgtagtccccacctgtcaccactttgttaatctccattgctttctggacccactgtacattggctcctgctgcacggcactcatctgaaatattctttcaacagtcatctattaccttgaaattggcaagtcaggtaatcatttctcagtcctcatcctatttggctactcctttggcttccacgatacacatcttcttggctcttatcagctctttctcaatctcctccacttgccactttttttgttccgttttgttttgagatggagtctcgctctgtctcccaggctggagtgcagtggtgcgatctcggctcactgcaacctccgcctcctgcattcaagtgattctcctgtctcagcctcctgagtagctggaactacaagtgtgcgccaccatgcctaattttttgtatttttagtagagaaggggttttgccatgttggccaggctggtctcaaactcctgacctcatacttgctacttaaatattaggttggtgcagttacttttaggtttaatttaggttggtgcagattgtcttattgatctattccctttcctttctaaaaataccaatgttgcagtcttagacacaattttaattcctggttctatgaattagtagctgtgagaccttcaacacattttttttttttgagacggagtctcgctctgtcgcccaggctggagtgcagtggcgcgatctcggctcactgcaagctccgcctcccaggttcatgccattctcctgcctcagcctcccgagtagctgggactacaggcgcccggtaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccacattttttaacctctctgagccttagcttctttatttataatttgatgataatgtctacctcaaaatgttgttagtattaagtggaatatggtataagtaccctaggatattgatggacatatagtaagagctcgatgtacggcaattgtttttttctttttttttaattctctcttcctctcctcttaaacattagatgatggacattaataaatataataaagggtgtttaacacaatgtaaaactcaacagaagactgattctcccaacattagctgtttatcatgcttagaaaaacctaggtgaaaatgcaacttttatattgctcaactggggatggagaaaagggaaacgagtttttacatgtattcttcagtactttcatatcataatgctgatttttactgcttattatttcagaaattttgaagaatctgaagatgagttgagagatgaagtagtagaatacttagaaaaactcgctactttcaaaggggaagaaaaaacagaagaggcctccagtacctctaaggactctagaaagtcaagagaaagagaggggataagtatgcagaaatctgaagaattaagggagggcttggagaatatttctactacatctaatgaccacatttgtattactgatgaagaccaaggaacatcaacaaccagtcaaaatatacaagtgtgattattgtactttttcttaagtaataagttagtgtctattacctatagtatttatttgggtacaagtcataaatgctcatttactgtaagggttttctagtaatctcaaggatttattaatttttctttcaatttaggaagtagaacttttgaatatagccattaatatttttactttaaagtttctattaagaaatcttaggccgggcagtctcatcactttgggaggccaaggcaggcagatcatgaggtcaggagtttgagaccagtccaaccaacatggtgaaaccccgtctctactaaaaatacaaaattagctgggcatggtggtgcatgcctgtaatcccagttacttgggaggctgaggcaggagaatcacctgaacccaggagatggaagttgcaagtgagccgagattgtgccactgcactccagcctgggcaacaagagcgaaactctgtctcaaaaaaagaaaaaaaaaaaaaagctttcagctaatatatgtggtaggcagagtaatgtggctcaatgccccctccaaaacatgtcccatcctaatccccacagtttgcaaatatggcaaaggagaattaaggttgcaggtgaaattgtttgcttatcagctgaccttaaaatagggaggttatcttggtttatccacctgggtgcagtgtaatcacaagggtccttacaagtggaagaggaagacaaaagagaaaaccagagagatcgcagcatgaaaaggactcagcctgatgttgctggctttgaagatgttggacaaggccacaaactaagaattcagacagcctctggaatctggaaaaggcaaagaaatggattcttccctagagcctccagaaggaacacagccctgccaacaacttaattttagcctagtgagttcaatttcatacttctgacttgcagaactgttaagataataaatttgtgttaactaagtttgtgataatttgttaggacagcaatagaaaacaaatacaatatacaggttcactcatttaacataatctgccgttttacaaaactgtgattttgaagtttcttgttgcattgaatacacttttttgaagctgatgttgacacaggaataaggcaattgagcaagaacaacaaggcatggtgtgttaattatgcactaaatgaccatggccattttgtctaatagtttcaatagtttccaatagtttcaagtgtataggttgagggcagggactatatctggtctttatatcttacaatgattttcttatatagttattagcacagtgccagaaatgtttcctgaattaataaatgctaaaacatttcctcattaagactgtaagctgtttggtgtaggaaaactaactttttaaaattgatcataacaattccaacgttgaacatggcctggagcttaacagatgtttatttaaatactaaggagtatgtctgggcttaggaaggagagggtggttacatttcagggtggtagaattctgcctgaaatatctgctttataataaaagtaaaatgtctcaccgatacactgttaaactgagaaaacaaagatgaggtaaggtgggtcagattatttctaaggtctgtttactatttacatttcatataattttcattaaatgtggagaatgcaagtcttaggagtcacctgaggtacatccagttttttgtgactatttcctgatgtttgacagactgttctttcaacttggtgtagagttacagtctactcttttagggagaatgctgtttgttcacatcatgaggctgtaaatatttaaaatgttctcaccattgtgttagtttccaactgacacatggcctgagagattggagtatcattaattctgcaactcttttagtgctccggatgtgcatgtttatttactttcaggactagttcagacatagtaaaactgctagtgacttcatgtaatccttattctgaactgtatttgaaagcaagggaaatgaaacatgatccctaataacctcaaacatccaaagatcaagtcaattaagggcaaaaaaaaaaaaaaaaaagaaaaaaaagaatgtttaaggatggtaaatgaacacgccaggtgtggtggcgcatgcctgtaatcccaacactttgagaggctgaggcaggaggatcgcttgagcccaggagtttgagaccagcctgggcaacatagggaaacacccatctctatccacccctcagaaaaaaaaaaaaaaaaaaaagaattagctggtgtgttggtgtgcacctctggtcccagctcttcaggaggctgaggcgggaggatcactttagtttcagcctgggaggttgaggctacagtgagccataatccgtgatcacatcactgcactccaccttgagtgacagagtaagaaagaccctgtctcaaaaaaaaaaaaaaaaaaaaaaagcatgtcaggttatcgggtttgttcccatgataaaagatgcttggctaaagtctagtctattttaggtaatagtcaccaagctttactcaacaattttgaattctttgctgtaaactggaagtattcactgtgataagtatacatatctgcaacactttcagctgattttagtccctaattctagaccttacccattttacacacactattagctaaatcgtgttcctgaggcatggctctgattactttactctggctttagccttggcctcatccgttaaattgaaactgttcaccagacctgtatgcattaaaaatttttttattagaaaaatcagtgtcttgctagccatgtatgatagctatcaaattgatcattctgtaaatggtagcaataagtgtatcaacactttgacctcctctgtgtctagtaacatttgcatatagtacaactgagcacatagcaccagaatattggaacagatgcttctccaaagccaagggttgccttacatttagagtgggaaaagaggaaaatgagttagcagaggagcagcggggaggggggtaaattacaggacataatttgcttctaaaaatttgtgtttcgtgttgtagttatataattaacttttctattgtactgattgacagatttggcacagacatcctctcattgtgaatatatatgaatatatcagagttttggactctggggtatatttacataaacacaagtattctgaaagcattgataaccacactggtgtctcttaattttgtctataagatgaccttataaaatccctcaagaattatttaaatcaagtgtacgaagctctgcagttttttgttatgtctgaaatattcattaaaaagtttattaaacctgacagcctcttcttaatgtttcacaagcaagacaaacttttatttttgtttcttctttaattggcatatggagcttgggaatattagtaggagaacaaggagactatgtgaggcatataaaaggcaccacactggaaagaatccaagagaatgaaaaatcacttctttaaataatatttagacacagactttgtatctatattagatataaatcatgtctaaatacaaatctaaataatatttacaaataattattacacaaaacctatgtaacacacactttatagtacacaactgtaaataagaatacaaatctccactgctgtgggttcaaaacagcaggcttggaccactcaaaaatgacatctgagaggaattaatagtcatcctgaaagttctgcagacagacgctagcggacaaaccactttgacacttttcatgctatcattcagaaaaaaatagaatacatgtaataccaaattaggaacactgataatgaacatatatgcaaattatatcttccaatgatatatctgtgatatatgaaaataattttgaagaaataagcttaaaatataatttacggaattccagaaaactttttcttccttcactacatcctcaggaataaggcaattgagtggataacagtttgaatcttacttcaaagtgtagctacaaagtaagaaaaagcactgggccaggagtcagaatatccaggttataatcttgattctttcatgaaacagctttgtgacactgaaggaatctactaaattctttagatttaaattgttcttgtctgtaaagctgaaaataagagagaactgggctaatctgtagggttcctttcactccaatttctaccagtctttttctaaatgggatcatctctaacaaaaagttacaatggtgtgtcagaacatcctgtgactgaccctctgtttgctgctttttgatctgatgacagatggcttggagatgtatcaacaacataattgggagtagataagctggccacattgatgaatgactgagaggagactgcaaagaaataatataccgtttcatttgccccttaacacaaagatgaatcagcctgtggatggggtcaattcactgaactagaaaggattgattatatatgcataaagtgcaaaagctataggtctttatagccatatctgctcacacatatattcacttttccatgctagttattcaggatagaaggtgcattaaatttataccaattcctagctactggcctagtaactaacaatctacagagttgtaatgcattaataaatataggattatagaagacatttagtatgtgatgttacctttaagtaactctcataattttctttttcctttttttcttttttgagatggagttttgcttattgcccaggctagagtgcagtggcacaatcttggctcactgcaacctctgccttccagtttcaagcaattctcctgcctcagtctcccaagtagctgggattacaggtgcctgccaccaggcccagctaatttttttgtatttttagtacagacagggtttcaccatgttgttcaggctggtctcaactgctgacctcatgatccacccatctcggcctcccaaagtgctgggattacaggtgtgagacaccgcacccagcccttaactgtcgtaattttcaaagtagtttcatctactttccatctcattccaactctaaaaggtagtaaggactggaattaacaactccagattacagatgaagaatctgagactcagaaagataaaggagcagctttagtgtcaaaaggtcagaagtttgtaaatgaagaagctgaaggtaggcccagatgtgctaactgcttgcccagcgctctttcaaaatgccaccttgccatcttacaatgcattatgctggtaatagataccctgtggatgtatctgtatatcatatcatcactgtcagaaaaacagcctgaggttctcttgaatgacttaaagctgacttccaggctgagatgcggcactgttaagggacaatgagagacccacacaaatgtgctgacagcataaacaaaaacaattttcaccagtacctagtatggaaaggattgctggcagcaccttggcctctaccaccctacacacacctataaagcatcagtcagtcccacctcttgactgtatgctttgagaacacgattaaacaagtctgtttaaaatttcttttttaaggaaatcattaggtatattcaaaagggtcatccactgtattgtttagaatttaaatgtactagaatttttctgtgttctaatgtctgatcaattctaaaatgctagtcaattaatggtcatccattttctttttttaaaaaatgtggctcaactacatgcaatgtgctgagccagttttggaatccaccctgtagcagagtaaaactggaccaaaggaagtggaatcagggcccctgactgtcacttctccagctacacaacctacagtttttcttctttattgtgacgtgtggtgattcgttttggattcctctgtatgacaggcaggtctgaccttgaggaagactggtagcccacatcctctgcttttatgggcttaatgatatggcctggcttggtgacgaccttgggagtagtcagcttttggaaagccctctgggtgttccatgtggatcctataggggtctggatggtcctttcaaattgccgatggtgggtaaatggatatggaagcacttgtacctgatgagctgctgcgtggatgttgcgcttctcactgataatcacatttggcaaattcttatcttttcttggaggaccctcaggggctttaatgagaaactggcgtcttttcttggcactgggctttaggcccacaccaccccactcgccccagccaggtagtgtcaggtccacgtcctttggcttactcgcctccacagcttccctcttctctttcaagaaatctctgatgacatcatccccagcaaaagcttcctttatcatctgcctttggtctctctcctcttcatcttccagctcctctattattgtgggaactgccaaagacctcacggaaggagactgtgtggtcaggaagttctgtaggttgatcagttgctccttctctttcttctccttaggggcatcaggccgattatttggggtcctctctgactgctgtccttctaacacaggtctgggaagctccttattttgaaaacaatcttcttttcccagctcttctagctcttccagagtttgtactctctctgacctctgtagcaataggggttccgcttcttctggggcaggttcctctctctggacctggggaacagtcccctctgaacttgctttttgcttcctggactgatgtttttccttcaatttctgagatagtgccctcaattcggacagcacctcctggctgctagaatcttttgtttcttgactgcttgctggctcagcatcctggttgagctcagatctttttctaagggattgcctttcctcaaattctctcaacaaaatttcttcctctgccactggtctttcttctgcctcacttgcagaaacctcatgagctgcaagctctggcacttgctcagggtcctcctgtgttgcagcctctttggtgtcactggtgcagctcctgaacatccagggattcggtccgtccacattcatctgcacttcattcgctacatgagggacaaggagttcttccacttctgtgcctccctcctcttcctcactctcagaggctacctggagtttctgtgtcagttctttgttcttggccaactgttcctgcatagcttggcgagcctccaggtcatatttggccataattgcctttgacttggcccatttcccactgttttggtgcttaaggctcattctttccatcattctggcattttcaattttttccatttcttccagtgccacagttggattaaccttctgtagctgctcaaactcttttaaggctttcttggcctttcctttcttcacgactttgtgatactttttacttttgattttcttctcttttcgagccttggcctcatagtaggactgcagagcccgagccctctgaagctctgctcggtgcatctttgcctcttccaggctcatggcttggagagaggccttttccatgggagtcagtaaaggatctgtcactggctgcttgttcttatggaggaggttaaaaatttcctgctccaggggagttcttgccttccagccactgagcgcatgttcaatgggagcaatggctggctgctccttccccaggggaaaaaccagctgctctgcctgctggttcttcaggatgatagggtcccatttggagaggacctgtgaggttttactgaatgctacttctctgtggatctgttcaattttttctttgttaagaggtaactccaccaccttctttgatttgactctattcagttgcttttttacagtggccaaagaagatgaagttttaacgggctcaagcagatctgcaaggcccagcttttctcctgatccttcagaactgacactgaactctgacactttcagactagcctcagacctctcagccaatttccgcctattctttccatcaagggaaatgattgcttccagaagcttttgatgctttctctctccatcactgtccccctcatcttcattttcactcaaggggtagttttttggcaaatccactagttcttcctggtggctcaaagccagattctctgcaacctggttcacattcatctcagcagccagcctctctcatgtataccaagaatggaagccgaaggctagtcatccattttcttttcaacacttccttttattctaaaaggaaattttgtctgttttctaaagtaaaatgatttgacaaatgagattgaatttagaaaaatatttacatatgaaggtgtttaaccagtttatataaaatatctttaattttacagatatggcattacttaaataacttttccacagatgataggaatgtcacttcaaattcctgatcagagaatctgcttacagatgcacgagcactttttctgatttggagtctcttttctgcagacatggaaagaatgtgagcgatagtttcagcatagtcttcttcactctcagccagaaagccagttatatctccttcgtgaggaaccacaatgtcaagctttgggccccccgaattgtgtgcaaggataattgtgccagctgccatacactccacaactcctgagaaaaaaaacacaaatcatgtaatcttttaagtttttgagtgtgttcataagaatgaggatgaatagaaatcttcaaaaaatttaagggacttatgagaaacttaattaaatgtatgtctagacatttgcttattcaacttctacagtacaagataaaataattttaagttttttagttttcaaagcttcataataatactgcttcacttttttttttttaagagatagggtctcactatgttgcccaggctggcctctaactcctagcatcaagtggtcctcccatcttggcctcccaaagtgctgggatttaccagcgtgagctaccacacccagcctgctgctttattcttagttaaaatagacaagtagatggaagactagcctattaaaaaagatatattgcagataattaaaaaagaagactagagaatgttagcaagatggtagaatattaacaggtattagaaaaacaaaaggagtaaaaacatataaaaaacaattttaatagttcaaattacattagcagaaaaaataaaaaagtgaatcacctaagtgaagcatactatcgccgtgcttatgttactgcctggatttctggcatatttgagactactgcatgcccaacaacagtgctgaactaaatgaaagttgtggttagtttctgccaaatgatacacatgaaatataaattactctagccagcccttcttagccatattcctaggagaattaagcccttcagggaatgattcaagtgactgctttcccaattatctgaaggatggtacagagctgatatcatcctggatgtataggagagaaattaaatcattccaaatgtttttagaactggtgaaatccctgcagaacagaattcagtagctcatatcatattctgcttgaagctggagagcatcctgtactttctcagagacctgcatcttttaccctttccctctctactggctccttcctatcagctaggaagctagggcaccacatgccctttctcaggtcctgcaacacccacccctagccactgtctcttctccccctccccgtacttcacagataaacttactgaaagtgtggtttgcacttaccaactctacttgttcacttctgagtgcttgacttttgatttttgctcatagtctgacttttgcttctacttctccctcaagactgctcttgcccaggtcaccagtgactgccttaccttccccagcatctgggcagcatcggaatctgtgccctctccattcttctccaaacactctcttccttggtttctaagacactgcacttggatggctttccccgcctctccatttcttctccccatttctcagctgttcctgttctctgcattttgtactgagagcctcttttcactctgtacatattccccaggcgatcttaaccacatccacgggagctttgataactacctgcacaaggacaatcctcattttttatttccagaccagactcctctcaacttcagactcctatatacaaaactacctcctggacgcatgccctcacatgtcccacagatgaactcaaattctgcaggttcaaaacttggctcattaatggcatttgctcttggatttcccctctgggagaaagccaacaccattctcacagctgccctgctcccaaaaccctaggtagtcttctcttcctccctcatttaacacatccagttaatcaccaagtcctggtcaatactactgcagaatgtttctcaagcatgttcacctacgaagttcagctcatgagcacctccatctgggctgctacagtaggccggctcatcttactgcccttccagtcttgctctccctgctcttcactgatccactccccatgtggccagaatggactggagaaatcagaaagcttttacgtgcaatacttaaaatcctgctatttttttccactggcttaacctggcctatatcacctctctgttgtcttcctgctgaatgttcctattgatgcatctgttgtcactcctgtcacagtgctgttccctctgctggagactctcccctctctcctggctaacctctattgttcgggtcctgctcaagtgtcacatcatttccttgggcaactgttccctgcccgcacaagtctgtgttaggtttctctttggcgctttcacatcaccctgcacttccttagcatagcacctggcacacggcacagcacggcacggcacttgcctgtgtagcctgttggtaccaccagagggtgggaagcctctgacaggccaagcagctcctgtctccaccacatccctagcatccacccaagcgctcagcagagtgaatgcttagtaagtttctatggaaggaagcacaggaggtcagatcccatgcaacaggttgggtcaacaagttcttgcttaatgtctgggcctagcactacactactaactaggagtaaaaagagtataagagaaattgaagtcttagtttaggaaatgtcacttttatgttatcctcatttcccctaacaactaacagtgtgaggcacaaagcgcttgagaaatatatgtggacccaaattaaacacaaagcagtacttgattttatagcaaaatgtgtgcttaacaggtcagaatagagatagcagtttgtgccagaataaacaagaaaggctaaagtgcaaggagatttaagttgaagacttatgatgcaatctggcacaaagaggagagccattccaatggtgagggtagaatcaataaaagactaaaagagttactgtgagaagcccctatgcaaacagtggttctcaacttttgatgcataacagaatcacttaagcagcattatcaaaatacatctacctgggccttgtccagagattctcatttggccattctgtaggattagggtagggcccaggaatctgtaccagtaagtatgtagtggggttagatggagagagaaaatgttgctgttaagagcaggggctatctgggttagaatccgggctctaccacttactgtgtaactgaactcgagcaatttctaaaccttcctgtgcctgagtttctttatttataaaatgggaataacaataacacctatcaaacgggtttagaaaggcttaaattagataatacatgtaaaaatctcaacacagtggcccacacacaggaattggtcaataaatactagctgctattattaactactatcttacaaggtctcaagtgaggaaagcacatttggtggatgagggcaagagaattagggcatgatgcagatttccagagtattatcattttatcaaaagaacttaaaatgtgtatctcatggcaccaaacaagttgtttaaaggccaaactcaccaatcccaaaatgctcgttccacatggtatgcagaccaattgttgcttcagacaaataattctttaattcatcaaatggaatgtttattttaaattccacatattcttgaactcctaaatcctcagacagccttctcagttggtttaccctaagttcatcatctttgttacgacaacctccaatgaggacaagtttaagcgaaggaggtgactcaaccatcttcttattcagcaatttagcaaaggctctgatctgcaatggatgattcttttccggcctaaactggccaacagaaaccagcaaatgtcctggggtcatctttttctcatgtaagggaatgtccagaaatgtctgcacatcacaaggtggataaacaatgttagtgcaattcccaactttccatagtgagagaatatggtttagtgtccaagaagaattgaccatgactacatcactgcaagaaccaacaagtccataaataaaagcaaataaatagtagtagatgagctttactttgctgagaaaaggattcctggtaatgaaggctgcattattaaatccaatattttgattcttcactacagagagcatgtcggtgctgatagtaggataatgaacatagcttccaacttggcaaccccctatatacttaaacagaggaagcgtaaaagcgtatcccattgaatcaatgtaaacatcaggaacacactgcattagagcttcccagccaagaaaaatggatcctagactttggcccagcagtgtgaagtgaggatacagtgaatcttccacaagatagcgtttccttaaaaaaacaaactgcactgggtgaattaatctgatgttaaatcttctgaaagcaccttctagtatctgttgaccgttgacattaacatcgccggtataaacaacataaactgcttcaggatacctaaaatagaatgtaatggttaagaatatattaagttacaaaaattagccagacacggtggcacgcacctgtaatcccagctactcaggaggctgaggcaggagaatcgcttgaacccaggaggcggaggttgcagtgagccgtgatcatgccaccgaactccagcctgggtgacagagtgagactccatctcaaaaaaaaaaaaaaaaaaaagcctgctacctaccctgagagactgagagccgagactgcatcactgcactcctgcctgggcaacaagtgtgaaactccgtctcaaaaaaacaaaaacaaaaacaaaaaaaagaatatattaggttaaaatcaagcaaaaagttgtagataactattttcttacagttataaagaagatttgattttttttttttttttggagacagtttcactcttgttgcccaggctggagtgcaatggcgccatcttggctgacaatctctgcctcccgggttcaagtgcttctcccgcctcagcctcccgagtagctggaattacagacatgcaccaccacgcccggctaattttgtatttttagtagagtcagggtttctccatgttggtcatactaaaaatgatgttttctacattttttattgaattagaagtacagtccttcaaatgagaccatgacttctagttctttgctatttcctccactgagggtttcacacagaacaggcatcaacagtaagtgttgatttatgaatgagatggtctaaagaaatactaaaaagttttgacagtgttcttagtaaaaaaaatggtaataaaatactataaacaagaattaagattcaacaaacctgtcttcagataggatcacaatactaaagcaatactcagggtttttatctgaaaaatgcaagtctttaaaagctagatcttgtgcctatatcacaattagatataattagtatgaaaatatctaaaagtatattctttaatgacttgtaatactttggtctccctctgtttataattattctttgagtcataaaacatttattggctgggtgcagtggctcacgcctgtaatcccagcactttgggaggccgaggcgggtggatcacctgaggtcaggagttcaagaccagcctgaccaatatgtgtggtgtggtggcacatgcctgtaatcccagctacttgggaggctgaggcaggagaattgcttgaacccagtaggcggaggttgtggtgagccaagatcgcaccactgcactccagcctgggcaacaacaatgaaactccatctgaaaaaaaaaaaaaaaaacaaatttattaagcatctagtaatgagatgccaggttttgggggtatggagatgagagagagtctttatcttcagaagttcagtccagtggagaaaacagacatgcaaaacaaataactgcaaaactgtgtgctacgcattgataaagacacccacaggatgctggggaagcctaaaggatgacaatctaactgctcctctctggccccttcccagtcactctttacccagcagcaagaatgagccttttaaaatgtgaaaaaagattgtgatctctggtagcctaaaaatgcccacaaattccatttgttttttctttctttttttaagacagggtctcgctctgtctgtcgcccaggcgggagtacagtggcgtgatcttggcttattgtagcctccacctctcgggttcaagtgattttcgtgcctcagcctcctgagaagctgggattacagatgtgtgccaccatgcccagctaatttttgtattttttaagtagagaaggggttttgccatgttaaccaggctggtctcaaactcctggcctcaagtgatctgccagacttggcctcctgaagtgctgggattacaggtgtgagccactgtgcccggacgggccacaaattctttgatacttttctcactgagaggtggcatctaagtcccctcccctggaataacacctggctctgtgactattttgaccaacagaatatggcaaaagtgacattgtgccagtttcccaacatagactctaagggactggcagctcctacttcctgtctcctggaatgctcatgctaggagaagacagctgtcatgtacggagtccaaccagcccgagattgctatgttgtatgcaagcacaaccaagtcacatgaagaagctcctcagtgagagagatgcccgacagcccccagcaggtccagttatcccagcccaagaaccagaatgtgagtgaaaaaggcttcagatgcctccagccccagctgccatctaattgcaacagtatgatggagaccaaacatggcagcccctaaaccatgtcacagaacagtaaccccaaaactggtttactatagcacttagaataaaatctaaactaatttccctgctcactcaagtcctgtgtgatctggaacctgcctccctctgtcacctcccttcccatgctctcctttgccctccagggtgcagccaaactggcattctttttttttaacacgccaagctccaaccagccttaggggacttgcagtggttgttctctctactctgaattctcttttctcattttcactgtcttttcataaggcaggcagtttagcatgtggttcagaacatgggctctagtgccccagttttcttctttgtcaaatgaggataatggtaacaactgcaaaaggctgttctgaggatcaagtgagctaacacatgtaaagcacttcaaacaatacctaacatacaatcatcacgcagtgaatgcagctgtttttgtcattcagattttgattgttatcagatatttccctgatcactctatctaaagtatcaagtcactcctatattaccctattttaactttttatatagcacgtctcactatttgatatttttcttctttgcttattatcttgtctctctcaactaaaatcaaacgtccaggagagaaggacttgatcgatcttgttctcttaatctcaacccccagaacagtgcctgacacatagcaggtccccaataaatactgctaggtcgaatgaaaagtgcactgtagtatgtgttgagttaggaaaggcttgtagaaattaactggggagaaaaaggttatttcagaagaaaagaacactatatagaaagggaaggactcgagagagagcatgatgtgttcagggagctgctccttgttctgcatgtcagagtaaagtacctgtgaaggaatggggagggatgagaaacgcaatgtggccagagcaagatgaaaaagtatcttccaagtcatattaatgatttggtttttttctccttgtagatgggttaggagtaatagaggctgctggggactatgtgtacagatatcatgaaactttaccaccgccatcaagaggtagataatctggttagagaagaaaaaagtattatcaacgagagtaggaaaagcatcacggagttgggaattatgagaattctttgtatttaggcagttacagaagatggcagagcaaatacaggggtagggcctggaagctaggatgggccaggattacagaaaagtatagctgaggtaattctgtgtgaaggccttggcactgaatgaagggtgtgtaccaggaagtagggtaaccatgaagagtaacagttttcctcatatgataaaataatggaacctactatgctttttcctttctaaaagagaatcataaatattttgggggtatggggggtggtgatgacgaagcctcaaatattaaaagatgtataacaccatattccttctaacatggtaagttgagactatccagctggtaatgatataaaaatttgagtcaaatagatactttcataaagattattcctgtgtgccacaactgcctgaaagtattcaggcttaaagtgctctgacatacttggtatatttctgtcaattacttaatctcttctgtatatgctctcccaaggggaccagttattcccattaatttatgccataaaagggcagatgttttccccatccactgtccatttctttctttcttttttgttttcccttgagacgggttctcactctgtcacccaggctggagtgcagtcagtgcacaatcatggctcactgtagctttgacttcccaggctcagtcaatctttccacctcagcctctggagaagctggtgcgcatcaccatgcccagataattttttgtagagacagggtttcgccatggtgcccaggctggtctcaaactcttgggctcaagtgattcacctgccacggcttcacaaagtactgggattactggtgtgagccaccatgcctgggtttgtctatttctttatcatagtaactaaagtcaaataagatcatataaggtatgtgggcacatgaaagaaatattttcttattgaagaacagtttaaaaaggaattcattttttactttaggtactttagaaagatgaggccgggcacggtggctcacacctgtaataccaacactttggaaggccgaggtgggcggatcacaaggtcagcagatcgagaccatcctggctaacatggtgaaaccctgtctctactaaaaatacaaaaaattagccggacgtggtggcgggcacctgtagtcccagctactcgggaggccgaggcaggagaatggcatgaacctgggaggcggagcttgcagtgagccgacatcgtgccactgcactccagcctgggtgacagagtaagactctgtctcaaaaaaaaaaaaaaaaaaaaaaagatgaatttctggataataatttttaagaaatggaacaatatagcaaattagctaagaaagatggatacctactttttctgcagggctcttaaagcacaccataaaactctttctcctcctccaccagcattgcagtatggatgaaaaaatgcaatcaccatttgatttttcccatttttgctagttgacactaattttttctttctctgtagcagcagtctgattccccaaaggacaatgaccaaacacacacataaagttccacatacaatgagcccagggaagaataatgaataaaaaaacctgaaataagaggacaaagttgagaatcaatgtgatatatacattaaaaaaattacaaattaaagtctgcttttacatatctactttatatattagtaacaaagagagaattgtctttaacgagtctgctaacaaaatactcaagtatgaaaattctaatgctgctaaatatccaacattgaaaggataagtcccctttagttccaattcctgtagcatgttaccaattgaacatactttaatcagcagtaaaaatcaacattgaaccccctttctcctgacttagtatatatgttatgggattaaaacaaatttaactattaatctaaacaagacatgattaagaatgtgttatatactgtcattttgagggtcagatgccaaaaaaaatatgtcttttgaacgatcaatattccactaaagtctggtaagatagtaaatctttttcattccatcacttcacctcaagtagaacaatttctgggataaaggaatggaacttagatttctccacttctatttccagttctgtatttgctctatttacatgatctaatactactaccttcccttatgtacctctgaatgagctgccaaaaacccactaatgttctacttaatactcattagtaaactcattcacaaagtgactgttaaaaggttctccattgctgtcaggtcgattgaagctctgcaaaagcaagggcccaggcttgctcataccatgtccccaatgccaagtacgatgcctggcacagagaaggcatccaatgaatatatgacggatgcaaaagtttattacgtcttcagatgttgcttaaaatgtgttaaaataaaatgccaaggtgcttttcttttagggttgccaatacagttggaatctaacttaatatttttcatactctgcctatcctttataaaggatttgaggagggcttataagatttaaaaacaataaaatgccaaaagttaaataataaaaagtcaggaccagtgaaaatagaataaagatggtgtgtatgttgggatggtggttgatgatggacacaggtatgcaggctgtatttacatacatagtagtgaatagcagactgggctctgggctgctcagtagcctaggcaaataggggatgttttgtgtagttacacagtgtattacttcgttttcacactgctgataaagacgtacccaaaacggggaacaaaaagagatttaattggacttacagttccatatggctggggagacctcagaatcacggcaggaggtgtaaggcacttcttacagggcagtgggcaagagaaaaacgaggaagcagcaaaagcggaaacccctgataaacccatcagatctcatgagacttattcattattatgagaatagcatgggaaagaccggcccccatgattcaattaccttcccctgggtcccttccacaacacatgggaattctgggagacacaattcaaactgagatttgggtggggacatggccaaaccatatcattctgccctggcccctccaaatctcacgtcatcacatttcaaaaccaattatgccttcccaacagtcccccaaagtcttaactcatttcagcattaacccatatgtccacagtccaaagtctcatccgagacaaggcaagtcccttctgcctatgagcctgtaaaatcaaaagtaagctagttacttcccagatacaatgggagtacaggtattgggtaagtacagctgttccaaatgggagaaattggccaaaacaagggggttacagggcccatgcaagtccaaaatccagtggggcagtcaaatttttaaagctccaaaatgacctcctttgactccaggtctcacatccaggtcatgcttaagcaagaggtgggttcccatggtcttgagcagctctgcccctgtagatttgcagggtacagcctccctcctggctgctttcatgggccggcgttgagtgtctgaggtttttccaggcacacggtgcaagctgtcagtggatctaccactctggggtatggaggacggtggccctcttctcgcagctccactaggcagtgccccagtagggactctgtgtgggggctccaaccccacatttcccttctgcactgccctggcagaggttctccatgagggccctgccccggtggcaaacttttgcctgggcatccaggcgtttctatacatcttctgcaatctaggtagaggttcccaaatttccattcttgacttctgtgcacccgcaggctcaacaccatgtgaagctaccatggcttggggctttcaccctctgaagccacagcactagctctgcattggcccctttcagccacggctggagcagctgggacacagggtaccaagtccctaggctgcacacagcacagggcccctgcacctggcccacaaaaccactttttcctcctgggcctccaggcctgccatgagagaggctgccatgaaggtctccgacattgcctggagacattttcccccatggtcttcaggattaacattaggctccttgctacttttgaaaatttctgcagccagcttgaatttctcctaaaaaaatgggtctttcttttctactgcattgtcaggctgcaaattttctgaacttttatgctctgttccgcttttaaaatggaatgcttttaagagcacccaagtcacttcttgaattctttgctgcttagaaatttcttacaccagataccctaaatcatctctttcaagttcaaagttccacaaatctctagggcaggggcaaaatgcctctagtacctttgctaaaacataagaggagtcacctttctccagttcccaacaagttcttcatctccatctgagaccacctcagcctggatttcgttgtccatatcactatccgcattttgttcaaagccattcaacaagtctctaggatgttccaaactttcccacattttcctggcttcttctgagccctccaaactgttccagcctctgcctgttgcccagttccaaagtcgcttccacatttttgggtatctcttcagcagcaccccactctactggtactaatttatggtaccaagttcattttcacgctgctgataaagacatactcgaaactgggaacaaaaataggtttaattggatttacagttccacatggctatgaggcctcagaatcatggcgggaggcataaggcacttcttacatggtggcagcaagagaaaaatcagaaagaagcaaaagcagaaacccctgataaaccccatcagatctcgtgaacttactcactatcacgagaatagcatgggaaagattggcccccatgattcaattacctccccctggatccctcccacaacatgtgggcattctgggagataaaattcaacttgaggtttgggtggggtcacggccaaaccatatcacatagttttcactgcccacatgaaaacatacaaattcatcagaaaagtaaattttgctttttttagatacagggtctcactctgtcacccaggctgaagtgcagtggtgcaatcatagcaatcactgcagccccaaactccttggctcaagcgatcctcctgcctcagactcctgagaagctggaactacaggtgcatgccaccacacccagctaattaaaaaaatgttttttgtagaaatagggttttgctatgttgcccaggctggtctcaaactcttggcctcaagtaatcctcctgccttggccttccaaagcattgagattacaggcatgagctgctgcacctggccagaagtaaatattttattgatatttagttttgacataaagttctcatgtgggatttcctattgtgaacaaatcctcatttgttcctattgtgaacaaatctcatgtgggatttcctactgtgtacttgaagaggtatttgactctatttgaaatcccacatgagcactttatttcaaagctgaaataattggtctaaaataatttggtctttatattctttatacacctttatactcttaaaaattttactgaggatacaatagagcttttgtttacatcagagtttctcatccttgacactactgacattttggaccaaataattatttgttgcggaggttgtcctatgtattatatttagtagcatctttggtcttgacccacttagatgccagtagcaccctcccaatcaaaattatcagttgggcatggtggctcatgcctgtaatcccaacattttgggaggctgaggtgggaggattgcttgagcccaggagttcaaggctgtagtaagctatgatcatgccactgcactccagcctgggcaacagagcaagactcttatctctaaaaaaaaaattaaaaaaaaaaagccctccagatattgccaaatgccaaatgtcttgcgaagggcaaaaatcacccctggttgagaaccagtggtttacactgcttatatctaccaatatttagcatattagaaatgaaaactaaagaactttaaactttttatgaattcatttgaaaataaaaattctttcataacacattaacatatttttattaaaaaactatcttttccaaaccaaaaaaagaaatttagcaagaagggtgccaatgatttacactttttgcaaatctttttaatgtctggcttaacgtgaaaccagatagtggctcctcctttctgtttctgcattcaatctagtgatatgttgtttttgttgaagtatatgaagaaaattcaggctaacttagacatgtagtaggaaaagggagtatattttaatatatattgatcttatgtttaaaatatatttaacttttcagctagttacagatattcttctctgatgctagaccacatttgacaagttatgcagtttcttaatgtcagttgcaatacagactctgaaaccctatcaatgaccttttcacactgttaattaaaatccactatcacttagttttatccgctatcacttttgcacttatcaacatagtaaaataggcaaatattacattaatgttattataaaaacagatttgttgaggatccattgaagggccttgggacctgcatggtccatggagcacaatttgagaaccactgccttaaaggatgaacagagtctgacaaaagtggtaagatttatcatttatttaacatttggaatatatgaattcataaaagcaacactacagaggacagtttgctttctcaggacactctttcaaaagcttatttaaaatgcagctgacccatataatgtaaaggtttttctggcaattccttcaaataatttaggtgggaaaattcatgtgacaagcttttcaaactgaactattaaacatttaacttaaaagctgcataataactaaagttaaacctgtcctttaagtctggttagtgagtttatttaaacattataatgtaaagcactgaggaatattacgtatgacagggaagaaccaaaaggctctgataacagactttctcattcaaaatgtttaaagtaatgattacagaatttgaagtagagtggacaaaaacgaagaagaaatgcctgaacttttgaaagaattaggtatatactgctattcaggaagctatggtgttaattataaattttcagcctgaacaaaaatatgtaggtggtaaaaaaactaggtaggtagaatatactaggccttctgttttattagtggagggcaaggcatttaaaatacagtagtactacaacaacaaaggtggaaaaaagcctgggagttttttcaccaaaatgttaacagtggctatctccggatggtagcattcctggggttttttccttttacttatctattttctaatttttctagaagaaacagcatatacacgtaatacaaataaaataatattttatgtaacttcttacatcataaaaattaaagtaacagattatcaaaaagcagaggattcaacataagctttatatttaagtgacgtgttaacaatggcagttttggtgagtttaagagtagaaactaagatgagaaggaagatccggtttcttctttaccgaaaagagacatgatagattggaaaatgtctcgtggctcaatcgtaaagaaaaataaggaatgaatatgaataatttatgacagactaactggagtgtgaaagggaaaaaaaaagctgaagcagggaagggaactcgacccctcggccaacagtgaagcagaagaaaacgcggtaaattgagtctttaagacctagtctattccagtctatatagaagacccccaagaaaaagaaagactgctcattggcctgagaaattaccttagattcatgacaaggaaggccatttgcccgcaaaatttagctacactggacgggcaagtacccctacagaagagaaaacgtctgtgagcccacacgaccggctgctcacctcaacaacttgcacaggcaccagctcctttcgccggccgccatcttccgccgacccccgaactcaggaaacgcttcactttccttttccctattggctcctgagaaagcaagccgtgctcgccccgcccccacgggccaattgtgcgttactattggttactggtagccgcttcccacggccttccagccaatagaatatgccgaggcgtagactagtgttcggcgtggcgcacacggctcccgcccccgtgggcgggacagcagtggggggttgggctgaggagggcgtggcctgtgattgacagccgtcgctccctccctcggccacctcccccactagaagcccccgcctgggcgcctgcgcccccgttcccggcccaaagcccgccgcccgttggaggccattggctggcctttgcgcacagcggatcgattttccaggtgcggagttcactcttgccgcggttgcttcctttgggacccacggcgtccggcagccaggcgcagagtccgaggagggggcagcgcagagcggacccgacgcggcgccgccgggcaccttccccgcaggcggtgggtgagccctgggagctgagtctgcggcccggctctgcgcagctcacctgccctcccgctcccgcacacgcgtgagatcccagtacagtgtcggagcgcaccagcgcgaggtggccgagaccgcggaggaggacaggcctccgccctgcggcgccggcacggcagaggacattgtggcactggcacggcagagaacactgtggcaccggcggggccggcagttccagggtgggcactcccagccacctggggagtgggcgagggtccgaggcccactctcccctcacgctctcatccccgtgcccccaggtcgggaggacggcggcgcgcaactttgaatcatccgtgtgaagagggctgcggcttccccggtcccaaatgaaggggcggttcccggacccctgtttgctttagagccgagccgcgccgatgccctcacactctgcgcctcctctcccgggactttaacaccccgctctcctccaccgaccaggtgaccttttgctctgagccagatcagagaagaattcggtgtccgtgcgggacgatgcctgagcaggagagacagatcacagccagagaaggggccagtcggaaagtgagttttgttcccccgcgtccgcgcagcgtgctcactcccaccaggaggattttcctccccgcgttcggcgcttactcgcccccagggggtgcgcagggaaggccgagccagaccccagctccagggatgtcttggcgtgggagaaaaggaccctttagaaaaagtgtgccgtcaactgatgtttgggagcaatggaaaaccccgcacctcaaaattcatctttatgcttttaaggggtctgatgctggagagataaagtgagcgtcgagttgctgtgctagagccctaatggctcaaaacgatgaagttagttacctggagaagttactcagagcctggtgcttggaccagatatggtatatcgaggtcctggaacttttataactgttttaaattcattttaattgtacaagtaatacattaagacagtcttttaaaaatggaaacagcacagaaatattttgcacaaaaagcagatctatttttcagtctttttctattcacgtacatatgtcttcattcggcaaatatttattgagaactttctatgtttcaggcacacagtgttgagttgatacagtggttaacaagacatgtatctatatgtaatatgcacacattcagagaaatctttaggtttcatttgtatgaggtgttaaaatttttgttttacctaaatgagatcactgtatgtgcattctcttttttcagtttaacgatatatcttagagattgtttcactaactgtctaattcagtgcaacctctgcacagtttggacgcatcatagtttattcatggtttcctagtggtggacgttctgtttgctactttttttctctctctcttgcaagtgaacatctttgtacatgatttttaatgctgacactatttctttaggatagatacttaggcctggattgctggacagaacagtaggctgtttcttttccacagatttctgaaactaattcactgacgttgctgggtgccctttagtagtgaattcatctaggctccggtgatacagaaatgaaaactaacggattagtggacagacagagagaggctggttagtaggtggtttgtagggtatgatgactatgcatttgataggagtatgaagaaatgttgggaggggtggcttgtacagaggagatttcaacttcctacagtgtccccacctagagaaagaaatcattatccttccaaatcaagctcaagacctgccacctccttgaaacgttctgtaactgctcctgcccatgttgacctgtcttctggaatcctctgataatagcgttgaccagcgttattgagcttactgtgtgctgggcattgtgttaggcactcatatccctctatgtgcactctcgcgtttaatcctcacaaaaaccctttgatgtaggtattatatcttgttatcaacatttattcaacaaatttttttgtgtgtactatgtgctcaaacacatagtactcaaagttttagacactggggatttaggtaggaccgagaccttgccctcatgaatttacatcctagttggagataggaaaaaaaaagggataaacaaatgtatagcgtaggagttaagggaaaacttttgtgccccgtgaagcgtcactgaaaaatcaactgacaaatggcagattaataggagagaaggcatacacatttactaacgtgccgtgagagtcttacaacataagatctcaaaggaaggcaaggtggttgccacaattatactatcctgaggttacagaaagtgtgggggctctaagcttggccaaaaacaggttatggttgtaaatcaggttataggagggagagaagaggagacctggctagcaaaggtggtcttatgtagatgaaacctcacaggtagcagccctcagggagaagaaatgtttcagaccttgaaggtgccaaattcagctaatctcacccagatccagacaaggaagggccctctgagaaaaactggctgcgtcaatggaggttctcaacagatgctcatctccctcacagtaggactacttttgtctgtaggccctctgaacggccatctcaaaatatttccaataagtctgttttgaggtgaaatgttttagtttccttcaatagctttatttcaggtactagtaagtactatgaagaaaataaagcagtttgggtccaggagttcaagaccagcctggcagcatatcaagacatcgtttatacaaaaaaaaaagaaaaattagctgggcataatggtgtgtgcctgtcgaaccagctactcgggaggctgaggcaggaggatggcttgagcccaggagtttgaggctacagtgagttgtgatcccaccactgcacttcagcctgagtgataaagcaagatcctgtctcaaaaaaaaagaaaagaaaagaaagcagaataagggaataagatagggattgacatgggtggagaggaagatgctgttttaagtaggtggtcagggaatgatttctcttggaaggtaggatttgagtagagacctgaatgattcagatttcagagaagtagcctaggttgagaaaccataaagtgtgagagtcctacggcagtcatgtgataagaagaaatatatacttggtcttgtcccaagttcctgacatagagcttcttaaaccgttgtaatttcctgagagatggtgataagagcatcttttgttattcataacaagtctctttcacccctacctgagtttctgttaatgagagggctcttgataggcccctagatagcttcaggatggagactgattgccagaagaaccaaccatgtgattaggggattcgaatgttcagccccgtgctccaacctctggagattgtgccaatcaccagtggacaatgatctaatcagtgatgccggcagaatagagctttctttaaatttttatttatttagttttttgagaggtagtctcactctgttgctaggctggagtgcagtggcgggatctcggttcactgcaacctgtgcctcccgggctcaagtgattctccggcctcagcctcctgagtagctgggattacaggcgcacgccaccacacccagctaatttttgtatttttagtggagacggggtttcaccatgttggtcagggtcatctctatctcttgatctcgtgatccgcccacctcggcctcccaaagtgttggaattacaggcgtgaggccactgtgcctggcctttttttttttaaccaatgcagtggatcacaaatagagctttcttaaaaaccctaaatgatgggttttggagagcttcctgttagtgaacacatcaaggtgctgggaaggtggttcctggaaaggatatggaagctcctggaaacctccattcccatattttgccctatcttttccatgtggtggtttcttagctgtattttgtataataaactggtgatattaaataaagtgctttcctaagttctgcgagctgttctagcaaattacccaacctgaggaggtaattgtaggaacctcctgactttacagttggtcaggagtacagatggcccagacccagcgactggcatgtgaagtgtgggcattcttgtggtcttgtgggcctgagcccttacctgtggggtccgtgctaactccagatggttggtgtcggaattgaattgaattgtagggcacccagttagtgtctggagagagagcattggttggtgtgaagaaaaaccccacacatttggtgtcagaagtgtcgtgagtggaaacagtacagaagacatgatgttagagtttggggaacaataggaaagccagagtggctgtggcagagggaaggagtgggagtgatagaacaggagatcagagttcatcattgctttacagatggggaaactgagccagacacaagttaagtaacttgcccgatgtaccttgcttataagaggcagatctaggattgagtcctagccaggcctgcctgactttctcagcgattttttattgtcaaaacttacttgacacttggtcataccacctggtatgattatttaatgaatatagcttttatttgcaactctgtgcttcttgaaatgggaaccgggtttttaccgtttaaaaaactatttcccacatgtaggtgcaccacagttgttcttgaatgaatggattctcgacatgatttctccacattgttttctcttcagaggcctctctgtggggcagcagtgacctggtcattcagccttcagtccacaaacattatggagcactttctgtttgcctggtactgggccaagcagggggatgcatagatgaagagaggtcagcccctgtgctggatgcatgctgggacagagctgtctacatggtacagcacccacagaaggggcagaaaaattccttcagtgggaggtggtgctcgagtgggtctttcaggaagagcaggcattgattgggcacacaggagcatggagagaagggcattgaaggcagagaccagcatgtataaaggtccagaggactggaaatggaaagaggcatttaggggactgtgaggggcgtggcaaggctggaagagtggaaggctggaaggtctgtggaagaccctgtttatcaggctaggagtttggactttaccctacaggaaaacagcgtaagtcactcctgcaaggcagagggtgaactgggcagggagctgcgggagaccagctagagactgttggaaatgatcgtccccatccagaccaaaggtggctgaaaagcctgaaaaagaactgtaagttgggtcttctacccttattctttatggaattgtcttctcagtagagaaactaggctatccaaactcaactgtcctgagtattagaggccagtggtcgttttagcagcaacagagtgcagttggtacctacggagcagggtaataaactaagcaagtgacagagatggatttaagtgcttctttacgtgacacacattttcttctcaatgggagggatggagatggcccagtaacatgaacactgctcactgatgccatagcatagatatcgaggaagtatccgtgttcagtgctgagagccccgaacaaagatttacccacgaatttattaacagcaagccagtcattagcattgtttctatagatattcattaactaaaagtatcccttatgggaaaggaagggatgggccgaaataaaggggtgggtctggctagttatctgcagcaggaacatgcccttaaggcacagatcgctcatgctgtttgtggtttaaggacacctttaagcagttttctgccctgggcgggccaggtgttccttgccttcattccagtaaacccacaaccttccagcgtgggcgttacggccatcatgaacatttcacagtgctgcagagattttgtttatggtcagttttggggccagtttatggctagattttggggggcctgttcccaacagaggcacaaagggactaagatagaaattggtaccaagaagtggagtgttggtataacagatccctgaaaatgcagagttggctttggaactgggtaaagggtagaggctggaagagtttggaggtacatgctggaaaaagcctagatagtgataaactaagcattaaggattattttggtgagggcttagaagaacagagctgtagacagaacctgaatcttcttagagattacttaagtggtcatgatcagaatgttggtggaagtatggacagcaaaggtcattttgatgaggtcttagacagaaatgaggaatattttattgggaactagagaaaagcccattctgtttttatttataaaatggcagagaacgtgggtcagttgtgtctgtgccctaatgctttgtggaggatagatgatgaactagatgaagagtgatgaactaggatatttggtggaagaaatatctaagcagagtgtgcagggtgctgcatggcttctcttgattgcttataagaaaatgcaagaagaaaacaaattaaagacagaaattataatcaaaagggaagcagaacttagaaagatttggaaaattttcagcctggctagatcataaagaataaaaaggctgctgggaagaatgaccttaaagggatttgggaggtctttgggactgctcctcctgtcacaggcccagagtgcctggaccatgagggcaggagggagaggaccataccccgccagcaggtctatgggtctagttgcccagggccacctcgagcctctgcttcctgcattctgcggtgctccttggccaccccaggtgcggctcaggtgtggcttgggctgctgctctggaaggtgcaggctataaaccttggtgtccatgtggtgctaactgcagctgagcagagttcaagagctgtggagtgtggctactttcatctagatttccgaggatgtcttggagaacccggggcccaggcagaaaacgtctatggggaagagccaccacagagtgcccccactagggcagtaccatcagtcatgaattgggcagtgccagactacatagttcagggctccatctagggggaatgagggaaagactttgtaagtgttcagggaagcaaaacaaagagaataattgattggttaaagtagaaaggcctagttataagctgtcatgagattggagaaaaaaataaaaataaggaataaaaaagaccctagttagagtttagttggtggttcctgattgatgaagtctctagttagagatagttaatggattgtgattggttaagctaagctttgttttactgtttatattgagttgggtttggtttgcttacataggaacctgaaatgttggagtcatctcagcctaattgcttcctgattaatgatttgttaacacaagttaggatgcaactccatcttcctgatacctcatggcctaaaacagttgttggtgctgcagccgtgtatttcaagttgcacatagctgaaataagggaaaggcaaggataatcctgctctctctttttttttgagacagagtcttgctctgtcagccaggctggagtgcagtggcacgattttggctcactgcaacctccctctgccgggctaaggaaactcttctgcctcagcctcccgagtagctgggtttacaggcatgtgccaccatgcccggctaatttttgtaattttttttagtagagacggggtttcaccatgttggccaggctggtcttgaactcctgacctcaggtaatccgcccccctcggcctcccaaagtgctggattacaggtgtgagccaccgcgcccggccagtcctgctgtcttttagggagcctgcttaggagccctgacaaacaactttgccttatattccattggctagaactttggccagttttcaacatcttaaaatgggaagattttactatgtaaaactccagctatccaccttctctcggaagctctggtgacaccaggccttttgacaacagttggctggagctgaggaacagctgcctgctccaggtggggcatgagctcctcctgtggccgcaagccccgcatggcctgttctgctcatttaagtcactgcctacttgtgacagtacaggcaaacctttgctttattgcccttttgcagatgctgtattttttttttttaccagttgaaggtttgtggcaaccctgcactgagcaagtctactgacgccatttgtgtaacagcatatactcacttcatgccacattttggtaattctcacaatatttcagatttttcattattattatatctgttacggtgatctgtgatcagtgctctttgatgctactgttataatcatcttggggcccgtgtaagatggcaaagttaatctataaatgtgtacattctgactgctccactgactccagcagttcatgtctctgtctctccctccctctcaggtctccctatttcctaagacacaacaatattaaaattaggccaattaataaccctacaatggattctaagtgttcaagtgaaagagtccactccctttaaatcaaaagctagaaatgattaagcttagtgaggaaggcttgtcaaaagctgagataggctgaaacctaggcctctggtgccaaacagttagcaaagtttttaatgcaaaggtaaagtccttgaaggaaagtaagtactactctagtgaacagataaatgataagaaagcaaaacagccttactgctgatatggagaaagttttagtgatttgaacataagatcaaaccagacacaacattctcttaagccaaagcctagtccagagcaaggtcctcagcattgaagcaaggccttccactagcagaaagaccatgacttactgacagctcagatgattgttagcatttttttgccataacatattttaaaattaaagtatatgtatttttttaggcataatgctattgcacacttgatagactatagtgtaaacataacttttatatgcacaaggaaaccaaaacctttgtgtcactcacgttattaggatatttgctttattgtgatgatctagaaccaaacccatggatatctctgagagatgcctgtatttgagcttagatccctggcttgaagggataaatgaatgagtaagtgagggaggagggagccagcttttgcatgaggcttgctcccttcccctcccctcccctcccctctcccctcgcctccctgcccctcttgtttcacaggttctctgttgctcaggttggaatgcagtggcaggctcactgcagcctggatctcctcgggctcaggtgatcctatcacctcagcttctcgagtagttgggactgcaggcatgtgccaccatgcccagataattaaaaacatttttttttttagagacacggtttcaccatgttgcccaagctggttttaaactcctgggctcaagtgatcctcccatttcagcctctcaaagtgctaggattacaggtgttagcccccacgcctggccctgaatgttgagtattgtcggaaagtttagcagtccttttacagcaagcacatttgtaagttgtttttgcttggcattctttgtcattcatttaacaaatgcttattgagaaattctttaagtgtcaagcactgttttagaccttggaataaagcagtgactgaacaaaatagatgtgaagaggctgtgtgtggtggttcagacctctaatcccagcactttgggaggccaaagtaggcggattgcttgagctcaggagttcgaggccagcctggataacatagtgaaacccctgtctctactaaataaataaataaataagcaagctgggcatcgtggcacgcacctgtagccccaggtacttgggaggctgagatgggaggatcacttgagccagggaggcggaggctgcagtgagccaagatcatgccactgcactccagcttgggtgacagagtgaaaccctgtccttaaaaaaaaaaatgtgaaggattcctgcacttgtgaaacttatatcctaactggggagatagttgttaaaaagagtaagtaaaagatgtattattgcatttggtggtgattgagaattctcaagaaaaataagacagggaaggatgatagggaattgggagtgtatgaaatttagatgggatcatttgggggaaatcattgagaagttgacgtttgagcaaagatttcatggaggtgaggaagtgagccctttggatatgggatgttggagggaggtatttctaagctagtagacagttccggaggcaggtgtatgctttgcttacctaaggaacagcaagatcagaatgactgtttcagaatgagtaaggggccaggagtgtgaggataagttggaaggtaatgggagggctgcaactgtatagtcttacaggtcatcattgtaaggattttaggttttattaagcacatgggaaccccctagaggcattttagaggaatgacatcttgtgacttcctcttataggtattctgacttttgtgttgagaatagactttaggggctaagagcagaagccaggaggtcgcttaggagattctaagcaatagtgcaggtgagatgagctggtggcttggaccagggttcttgtggatgtgttgaagtcattagatgctggatgcattttgttggtggaactaacaggatttgctaaacatttacatgtgggtttgaaagaagatgattcttttttactttttaattttaaattcattttaattattatttttgagacagaatctcacactgtcacccagggtagagtgcagtggtccaatcacagatcgctgcaacctccacctcctgggctcaagtgatcctcccacctcagccttctgagtagctgggactacaagtgtgcaccaccatgcccagctaattttttattttttgaagagatggtgtctcactatgttgcccaagctgttctgaaacatctgggctcaagtggtcctcctgccttggccttccaaagtgctgggattacaggcatgagcccctgcacctggatgagattattcttatcaaagagggatccaggattttttcctgggcaagtggagggaaggagttgtatttactaaggtggggaagactgtgggagcagcaggggaagggcagaatgttgagagctctgttgtagacaagttaagtttgcgatgcatatgaaacaccgaggagatggtgatgaggcatttgggtctgtaagtatagagttgggaattgtaggctataggtggtgatatagtctgaatgttaatgtccctgccaaattcatatgttggaacctaacccccaaggtggtggtattaggaggtgaggactttaggaggtgatttggccatgagggctctgccttctcgaatgggattagtgcccttataaaagaggcttgagggagccactttgctcttctgccatttgaggatgcagcagcaaggcaccatctgtgaagcaaagaacagccttcaccggatactgaatctgctggctccttgatctgggacttcccaggttcctgaactgtgagcaataaatttttgttgcttataaattacccagtctaaggtattttgtgatagcagcctgagtgagctaagaaaggtatacttctcctggcctggatgagtgtacaaggaatgagtagagatggaagaggtccaagggctgagctgggggccactgcagcacttggaggtttggggacttggaggctctggtgaaagactctgagtaggagctgttggtgggaaggataggaggaaaatcaggaggtggggcaacttggaggctgagcttggagacaaggactggtcaccttgggcagtgtgtcactggctgagagtaagtatgggggtgggcactggggacctgaggagccagagaggggataggaccactgtctcggagagcgaagggtgagcggactagggggtagttggactgccaggtggcagcacgggtcctcccgcagttcgtggtgctgaatcagagtgtgggcagccagcctggatgtgcgttctgtcacattcttgttgagctgctagaggacaggcgtgaagccaagtggaactgagagtaaagccgtgttggagttttgcaggaaggtgccagatgatgagggcagccagcgaagtcgaaggtgcatggaatgaactgtgaaatggaaacattggcttttacttttcgataatcccattgtttctctttttggccatcccatctcttcgtaatttagaactatcataatcgtttttcactcaagactgttcagccaagtgcagtttatttaagagcactccttcagtgagcttacttaggtatgtgtgtgtttgtgcctgtctcctgttaataagctgatatgaaagtcctgctgagctagttgtttcagtcttggagatcagcagcgatatggggaggagaagccaagcctctgttaaagcccaccagtccttccctcccccgctcccagcacctagtgtttgaggaattcagactttgaatactgctctttgctactgttcttctctcctaacttgccagtaaacttccaagggcagtatgtgtcttgtgctcctctcctggtcttctgttgtgcatacacttaaatacggctctcaggctgtgaataatctgctttggttaacactcccctctgttctgaaggctgggctgctagagccctgactgttggtggctgtgctgtttgcagtgctcatgttctcttcttgggaacccaacatatgcagctttaatgtcaggctctgccctcctgtcctgtcacaggatccgggactcctctccccatcttgggagggatggcctggggatttcgtctgggaagccctgcccagtgtgagcctctagctggactgagcaggtaatgtttgtgagtgctgaaatattttaaccagatgtccctcctccaaagagccctttgtcctggaggttcatggaaacatgagctgcccatctgcctttgggcccaggcttctcaggttgcaacaagattgtttaggacaccaaagagatatttatttttatacaggaaaaatccacagactgggaaggcgaataggaggtaaagaagatgaattttcttctggaaaatggctcgtgaaatttgtacatatggaagacagaataatctagtgcaaggaaatccttgaagacctagaagaaatatgtgagggactgatagagtttgcccttgtgttgtggtaagggggacaaaaagtaccatgaaattctaggtagaaagcacattctgagcagtatataattgaactcatttatttaaatatggttaaatatacttattcaaatgtaaatatgtaaatatttaactgcttaaatatacttatttaatgtctgatattgttcatcaccatgttaggtctgtgggcagctaagatatgagatccttgtgttccaggatctgaccacgtttcccaaagtgagcacatgcccataggcatcagtaacaagtgtggactgagctgactgcagcctcggtggacagagaagacttgtcctccagcagtgttacaggctgaccacctgctggcaccctgatgttgacattagtgatgctggaattcagataagggagagagctgctagcaggattccacagagaggcaggacttaaaggataagaaggattagatggtgccgggaaggggaggagcagggaagccagggtcaggtgtgaggaaaggggaaggtgctagaaagaggagtttggacttaatactgtagcctaggaaggtggcccatgccttggctgttccacacgtctcttagattctatgggagcaaaggagaagccactgtgtttaccccagacttgccttcttcccaccctccccgctcatcttggtgtactcatcaccatgtgctcaatctgcgaaactggaaatggcattgtcatcctcaggcccccactttttgtcacctgctgtgatccagcagtcactgagttgggaggcctcctcgtttgtttaatcgtattctactattaaattttctgccccttgtaatccctcctctcctgggtcttcattcttgtttctgcccaaactgtttccagatcacaaatatgattctgtgagttctctcctcagaaactcctggtgattctacaccacccacaggacaaagtctagactctgccctttctaacctggccccagcccccttttctggctgtcttctgggtctgagccaccatctagaaatggtttgaatggtgaagtatttcaatttcatggagctaacagaatagattatttaaaagcatgtgggacatatgatcccaacatattttccttattagctattcataggcacagcacagaagaagcatttatatttataatgatctcatgtcaccaaggaaaagttaaaatatgttcaataactcactttaaaaggcagcggaaaaatagatgtcacttatggggaatattttcacccagaatgacaaaatttttaaaaaatctaatgctcaaagcgatgagcttcagttacctggaaaatctacttctgatgccccataaatgaaatgtcaggtggtcagcagggcatgtgaggctcctgatagatcctttcaggaagggagagacatagataagcaagacctgaagaatcactagaaagcaatcacagatgcacctgatgtatttacatgggctcccatagaggcagctgcacagccccacagtgctggcctctggcagggaggctagggttggggctcaaggcctttagcatcaaatatacctttcctttgatgaaaatgggtttgaatgacatttcttggaaattgaggcaggttctttgttttttggctgagcacttaggagataagaaacaaacccagacacattttggaggagttggttgctcagcgtgtgctttagaagtgatagcaaccgccacaagtgtggtaagaagcagcaggataaagcaggcacgaaggggctttggtgcatggaccagccttggtgttgcctttcctcaaagagaacagatctctcagtcaggagttcttggggcagggatgacagtgttaatgggggaggaagcgtcactgtgggcaacctatgaggaggcagccttcagtgaccttgggcatgtgttctgagtgccctcactgggtgcacaccttagtgaccccctgctggtacattctgctgtgaagaataacacggagagacagagtgatcattttaccctgaattcaattccacactcacttgcagcaggaggtatggctggaattagtggctgtggtggagctgttcctgccatgggggatgtggtctctccttctggtccccgagtggtggggtgggaatggaggcagcgctgcccgacagagcaggctgctgctggaattaccacagtgtcgtgtgtctcctcctattaatccccatgtggaacagcaggtagcctgagaagcctgaattgtgccttagttcctggccgtggtgctgcttaaacagatgagccttgttagccagtttgtgcagtcagttcttactgaagtcaagcctttggtccaagggaaaacaaagctacaggaaacatggaactttcttacaccttcttgaaaatacaagtcatgttgcctaggaaatacttctctcaccaagtattctgcacgctgccaacattggagctgtggaagaggcagctgaagcaattccaagaaagtgctagcagtttggtaataaaaggaagtggcatatctctcctgcctctagactgggtttctaggagtgcacatggccaaaaggaaactgctgcactctggcaagtgattacatgttgtgctcatggacaccttggccgggtgtccagtgtgcactgggtgagggtgtgcatgggctgtgtgcaaagatctgcagtgctgcacacagtgtgttgagtgagagggtgccaagtgctgggacggttgtagataaacaaaagcaaataggtgcagtactgtgcagcctgcccaagttcccaaagcttgctgccaggctgaagactgctggcagcctctcctgggctgggtcaggagtagaagggtgtcttccccttgctaattaggaggacacttctaaagcatttctctctaacacaaccaaatagtctgctgaaggtgaactgctttagtgaggagggaagccgtggccgtgaactcagcgatagagaaagccaggggtgatgtgccccagagccccgagcagtccttcctggcaactctgagtgaccaacatgtgaccctgctgtctgtccacaagcagtggtcctttaggaagagccctggggttaggcattcagccaggccagtgtctactgtggaggaaggcactccaccgtcagaggaaggagaatttccacagagagttttgaatggaacctgggaaatgagttccagtcaggtcagtgcaattgcagatgggctaaaaagcctggaagggcctggacccattttaaagatggaggtttctctccatgtctcttgtgtgggatattggggagaggtctggggagcggaatgagagtgtgaatgtagcacctggcaggagtcaagctgattaattacaccatggcttggaagtttgggttttgttgctttttattttcagaatattttgtaagactctatgaagcaaaagttttccacaatgcaagtcaaacaaaaatgaatccttccttctttttactaatatgttttatagtgtataccttattttgttaatctgtacattttaactaaacattttgaaaatgctgcaaaatgaagttccttttcttaagcaagttgaagttttgttactccaaaggttaggtcatgtccaaaagtaagacagtataacgttttgtaaaaatggtgccttttagcagcatttctgagcagactggtggtgtgtacagggtcttcttcattgacctagtcagacgaaaataaaaaacaacttttgaaggcatttactagttagatacaaaggaaggtttcataagtactttgcttcctctaagacttatttttgtgctgttcattggttaaagtcccaaagactaaaggaaattttgtgaaaagaactttcaaatgtgctatgcaagagatttacatacgttgaaatcacagggtacttggatattgaagacagaaactccttttgagtatttaaagattctgcattttgctatcaggtttttaaccaaggatataactatgctcggaggtatttattttaaaatattaaaagtgttttttggtgttctgaatttgtggaaatttccaagagactcctttaaagttttttcctaggcaaatttaaaaatatgaaatgtagaattattcagtggctgcccgtttgggtagcttctacacagaggttcgagtggttttaggggagggaagtgaggtgatagatacaattttaattactttgttttctaaagtagttttataaatttcattttatgtctctttaaactgtattaagccagtagctaaactaatgtgttaaatcacttagaattttaaagagtgacagagcgtttaatcttttaatcagccttttcatatgttgccggtttatacaatatacggtgaacatttatacttttagccatgtgtttaaaatagtgaaatactaaatatgttggggtgaaaatgcttgaggcatttttaaaaaatgtccaaactgttactttacaatttccagcctatatctgaagttttgagatatgacgtgtgctggtgatttttaaggccagcaccaatctgtgactagtggggcgacctgaagctgactaggggagcctcttcagaaaggagggctggggaagaggccttggtggaggggatctgagtgcagacccaacacaagttgtgggacctgggcaggtgagtcttggacactctcctttagattcttcattgcaaagtggatgataaatcctgcctcatatgattgtgaaagcactttgtagattatcatgcaaatgcaaaatagtgttacttctgccaaaattatgctttttcagaagaatttccaactctgagatatgtttgatgtgttgtctgaaggtctggacaggactgtgataacccagtaatctatctgagcacagttgcaactctatttttcctttgtttgtttttttctaagttttttattttgggacatggtctcttgctgatgccgaggctggagtgcagtggcatgatcatggctcatagcaccctcgaccttccgggttcaaatgattttcctgcctcagccccctgagtagctgccaccacaggtgcatgccaccatttccagtttctctttatttgtagagatgtggtctccctatgttgcccaggctggtctcaaactcctgggctcaaatgatcctcctgcctccccctcccaaagtgctgggattatagatgtgagccaccgtgcctggcagctctattttttctaaagctctgattataaaagtaacatatactctatataaaaaacaaatttacgatggaacgaggagaatacaaaaaagtataaagaaaaagcagtcgttttcccaacaaatatgaatgtgtatacgtgtatgtatgtttatgtttacataatgtatatttttaaaataaatatgggatcaaattatacatactatcttatactttgcatttcttactgaatattttgtggacatttctgtatgtcaatatatatgtaaatctgtattatctttttttttttttttttttttttgagacagagtcttgctctgtcatccaggctatagagtgcagtggcgtaatcttggctcactgcaacctccatctcctgggttcaagtgattctcctgcctcagcctccagagtagctgggactacaggcacctgacaccatacctagctaatttttgtgtttttagtagagatgaggtttccccatgttgcccaggctggtctcaaactcctgagctcaagtgatccactcacctcagccatccaaagtgctgggattacaggcgtgaaccaccctgcctggcctatataatcattttttattgcagttccacttttaaatttaggattaatttttagaaagaatttagttatccttaaatagaagaaatttgcagtagctggtttatgattataaaaaccaacccaaaagttaatttcaattgtgactcaaagtctgttataaatcagctttgcaccttgagaactaacatttagcacttggtatatggtaggaaccttactcttgtcacttaatcattttaacaactttagtaggtatcatcagtccacctttaacagacgagaaagctgagtgagagcttaggtttcctgaaaaatttaatcccaggtccgtctgatgacaagtccttgcttttccattggaacactgaagtattatttaatacactgggcaaaatagagttttgaaagtattggaaaactgctaattcatagtgaatggaaagttagcttttaggtggcacgttgttcagaaaggccgctgctatgaataaaacatttaaaaattgctgtttatgcctagcagatttgtttgcttatattttacatttctttttttttttttttacatttcttacacaatgcagagtacattctgtacaatgtagaatgaaatcatgactttggaaaacctgtttctttgattcttctatgtttcagacaggcagagaggggaaaaagatctgttttaaaaggcataactggtaaaagctcagagtctggagggcacatttccgcccgctcctctcccacattagaaagtttctgtttgctgatgtgagcagggctaagcctggtgaggttcctaggaattaattatgaaaagggggaaatagggaggagggccttccccgcaaatcccctccataagagcacgctaaccagagtagaagtcaggggctccgtgctttggcccaggtgttcctatcaaaggttccacagacaacctttcaggcccagaatggtgagctggagaggaatgggtgcctgccactgaggctctcccttctctagcccctccttaactctctcctctacttgtcttggcaggtgggaaatggttggaggttactagaaagttgttccagctgtatacagaattaccctttgtttccagaaacaactgcttaagcctccttactcatgactctgttgacttctttggccaagcttggctgctgtttttttttgtttgtttttttcccgacagggtctcaccgtgtcacccaggttggagtgcagttgccgcagatcttggctcactgcaacctccacctcccgagctcaagggatcctcccatcagtgatcctcccaccctagcctcctgagtagctgggactacaggtgcacactggctgctgttttaatttgtcatcgtatcctgtatctgacagagttcagtccatggtatcaagctattgactgagtgaacaaatgaatgaactagaagtagatttatactgcagcagggaggattgatgttagacacattgaactgatggtgactataaggttgttacgtggtggacttagcatttttagagaccagaatatggaattttgttcttaggtaagtggtggttaggttcttttttttttttctttaaatatgagacagagtctcgctccgtcgccaggctggagtgcagtggcgcgatcttggctcagtgaaagctccgcctcccaggctcaagcgattcttctgcctcaggctcctgaatatctgggactacaggtgcatgccaccacgcccaactaatatttgtatttttagtagagatgaggtttcaccgtgttgtccaggatcgtctcaatctcttgaccccgtgatccacctgcctcggcctcccgaagtgctgggattacaggtatgagccattgtgccagggtgggttcggttttatttttgcctagttgaaatcaggatgacttggctggcacagatatatcccttctaaaataaaggaaaaacaataaatgaagtggtgtgatctagtcatttaaagaagttatctgtcattatggaatcatcagcattcgctattattttatttgcttttgtagagaccatttgaagtggattcttgaatttagtttttcctaaaagtagtatctgctggatacaaacattagtagcaaagtatagaagtgtagttcttttcctctcttagataaagaggactgtcttaatacagttctgcaacttttttttctttttaacatcatggaagtctttccacgtcaatacatgtaaattcacctatttttaaaaaaccatgacatagatttctgttcgatggactatattttatgtagacagttctctatagaagaatattgagatggtttccagtttttcactatttgaatgtagcaatgaacattaatatgtaattgtatatctatatggtaaaattcccagaagtggaatttctaggacaaaagcagtaatactttttgaagagcaattaggcaaaatttagctttctacaaacagtggttaagaactgtttttccttatactcttgtttactgtatcatcagactttttaaattaataaaataacatttattttattaatgttataataaatgttattttaattttaaaaaagatttattagatacttaatatttctttttctaaggattattttaagtagcatttcccatcatgcatttatagagtagtgctaatttataaacattaggtttgtacatgtcttaaaggaatacatttgttttatgtgtcatacctataattctaggcagaaaccaatactccttggagtacagagtaaaaaaaataaataaataaaacctctttgttgggaaaggcttgaaatacagagtgttattagagaagattctgaagcaggaaaatgctgttaattgataaaagttagatggaataattgttacaatagacataaattaaaagcagcacattctctgaaacggttgattataaagctgtgtagcacgagattgtgaatgggttttctaagataatattgtgaagtgctccttggagacgataccctgtcttatagtttgtgaatttctaaatttcattttgttgtatattgaaaataacatatttgtatgtacatatgtggtgaggtttgttaattttgtttttaattttactcacttttttttttttaggcaagtgtcagatatgctacattttgtttctcagtaagggttaatattttcccttgctgtggttgagagaagcaaataggcaatgaatagtcatttgcacagaattacccagaaagtttacagtctgtcctcagaagggcagagattgggttaatgcacacatagccctggcacatagtaggccctcctatgtgtttgaatgaatgccttcatttttaaagtagataaaatttaaataattgtcagtggaaagtctttttggaccattgtgaaacaggattcaaggccagagtgaagggcttgggggaatatgtacactacttttaataattagtttgccttatcagtaaaatggagaaaactatgtagagtactcgaaccttcctgggtcatgtttgaagatcaaatgaggtgatgtttgtcttcatagtcatttgttttcaaacatgtatgatgttaatctttttttaaaaaattatactttaagttctggggtacatgtgcagaacgtgcaggtttgttacatagatatacacgtgtcatggtggtttgctgcacccatcaaaccgtcatctacattaggtatttctcctaatggtatccctcccctagcccccccacccccgacaggccccagtgtgtgatgttcccctccctgtgtccatgtgttctcattgtttagctcccacttatgagtgagaacatgcactgtttggttttctgttcttgtgttagtttgctgagaatggtggtttccagcttcatccatgtccctgcaaagaacatgaactcatccttttttatggctccatagtattccatggtgtatatgtgccacattttctttatccagtctatcattaatgggcatttgggttggttccaagtctttgctattgtgagtagtgccacaataaacatatgtgtgcgtgtgtctttatcgtagaatgatttacaatcctctgggtatatacccagtaatgggattgctgggtcaaatggtatttctggttctagatccttgaggaatcgccacactgtcttccacaatggttgaactaatttacactcccaccaatagtgtaaaagtgttcctatttctctacatcctctccagcatctattgtttcctgactttttaatgattgccatcctaactggcatgagatggtatctcattgtggttttgatttgcatgtctgtaataaccagtgatgatgagctttttttcatgtttgttggctgcataaatgtcttcttttgagaagtgtctgttcataatcttcacccactttttgatggggttgttttttttttcttgtaaatttgtttaagttccttgtagatcctggatattagccctttgtcagatggatagattgcaaaaattttctcccattctgtaggttgcctgttcactctgatgatagtttcttttgctgtgcagaagctctttagtttaattagatcccatttgtcaattttggcttttgttgccattgcttttggtgttttagtcattaagttgttgcccatttctgtgtcctgaatggtactgcctatgttttcttctagggtttttatggttttaggtcttacgtttaagttttaatccatcttgagttaatttttgtgtaaggtgtaaggaaggggtccagtttcagttttctgcatatggctagccagttttcccaagaccatttattaaatagggaatcctttccccattgcttttgtcaggtttgtcaaagatcggatggttgtagatgtgtggtgttatttctgaggcccatgttctgttccattggtctatatctctgttttggtaccagtaccatgctgttttggttactatagccttgtagtatagtttgaagttaggtagtgtgatgcctccggctttgttctttttgcttaggattgtcttggctatctgggctcttttttggttccgtatgaaatttaaagtagttttttctaattctgtgaagaaagtcagtggtagtttgatggggatagcattgaatctataaattactttgggcagtatggccattttcacgatattgattgttcctatgcatgagcatggaatgtttttccatttgtttgtgtcctctcttatttccttgagcagtggtttgtagttctccttgaagaggtccttcacatcctttgccaaattgtattcctgggtattttattctctttgtagcaattgtgaatgggagttcactcatgatttggctttctgttattggtgtatagaaatgcttgtgatttttgcacattgattttgtatcctgagactttgctgaaattgcttatcagcttaaggagattttgggctgagatgatggggttttctaaatatacaatcatgtcatctgcaaacagagacaatttgacttcctctcttcctatttgaatatcctttatttctttctcttgcctgattgccctggccagaacttccaatactgtgttgaataggagtggtgagagagggcatccttgtcttgtgccagttttcaaaaggagtgcttccagtttttgcccattcactgtgatattggctctgggtttgtcataaatagctgttattattttgagatacatcccatcagtacctagtttattgagagtttttagcatgaaggggtgttgaattttttcgaaggtcttctctgcgtctattgagataatcatgtggtttttgtcattggttctgtttatgtgatggatttcgtttattgatatgcatgtgttgaaccagccttgctgcatcctagggatgaagccgacttgatcatggtggataagctttttgatgtgctgctggattcggtttgccagtattttattgagaatttttgcatcgatgttcatcagggatattggcctgaaattttctttttttgttctatctctgcaaggttttggtgtcaggatgatgctggcctcataaaatgagttagggaggagtccctctttttctattgtttggaatagtttcagaaggaatggtaccagctcctctttatacctctggtagaatttgactgtgtatccacctgatcctagactttttttgattggtaggctattaattactccctcaatttcagaacttgttatttgtctattcagggattcgacttcttcctagtttagactttggagggtgtatgtgtccaggaatttatccatttcttctagattttctagttcatttgcttagaggtgtttgtagtattctctgatggtagtttgtatttctgtgggatcggtggtgatatctcctttatcattttttattgcatcgatttgattcctctctcttttcttctttattagtctggctagcggtctatctattttgttgatcttttcaaaaaaccagctcctggattcattgatttttttgaaaggtttttcatgtgtctatctccttcagttctgttttgatcttagttatttcttgtcttctgctagcgtttgaatttctttgcgcttgctgctctagttcttttaattgtggtgttagggtgttgattttagagctttccagctttcttttgtgggcatttagtcctagaaatttcccactaaccagtgctttggctgtgtcccagagattctgggatgttgtgtctttgttctcattggcttcaaagaacttatttctgccttaatttcattatttacccagtagtcattcaggagcaggttgttcagtttccatgtagttttacagttttgagtgagtttcttaatcctgagttctaatttgattgcactgtgatctgagagactgtttgttattatttctgttcttttgcatttgctgaggagtgtttcacttccaattatgtggtcaattttaggataactgcaatgtggtgctgagaagaatgtatattctgttgatttggggtggagagttctgtagatgtctattaagtctgtttggtccagagctgatttcaagccctgaatatcgttgttaattttctgcctcattgatctgtctaatattgacagtggggtgttaaagtctcccactattactgtgtggaagtctaagtctttttgtaggtctctaagaacttgctttatgaatctgggtgttcctgtattgggtgcatatatatttaggatagttagctcttcttgttgcattgatccctttaccattatgtaaggcccttctttgtctcttttgatctttttggtttaaagtctgttttatcagagactaggattccaaccccgacttttttttgctttccatttgcttggtaaatcttcctccatccctgtatttcgagcctatgtgtgtgtttgcacatgaggtgggtctcctgaatacagcacatcaatgagtcttgactctttatccaattcgccagtctgtgtcttttaattggggcatttagcctgtttacgtttaaggttagtattgttatgtgtgaatttgatcctgtcattatgatgctagctggttattttggctattagttgatgcagtttcttcatagtgtctatggtctttacaatttggtatgtttttgcagtgactggtaccagttgttcctttccatgtttagtgcttcccttcaggaactcttgtaaggcaggcctagtggtgacaaaatctctcagcatttgcttgtctgtaaagaattttatttctccttcacttatgaagcttagtttggctggatatgaaattctgggttgaaaattattttctttaagaatgtcgaatattggcccctattctcttctggcttgtagggtttctgcagagagatctgctgttaagtctgatgagcttccctttgtgggtaacctgacctttctctctggctgccctcaacattttttccttcatttcaagcttggtgaatctgacgattatgtgtcttggggttgctcttcttgaggagtatctttgttgtgttctctgtatttcctgaatttgaatgttggcctgtcttgctaggttggggaagttctcctggataatatcctgaagagtgttttccaacttggttccattctccccgtcattttcaggtacaccagtcaaacttatgtttggtcttttcacatagtcttatatttcttggaggctttgtttgttccttttcattcttttttctctatcttgtcttcacgctttatttcattaagttgatcttcagtcgctgatattctttcttctgcttgatcgatttggctattgatacttgtgtatgcttcacgaagttcttgtgctgtgtttttcagctccatcaggtcatttatgttcctctctaaactgattattctagttagcaatttctctaaccttttttcagggttcttagcttccttgccttgggttagaacatgctactttagctcggtggagtttttttattacccaccttctaaaacctacttctgtcaatttgttaaacgcattctccatccagttttgttcccttgctggcgagggagttgtgatcctttgaaggagaagaggcattctggtttttggaattttcaggcttgttgcgctggtttctccccatcttcatggatttatctacctttgctttttgatgttggtgaccttcggatggcgtttctgagtggacgtcctttttgttgatattgatgctatacctttctgtttgttagttttccttctaacagtcaggtccctctgctgcaggtctgctagagtttgctggaggtccactccagaccctgtttgcctgagtatcaccagcagaggctacagaacagcaaagattgctgcctgttccttcctggaagcattgtccctgaggggcacctgccagatgccagccagactctcttgtatggggtatcttttggcccctgctggggggtgtctcctggtcaggagacacaggggtcacggacccacttgaggaggcagtctgacccttagcagagctcgagcactgtgctaggagatccactgctctcttcagagctggcaggcagggacctttgagactgctgaagctgcacccacagccaccatttgccccaggtgatctgtcccagggagatggcttcatctataagcccctgactggggctgctgcctttttttcagagatgccctgcccagagaagaggaatctagagaggcagtctagctacagtagctttgctgagctgcggagggctccagccagttgccatttccctgtggctttgtttacactatgaggggaaaaccacctgctcaagcctcagtaatggtggatgcccctcccccgaccaagcttgagcatcccaggtcgatttcagactgttgtgctggcagtgagaatttcaaaccagtggatcttaacttgctgggctctgtaggggtgggatccgctgagctagaccacttggctccctggcttcagccacctttccaggcgagtgaacggttctgtcttgctggcattccaggcaccactggggtatgaaaaaaaaactcctgcagctagcttggtgtctgcccaaacggctgtccagttttgtgcttgaaacccagggccctggtggtgtaggcacccgagggaatctcctggtctgtgggttgtgaagaccgtgggaaaagtgtagtgcctggaccagagtgcaccattcctcatggcacagtccctcgcggcttcccttggctagtggaggaggttcactaaccacttgtgcttcctgcatgaggcaacaccccaccctgctttggcttgccctccatgggctgtacccgctgtttaaccagatgagctgggtacctcagctggaaatgcagaaatcaccctccttctgcgttgatctcgctgggagctgcagactggagctgttcctattcggccatcttgccacaagctgatgttagtcttttagggcccattagctctcaagccttcctgtacaactgtaagatggccattattattactcccgccagatgccagccggagctttcttgtatctaaacctgtgtttgttttttaaaactcatcaggagagttttttcctccaaagatcatcttaattgaagaactgaattaaaagcatacatgtgccctgtgtctacacttaaaactatccaaaacacaaacctttatacctaaaggaaactgaggcctggatttgctcagataatgctggaattcatacttaaaactctcagacataccctcaagaaattcagaagtaggaaagacagatatttaaacaaatatatgtgaaaatgctctttgaactataaagcaatttacaaaagtgtcatcaattcatcattgttgttatctttatcacagtcaataatattgttgcccaaattagaatggtttaacaaaacattttcttccttgccttagagcaggggtgtccaaacttttgactttcctgggccacattagaagaagaatgtgtcttcggccacacataaaatacgctaacactaataatagatgatgagctaaaaaaaaaaaaaaaaaattcacacccaaaaaaatctcattatgttttaagaaagtttacaaatttgtgttgggccgtattcaaagccatcctgggctgcatgtggcttgcaggccatgggttggacaggcttgccttagacaaacgggaaaatcacatttattttctgcttgtgaaagtaacacttgtttttttaatttaagtttgaaaaattggaactatgtacagatatttttaaaaatcagtatttcataactcaccaaaagataacctgaattttctctactgatatttacgtttatccccctgtatacttaatgttcatagaggttaatatgggacattgattcttcctcagtgggggttttagagaccaacccccactggcctggatgcctgggatggtttgggtgagatcctttcttgagtcaggcatcatttttgacctgtgccctcccctgtgaatttgtggcatccagagaattcttagataaggccgagcaaggcagtactcattccagatattcaggatgtacgtggtccagagctgttgtcttctctgacttgtgtcttgtgtgccttctcctgtaagtgtggttgccttgattagggatattgaggaaagtggagcgagtgtggatattttgctgtagttttcctgaggtgacagatactagtgggtgaagccagggctcaggcagctcagctctcttgtgtgttagcctggcttgctgcttgcaggtatggctgtttattttcatttcacttttctgcattgtagtctcttcctataattaacatggctgaaaagaaaaggttactctaaaagttgtttttaaaaaatacagagcctctcggatttctcagcagcgtttaaatcccagctctgttacttaatgttgatttgtgctcttggataagcttctgagtcagtttcaacagtgaaatggtgataatatctccttctagaattgccctaagcatgagggatataaaatgccatcctcataaaataacactcagaatcattaattatttgttattattggatctgcgtgcatatgaaagaatccggacttttttgtattttgaatcccatgaaagttcagatgtgttaagttgtatggggggaggtgatatattggaaaagttgccttcatgtataacatgtttgcctcataagttgttatgggtgttatacatccttcaaagtgaaagaattcttgaggataggcagcaggggactgactggtatcctatttaaggttgatgggaatccaagagtgatcaagagacctccaaagtggccagtggtccttcacttgtacatgagttagtattttttgatttgtgatcacagccactttctaacaaagcatgttgtttctgctttttcactatcagattggctttgaaagccttcatgaaaacatgccacccagtttctgatttcttcatatcagaatggcttatccagagattttgttttcctttctggcttcatcttggtgaatcagtagttatttttttaacctatattttattttaaaagccctggcactctcagcaaatttcgtgtgacttgggtacctagagaggtagcagagaattgaaattcacttttggactcccttctgtggcctcctctgcttccagtcctttctcatcctgacgtctaccatcatttatcaaaaattcaaaagctagaaaaagtcattctaaagcctggtgttgggtctgcagaaaatgtcccaaatgtctgtccgtaaggagtgcagaatctagtgggaattagataaactagggctttcacaaggctttctgggatatccatgtggaaccttggcctgctctccatttctgtgactctttgatgggcccttaaatctaaacctgtgtttgttttttaaaactcatcaggagagttttttcccccaaggatcatcttaattgaagaactgaattaaaagcatgcatatgccctgtgtctacacttaaaactatccaaacactaccagttgtttaatgaggttgttcctagaccaacagatactttagtgttttgtagagatatgttatttgcaaggctttgtcttctgtaactgcttggccttaaaaacctgcctgtctagaaaggggggcctctgagtagtgtttgataataagaaattgctttcagtactactgcaaacccttttggcagaaacatagaatcaacattctagaaattaagggctgctgttatggtttggggtttgtaaagttgtagttggagcgaggaccaaaaaatgtaaactgggttatcatgagggatttgtttttccaacaaactagatggttgagggttatgtctttcttattatgaggaagaggtttttgcctaataaggtactatatgaaaatgaatgtctttgaatatcttcttagtttttcttttatccttggttcttttttaattaaagaagtatttaattaacaccaactacaatcaagtcactgttctgagtcttctttgtgctcatgttattttaattttaaattaatttttagattttggtaatgtgtgtattgtacagttaaattatatagtgaaagtaattctctgtatcccagccacctggtccccttcagctgcctaatcttcctcaaattctgtactagcttttgcactgtcccagagataatccatgcctatacaagcatccatttgtatgatattctcttgtttcacacaggtagtcctagcaccatgacagaattgtagccctctcagtgaactacacacccttgtattcaagctccgtgtaattcctgcccatattgactgtgcttggccgtgtgactggttttggccaatgggtgttagcaagtgtgatgcaagcagaggtttgataagagcttgcactttgaaatgtgttctagaggagtgcttgctattgtgacactccctctcagtacccagaagcccccagctgtgaggtccccacctagtcataaagagaagccacatggaagagaaccgggtccctgccaacagcctcatctgagcccctagccggcagcaagcatccacttggcagccatgtgatgaatgaactatcttcttggaagtggaactgccagccccattcaggccacccccagtggtgctatgtggagaagagacaagctttccctgccaagccctgtccgaattgaaaaattgtgagctgttgctagtaatgtactaaagttggtttgtcatgtagcaacagataacaaacacatgctatatatatgatattttctgtgccttgcttttgttgctgagcagtatattagatatcagcttatttcattacatacagagtcacatcattcattttaagagctgaataatattccatttatggctgtacagtaattaactagcctcttattgatggacattgatgtttctaatctttctcagcatttaatatctccatggcatgctttgttttgcacatgaacaaatatatttattgggtaaattcttagaagtagagttgctgagtaaaagagtacgtaaatttgtaattttaataggtattgcaaattgccctccagagaggttacactcccactagcaatgtaggaagactgtgccagtgtggttggaatgttacatttctttttaatattttcccatgtattttaaaaaccatatgcatttcttttttgatgaactgtcttcttttttgtttggattgttggcctttttcttttttggaggaactctctgtatttaaagaaattaactcttaatgtatgctatgtgaagcaaatcttttttcccccagttttttatcttttgacttcatttgaataattttttgtccttattgtgtttagttatgtcaaatcttttatagcttttggattttcttggttttgttctggtttgttggtcatatttaggcttttctcactttaagattattgtagatattctcctgtgttttcttctagtgtttttgttatttcttttttacatgttaatctttgatctgcctgaaatgtcttttgacgtagacgtttccaggtaggtgtccgaggtggctagtcatttgtctgttaatattgttataccatgtcatccttactatacagtcatgatgctttagtcaatgatggactgcacatatgacactggtcccatgatattacaatgaaactgaaaaattcctattgcctagtgatctcgcagctgttgtaatgtcatagtaatgcattactcatgtatttttggtgagctggtgtaaaccaacttactgtactgccagtcatataaaaatagagcacatacaattctgtacagtacataatactcgataataaatgactatgttactggtttatgtatttactatactctattgttattttagagtgtactccttctacttataaaaagaaaaagttaactgtaaagtagcctcaggcaggtcctaggaggtatccagaagaaggcattgttattataggagatgacagctccatgcctgttatcgcacctgaagaccttccagtgggagaagatgtagagatggaagacagttatactgatgatcctgaccatgtgtaggccgaggctaatgtatgtgtttgtgtcttagtttttaacaaaaatgcttaaacagtttaaaaataaaaaaattttaaaagcttataggataagtatataaagaaaatatttgataaagctgtccagtgtgtttgtgctttaagctaagtgttattacaaaagagtcgaaagtaaaaaaaaaaaaaattaaacgtttatgaagtaaaaaagttacagcaagctgaggttaattaataaattattattattgtttcagagacagggtcttgttttgtctcccaggctagagtacagtggtgcaatcatagctcactgtaaccttgaactcctgggctcaagcagtcctcctgcctcggcctcccaaagcattgagattacaatgagccactgtctggctatgttgatttattgttgaagaaataaaactattttttataaatttagtgtagcctaagtttacagtgtttataaaatcgacagtagtgcagtgtcctaagtcttcacatctactcaacactcattcaccgactcacccagagcaacttccagtcctgcaagctccattcatgataagtgccccatacaggtgcaccattttttaatcttttatattgtgtttttactgtaccttttctatgttcagatatgtttagatacacaagtacttaccattgtgttacaattgcctacagtattcagtacagtaacatgctgtacaggtgtgtggcctaggagcaacaggctacaccatacagctcaggtgtttggtaggctacatcagctaggtgtgtgtaagtgactctatgatggtcacacaacgatgaagtcacaatgatgactcatttctcagaatgtatcaccatccttaacatcattaaacattcatgtatttactggattcagcaatatcttttgaactgctgtcccccaaattacttaattattcccttttttctcttaggaaatgctacagtgaatatttaaaattctatgtaattattaatcccaaacctttgtggatatagaaatcaacatttatatagtctgcattttacaagttatttaaacatttgtgttgttaagctgctcaaaagccggttggcaaggtctgcattttatgcacaggaaaaaggagaagatcattccatgtaaaggagattcatctgaagacaagcaggattgtgtacaagtagagagaaatgtgcttttttatgatgtatcatgtataaaggcctgttcccaaatttctgaagcacatggaagttctggtgtaaaaagtatatctagttaagacagctgtaggctgggagcctgtgaaaggaagattttgcttgttaatagaatgactgagactacatcatcctgtgtagaaaccagggaataacacttgtactgtgttgtgttaagaaaacaggttctttaattaagtgatgtacctgaaatttcaggtaatgactacagctctcctgaacacccaggagggcggtgacactgagtcacaggcagaactatgaaattccttgtgaaactcaactttctgttcttccagcctttcccctcccgcccctcggctcagccacaggtgctcattaaacctcgcccagggagcatacctccaaagctttttcacaggcatgtggcccacctttggattccgaccctatggtcctgggaagtctgcatttggagcgtgtacctgaagggtgttaagcacatttaacctctgctaagataatcagacagacacccctagaaagagatatagaagtaaggtgttgactattctggggtttgtatttcagcaggacccccaaagtttgagctgaaaggactaagttctgtggggaggtatcagccagaggtggggacctcttttgggatacctgtgccttcccaccgtgagccgctgtgccctctgcctctgctgcaggccagccgtgctgcattccatatgtaaagctgtgtcgtgctttccttctttccctcagaatcctccacgtctgttgtgtgagaacgacatttcactaaggaggacagacagttagcttctgtcagagaagaatgtcagagctctttcattttgtagatgctgcctttagcttgctttctgtgtatgttatgttcttctacccttgggatattttgacaccagtggcattgttttccattttctcagtgccagagaagctgggatgttgtagaaaatatttggtttcaaggttaaaaaatgttatttcttttctttttagatcttatctaagctttctttgcctacccgtgcctgggaaccagcaatgaagaagagttttgcttttgacaatgttggctatgaaggtggtctggatggcctgggcccttcttctcaggtggccaccagcacagtcaggatcttgggcatgacttgccagtcatgtgtgaagtccattgaggacaggatttccaatttgaaaggcatcatcagcatgaaggtttccctggaacaaggcagtgccactgtgaaatatgtgccatcggttgtgtgcctgcaacaggtttgccatcaaattggggacatgggcttcgaggccagcattgcagaaggaaaggcagcctcctggccctcaaggtccttgcctgcccaggaggctgtggtcaagctccgggtggagggcatgacctgccagtcctgtgtcagctccattgaaggcaaggtccggaaactgcaaggagtagtgagagtcaaagtctcactcagcaaccaagaggccgtcatcacttatcagccttatctcattcagcccgaagacctcagggaccatgtaaatgacatgggatttgaagctgccatcaagagcaaagtggctcccttaagcctgggaccaattgatattgagcggttacaaagcactaacccaaagagacctttatcttctgctaaccagaattttaataattctgagaccttggggcaccaaggaagccatgtggtcaccctccaactgagaatagatggaatgcattgtaagtcttgcgtcttgaatattgaagaaaatattggccagctcctaggggttcaaagtattcaagtgtccttggagaacaaaactgcccaagtaaagtatgacccttcttgtaccagcccagtggctctgcagagggctatcgaggcacttccacctgggaattttaaagtttctcttcctgatggagccgaagggagtgggacagatcacaggtcttccagttctcattcccctggctccccaccgagaaaccaggtccagggcacatgcagtaccactctgattgccattgccggcatgacctgtgcatcctgtgtccattccattgaaggcatgatctcccaactggaaggggtgcagcaaatatcggtgtctttggccgaagggactgcaacagttctttataatccctctgtaattagcccagaagaactcagagctgctatagaagacatgggatttgaggcttcagtcgtttctggtacgtagtgtgtttgaggcatgtcctgagcttgtctccttttctctttgtgtcttatagctcctggatggtggtataggtgagccctgctccctgcctcccatgtcaacagtggaacaaaatcctgcaaactttccttgcatgttaaatttgttaagatagaggaaatataatctccaagtgtctagattttgcttttcatgtagttgggattttgtattagtctgttttgtgttgcttataacagaatggctgaatttgggtaatttataaagatatggaatttgtttcttatagttactgagaagtctaaggttgagggccacatctggtgagagccttctgccagtggggactccggtgccacagggcatcacatggcaggggtgctgagcatgctcacgtggttgcttaggtggctcttcctctttttagaaagcctcgatgccacacctgtgataacccattaatccatgagtggattccattcatgagggtagaaccctcatgatccagtcacttcttaaagccctcaccttttaacactgccacattggggattatgtttccaacacatgaaatttgggggacacagtcaaaccatggctgacttgaatgcgaacctccttggatttgggcttcttttctggagagaattctgattctgtatcctgaaatagagcactgtgggaccatccaggcccttttcttaccaagagaactattatcaccttctcaaaagattttactgctaaacaacagaaccttagtctcatcacctagagaccatgctggtaaaaatgagagttaaggaaaggatttataaatgatttttttctccctgtttgatgaatataagagaagaggtaaaggtgagggagccaccaggcttttatattttttaattaaaaaattttttaatttttttagggacacggtcttgccctgttgtccaagatggaggatagtgacatgatcataggtcactgcatccttgaacctttgggctcaggtgatcctcgcacctcagcctcctgagtagctgggactacaggtgtgcaccaccacaccgggctcattttttatttttatttttttgtagagacggagtgttgctgtgtttcccaggctggtcttgaactcttggcctctagcaatcctcccgcctcagcctcccaaagtgctgggattgcaggcgtgagccactatgctcagccaccatcatgggttttaatcagaggaagcacgaagtcagattatattttagaagactggtgtggtgtcacagtacagtgtccatggaggcaatgagaccacgtaggaggccgggtgagaaagaggtgggtttgaaagacattcaggagggcagctccaccaagcttggggtcaccaagaggggtgtgtgatggggagggccatggaggaaaggggtaactgggatgagcctttagctgagatgctggaggacagtgggatagaagggccttgaattttgagggagagtgtggggccggaaatgcagagtgtgggaagatgacagagacctagaaagagtgattgtgagatgggaaagaattagagggaggaggaggggtctcctagtcaccctggacataatgcgagccgcagaggccaaggtctgaatcgtatcttcgcgggttaactaggggaggccattggaggcctcggcagctgcttcaggaccctgggaaggtgggagcccagcttggctgctggtaagggtggagaccactagtagcttagattagggataaagaggatgataggtgagtggagatggttgagagaaatgctgaagataaggagggaaggggcacatgttgtgaggggcagctgtgtgggtggtgtgttgtaaccgattaggtcccagacatgggccctgcccgtgcgtgtctctgtggactggaccaggacatggctggcttcctcagccttttggctggagctcggtactgtagggagcagcgggcccaacactaagaagagctgctttcagtggcgtgggcaagcccactggcagctcagtgctcagggatggctgaactttggtttcccacatcatttcctgtggtcactgagataaagtttgtgtccttgaaaagttcactcagctgtgagtctttgctgcctcccctctgtgcccacagcacacacctactgctgaagggagtgggcattcatgtggagtggcctggccccattttgtgctttgtcttttgtatcaagtttcaggaaggagtttctttaaaacaaaaatcaataaggaaaacacaatagaacagtaaatcctgtacgcaataggtaagaaatatagtataaggtaaacatctgcctgtttttgtgtgatgtttaaagtctttcaaccgtgcaatcaggttattagtggtaaaaagaaattagcactgaacttacatattacagaataattggatttgattaaataaacctagaaagaaaagaatagtgatttttttaattgggcaggattatgagaattttatttagccgaagaggtatttagggtatcagacttagcaaataaaaatataggacatctacttaaattttaatttttcataaacaatgaatggttttttagtataaacatgtccagctcaatattcatgacatatgtatagtaaaaattatttgttgtttgtctgagaatcaaatttaactggatgtcctgtattttacctggcaactttaatttggaataaaccattagtgtgccagtttgtatttgaagagcccttcttgattgattaggagctccttgaggacagccttgcggccagcgtgatttgtttctccttggactcaatagcaccccgcatgcagtaagtattcctgaaggaaatgaaagataaggtgaagttacggggtagctcagtggaaggatttaatatagagaactatttacaaaggtattagagagctggaaatccaaataggcaatgggaagaaccccagagattaacaacagcagggagctctgtcctccaggatggctgagggacaaggtagttactggagcccaggggctgaggctgctcggtgggagccgggacaatgaaccctcaccaagagccctgaaacctcttgttctgaaaaacatattatttgctcttctaatttgaatattttctgacattttatcctagaaagctgttctactaaccctcttggaaaccacagtgctgggaattccatggtgcaaactacagatggtacacctacatctgtgcaggaagtggctccccacactgggaggctccctgcaaaccatgccccggacatcttggcaaagtccccacaatcaaccagagcagtggcaccgcagaagtgcttcttacagatcaaaggcatgacctgtgcatcctgtgtgtctaacatagaaaggaatctgcagaaagaagctggtaagagatgaacgcccatgttgaacttaggaatgctgcgtatagacctcgtattctcccttcagaatacccagcaactgtgtttatcagtagccctgataaccaggtagcaagttcattatatagcataaatgtttgtctaatgtccttgtataactggcattgtgttctttaagaagtatttagtttgagataaaatatatctctgagtaagttagccattgaaaatccagtttaaaggtcatagtaccttttgtggatagacttctcagttaggttgtactagtattattccatattttgttccctcccatcccatcaaccccttactataaaatgaataaataacctgcattttgtatagaagttccaatttcaaatattctttcttgttgttcctgtaaaccagagagtgtttgtaggaacaacaggacagaaatatgtggaaatgtcaaagttttgtcctccagaatgcatttccaatacttttaaacctgaaagtacaataaaattcggatccatttatttgtttggaaaatctcttaaccatgactctaccttgccaccagaatcactttctcttttcttaccccagtgatgtgtctttttacttgaactccctggcccttagaatcagccctgaattcagatgacatgtttttccagcctcttgttcactatgcattatagcttcctgcagctctagagtgactgttagcagatggaggtgttaataggagatcccttgttatccatggtctgactgctcataaaattagcctataatctcctatagcctatgtttctgttcctgacttgaatcctcatttttatcctatgtggcatcctttctgaagcacttccttcctttcatttatttgaacgaggctttttttcccatgtaaaactaacacaatagtgttagcaagattgtgggatttctttttcatacctgaaagtcattagaaactataaaagagtaaggaaaaccacttttgaaaattctttattttttccttgtatgaaagtatctggagaaaaggagaaaaaaaaaaaaggatatccttccggtaacagcagtcaataactgcagaccacattccttatttcattggtgtcttctaaagcctgagtgagaatgtgtccatgggcaggcagcatgagcatcacctgggagctggatggacctgcagactctcaaacctcatcctagaccgactagtcagaagctctattttaacaaggtcctcgggtgattcatatgtccattaaagtttgagaagcattgttcttctagaatagtggttgtcagacttccctgtacattaggatcacctggggagctttttttttttaaaaaaaaatgatgccttgggaggccaaggcgagcggatcacaaggtcaggagttcaagaccagcttgaccaacatggtgaaaccccatctctactaaaaatacaaaaattagctgggcatggtggcacgcacctgtaaccccagctactcaggaggctgaggcaggagaatcacttgaaccctggaggcagaggttgcagtgagccgagatcatgctactgtacccagcctgggcaacagagtgagattccatctcaaaaaaaaaaaaaaaagaaaaaagaaaaaaagatgcctgccacctaccctgggatactctgatttggttggtctgggtaagagaccagacatcgtgattgtcgaaggctttccaagcaagcctcatgtgcagcctcattttcaaacagtgtttgaaaactgctgttctagaggattctgggaagatgtgtttctttgttcggttatattgactgtgtcaacctagaggccctgcccacccagagtgttacagccatgacctgatggttccaggtgttctctccgtgttggttgccttgatggcaggaaaggcagagatcaagtatgacccagaggtcatccagcccctcgagatagctcagttcatccaggacctgggttttgaggcagcagtcatggaggactacgcaggctccgatggcaacattgagctgacagtaagtactgtgggtgcgttacggggttacaggcttctgacagtttgcattttggacacatccatctttgtgattagtaaatttccccatcttggacgtgtctggtttgttgttgttgggtattttgtttgtttcactttcctttgaagccgacaacaatgacttgttcattttaagaaaggtcagttacgttaaacagtcatggggaggatcccactgagagtattcagggtgttaggaggaagagatggtgagctgcaggagtatagaagaaacaggaattaaagacggtggactgccctgagctgggtggttagggggagttgaacatgaacacagtccttcaagcctaaaaagaagctagcatgcctgcaactatctcaaggcagaagagggaagtccatgtggtagaaagtgccattctaagagaaaagggcttgtgataggtgcatgggtgtctagagggccaaagtgctccacaacactcagtctgaggggaatgctccaggtagtgattgttgccagtgttttgggtggggaggtattatttcccatctgtctacgtgccaacacattattgaaaacaatggatgtgtctgatgcctagaacatgctatgtttgaaagcacttctgtactttttgtacagctctttttgtgtaagcaaagggagacttagaagaactcacagagaattgaatgatgctgctttacccaggccagagggtttctacttcctttgtgtgttttgtcagtgccattagtggtaactggatgtttgaggggaaagcactgaggacacagaggcccatgagctcctgataagccgtgttctttgtggagcaaaccctttgctgtggtagggcctccctgtgtctggagggcatagctgatacttgctgggacacagctttggtcagccccacaagaggtgcccaacaagaggggcagggtctctgctgcaaacctctggatctacatgtggacatctctgcctgctcagacttctatgtggaaaatctaaagcaagaggattattggaaaaggtgtacatttcttttaaacaatttttttattgtagtgttcttttttcttttagcacacatttattaaacaaagggataatcctaattaatccaacacactttgaaataactgcatgtaaaatgtttgtgataaagataattgaacacagtaatgaaaaaaaaaagaaagaaacagtatggagatttgctcattgaactgagcttggtcattctcttagttaactcctgtccaaagtgatgatggaatttttattctactttttcatagatccgagtacaggtgacattgttcatgacacactccaccactaatttcccatctttcaattttcttgttattgtgctttccttcccatcccactcctgatgctgaaccaatgcaccatctgtaaagttgcagacagtctgtgtttttctgccatcagctgtggtttcttcaaactcatctcccagggtacaagaaaactgtgttgttttcaaagtgctctcggtttttgtggtgaggtttctgccatcacaagtgatgatacaatctggcttggccattgcgcccattttttgcaaagctattcccactcctagctccttcatgtattcatcaaagcctttgctgtccagcaggcgccatcttccttccagctgctgaactgtggccatggtgggtgcgggcgggctggcgtgcagagcagggtctacgtcggcatggcagcatgctgtgtctgtagtgttctttttttaaaaaaaccatgctgtatcaatagttgcattgtcatcacatattcagattttatgtgaatttctgcatttaactagtcttctaggaagtgctgaccactgatactcagaagagtgaattgtctgtttgcttcatatttgcctaatacatatcccaggaatagcacgtcacacttaagacttccctttcccatgtcaggatacacaacatggtacggcacaagcggtgtaggctttaaaaaccgggtttgagttttggccctgtcgctgcagggatacttctgaacctggtctgagaagactcacctcatgctgcagatggcagtggctcagagcagattctggagccagcccatctggggacgtgcttcagctctacccgtcactagttgcgcgactttggacaagttcctaaacctctcagtactgcggttttgagacttacctcttaggtttggtgtgagtagcacaatgcctaggacagcaccagccatgttgcaagtgcaaagtaaatgctacctgttattgttgttgttataaaaacaaaaggagagcagagaagtaccattgaaatatttggatacttgatttttaaaattctgttggcagtcacctgccaacagataagctcctaagttttcctggtggtccttgcagtcccattttttccttgggtcttgggccaagttgaatgcattctgattgcagatgagctcccctcttcttcctccctaattccagatgggacccttggctctttttgtatttattctgggatcactgatgcgaatttcagcatgcagctccagtcacatcattccactgctcattacccctcagtgacttcgcatcaggtgctagcttagcaacactttagctggctgcttgagagccttcaggctgtggacccatccagccctgcagccttccctcctctccctcgagcatcctgtgtccagagaagcctggcttttgatgtttgcctgaatacatcatgctatcctgcctgtcgtctttttcgagcttctccttctggtagtgtccttcccttcacttgtcaatagcctatttgtaccttgggaccacctttgattacatctcctgcatcagccacttttctcctgttaataagaggtattaacatcattacccttggagccagcagagcactaaaatagggaggatgctagcagcagctgcagaccgcatgccagcaacactcaggattacggagagtatttcaggagtgcagcgagtttcacagaagtgcacaaccccgtacaggcattagtatcccggctttgccagtgaggtaacagacagtggagaggggcttataaaagcccatctgtatcagagccggaagtcaagccttggtctgttgccatctgcttcacgattggctgtctcttgtacctgttttggggaagagctactctttagtccctgaagccgctggaggaacgttgagaatctcacatgcggggtttggaggtggagtccagggtcttgagagcagtgctgaggagggaaaggctcttggctgcctgttacctagactccctggactggctttcacaggctttccttgatcctgggtctgtgggattcttgccatcctgtgttgcagatcacagggatgacctgcgcgtcctgtgtccacaacatagagtccaaactcacgaggacaaatggcatcacttatgcctccgttgcccttgccaccagcaaagcccttgttaagtttgacccggaaattatcggtccacgggatattatcaaaattattgaggtaagtaattcattaaaaaattgtagtcacctttttaaaaacagtaatatataatcagtgaagaaaaatgagaaaatatagctaagaaaaaatgaaaataaccaaaattcttcaacttttcccatggaaataagctcagtcattttaaaataaactgcaggtaagtaaataataaataatctgagggaggatatcagtgaatgggtaagagaaagatgaggaaaagacattattattgttttaattttagatattccctaagaaacatcaatattgtcaagataccctgtacatagggttaaagtgcctaattgtaatttttaagtgtgatctttgcccaaacgaagtatctgtagagcaaaggaacgttggccttggaaaaaatgatccacattttgccactatgccaggccactcttgttgtggagagcttggccgcttctgctttggaaaatccgtgagaattttcatgcgtgccctgcctcttactcccttcccagtttgtccacagacatgctatttcctttttacattttatacaatactaggctataagagaatgagcatcagtggtgatctgaatgggttaaggcagtcaaaactgaaaaagattaacttgtaacagctagtaaggataaattaagtttagtgggaactacatgttataaaatcgcttatgaaatgaagcctcttatagcaggcttaatgtagtatcctgaatttcctcttcattgtgtgtgtgtgtgtgtgtgtgtgtgtgtgtttaaagagagatgctgtctgttatgtggcctgggaaagctttttttttctttctttttttgacagagtctcattctgtcgcccaggctggagtgcagtggcatgattttggctcactgcaacctccgcctcccaggtcaagagattctcctaccttagtctccccagtagctgggactacaggcgtgcaccgccatgcctggctaatttttgtatttttacttgagatggtgtttcgccatgttggccaggccggtctcaaactcctgacaccttaggtgatccacctgcctgggcttcccaaagtgctaggattacagatgtgagccactgtgcccggccttggagagtttttttttttttttttttttttgagacgtggtctcgctcttgtcccccaggctggagtgtgatggcatgatctcggctcactgcaacctccgcctcctgggatcaagcgattctcctgcctcggttccccgagtagttgggattacaggcacctgccaccatgcctggctaatttttgtatttttggtagagacagggtttcatcatgttttccaggctggtctagaactcctgacgtcaggtgatccacctgcctcagcctcccaaagtggtgggattacaggcatgagccaccgtgcctagccccgggaaagctttttgacatggaaatgatcatgctgctgatggtccagggccccacccttggaggcagacagcatagcttttttatcagctgaggaaagatgctcagagaggttaagtaactttactcacaatacccagctcacggacagcagaactggtgttcaaacccaggtcttgtgcttccgagctcagtggcctttgtgagtctagtacaccacaaatcttaaagaacagtagtgatatggcattgatgaggctcagacatcagactgatgcagtcaacagcaaggagagtcccatgtggtgcttttgaacacaacttagtcaccatttctgatttctttctttctttttttttttgagttggtgttttgctcttgttgcccaggctggagtgcagtggcatggtctcagctcactgcaagctctgcctcccgggttcaagcaattctcctgcctcagcctcccgagtagctgggattacaggtatgcaccaccacgcctggctaatttttgtatttttagtagagatggggtttcgccatgtttgtcaggctggtctcgaactcctgacctcaggtgatccacctgcctcggcctcccaaagtgctgggattacaggtgtgagccactgtgcccagccaaccctttttgatttctgatacctcacttgcttctatgctacccagcctgctaagtgtggtgtggcatccatgctgaccttatttggggactattgctaatgtctgtcctccattcttgcatctctgggccattttttgctaatataattaggctggtattacttgtaaaaggatttgtctttagacagtctcagctgctcttcctcccaccccaacttttaatttttgtgtaaaagtcccagcaccagagttctggggcccttctcttaattgtgctaccagacaagagcattcgtggcagtttttcctgtgtgtattcataaagagtatcagagatatagtggtcagatgaacgtggtaacaaagcgcttgagttaaactgtgagcaaagcacaagattgcggtgtaggctctgttggggcacagtggaagctgtgcttccaaatgctgaaggagccgagttctgccgcagtggcaagaagcctgggctggaagctggaggctggagctctgagtccagctcttctgagaagggtggggctttgggcaaggtatttatcctctccgaccttctgtttcctcatacatggaatgaagatttctgaccattaggtatctgggattccttcactcaaaaatgctgagtttaaattataagtcagcactgctcagctttggagtctggggaagctgtcttcccagaagtgctgaacttctgcacagggtttgtagggctattgggtaaagaagttgtaagcagaaaacccacaaagtctactgaggcacttttagattcactttctaatttccaaagctgaaaagtgctttctgccaatgcatattttaaccaagtaccttcctcctttttccccacccctctctttttaatgacaaggaaattggctttcatgcttccctggcccagagaaaccccaacgctcatcacttggaccacaagatggaaataaagcagtaggtagaacacaaaagataaactccagctctcatctaagtcccttcctctacctgggcccaactctgccagctggtcttgtcttcccatggtgccttcctcctggattagctgcctttacccttgtaatgtgaaccctctgaaacagtgctgtccaaaagaagttctggaatgatggcagtgttctgtatctgcactgcccagtgtgatagccgctagtcacatgtagctagtgagcacttcaaatgcagctagtgtgactgtggaaatgaatttttaatttttaaggaatttcaatttagctacctttagctaacagattggacagcacttaagttgggagggagggagagagtgtagattttttttcctttgacaatgttttcagactttatttgcatgggttctagaactagaatttgaaggcaggcataatggctgagtggaaagaaaatggcccaggcgcgggagacctgagatcattcattatttcagatggccagttactcattcagcaccataaaggctgctgttgtgtgcagggcagtgtgctaggtgctggggataaatactttccctgtctcggaggggcccatagtctggctgagaaagagtgagtgagcaatgaaatcaatggctctggcagattctggaaggtctaggaaaactccaagcaggggacataagatctgagcctcaaagaatgagtggaagtttgcttggctgaaggaattggtggcggctacccttggggactgctgtggcttggttcagtaggcatgcctggggcacaggaggagcttacgggagaggcatctgaacagccagttgggggtctggttcttgggtagcagtccaacagcctaagacttcagcctcaaaggccagtggttttcatgtcatgttttaggtgcatttgaggttccacaaccactcggttggaatttcatggatgctgcagctaacatgagaccacagctgtcagccatgacccccgattccaaactatggtgttcattgagacagccagtgatcactgttctcatggactctattttaaataattgtttaaagatagaatgtataagtttatactaataaaatactgcttttatctatttttttctttgggggtctgtataagattgcattttgaaaagaaagctataggcaaccataggccgaggatggtaggcacctttggggctagattctcagctttggggcctcacttgcctcacccgtaaattggaggtaaccacagtatgtgaaggcaggggctgggcctcaacatctttggaacctccttatagtgatgtttagacctctagatgctccctcagatggccagtgtcagagagagagagttcttactttcattttaacccctggtggtctgtcccagacatgtgacaaaggcaggtcttaaactgtgtcctcagaaggggagtggcttgtaatccaggtgacaagcagcatctgatatatctgtgttgctgcatttgctttccaggtggaagaagtctttcctgtgcagcctggtgtttggcatccctgtcatggccttaatgatctatatgctgatacccagcaacgagccccaccagtccatggtcctggaccacaacatcattccaggactgtccattctaaatctcatcttctttatcttgtgtacctttgtccaggtatatatgagaaagtgggcagacctctcccttccatgctgtgtgtggccctcagatattctgcccgctaagcgcaaacatagtgctttagcttggtttaaatggcactttattgcagctttcctgccccacccaggcagttgctgctttttttctctcttaatgaccagtaggtggggcttggggcccccccagtgtgggggactactaagggcctggtttcactgtcagtttcagttgattgcaagtgatcagaactggccctggaatagcaacctccttgctgcaaggtgtggtgaactctgtgtctccaatgtgcatattgtttaggttaatttacgtttgttgctggaagcaacaactggatcacccttgagcccatgccactcttgagtgttctatcttaaaaggtggagatatggtccttgtctttcaggaagttataatttaaaagagaaaggcatgaaacgtctgctttggtggtgatattaaggaactagctgtgtgtctggtgggaagtgtgccctctatgtgtatattttggaatataaaactaaatccctgtcctaatattggaatgtttaggggctatttgggggcaagcattggtaggctggatttttttttttttttttttttgagacagggtctcaccctgtcacccaggctggagttcagtgatgtgatcatagttcactgtagtcttgaactcctgggctcaagcgatcctcccacctcagcctcctgagtagctaggaccacaagcgcctgccaccatgcctggctagatagggtcttgctatgtgcccaggttggtctcaaactcctggccttcaacagtcctccaagctcagtctcccaaagctctgagatgacaggtgtgagccactgcacccagcctgaatttgtgtttttctatattttgtttgattataagtgtaatgtacacttattattaacaattcaaaccgtactgaagtataagaagaaaagaggaagatgccctttcactgatcacattctgcctcccgcccaatctcattccccagtgttgctatggtgatattaatagttgggcattaatctctccaaatctttatatagagaaaatgcacacttgcgtgtatgtgtatgtatatgttcacgtaatacagatacagacttttttaactgaaatgggatcatacaagatagactgatgtgcagctggctttttcacttaactatgtattagacatcttttatgccagtgggttatagatagagcccattctctttagggaatggaatgccttgtgctgtctacagtacaaatgagtcgtgatttttttccccaacttttcaccattctcttattagaggacatttgtgttgtaagcactgggttttaaaggtctcacatgctcttggtcatccattcctgtggacagtagtcctctgaatgggaaagtatatttcataaacgcccatcacagaggaagaagtactgtcacgactgtgcacaaagctagaggctttgccatccccagggcccttggccctgtgtcgctcattgaactctcctccctacttgctggcagccttcactgtccttgtctttcagctcctcggtgggtggtacttctacgttcaggcctacaaatctctgagacacaggtcagccaacatggacgtgctcatcgtcctggccacaagcattgcttatgtttattctctggtcatcctggtggttgctgtggctgagaaggcggagaggagccctgtgacattcttcgacacgccccccatgctctttgtgttcattgccctgggccggtggctggaacacttggcaaaggtaacagcagcttcaggttcagaaaagagctgctccttcagtaaacaaatctcacttcctctgaacaccatgtttagaattactaattatacacagcatagagacagacttaaagaaataggaaacctccatataattaaggtgctctagtcactaatctccaaattggtcactacttctgaaatcccagctaatctggttaattattaaaaccatcattcaggtgtattgtgtaaactaaagaaacctggccttcagggcagagcctacattgtctcttggtgcaaaactgaatatgtagttggtctagacatccatacatcctcctcaaggtcatgccatttttaacacccttcattgtccccaacactgaaatgtatcttacaagagaatggaactcaggccctaaaagaaattagattgaacctaaaagaaaatggtcagtgggaagactgatgtttgtttccagtctgaaatgtaattcccggactttagtggcacaggcactgtgcatcactgtggaagtgacatgtggccatgtgtggtggatagcaagtaacgcccacctgcagagccttttatcgtgccgtgcggctgtttctctcgcaccagctgtctctaacaccacgcttgtgactctcaggctgggtttggacaggtctgctttcgatagctctcatttcacattctggttatttcctagagcaaaacctcagaagccctggctaaactcatgtctctccaagccacagaagccaccgttgtgacccttggtgaggacaatttaatcatcaggtgagttatggttatcaaatgtctttgtggttggtatctatcaatctgtgtgagctgcatcagatgcccatgttgtattgacattgcaatagaccttgtgagtgtgggcagagacacagtaagatcaccactctcaatccagctacgaaagcaaggcattgaactataaaactagcaagatttgtaggtggtgtgtgtgtgcgaaatggcacatgggaggtgtagatgattagtattccaggaattaagaagaggaaggccagtgttggtcaagggaaacttcacagagaacatagagtatgaattaggccttcctagtaagatacacattcagacaggcagagagataaggacttcaacttgctaaagaataaaaattgaaggagaaatttatcttcttcttaaggttgcctgatattaaaaataataattattattattcctggaaactcttgttgcatttattgtttgctagacactattctaatctctttgtatttaatctaaccaaagatggaaactttctgaggcagggactattattactcttaatttacagatgaggaagctgaggttcagagaggctaagcaactggcccaaggtcacacaggtattcagtaatggaattgggatgtaacccaggctggtggatccagagtctattttcttaacctttacacacactgactcttaatgcatatttaataatatggaaatttttctaattaaggcttctgtatttccttggggttagcttcttttttatattctaggcaatggttatttcagccctccttcatattcctaaaatctctccctggtcccaccacattttctattagcctgtggtctcgctttggactactggaaggagaagtgttcagatggaaaccctccagttccctgtccctcagcctacacagctagcctcctccgtggcacctcccgctcctgccccgttggtgggagaggcgtctcctccaatgcctctacccgggaacctttctctgttggttttctcagtggtttttggtgtctctgattcttatcctccgatgtcatgcagactctaaccactcccattttcagaggcgttgtgccttgcccctcccttgtgtgcccttgtccatgtatcacactgttgatggagccagcctgccctagctgtgtcctggaggcctgggcgtgaaggctgagacagaccccttgcttccccatggggtctgcagggctggtgcagctggccctgggcacgccccaggtgagtagaggaactgaccggggccacacagatgcatgagtgttcatgaggtgcaggctggctgctgcgcggtggcactggttttgttctggatcctggcttttaaatgatcatcacaattgtaggactggcaactgagatttgagtccttctggtgttccaggctcactccccagcacttgccacagatcgtctagttccactctgtagctgttccgtgaggcagcactgtcatcatcccagctttcctcaggaaaagccaagtgcagtgaggtggagtaatatccccagagtccatggcaggcaggcagcagagctgggattggaaccctggaggcacagagcccccctcagccactgtgctgcgctgcccccaaacaggaccctgtgtgacggcacctggcatgctgggctctgctgtgccatgggtctgcagcagtcacatgccttggcttcttttttttttcttctcttataaattaattgcatgaaagtttctgagaagtgaaaacgttcagacagggagccaagccgctggcagctgtgttggttttgactcatgtttcctccaactcgccttgctagggtcttcggtacagtttgaggcgcctctgatggcactgactgcagttgcttggaactattccagggatctgaacaggaggagaaggcatctgccggccgaagtgcccacggggtgcgtgcagcacctgtcataactcagttcttttccaagaatgccgattcattttttggctggggacgcacggcctgactactaccatgcaacatgacaggacattattaagctaggggccagaagaccagagttcattctgcctttggctcactgtttgggtgtggtcattcctacttgcctcctgacagcacaccccgagcccaaccctctgtcccaggccaaggctgcacccactgccgcctggattgccgcagtctaggcctcccctgagctcaaccattctgtgctttgaggtgcactggacactggtttcccagtgactctgcctcccacagggccctcccgcgtctgggcctctgcttgtgcctttggtccatggcaccatctgaaggcccccagaggttctcgcataactgccctctttgactgaggcttgggcttcttcctctgaccatccctttgctggggacacttgtgctttctctttactccaagtcttgggtgctggcagcgtttctaggtgcgatccgtctggcacactgtagtttccttgctgctgctgctgcttagtctccatgggctttcttctctcctttttccttgtggatggtccttggggttctggtggtactgcctctgtctttgtgtgttacacaccgtcactgggacgtctcactctcccacgtctttggttaacagccgtgagaagctcattctcaaacctacgtctagatcccagagactacctgctggttggagtgtttttcttggttgactggtaaaggctcagactcggcctgtctgtattcttcttcaccttcccccactttttccccaaaaatattccccttccttggtgcctgtctgtctcaggcaaaggtaccctcatgccagctcccagtgtgtcctctacaatgcctgtctgccctcattcacacatctgcagtccatcctcatggttctagcacctctgtctctaggggcgtcatccactggcaccatgctggtccaggccactgtggccttgcccctaaaacaccgcagctgtctcttcatactgcttgcagccatttatcaatccagtatttttccacattcaaaccagtgatcttcctgaaagcacaaattgatcatattacagtgctttctgaaagcacaaattgatcatattggaaaatccttcaatggctgcatgctgtccttaggatcaaaaccaccttcctaacgtggcagtgaggcccggcatccgcctgcatgcctgttgagcccagcctgtcttgccatcccctgcgttgtgctccagctgccctgcaccactggcaggtcccaggaagggactgcctctctctgcagacctctgcacacatccttccttccctctgaactcccttcttccttaacctttgcctggctccttgccttcagggctcagcatggaagttgcatcctccagaagcctttcctgattccccaggcctggctcagctgtggctcctcagtgctctcagaacactctgtgcctcagccaccctgggatgtaaacatggcgggtgctgagatactcactggtggaatgaaactgctgtcagatgttaaagaaacatactgcacacatgcatgtgtgtgcttgatattaaaaggcttgcacagccccatccccagtctcccatgttgaaattttctggtttttttttttttttttacaattgatggggaaacaaattacaaatcatatctagaccagtgaccataatgctataagttttttctttgttttcttaacttgtgtttaatgaggaaggggagtagaagagaggagacaagtgaagtaaacagattcctggcagaaactcttaaagatgaagtgctatgaaacaaaccactgtcttttaattaagagggttcctatcgctcagcacttggagaggaatagtagcttctgaagaatacatgctattgagattcaccagtaggagccacattaaccctcataaaggactattccttgtaagctgcttagagttagaaagatgtggttaatttagatcaaaggagaaattcaaagttagatttaacagagattagcattactaaagatttcttagaaagacacccaactgtacattcgtgccaattttaagtctccttacagaagtggacattttaaaacttagtgattaggttctgctggaggagggtctgacctttagttcttggggtctttcatttctaaattgaatgcagggagctcctcctcccgacttgggcttctcaggccatgtggagacctctgtgggatgataaatcctccaggttgttcagagggggcctcaagggcaatgttcagcctggacttctccatcgctggaggactttaaaattaagcagagaatattcttgggttctcgagatccttccgttctcctggctcactcagccaccaaacagatttacacaggtatactcccagcactaaagacttcagtctttgaaagtctccttttcagtactccatttattttggttgccatgattgaactttctgtgtgtgtcttaactgtccatctgtgtgtctgcttttagttatgaggctataaacctcctgagaggaaggctctactctgtcctgtttgtaaccccagcctaccctggtgcctggtacacaagaggccaatcaatatgaaaatgtcaattaggtgataataaaaatcaccagcattcattgggcacttactgtgtacaggtgccatactaagcatctcacgtaatcacaggaagtagccacacaagccttgaatcctcgtagcacagagactgttcctgaacaatttttacaaaggaaaataatgatgcaaatatttaacatacatgcctgcatatggtagttactaagttttatatagttgtacatagcaacatttaaataagtgggcatgtatgttcaattttgtgcctttctaagacatcttcaggttttgctgaaatgggggtaataagactcaccttgtatgtgtctgggaagattcagtgaggtaaaacatgtaaaaatctagcacagttcctagcactcagtaaatgtctatttctccttctcaagtaagtaagatggcttttgtgcctgtgatagtttaaatgtagtctttgtagaatgaaagcaaggtgtaaaataacctcagagccctgcttgctttccatgcatgctcttctggcttgttgaccattagctcatgagccagtattacctatacaattaattctgttgggcccatgccatgcttttagtgagctgctgctgaagctggccctgggccgtaggtgccctccctctggctttgtctctgttcctgccgtcttctcctctccccccgcagcatctctgtctctgcaggacatgtcccactagcacacagttcacatgtatgtacaagacacaatccccactttaatccaccctcccttctactgctctgtttttctgttccttcacaaaagccttctttaaaaacgtgactttcgctgttgtctttgccttctcactgcgtgctctctcagcccattctagttgagcctctgcctttaccagtttctgaacttggtttggccagtgccatcaagtaatttccatataccccaatccaacattgcttgtgttaagtcctcatttcagtctctcaccagtatttcccccttgtctgtttctttgattttttttcttttttcaatgtgtaactcacagtcactgcaacacacaaaccctacgtgtagagtgtgatgaattttacgtatatttgcccctgtggaactacttgtgcagcgtttggtgtggttggatgggtgctccctcctcctcctcctcatccccactctcattttcctcctgtgtcactggctggtccttcagcttctgctcagctttcagatagtggagtgtctcagggatgagttctaggaccccttctgtgttttctccgtcactcctaggggcgcttatatgatctcatggctttaaatgctatctacatgtgacagctctcaggtttgttctctacctctgacctcttctttccacttcagactcatattttcagctccctagttggcatttctacgtggaagtcaaataggcatctcaaacccgacatgtcaaaatgaaccatttctctccatcccctccccttctcttccctcaccctcccttagctgcttctccataatcatctccatctcattaaatggtttctctatccacccagttgctcaaaatgaaaatttggagctcatctttgattcctttctttaccctcatattcagtgcattttcacatcttgttaacacatgatctaagaatatgctgtgtatttcttctccctctctctgtagtccaggttacttccatcttccgcttgggctgctgcaacagcctgactctccccctcactcctgtgatcatccctacagcccattctcatgcagcagccaaagagatcacttaaatgtgaatcagattgtgtcactttcctgctaaaagccttacatccaaaacccatgctctgctccaggagactcggcatgatctggactctgcctgcttctctgacctcaacttgcacgtcacttacttcctgccagccttgcttgctttcttgctgtttctcagacgcacccttcctgcctgccttaaacctttgtgtcagttgttttctctccgtgaacttcctttccgtgtgtgttggaccttcttggcatgcaggtctcagcttaaatgttaccttcccagagaagcccttccatgtctcctcctccctctgccactctaagaagccctccagtcacattatccttgtttttttcatcacagcacttattaatatttaatacctgattctatcttgcttgttgtccatttctaccacagaacttgtcttcatgaggtagtagggcctttgctgtgccattcacagctgtatcaccagtgcctagaacagtgcctggtattcagcagctgcacgataaatatctgtaaatgaacagatcaaatgaatactgttgctcagtataagcaaatacagtgtaactattgtaacagctggcctagaacctgacccggtgaccgaatgagtggccatgtgagtgataagtggcgtttgttgcagggaggagcaagtccccatggagctggtgcagcggggcgatatcgtcaaggtggtccctgggggaaagtttccagtggatgggaaagtcctggaaggcaataccatggctgatgagtccctcatcacaggtgagatggcttgtttcatgttccctcaggaggatatcatagcagctgtcaggtcacatgagtgctggatggggctgagcaagtgacagttgtctctttcctacgtctaggagaagccatgccagtcactaagaaacccggaagcactgtaattgcggggtctataaatgcacatggctctgtgctcattaaagctacccacgtgggcaatgacaccactttggctcagattgtgaaactggtggaagaggctcagatgtcaaaggtaatgaagaaatttttaaaactaacttcatctttctcgttttagaaattatgtgaagagttctgggaaatcagacagttttattgagtagagattgattagtaaatgtggttaaatgaaggagattatcccaatctttatccatgcttgtggtgttttatttcttcataggttgtaatttcccatggtcttggtgttttattttcataggcacccattcagcagctggctgaccggtttagtggatattttgtcccatttatcatcatcatgtcaactttgacgttggtggtatggattgtaatcggttttatcgattttggtgttgttcagagatactttcctgtaagttgaatgccttgggctatatggtggttgtgttttaaataatctactgacattgatcctgttctttcatatcttagattcactgggctttaattattcattacattttatttgcttgcttctcttattgacagcaaaatctaagccagagtaggataaacagtcactctccttctgcaggtttctattaaagatctcctttacattctacttagataattttcacagacaccaattggtgctcagttgtaatgcttgaagcatttacaatatgtattattggtcctttttgaggttatgaggcatacatcatagaaaatagttcactttaaatctcaatggcatgataatattatttaatacattttaagaaaaatatcttttgatgtatatatttaccagtaccatctttgacctcccagcttcccaagtaatgtaaatagctttttatgtttgtttgtttatttatttatttatttgagatggagtctccctctgtttcccgggctggagtgcagtggcttgatctcggttcactgcaacctccacctcccaggttcaaccagttctcccgtctcagcctcccaagtagctgggactacaggcacacgccaccacacccagctaatttttgtatttttagcagagatggggtttcaccgtattagtcaggctggcttcgaactcctgacctcaggtgatctgcctgtctcggcctcctaaagtgctgggatttcaggtgtgagccactgcacccaggcgtgaatagctttttataatagttaaatatttactaaacattgtatgtgaggcaatggaatatacatttttgagtttaaaaaagtggttgaagaacactatcttaggaaatatggttttattaaacctcagaaaaagaaaggaaaatacaggccacccctcaaaaaaacatatctgcttgaggaataaaagctatattacatctgtgattctcagttggcagctgtgacattttcggtgtttgtgactggggggatgctgctaaacatcctgcaaggcacatcacaggccctacaacaaagagttatctggccccaaatgtcagtagcactgaggttgaaaccttgataatgtacttaaaaagctaatggcacacttagaacagtatttggtaatggcacaatgagcggaacaatgtttttaccttatcttattcctagcccagtctagtgcttgttataccatagagccatagaatgagaaaccatactgggtgtggtgatgcacctgtagactcagctacttgggaggctaaggcagaggatcatttgagtccaggagtttgaggctgtagtgtgctatgatcgtgcctgtgaatagccactgcactccaacctgggcaacgtagcaaaaagtacaaatacagaatggataatttttttcttttaaaaaaaatccttcacataattaaaagtatatcaaatattctcaggacacatgtcatttactaggatgtattttctccctcaaatttcccatcttaaattgaacaatgttcaagttaaacactttctgacatctaaggaacctcagtgctcttaaaagtaacttacagatatattggtagaatgtgcctgtggctatccatggcacctgactgcctataatttcggctttttcgggaaagcagtgcgttggcatatggccatgggaagactcagtcctaaacaagttggaatctgtggctttctgctgttccatgcctttccatcttactttggcttcttttgtttttatctgcaatatcagggaggatgctggcaaatgaggtactgcatgttcctttaagatactgtcatctctctgctgtacaaaagtcattgtagagaagggctcatggtaacttccagaagtccacccagtcctatcagaatgccaggtgtgattttgacaagaattagtgtatttttaaaaaagattacataatctttatgtctaaaaatcttaatatatccctctacctaaatataactgtttctatgaaaattaaaagacccctttaataatacattattttagaatcctgcctttcagagtgaaataataaaatgtagatggaagctaaagaggctgtggtccatagccttaccttagacaactgtgctttttactataagtaagtgaacatagtatctcttgattatactccatagccaccagccatttttaaaaataaaccaagataattcaagctctcagaatgcaaataataccaagtgtctggaaagtaggtcatattttgtttgttttgggtacaaagaaaaaatagtgaaaaatacagagaagaaaataaagatacctccaaatcatatccctagaagtaatttttttgcatattggtggatacctttccagtattgttgaaatgctgtattcagatacaggcggagatttttgcacgaataaatcccagcacatgcgattttgtacttgctttttaattttgcagtgctgctggtacctttccatatcagtatgttccatcatcattccaatagttgcctcgtatcccattatatacatcacacctacagtttaattaaccaattccgtattggttgtttccattttttatcattacaaaaacaaaacaaaacactgtggtaaatatccttgcatcttttcttatttatatgattatcaccttagaatagcatttttaagctttcctaatgatgagaaaaataacgataatagttactgtttcttaaatgccgctcctatgccaggtgttatgtactgtgtatatttatatgtttatatgtgtattgcctcattcaatccttgccacaatttatgagctatgcattatcatctccattttgtgtatgaggaaaccaggatctggatctgtgtggtccatctccagagtctgctttcccctatcaagggcttttatttgactctgctcctgtaatgcctctttgagggaaacctgtaggatgaagttggatagctgggatgtggagagcagtaacgtgttctctatgatggcagagcagtgtggaataccatctgtttccggaacccaagttcgtcacgttgtgtccagtgcccccctgaaatgtccttatgtgattagagttctgggagcttccttattgaactctcaacctgcctctgactctgtcctgttttcagaaccccaacaagcacatctcccagacagaggtgatcatccggtttgctttccagacgtccatcacggtgctgtgcattgcctgcccctgctccctggggctggccacgcccacggctgtcatggtgggcaccggggtggccgcgcagaacggcatcctcatcaagggaggcaagcccctggagatggcgcacaaggtcagcctgtagcacggctttccccatcctgagagatgaaagtagtatctgtttactatttcacattgagagaaaagcctgagagccactcaagacagcagtgttaattacatagaataggaagtcaagtataactgggaataacaacagtagcaacagagtagccaccagtcatataatggaacgctttatcaacattacttgatttaattgcattaacaactctgtgtggtaggtgcttatcattcccattttacagatgaggaaactgcagcaggaggagattaggtaacttgaccaaacgcctgcagctaaccagaggcagagctgggattcacacccaggtagccaggcttcaggacaaaagccccaccgtgacatctgtgggattagtggtgggtcctgtgaccctggggagtgaagagtgagtgacggtgtttgtgaagagtcttccttttgcccaacttactaacctctggccttccacactttcacctatttaatcagtatttgctgggcactcactgcgtgtgagccctgcactgggttctggcgatggtcatggtttccagccgccaaggagcccaccagggggaaagacagacagtgaaaaagtaaatagcaaagctgactgagtattacgagatactgagtattgactggtggtgcttgacgtcctggggacacttgaacaggggccaatcctagacttggggtgctcgactcagggacaagggtgctgcaggtggtcagggaagcgaatacgaacgttcatctgagaccttactgttgagtgagagctggacaacggagctggggaagagtgttccaaaatggggacagaaggtggaaagcacctgtggaggtggaacttcccctccccgcggtatccccagcatctaacctgagacatcaagtgcattcagaagttatctgttgaatgagcaaatgaggaactggaagaaaatcattgagagagaggaaccagagatgaggccgttgagggaggggccagaatccaaaggctgaagatttagtaaagtgttctgaacgttagcctagaagccacgtaggggatggcatacccacgtgatgtgactggatcgtgtgttgggaagatcattccggctgcagtgttaaggttgcgctgaaagctggcaagaatccctggaggaagatgagttaagtgtgttgaaggaaggaaggccaccgctcagcatcagaaacaaaaagctgaattattgtttgcttgtaagggagaaccctgcttgtgggacatggtctgagaagagcaacctgctggccttaaatgggtaaaattatacacttcaggaattactggactttcagaagcagggctcagggctcgactggccctggtcatggaagtgcaggtacctgaatgtagctgctgcccatatctgagcccagaggtgtggggactctgcagactgccattgactaagtgtgaccaacttaaaactggctctgggggtttgtttgtcattatggccatagaatagtcctttcctttcttgaactcagagtgtgaggactctattcccagtagcttttgcacttaggcaggcaaaaggaagctgaggttgggctcggcggatggcagtggacagggaggcaggtgtccctcagggtcctgactcctgacctgatgtgggggagtatgtggatggtgtcactgtctgggggacagtgctgtgccatctcctgtacagccgactgagggtttctggctttgcctggtcaaggtcaagcctcagtgtggctggtttgactggacacatagggaaacagtttctttgcagtgggagttgttgaaccctgagattgaacgacagaggatcacgttaggaagctgtgcaggtgtcttgtttcctgtctgaggcaggttgggtgaagttctgcctcaggagtgtgactatggaagcccctccatctgtattgtggtcagtgagttgtggttgtttttggcagataaagactgtgatgtttgacaagactggcaccattacccatggcgtccccagggtcatgcgggtgctcctgctgggggatgtggccacactgcccctcaggaaggttctggctgtggtggggactgcggaggccagcagtgaacaccccttgggcgtggcagtcaccaaatactgtaaagaggtacgtggacttgggcgtggccctgccctccccgccaatgctcttttattcctcaccatgtccttctctcctagctgccctcgaggagccttctctgtgtggtctggaaaaccacttagagggcccttctgcagcaggcggagatatagggctcacagtcagcccttgccacagttccaggttatcacaaagggagttcagtgtcacaggcatttgctgaacatcaccaggcgccaggctcaggagaacaacaggagtgggatatgaactctaccctttgggagctcacggtcttggggagtacgggcagtctggaaactcagtgctttgacagtgcttagtgcaaggggacacaaacatgaaatgggagtactggggtggaagggagaaatctactcccctgggagcacctgggacagagaggaaccagcagaggtgagccagagtgcccagcaggttcctggcacttcgtggagaagcattgccttcttttggtctctccacaggaaaggttctattttgttttctcttaatttcagtctgaatataggggcagcagaacgcgtcacacagaatattgccctgacaacttttaaacagcctgagcaatactgttagcagtaaatgtagaaaggtgacatcattgccttgaaaaacaattgacaactcttcctgatcaggggctcttccagaaacctcatttctagttttgtccttcatgtagggtcagacagcccactctttctcacctcacccttctgacatttcagggagaatcttgctcaccctcagtcatcctttatttgttgtgtggtctggaaaaccgcttagaagggtcctctgcagcaagtggagatgaggggctcacagtcagcccttgccacagttctaggttgtcataaagtgaggtcggtgtcacagccatttgctgaacatcaccaggcgtcaggctcaggagaacaacagaagtgggatgtgaactctaccctttgggagctcacagcctgggggaggacgggcagtccagaaaccccagccattcctttaccctgccaccttgtcccctcctcctccagggtctgatatacaggcagttatctcttgatagtctcaaagagctttgttaacactacttattccattgtttttaatgaaattatttgcaacataaaattcacatctccctctctttggcatctgcagtcctctttaatttgaggtgtttgatatgagttgcctttttcctttccagtcggtaacctgttcactgtcatgaggcacccacccagggaaggattttaggctgtttaaaatagtctcattcaacttacagctataatatctttaccaaaggagggagaaataattacaagttactagtcactatcttaacctttcctatctgttccacctccctcccctcctttctctcagttcccgctttccgctgctctcttgccaccttcaccctgtgtccctgtcctgcctgcccctccctttcacttcacccctcttggcttacagtttcctcttcctctctttccaccttcccaggaacttggaacagagaccttgggatactgcacggacttccaggcagtgccaggctgtggaattgggtgcaaagtcagcaacgtggaaggcatcctggcccacagtgagcgccctttgagtgcaccggccagtcacctgaatgaggctggcagccttcccgcagaaaaaggtattgctggcttttgtctctgcagctggttaaaagtagaggtgggtcaaaccacagagagcaccacgcccagcagtgattgcctctgctgtgcggcagacggttcatggctaaggcacccaagcctgcctccccacacccaggaaagtttctcttatgttcttgggtgcgtctaaattttgttgcttatggctgccttaaattcatagagcattgtttagctgacccatgattttgattctcctctttcttatcccatatcggtcttgcttctcataagctacagagtagacagacgggaattccactttcgttcttcctgtttccattctgtatggtagaattctggtatttacaaagcaggcagaaaaagtcagggaaagcagagggaaatgtctgcccaagccaggaagggacactgcttggagggacagctgcttttgaagaatggccttttttattctcaaggtagcttgccagccaccagaataaagggtggaaaacactcaaaatctgtgactagtgtttttcctaagtgttggtagtgaaattgtggcttagattgtgtggttagaagccatccaccaccttccagcctttaaaaccccaggatggcctttccatgagagcttccagagcctggccgttcagtgacacctcagctagcagcacacgctgttagaaagtgataggtgagaggtgcattagcctcgggagttacagttttaaacatttcatgtagacgtgtctgattatttgttgattcacctggggttgttgataccaagcagtaatgaatgtagtcaacacttgctttgtgtgctgggcaaatacctgagtgcttctaatccctgcagaaaaagaatcagtggatacttctaagacaaagacggacattgccttatgtttaatacgtttataccatttccacccatgtagcatgtactattaatgccccatcttaattcatacccacatgtcctacacattaattttactttttttttttttgtcctaaaggatgctgtcacaagaggtgcttacaaggttacagtttttcagaatggttaaaaggatattttgctgttaaaaggattgcatggtttttagttcacagtgaaattggaccatttagaaataaccacagcctcttttgaatagatgcagtcccccagaccttctctgtgctgattggaaaccgtgagtggctgaggcgcaacggtttaaccatttctagcgatgtcagtgacgctatgacagaccacgagatgaaaggacagacagccatcctggtggctattgacggtatcttctgcttctgccttccttccgctctctcagaaatacagttttctgcagatatcaggcaaaagagtcctcctttataaaagaaaagaagacaaacaaaagccttcctctcttaatttcaggcctgttttccagaagattgtctttttgtcttttctcttcattctttccactggctccatcttggccccagagcagctctggtctggcctcagtctccttgaccttggaattctaaactgtctgtgtcatcatcattgctcttgtccaggtgggcagttcagagtcatccttctccttcatccctgcagacagagcaggaattcacttcccagcaggtttaactacaggatgcatttaaataatgagatccatgccacccttctctgtctgctttatttatttattattactttctttttcttttttagactgagtttccctcttgtcacccaggctgtagtgcagtggagtggtgtgacttgtctcactacaagctccaccttccgggttcaagcaattctcctgcctcagactcctgagtagctgggattacaggcccccgccaccacgcccagctacattttgtatttttagtagagacggggtttcaccaggctggtctcgaactcctgacctcaggtgatctgcttgccttggcctcccaaagtgctgggattacaggcgtgagccaccgcacctgcccttctatctgctttatacagactggtgtcgcacagagtacaggtctcaagactgtgtgttggccaggtgcggtggctcacgcctgtaatcccagcactttgggaggctgaggtgggtggatcacctgaggtcgggagttcgagaccagtctgaccaacatggagaaaccccgtctctactaaaaataaaaaaattagcggggtgtggtggcgcatgcctctaatcccagctacttgggaggctgaggcaggagaattgcttgaacccgggagttggaggttgtggtgagccaagatcacaccactgccctccagcctgggcaacaagagcgtaactctgtctcaaaaaaaaaaaaaaaaaaaaaaaaaaaaagactgcatgtgttttagtgctcagattctatcctgggctttacatcccagagagattagagtctttactttgttaatgttagtttctgctaatagaagtaacagtatatgcaagcaagaaataaaatacatgacaccttttgaatgctccagccaaatatgtctttctctcacattctctctcttttttccctttttctaagtctttgtaaatccacccgcccctcggctatcaaaccagaattggcacaactaaaggagtcgtgccctctcgtatgtcatcccttactctgttctcattcacacctcagccctaaaagccctcctgcttctatagctaagattcactcaaagagaaattctgccgaaatgttttctgcaggaaaagacgaaggattgattttctagtttggacatttatcactttaagtgatatctgttatgtctcttgaattttagtagctaatgtgtattgaattcttattacaagccaggcacttcgcaaagtgtcatacgtgctccttgcagaaagtttggaaaattcagctataaaggagaaaatgaaatcactcgtaatcctattccttggggagccactgcgaagatttcaattatattgcttccagacttttgtgtacatccgtaaatgcatgtactttttaaaaagcaaaaaaaccacattgtgttatataatttgatgttttgttttttgcacataatattatatgatgagaacattgcaagtgtggtatcttggtgcggggtgccccaacttgtgtagctgctgatgctggctggttcgctccaggtgtgctctgtgggatgatcgcaatcgcagacgctgtcaagcaggaggctgccctggctgtgcacacgctgcagagcatgggtgtggacgtggttctgatcacgggggacaaccggaagacagccagagctattgccacccaggtacagccctttaatgttgcaaactgtgtaaagctcataaaagcagttagagacaaaagtaagcaccagttggcccagcactgagctgtactcctgctctttctcccttgctggatgcttttctctccacgtgtttcattctgtggccatgtagtgttgcacgtgagcactgtggtgctgtgcgaagatctcttccctggagcttgggcgcatgcatcctggaaaaaaaggagttccagggttctctaaccgtttcccagtctttgcaatggaaaaaaaagtatgtgacctaagggctgagatagacattttctaacctttatgttaagggaagattttgccagctcagctcttctcactggggtgctcagataagtgactcctgggcagttctccagcagcccctgatgctgagtttggtctgtgaggacagcaccactggatggctgcctgacttctcacacagcagcggctccagtttggattcctagaaattatgcacctccaaatgtgtgcagagctctaggcttctgaaagcttaattgtgttccttgagggaagcagcagtacccctgttttccatggtcctccttgctaattatggacctgtttagcgtccttccccccttttctggctagcacttgttcatctattcagcaggcacttacgaagcaccacgaatgtgacaggcaggtgtggggccaggctctgtgaggagtgaaggggggtctgcccttgacgggctcatggtcttgcaggaaggtggaccagtgactgtgtagatctgagaagcgggaaagggactaggaaaggaaaactgcaccttcccaggacagagcaggcagcaggagcatttcccaggggcacagagtagcacggcggtttggagatgccgcggggagctgaatggtatggtcaagtgtggcaccagctgccagaccctgggaccctgggactctgggaccctcggaagcagacccaagagttgagctgccctcctctgggagatgcatggggtctactggatgtgaagcaggagagtagggagggacatggccggacggatgctttggaaagaccatgggggcagcacatggagaagacagttggaggactgagccgtggacagggagaccagcaagggggttgtttgcacatccagaaaaggacagggcctaaaccagtgcagggtgttggggcaggagccagggataaactggccctgtgacagcaaacctgcagggtgtggttgaccaacatcactgactggacccagaggccgagggcagagggggcaagggtaacttgaggtttctgctgctatctgataccttttgccaacactaggcattgccttccttttgtcttaggttggcatcaacaaagtctttgcagaggtgctgccttcgcacaaggtggccaaggtccaggagctccagaataaagggaagaaagtcgccatggtgggggatggggtcaatgactccccggccttggcccaggcagacatgggtgtggccattggcaccggcacggatgtggccatcgaggcagccgacgtcgtccttatcagagtgagcgtggctgcagccaggctgtgggtgctgggagggcaatgggcagaccccttcctcactgtgtgctcctctccatcagaatgatttgctggatgtggtggctagcattcacctttccaagaggactgtccgaaggatacgcatcaacctggtcctggcactgatttataacctggttgggatacccattgcagcaggtaggcagctcttacccactgtgctccagctgcgcccagaaaggcttctgtctcccaggttcctgctggggttagtgagtggctcactcactggctggctagaggcgttttagaaaggctgtttttttttttttttcatgtcccctgctttatatgtctttaaatgagaaactgtggagaggacctgaaaccttcattcactctggtcctttctaaaaagctagtggagatgcttggctgtattttctgatccctattttattgtggccttattttctgagccatttgttaagtcatatagtctgagaaataatcattagtaagaattatggggcatctgctacatgctaggcacaattattggtgtttcagaaccttatcctgaacattaatcctgcccaagtttcactctgagttacacaaatgatcatggaaagaaatggctctttgaccaggcatggtggctcatgcctgtaattccagcactttgggaggctgaggcaggagggtcatttgagctcaggggttcaagactcacctgggcaacatggtgagactccatctctacaaaaaattttaaagttagctgggcgtggtagcgtacaccttagtcccatctgggagtacagaggctggggcagaaggatttattgagcccaggagttggaggtggcagtgacccatgatcgcaccactgtactgtagcctgggcaagagtgaaaccctatctcagaaaaaaagaaaaagaaaagaaatagatttttctgctttgtaattccccctcattccccctccttaagaaccatctctcccccgccccctgctccctgccccctgcccccaggaacatggcaatgaaaagttccagagtgctcctccatgggctgaggagagatcaagtttgtaatcacagcattcctgcctcagtctcccttgtgtctgagtggttagtggtgacttgtgtaacagggccttggcttcctgagcccagtgagtcaggcaggtttacttcttgtccccagagccggctcaggagcttaattcccccagtgtatgtgcctctgccacacaaagttgaccatacctgtctcctgaccctgtcctgggacctggctctcattcctcttctaaagatgtcatgaagccctggaggcgagatcatctgctagagaaggactgtggccctcagccgtgtttgtcctctgtgggactgtggctacaggatgggcaactggctccctcagctcctgccgcttttctcctcccgctcctcccactccttgtggtttgtcgctgccctggagctcgccctgaaatgggatgccacctgtgggtggttctgggaacatcagggcgagtggaagagagccaggcccactcaacagcatcccacacccagctttctaggaagcctcactttggggggggcctgtgggcaagatccattggcaggggcttctgagcacgccaggtggagacctcactgggggccgctgagggtggggcagcccggtgcctgaagccctctcctggctcctctccccagacctaggtgtgagtgcgagttctttcttccccaggtgtcttcatgcccatcggcattgtgctgcagccctggatgggctcagcggccatggcagcctcctctgtgtctgtggtgctctcatccctgcagctcaagtggtgagtcccctcaggtggagcatctgtgggaggctcccaggaggccttgtcattctgcatgcttagcacagtggaacttgcctctcatttcccattcattcacctgggacaaatgctgcagtggcagcccacatggagcctggtgtgcatgcatgtaacttatcagcaccatgagcaggcaattcactgctgcccattcacgtgctgggctgcccttactctgctcctcaagggctgtttatgtgaacatcaagcagacatgggtccctgtgtatgatctatcacttttttatttaaaaaagatgttcacttatttatgagtgcattcatttaacaaaagttagtggcagcctacaatgtgcaaggcatttgcttaggaagtttctaaatcaggtgagctttcctggaaccatagggagtttaatgtccttttccttggaaactcttgaggttttgatactgaatgttattaaaagatggatgagaggccttcaccaggcttagaaaaaaaaaaagccttgtttctagaatggctcagatgctgttgcgttcctgctttccagctataagaagcctgacctggagaggtatgaggcacaggcgcatggccacatgaagcccctgacggcatcccaggtcagtgtgcacataggcatggatgacaggtggcgggactcccccagggccacaccatgggaccaggtcagctatgtcagccaggtgtcgctgtcctccctgacgtccgacaagccatctcggcacagcgctgcagcagacgatgatggggacaagtggtctctgctcctgaatggcagggatgaggagcagtacatctgatgacttcaggcaggcgggccggggcagggacttgcctccactcaccacaagctgagcaggacagccagcagcaggatgggctgagctagcctccagctttggggacttccgctccctggatatgtccagtcatcctgccctgcagcacgcggccttgtctgggtgcagctgggcttggcctggagaggacggccctgcctgcctcttggcctcacgggaccgtcagcatgggctttgtcttggactctagtccttggctggactgtagaaggtgagaggcgagtcaccctcctcacagacctctgcttggagtatttaggatgactgctgtgaaatggagaacagtttcatcaggaccaaaaaacctcactgggcctttccagagaactgcagacctcactgtcagggtctttctgatgacgcctgtctgtgtgcatcatgtttctgagaccacagtttacctcaggtgtgcctgttgctttcttcctgcatagtctgttcctttcttcgtacatagtctgttccttttctctcctgtgtgcttgtcagtggggacccctcgcaaccctgcctgtcacctgggagggtgggaccaatgtccttgtggtctttgctgctgctctcaggcgcttctccaatgctctggagtgtgcatttcagcttgaacctgcttcctggctcacacatccccagccagggagcttgccacactcttcttcaagttgaggagagttcttttttgcttaaagcccccttctccatggagtgttggcttctcaatagagtgttgttgctgaccagctggagtgagggcctcagagcctgacctgagagtccgtactcggcttcctgtggggtgtaggttctcgcgattcaggacgtccttccatatccctgcccagcctgtggtgcttgaaacgtttgccccatgggaaacgtatgtgtgcaggagcctccctgcacggcccaaggggcttcgttttcagtcttctgactgtcacctcgtggggttcagtagagaattcatgtgactagcgcctggccttgtgtggcttggaggaaatggtactgcccaaataggaggaaaacacagcctccctgagcctgcattctgcacgctgcccaggggcttcagaaaaggagtggccacagcaccccgaagggagcatctgtttacctggcagtggctctcagagcagcagaacgggttcagttttagactctgaagttggttgtgattgacagaaccctttgggagcaaactagtagagttggattaaattctgggtgaaacccttttctcccacacaaaatagttttagtgatttttttcattgtccattacttgccaggggcagttttagcagcacttttgatagattacgtctaatcctcccaaccaaccagcagggtagctattactgtccacattttacaggcaaggaaacaggctccaagaggctgaggactttgcccaggatgacatagccaatggacaagcagtgtctgtcagctgtgaaggcttcactcttattgtccttctaccttgaatagaagttttcctgataagaataaacgaggaaaaggtccttgcctcctggaagaacaaatctaccaggtgatctattcattgtttcaactcagaatgcacttgattcaggaggtcatctgaccttcaccttggatggttagtttcactttttacatatagtttttgcagggttttattttataaaatccaagcgcgctgttgattgtgttttccttgttttcagcccccccactccagcccgcagcacatttccgctgtccgtcagtaattgtgtcctctctttatgcttgcttggggaatgttgttttctgactaggctgatcattatctaaagaatctaattctgttgatttttaaaacttttaggaccataaacgttgtgttcatatatggacatggaaatatttatataattttatagaaaataaccttttagatggtcaaagtgtaaggagtttttttgtcagataatcatttctacttcaaaaacatttcatgcaatattagaataaagttcctgtcattcctctaaaaatctgcctgtgagtgagatgcgtggtcagaggccagtgccgtcttgtcttcacgagggcttctgtgaggcactggcttggcttcatgtctttttagggggcagaggaggataggattttaacagtagggggaatgagggtgggcagagcccccttgatctgccatccccagcactggtgtgagtccctttctctaatgcaggcctgcctcagcggcgtgtggggagaacgctgaaaggcagctcctgtcaaagtccctgccccgctggatcggacacaggcttaaattaccgcatcgtttgcacccctctgttctagggtgagtgtctgcaaaaggctgttctcaaacacatctcaatcaggagggatatgttttgggttccttggccttgagggagtgagtcaggaggaggagcagaaaaatcttgactagtaggctctgctgggaaagctctgtgggcatcttggggtggccggggggtgtaagtgagccacacctgaagggagttgacagtgtaatcttcacccacaccaggacacttcaaagagtggaaggaggcactatgaatagttatgccaggacaactggcctaaaccgggactatccaggcaaactgggacatatactcaccttccttcaaagggaaatagacattgtgacatctccattgacacagactacgtactttagaaccttgcctgatcataggttccagagacatgctggtggcatagtccgttatcatatttcaaggttctcccccatatccacgtcttggtacctacacatctctgtagaatcattgaggtgattatctcatggctcattgtgactgcatagctagatggccagccccgccctccagcataccctggaggacttcatgccatgcgtgcttgactgtttttccggatgcctgggtacagaaatttcatgttgtgtgcatgtcccattgtgaaaagtgagggtgataccaccttaggaagggatcccatttctttagaagatagattctttctttttcttttttttgttatactttaagttctaggtacatgtgcagagcatgcaggtttgttacgtaggtacacatgtgccattgtggtttgctgcacccgtcaacctatcatctacattaggtatttctcgtaatgctttccctcccctaatcccccacccctcagcaggccccagtgtgtgatgttcccctccctgcgtccatgtgttctcattgttcatctcccacttacgagtgagaatatgtggtgtttggttttctgttcttgtgttagtttgctgagaatgatggtttctagcttcatccatgtccctgcaaaggacatcaactcatcctttttttttttttttttgagacgaactcatccttttttatggctacatagcattccatggtgtacatgtgccacattttcttcagtctatcattgatgggcatttgcgttggttccaagcctttactattgtgaacagtgctgcaataaacatagtgtccatgtgtctttatagtagaatgatttataatcctttggatactttctaaaacttgatcacattttcctgatatattcctcaggcagaataaatcacagcattccaaataacttttagtcttttaagaccttagtgaagaattgtgatgggattacctttttaataaacaaatgcagtaattctcattttttttcaaaaatgacatctggaaattgacatgttagaaaatagattctcaaattattctgctagattaccaaggaatcaagattaataaataaaaccttttttattaaagattaaaaataaaaacttattttttataaatccagcatagaccaaaatcagccaatcaaatagtttaattagaaagagattatttgaattgcaggggttttttttttttgctctaaaaaattatgacagtgttttagtaggtaaatttcctaatgtgtatacaattgagttagacaatttttatttgcatacatttttcttaattgcatctttgttttaaaaaaaaaacaaggaacgtatgtgcaaagaaatgctttaagcagccacttaggctgactgtcagtttccctttgcagattaccttgatgtgtgaggaagctgatttggtattggaaagtattgtggagctaggaggaatcaaactgctctattttcttcattttcaaactcaccttgggcaggcacgtaaacaccattgtccaggctttcattccagagggagatgtctactttgctgtttttctttgtgtgaagacaatgacagtggttgaaattacaggatagaatatgagaatgctaagtaatactgtgaaatcccagaatctactttattcaggaagatgaataaacagagatgtaaaaccatctaagggctaagatgaaaagaattaatggaaatttaacatttttgccctttgaaatggagacggctattaactgttctcaatttaaacataataactgcttatagcaaaaaattaagcatatagaaatatagaaagtggggggggggaaggcaaatactccctccccagccccaaaaggaaagccagtgaacatgacttcatggagggatgtcctttgtggatgaaccacatcgggacatggagggagcaaagccttcctgctccttgttgaccgacacctgaccaagtgtcagccatctgagacagaggtgctgcagtggcctcagagaggcctgttgagagcagatccaggtcctggtcaggtcaggggacagacaatgctcaaatacctccaggctgctgagtgctgggtgcctgggcaggttctgtcactcatcttgcctgtctggccctcctcacagtggcactaagagctatttgcataactgtcccatttccacagacgggatgaagccttaggttgttcagttgactgtccgggacacagaaggggcgttcaaacccatttggcactggcactaaagcctgtaatctattatgctccatctggaaagctccctcttcctcccaaaggtgaatgctggtgctttccttaggagttgaatctgtacttcctcagcatcccttggtccccttatgtggacaagaaaggtgtcctttggcaggacagtgtggcttatctcaagagccatcccgtgtctatctgaccaaaacaacctcctagtctgcagctggagccaatttaatcattttttatgcatctagaaatgcaagtatcagaaggaaaacatgggagaaggggaagagcatgaggctggaggttagccctgccactggatacctccatgctacaatatatgcaacacctgtactagcagcccagggttttagagcctcagatatgcatttagtgcagagtacatgttaggatgactcgacagtcaacgtatttttatcatcatgtgcatctgagcttcatgttaaatattcttgcaagtttatataactttttttttttgagatggagtctcactctgtcctcaaacaggagtgcagtggcacaatctcagctcactgcaacctccgcctcccaggttcaagcgattctcctgtctcagcctcccaagtagctggaactacaggcatgcaccaccatacccagctaatttttgtatttttaatagagacggggtttaaccatgttggtcaggatggtctcgatctcctgacctcgtgatcccctcatcttggcctcccaaagtgctgggattccaggtgtgagccaccacacccagcctggataactttttttaaggcttgaacattttttaaaagaaaaggtttttaaagggctcacagtatttttgatggctccaaagctccatgttctaccacctgtgtttgggtctacagaactccacctcaaacccctggacagaaatctgtcttcagcagttgattacaaagctaataccctggtagcttagaaaatagatcctcaccaaatccctgggggccactctacaaactgctccagacctctattttctcatctgtttgataagaactgccctcattactgccctgagctaggaggttggaaggggcagtccacaggaaacctgcacacaagtgcaaggtacgcagtggtcacaggcgatctcaacaggcagtgaatgtgtcatgccgtctccctcagatcatcctacctcttcgcagttgagtgcagtcggggcttcagccttctcatctgcacaaatggggataataatagttcctgtctcacagcactgccatgagggtatgatgaggtcatctgagtaaagcaattagaatagtgcccggcacatccggagtgctcaagaaatgctagcggctgttgtcatcgttgctgttaagagtgatgatgtctgtattctaggaaaaaacaaacaaacaaaacaaaccacctcagcctttgttcctggagcaggtaaaagccacctttctatgttgggccagaggaagttcctgttctggggcctgctgctaggacttagtggactgatgacaaaagtttgcctttaaaaagagctgcgtttgtccagttactggacaccaggccagacccccagttctcttggttcttggtggtctttgcatgtgtcctccacctcagtgtgccctgggtccagtggaagaccacggaatgtaggggaggttaatagcactggctttggagttggggcagacccgagttcaaaacccgactgtacccctcaaggaagtcactcaccattctgggcttctgaatcggtgtaaaatgagttcactgctgcctccgtggcttgtgaaggttaaggggaattatgtacataaaatgcctagcacggtgcatggcacacagcagacactcataaaaggcagtcatcattagaatggcactgatggggcatccccaagtagggactggagaggtaaaagctctcagggagcatctgggatggaatgggatgcaggctcctggaaaatatttattgaccgcctgaatgatgctggtgcacattggggattgaggacgtgagtgtaaagggtgctagtgaacaagagtgtggagatgaggaaagtgatgagttttaatgtggcatttcagtctggttttagaagacaggaccttatgtcattcagcccacctgccttatattcagtaattcgatcattttcagcaaccttttaaaatatctttaccttttctccaggacagaattacatcacctttagatatgaattcctaaagaatgtactaatttttgattaaaatagaacaatcttgctctgctgtttctgatgacccagctttgggggctaaatataaacctagcacggtggtgtggtacttccatcacagcagcgagtgggccgtggcatcgtgtgaatttaatcacagaataacctgctattaatagttcctggggtggggtggggagcagtgaggggatcgtctatttatttatttattttggaggaatatgggtgttttataaacttccattttctccttcctatttaatgttcggaattaatgccaaaatccatataagcttagatccagctaaaaatgttaacatgtattacttctgggaacctcaaagaagctgatattgcctgtttgtgacttaggatacacttacttgggtttattggggtttcctgtaaagtatgaagcactagatgctttaggctgggggctttgttttccccttaaagctccaccaatctctagttaatctttgtttttctgaataacagtgttttatatatatgtttgttttattattttattttttaaattgatagataaaattatatgtatctatgatgtgcaacatgatgcttagaagtataaatgcatcacagaatgatctagtaatgttttaatgttacttatgctatcactgtcaattatccttgctccctgtcccaccttagagcattcagaggataattccatccctcctgctcccagcatgcccctgtccccacccactgtgcgtgtgcgtgcgcgcacatgcacacacacccacacccacacccacacccacaaacccgccccaccccccccacccccaaccatgaagggaccttaacctgttttgcctctcacgggctcttcccttcttcctgagcctaaacattcaggctgctctaatgctccagggctttcccctgtgtcatccatgggtttactctgattacgccctcacctcggcagtggggaggactagtgaattgtgtccactgcccatgaagcagatctcctggagggacccaggttagcttggcctctcccagcaagtgggaagtcaccagaacgggggctgtggagctggaggtggcttcatccacagtgagtgaggaagagaaaagccacagcaaggaggtcactgcgggaggggctcccatctccaggtccccagggaagtcctgagcccatgctgagcctggaaggattcagggaaggcacagagcctgcctcaaggaaccagtgcagggaagacaagacacacacacatacaccacacacaccacataccacgcacacatagacacatacaccacacacacacaccacacacaccacataccacacactcatagacacacaccacacatatatgtcacactgcacacaccacataccacatgcacctcacatacatatatgccacacataccacatacacatagacacatatgcacaacacacatacctcatgcacatttacatacatatatgcaccacaccatacaccactgcacacataaacacactactacacacacagctaatgacagaaggagctccttgtcttaggagagggatttggtgaggagaaaaaatcatgtccggtctcagctttggggaggaagggtggcatctgggctggcactgaagtgtgatttcatggaagaatatgaaggtggaggcctgggtgggtaaggggtgtttaggggaaagccacatggtcagggcagaatgggcagagtgtctctccttggcaagctgtgggaggaagtgtggaaggggcatgagttaccaaggaaggctctggtacacatctctatgcatctctgtaactactggaactgaggggctgtctgggatggctctatgtgtctatatttgtgttttgtgtgtaggggtgtgtgtgtatgtgtgatgtgtagggatgtgtgtattgctatttataaacaaaccatctagattagtacaaggaaagaaaaaagttaattccacctttggtagcatctgttctaagaatcacttccttgtttgtttcaatttctatggaaagtgctcaccggcagtacttttgctgatgatgtaagatggcaattaagtggagaaattatcagaaagctgacacaattttctgctagttttaatcagttttagaagtcagtcgatgaaatgtgatgttcctgccaggtgcttagcttggtatgaaatgggactcctgtcctcaagctgctttgctagggggtgcctagacgaaggcagtggagttttgggaaaacaaatgagcaactaagaaagagctaaacagtggcgcattccttctaagtgcaagagaaatttagaaaggagtaatgtctagtaatgccaggaaggcttcccagaggaagaggtgtcaagggcctgaggtgcttacgtgtgctggctcgccccttgccagcagatcttgttatgtcaaaggttctgagaagtcctgcagcgtaaaatccgcatttcccaaacatactggtgggaccacagaatctctcctcccacaatacagtttatatcagatacagagaagagatcttctgggaatgctgctgagagagggtgagaactgagtgaggtcaggcacaggagggatttgctcgggaggggaagagagggcttatggtccaggtggtgcatgattgttgtatgcagtgggggtgcatcctggctgctggggagagcgggaaaggggatgagtaggctgagtggggccacactgtttggagacaggcagaattcaggcaggacggaaggaagcaggcacagccagcagtgctctcttctttctcttccaccaactcaggagactccaccatcccctctctgccccattctctgaactgtggccccaagaatgcagaagtgggggtcctaggaagaataacagggcagatgggggctccatccctagactcaaccccactggcaggattgtggagaccatcaacagacccagcaccccctctcctgggactgggggaaagaggaaaagaggtttttgtttgtttttgttttagagaaggggtctggctgtgttgcccaggctggtctggaactcatgggctcaagtgatcctcctgccttggcctcccaaagagttgggattacaggtgagagccacttaagccaggcctgagggggtgtttttttggttgttgttttgttttaaacagtgggggaggagagtccaaaggacatctgaatagggcgccaacctctagaaggccaccaggtggccagtcccagacaggaatgactagagggcaaggctctggggagaagcagctgtaaggtgggagggtagctgaaaggttgaggaaggcgtggttttcaaaattgatcaggagtaggttgttcctcctcttctttacccagccccaagccctgagggtgcctgatgcttattattaactcgagataattcatagagcccccaaaggggcttcgtctgaggggtgccaaaaggcaggtacccacctggggaaaataggaccaaactgctgcctgtgggtgagattttctcttgaggttcacctgcaatgaaaccagagtgcctcctagctttggaggacagctgctcatctctgcaggggtggctgagggctaattgggcttgggggattgtccccctgtcctctcctcccttcttttcccctcccctccccttccttcccctctcctctcctcccctcccctcttgtttcttcttttacccccttctctccttcatcttcctttttttccatcccttccttctctcctcccttctttttctctcttcttctttgaacaggcagctttggagctgtttgtctcaccagtggctctcaagtccacagcgccagccccaaagcatctgagtggctgccggcactttccactgtgagatgtgctgcctgagggtctggtgcttggctgtgggctttcaaccgatctcagtgtgggtgtggcacaactgacactgttgcttttcctggccttaacaagccacccattccatcgcctccccaggtggctgtggtggtggcagtgaagcctgtcaggtcacagagcagctcctcaccagcccatcgcattctgtctccggagaggtcccatcacaggcgatggggcagagaggactgagtcgcagcccagatctcagtgtctaggactggacttggtttgtcaaaagtgtagtctcccatccctgctggcattggcaggctgcagtgcagagtgcctagggctcatcaggatttgccaacagaggcttgtccaagaatcatccagccagctccacgtgaggttacattgccatcaccggactctgatggaggattcagacagcccactccatgcctccagcaccacaccctgcagctggcagaacagtggcccccaagacatcctcatccgaatcctcagagcctgtgaagggcaaaaggagccctgcacatgtgattaagggtcttgacatggcaagaggatcctggaccatgtgggtggccccagataatcacaagggtgtttctaagagggaggtaggaggatcagagaggagatgcaatgatagaggaagaggttggagggatgcgattggagatggaggcagggccacaagccaaggactgtggtggcctcagaagctggaagaggcgaggaatagatcctcccttggagcctccagaaggacccagccctgcccacatcttgattttagctcataagacccatttcaaacttccaacctctgggacggtaagaggacaaatttgcattgttttaagccatgaagtttgcagtagtttgttacagctgcaacaggaagtgaatccacccacctaagctcttctgcaggtgtgatccctgtcccacaggagtcactgctgtcgcctggcaggttgaggctgcagtgagctgtgatcacaccactgtgctccagccagggtgacagggccagaccctgtccccaaaactaaataaataaaaataatttaaaaaattaccgtgaaaagtatcaactgctttgtatatagaaatacaacccagcagtcctgggaacaggagcctaagcctgggccacgcccacccaagacttctctgaagaagcctctgaagctgagcgcatttgggaatcactagtgtataaacagggctcttttctggagatgacccttcctgtgtttatctgccccgtgagtcattaagaaaagggcatgtgcccagcatttcccaacgaactgtgaaaccttttttcaagcgataactcctgcggttggatggtctgtaaaggatgaactgatacgccatctccaccctctgacactccctgctcaagaggccagggctgcctgcagagaggtgtgagggaggaacaagaaaacaaagacgttaagtcttgacagttatgttttaaaaagcacaacccacacgtataaatgagtggagagattgcatgatcaggctgaaccaacacatatccccaacacacacacacatacacacacacacgcacacagtgggtggggagggatactgatgagaaagaatgtgagaaagattacatcaggttgagtttctgagaaaatgctttggacctccgctccccagctgagtgggagagaggggagagcagggggcacatgtctgtgagaaaaagatgcttgagccccttaagttctgacggcttgaaggtagagcagaccattatccccttatgctgcgttaatgtcctggaagaggagttgcccagagcttcccctgtggcctgggtgagcaaaggacaggtgttgcctggatgtgtgcttaggtgggctactgacagcaagagctccgaggaagagggtgcctggtgtgccttagagaggcacagcccccaggggtgccccacctcggtagattcccttgcctggaggtagacttgcaggaactgctctgagcttagacactgaagactgaggagcaaatccgctgctaggctgggatgagcagccttctttcctgcccttggatcatttaagtctcctggatttctgtgagactttgggagcctcctggagtccagtaacaaccaatctgtaatttccagcccagtggaattagagactggaatagcagttcactagagacccaggtttatggattgagaggcaaacctgctagatatccgaacgtctgctctgcaccaggtcttgaaggaaaacccagggcttgccccatctcttgccacacaccttactgctcatggtcactgcaggtacttgacagcctgagaaatgtgtagccgcttctccattctcagatcaatgtctgcgtattgaccagggtcagcactcaatggctgcctcctgatacagcaagctctctgcctagctcctctcccaccaggcgtcgcagagctgtgaattgcagttatcacaagcaaaatgaaatgagtttgagcctaaggggaatccataattggagtgcaggaatgttgcagtttcacagctgggcctcaggcacgatggggcagagaatctgaaggccaccggaagtccacttgcaataaatactcattaggtgactgtcgcaattgtaggtgagggatctacagccaagaaacgattcagacaaggctcctgcccttcatgagtttacattctagtggaacaaagagacagcaataataggcaaatcctgtcatttctgccagtggaaagtgccatgaagacactgtagcaggacagcagggtagaggaggcagtgatgagaggtggggagggggattgccatgggaagatactgccctgtgagtgagaaagccctgaggggacccggctgggagggtcagcactggtgcacatgggtaggatggagggaggcaggaagaacaggcccagatctcaaagacaccagcagagcaagaagttgacactttattgcaaagctgctgggagacattggagggcttgaaggaggggcgtgacatgatttgcttcatgtggtgagtggattgtaggggagtgaagaggccatgccctacccagaccctcctcagggctcacctgtgctgcctggcacagagcaggagtggaaatacacgttggctgaattactgtcaaagtcttatcttttctctgtcaagtcttagctggcttgagaccatgtagttcccttcatctggaaaatgacaccaaatattctataactagctgttatcagacccgtttcaggagcagtgcaaaatacaggcagcagcgcaaaatacaggcagcagctcacatctttctgctgagaggtaaaacgcttgctgagagtatgttctttggttgcaggcatatacattgctattaaaatgcctcttggattcctcactgcaacgtcatacctggacttccacaaaataattccacgtattgcctagtccttagctcctgagcctggtgatagaaagcctccctccctcctttccttccttccttcttcctttccttccttccttttctccttcatattaatccactatgagctaggcatgatgcattaatagcatagagatgaaagtactcactttctttgcttgcatttgagtgggggagtcagaaaagcaaacaagcacaagaaaatgtcacagggacggtggcaggtgaggagagcgacatgctcacgcaggtgcgcagcaggagacctgcaaaggcaggtcaccatggcaccgtttgctcgggacacagccgagacgtctgcttagggaagtggacagacaacttgcgatgtgtgtcataagagaaagtatttactctgcagcattcagaatgaaccaacaggatctgtgtgtatcaatatggggaaaacacagtgttgagtgaaaaaaattacagatacttaaagagtcatgaagattaaaaaaaataattttatgtattgttctagacaccagtctctgtggtcaaagtacaaacatggtctggggctatataccaagttcagatcggtggtttcctatggggagcaagagaagagaatggggtctgggagaggtgtgtcggggccttcagctatatttgtaacttgttatttctaaaactatgaagcaaatgtaccaaaatgtcagcactggttaaatctgggtagtgggtcagggattttgtcttcttattctctgtatttatatacatatttaaaatatgtgtaaatttttaaaaatacacgtgggtctggtgtttgtagagagggcaggactaaagctatagcattggctcaccttcacagcaggctcaggtgaatcagtgggctggggagtttcacctgggcctcggcactggccactggcacttcacacagaggcgagcaagggccttgggaagcacttatttttcacaaagcaggtagagaaagagaaggaaaagatgggaataggaggtttcagaaaggagcagagccaggagagatgtgtcataaggaggtccaggaaagaaaaataatttctaattatggggccggtcatggtggctcatgcctgtaatcctggcactttgggaggccaaggtgagtggatcacttgaactcaagagttcgagaccagcctgggcaacatggcaaaaccctgtctctacaaaaaaaaaaaaaaaaaaaaaaaaagaatttcaaaaattagccaggcatggtgacgtgtccctgtggtcccagctacttgggaggctgaggtgggaggatacttgagctggggaggttcaggcttcagtgagctgtgattgcaccactgtgctccagcctggatgacagagcaagacgttgttccaaagactaactaaataaataaaaatagttttaaaaattacatggaaaatgtcaattgctttgtatgtagaaatacagagactaagagtgaatccccatatacccaccctgaacatcttgaattaaataattgtcaaggttttgccatatcatttttgcttcttctattcctccttttctttctttttctcttttttatttgctgaagtaatttaaagtaaatcccggatgccatgtctttccaccccttcatactgccttgtgcaattctaaaatatccagacactgagaaagatttttaaagcgggaagtgtcagtcacattaaatgttacagatgacttgagatgaggaccagggggctgtcaggaaagttccaggatggagaacagctgaaggtgcagaggtggcaggaggaagtgctgacccccaaggcattgctggaattggcactaggagttcacagagggccttcgagagaaacattcaagaaatgccaatcattattttgagaactgtgatggtaaagaggagaaggaagatcacctttgagcatgcagggatgaggcacagaaatatttttaggatggagagagatcgatatttggaagctcaggtgacaggtatgaaaaaggaagcaaaactgatggaagaaattcccagagggacagaagggaatgagaggacactgggatgaatctctcaataaacaggaaagaagttactgaaacatctagaggtgggaggagaagggcgacattcttggaggacactgagtttgcagtttgggacgtgagaattcggaactccctggggcagagaccagggtcaacccagaattgtgatgatattgtgatttatcgggtagctgctgcaggcacttttgtcatctcgtttaagccccatcaatgcattttgcagctcagaaacgtgaactcagagatgttaagtaacttaacttgcccaacacatacttagtaattagcagaattgcttttagcgcagagcccttctacacagccctgaggaacactgtccttaaaccacaggactcgctggtagcacctgtcctcagtagcgtgtgggtttccctagcatctcccagaaaacagctcactggattggctcaggtgtgtaagggtacctggatatgtgagcagggcaggggtggcagaagatggaagattcaggaacctaggggtgcctgtccatctttgttcttgaattatattatttcctctggaattcctgcttctgctctctccctctttccttctgtgagcaccctctctgggtgctcaaactcctccttgtccccagctacccccagtcttttactcaggcttaataaaacttgtccttcacctggcagcatcacatccccaccaacctgctgccatttgttgagagagagagacctgggatgtcgctggtccactggcaagtcacttagacgaggaaggaacggttgccctgtggagctccatggtgatgtttgcaggtgcagtgtgggactaggaggtgggtgggctggcacccataagtcatattcatggtctttagtgaatgtccgcctggtcagcagatgggcagctagggcttaagcccacaggttagcgttaacggggccttacttgtcctcctccgcataagggaatggagaaaacactggtgagcgagacagacctgagtttggatcacctcaggtgatcacgcagcttcccagagcctgaggatgcagtgagaatgatgccggagaatgatgcatgggaatgctcacggggtggaggaagagttgaaggggtagaagggtactgaattcttgctggtttaattgaagggggaaagagtgtgtttaaataggattctcagaagaaaaatcactgaggtaaaataaattttacatggatgatttaaaagatgaaacttaaggatttcttggataactgacctgaggtgaccctgaggggctctgggccaatggcgccccagggaaccaggccctacctgggatgcaaacctaggaaagagggctgggtcagtccatgctcggatggctggaagggccaaatccaagccagcacctggctccatgtggctcctttctctaaactaaaatgcagactaaaataagacgttttcaataagggaagaatgcgttgatgatagctaccacttgttgaaccttaaatatatgccaggcaccctgataagtacatagaaaccctttacatatctattctccccagctctcacacagcccatatgtaaaatactattgttcctgctgtttcatggagaaagaactgagaccagagtacagaggccattcactgggccgttcactgggctgttcactgaagcttctccctcaaggcttctgtaatgcacaggaaggggctctggaaggggcccagccatgggttctcttggtcatgtgttttgcaagttttgcaaagttagttattaatatttcacttgtaattggtttagataggtttcttcatgccggtgtcccctccagcacatacacgttcccagtgttaagtgtcagtgattttttttcttctttttgagaagaggtctccctctgtcacccaggctggactgcagtggtgtgatcttggctcactgcaacctccgcctcccgggttcaagtgattctcctgcctcggcctcccgagtagctgggactacatgtgcacaccaccacgcccagctaatttttgtatttttagtagagacagggtttcaccatgttggccaggaagttctccatctcttgacctcgtgacccgcctgcctcagcctcccaaagtgttgggatttacaggcatgagccaccgcacccggccacgtgtcagtgattttaaggggaaaaggtcattgagttgggcatacaattagtttgaatgagtgagatctattcagatgatttgctaccacttctgtgtatcaagtgctccctgtataggaatgacttccaggacccaggactactcccactgtccacttcgtgactcacccaggggcatggtgacaggggcgtgtctctgcgtatatgtagaggaacatgaacagtagaggaaccccagatctgtagcatgtggagttcaaagctactctggagaattctcccaattatctgacatgtaaaattgttagcagagttgattctcatcaacaaaggtctctcttgtcaggaacatacttaatgtggcctatatacttttaagcacatcatgcattgttttctttttcaatggcaattccaagaaatacaattcactgcagctattgtatctttagggcagaaattaatagtagtgctgtatctaatgagtatgtctatgcgtgaagtggcatattctacacattccaactatcgataatgaaacatttctatcaaccttgctagggaaaaggctgaattatcttttatgaaatcatagccagatgaaaagtcaatcagagccccaaagcacaggataaaagtattgcagaagtgtattggttgataaaaacatgaaatgatttttctttattgtttactgtttttgcggtactttccagctcttcaatatttgtaatttgccgtgaagtatttacattctaaacatcacttttgtacctaattttgtatttgtaattttatatccttcttttcttaaggaaaatactccagattgtataagatttaggcccacaaaacctgaatcgattcttgacagagtaattaagtaacagccgaaatcacagccactaaatggccaagccaggatttgaagctggagttcaaacgtgggcctcaaaagggcatcttggactctaacatgtgcccctggagtcagggtcttgttaaagttcagattctgactcagtagatgtgggctggtgcccaggtgctgtgaggctgctgctctgtgggccacactccgaggagccaggatctctcagctaatgcactctatggccagctctcagacagtgcaattaaccattgccactcagggaggttgtgggagttgcccagagtagcagagtcagaggctgaactcacagctccatcgcccgccttacatggtggcaggtgggctaagtggggaatcccaggagtcagctctgggtccccaagaggaatgtcccttccagcccctgtcccctgtccctgaattggcctgagatgctgcagtcagtctcaagacctgcaaggtgagcaggagaacactggcgtttccattgcgacagacatacctggctgacctctacttgcctggctttctccaccttggtgacagtgctgctcagccctgctaagcgtcaatttccctatgtattaaacgagcttaatatgacccacctcatcgagttattcatggattaaatgaggcattatatgacaagttacacgatccaactctgcatgtattggcctgtagcacccgtggaactggtgattgttgttcctgagctgaactgaccttgggaatcaagtgacttcttcctgcagcatgtactctcagcttccttttttctcaatgtgtgtgaagaagaaactgtgttagaatagaaggacatctgcaaacatctcacacctgcagagggctgaacagaggtaagggcttgatggcagctaattgttccctgacagatgtcagctttgcctgtctgtctctcttaacatgtttgcagctgtgcagcaggctgacagcctctggcattctctttctgccgggtcctcccaaatgcacccaaaatcccagccatgctgcttgatcaccacaggtctgcctgatgacaacaggctgtggtgattttatttgtcatctttagagcatgtgtagcagtatttctttcccagaggcatcagatgtttgtactgcagacatcttttccaggagaaaaggctaatagatgagggcaggctgtatttcctggctggcccaatcctctggagacttcctggtcattagcatcccccagaaggacatgcaccataatggctgcagactctaggtggtgctgccccaagccctgtagcctagagcgtccgacatcagttgcagcctggcctgggtttgggttattttaagctgcccctgcaatgcagctgcaaatccagaaaaagaggactgaggggcctgctcatcagggaagagctcagtaagcacacgttgtcactggcttagagagcagggagacaatataattacagtcattccaagaggttcattctgctgcattgcccttttcaggaacacccctcccatttctttggcgccaatactattttttaaaaaccttcctggtaaatttcaaaatgccactggtaaaagcaaactgcctcacttagctccttggttatttgtttaaaattcagtgtatctcagtagaatttttttatgcaagggattgaagctcctgaccctgccatttgggggaaagggatgtctaagagtagggggaggagctttcaccttcaacccgaggtcctcaactgcattccacacgaagcgttagctttaggataacatgagcacagactgaaccctgagaatgcagtttgcccactcatctattaatttggtgtgtgaattaacaggctttgcccagaaagaggaagtggtgaagctgtgaaattgctttccttggaaagctttgttcagtggacacctgttagtcctgaatggcaggcagaatcctgggttcacaagtgttaattttctaactctgaagctccttctattgtcatttccatccgtctaacttttcagattcctaagtattttttctgcttcattcgtgtatgtattcattcatccattcagtgagcgtgcattaaatgtgaactgtgtgccaggactgcactggacatgggggccactgtcgctgcccttgagcttccaaagccgtgatgggtggatgagcaggggtcagtaggcagacaccgaggtcagtgccactggtagcccacatgtctggggcatgtggagctgtggagcatcacttactgggtctaggggctggcgaggcttcctggagtggtcctagagaaacaaattggcaataattagggaggaagtttagtgaaagaaagagaaaggcgtttagagggaaatttggaaagtgtggccaaggggtgtaccacataaaccctctctccagtcccccacagcttttagtaagagatcagtttcccgagaatgtactgtgggctgggagctctgtggaggatgtgccaggcatggctcggtgctcctgaggctgctgcccccacgtgatacggagaaggctgtttgcagaacagccactggtagcagcacaaagaacaagcgtgaatgggaaacaggtctcaagagctctgcctccctctcgtgtccattcacttcttaataattaccgaatacctgctgcacacactgtgctcgggactggaaaaacagggaaaaccaccgcatcttggcccttttggacctttacataatgatcagcaaatagatgaatctgtggtttgtcagaccatgatggaggaagacagctatggagaaagacgaaggaaggaagtgagatagagcctgcaaggctagggtgagggtgggaggtgccacactgacaggtgacattcaaacagatccttgagggagtggccatgtgggtgcccgaagtaagggtggtccaggcagaggaaagaagcgggaaagccctgaggcagcagtgggcttgttgtgttcagggaaaggcaaggaggggaaggcagaagcagagcagtgggagggagtgggtcggagaggaggagatggagctgggcagtgcatggagggccgggaggctctgtctcgggcaagtttagaagccaatggaggctgtgggcaagggagtggcagatgtgacctctgtttcaatgtgaacacccactgtcaggtcagcgtgggcccacgcttagagcagccaactggtgcctagcaaaaacaaacaaaaagcaaaaaacccagagtctccagaaaccaattaagcaaaaatatttatagaacatctagtacgtgaaggacattttgctaggtagttggttcctctcctgaaggagcaagctttccggatgagttgaagatatgtgcatgcgcgggaggtgatggctcattgcagggcagggcatcatctgtgttgaaggattgccagtgtttcagaaatggacacagagcaggtatgtttgatggacagttaagaggaacactctctatgtgacagcactgttttaagtgccctggatcttctggggatgagactagtgtttttcagtcgtgcatgggacagttgaggatcatgctaggcagaggtgagccctttcctggaaggagttaacctaaaaagcataatctgcctcatctgggaggagcttaataaatctctcttcaatgacgtaatggtcaatcagaaaatttatattttagctgtaaaattacttatcacaatttaccatggggcataatcttagtcaagcacccaaagtaatgatttcaggcaacagatactgaaacaccaaagtgataaggtggcaggtatttcagttagctactgctgcataatgaaagaccccaaagcttagcgacttaaaacaatgatttgttattccttatcattctgtcagctgggagtttcttctgctggcctcacctgggctcatgcacaagactgcatttagctagggtgtcagcttggggatgggcatagctgggatgctgggtcacctgagtctttctctgcatgtggtattgttttaaaatacaggttttagcgctgcctcaggatgtagagtgtaacaagggggctggggtgggcagcgtgggcctgtcaggcctgtgggtgctcgtgtcctccagattcccccgcagctgactccgcagtggtccgctccggttgcctggcgcagatttgagttccgaacagaaggctgtgtattctctgccgcttattgtggcctcgacaggccatggttactttggccactgccagagcagccttggcactatggaggagcctagggctacccctcagctgtacttggggctggtcctgcagttgctacccagggttatggcagcactgcctgaaggtgtgagaccaaattcgaatccttatggttttccatgggaattggtgatatgtgcagctgtccttggatttgttgctgttcccttttttttgtggagaagttttagatcggttaggagtcggctttatgtgggaagagagaaagagcttgctatagcgctttctggactaattgaagaaaaatgtagactacttgaaaaatttagccttgttcaaaaagagtatgaaggctatgaagtagagtcatctttagaggatgccagctttgagaaggaggcaacagaagcacaaagtctggaggcaaactgtgaaaagctgaacaggtccaattctgaactggagcatgaaatactctgtctagaaaaggggataaaagaagagaaatctaaacattctgaacaagatgaggtgatggcagatatttccaaaaagatacagtctctagaagatgagtcaaaatccctcaaatcactactaactgaagccaaaatgaccttcaagggatttcaaatgaatgaagaaaaactggagataggaatacaagatgcttcgagtgaaaattgtcaacttcaggaaagccagaaacagcttttgcaagaagctgaagtatggaaagaacaagtgagtgaacttaataaacagaaaataacatttgaagactccaaagtacacgcagaacaagttctaaatgataaagaaaatcacatcgagactctgactgaacgcttgctaaagatcaaagatcaggctgctgtgctggaagaagacataacggatgatggtaacttggaattagaaatgaacagtgaattgaaagatggtgcttacttagataatcctccaaaaggagctttgaagaaactgattcatgctgctaagttaaatgcttctttaacaaccttagaaggagaaagaaaccaatttatattcagttatctgaagttgataaaaccaaggaagagcttagagagcatattaaaaatcttcagacggaacaagcatctttgcagtcggaaaacacacattttgaaagtgagaatcagaaacttcaacagaaagttaatgactgagttatatcaagaaaatgaaatgaaactctacaggaaattaatagtagaggaaaataaccggttagagaaagagaaactttctaaagtagacgaaatgatcagccatgccactgaagagctggagacctgcagaaagcgagccaaagatcttgaagaagaacttgagagaactattcttttttatcaagggaagattatataccatgagaaaaaagcacatgataattgtttggcagcatggactgctgaaagaaacctcaatgatttaaggaaagaaaatgctcacaaaagacaaaaattagctgaaacagagtttaaaattaaacttttagaaaaagatccttatgcacttgatgttccaaatacagcatttggcagagagcattcctcatatggtccctcaccattgggtcggccttcatctgaaacgagagcttttctctatcttccgactttgttggagggtccactgagactctcacctttgcttccagggggaggaggaagagacccaagaggcccagggaatcctctggaccaccagattaccaaggaaagaggagaatcaagctgtgataggtttactgatcctcacaaggctccttctgacactgggcccctgtcacctccgtgggaacaggaccgtaggatgatgtttcctccaccaggacaatcatatcctgattcagctcttcctccacaaaggcaagacagattttattctaattctgctagacgctctggactagcagaactcagaagttttaatataccttctttggataaaatggatgggtcaatgccttcagaaatggaatccagtggaaatgataccaaagataatcttggtaatttaaatgtggctgattcatctctccctgctggaaatgaagtgagtggccctggctttgttcctccacctcttgcttcaatcagaggtccattgtttccagtggatacgaggggcccgttcatgagaagaggacctcctttccctccacctcctccaggaaccatgtttggagcttctccagattattttccaccaagggatgtcccaggtccaccacgtgctccatttgcaatgagaaatgtctgtccaccgaggggttttcctccttaccttcccccaagacctggattttgcccccacccccacccccacattctgaagatagagtgagttccctttagggttgagtctgccttcaaatgagcctgctgctgaagatccagaaccacggcaagaaacctgataatatttttgctgtcttcaaaagtcattttgactattctcattttcagttgaagtaactgctgttacttcagtgattacacttttgctcaaattgaaacaatagaattataattctcaggatagtattttgtaaataaggatgatttaaataggaatcttatgagtaaattatttccattttattttattctagatagtgttaactattttaatttgattaatccactattatctaaacagtagtgggagttttatatatgtaatcttgcaggtggtgaggttttaaattctaaagtctttgtccttattccaagaactgtatttactgtggttgtagacaaatgtgaaagtaaatttatgcttaattgaataaattatagttgatttaaaaaatatatataggttgcattattcttcaggtatggagagatgaacagatcaagtgtcgattaccactgaaaagatggtttgttactcacagatcccaacagaagggaaagtactatgccatgcagcaccgaatagggaggcagtatggtcagcgagaagataggagtgatggaaaaacatgggcaagagcctttacggtggtttccatgggaaggaatgagtgaggcaaggtgagcagggttaaggttagctattatagtttgagtagtttcagcaggctctgggtataggggctgtccctagttgtctggtacctggccttggggtgcttagggcagaggaatagtggcctagagtgtgtgagtcctgtggaaggctgatgaagtaggcagctgggggcatgagctctcgactggttagtttgtgtgtgaaaagcacgctcaagggcaagttgtttactgtctctaggaattggctaaccctgggagggacagacctgccaaggtcagcaaggccctagatgttgaagtgtcagaatacataaaaagacatggttaatatggtatcagagcctctgtcttcatgtggcctctcatgaagggctctagagtgagctcccttaggggatgtcaaaggccgttcaagacagcagaagccacaaggccacgtaaagcctcagcttggaagttatgcaacatcacttctgctgcatcccatgggtcaaagcaagtcacagatgcaccccagatccctgctcacgttgggaggagaggaacattaaccatgtgggaggggagggtcattgcagttgtttttgcaaacaacctgctacagaagatgtggcttcagagcactgcaaaggcgtttctgaacagaccagatcacataggaagagcagaaagaagtgagttccagctcattcgtctttgctaatgtggagtcagggtatagcttccctttcactgttggtccccagcatcaagggtcagttggatgtttgtccaggagcctgcagggactgtttgtacttctagaggagagttggcatggctttgggttgctgtctctgaaactgccctagggcctgggatcccggggagtgcctgcctgtgctggcagggagcccaggcctgtttgcaaactgtttgaatgcctcagggtcagggtctctcatggacatattattttcttatcaggagttaaaataactctagaacttctcctgtagaaatgcagatgctttattacaatgaaagtaccatttgtaaagcatatgcaattaggccaataacaaccaacatttactccccactttagggcccatgaagcactttctcatatgttcttccttgttctcacagtcacctgtggttaggcctcattatcctagtttttcatatgagaatactgaagctctaggggctccctgtcttgctgggggctcaaaattggcttggggccctaggagttgccctgggcccaagggtggagctatgggagccctacaaagcctgccctgtttcagtgaatcccttctctcccccataactgctcattctgtgtggctgcactcaatagattatttcaccctttgaattagatgcctcagggagtccccttagcgggctaagttaacctttgcagggggtactgacatgcccaggtacagcccagccctgcatgctgctctttgctccagggaccccagcctggtccaccatttgctaggagaagatttcagtccctccagaacacacagcctgtaaggagccacactggctcccagagcccgagccccaagtcatcactgggtacagtgcacgttcctctgctgtgcagtggtggagcttcatcctggtgagtcatttgttctgcgtctaggtgtctcagtgagactcctacctgtctgcttcagagccacaggtgaagccttcattctcaatccgattgaagaagagaaggcggcatcacagctgagttgctctccatcatagaaccatggggcattgtcctcagacacacgctgacattaaccgaggctaatgaggcagagcctctcataatagcattctgtttctttggaaaccaaggtgtagttttttaagtgtcgcatggcccttgattacaatttgcatttcctagcacttattctaccatttttacagggacctgtggcaggcagaggggctctgggcagcttccctgcaggattccacttcctgcttgggtcgaccgcgccgctgcgagggagggcttgccccttgcctccctgctctctgggtgtttcctttgtgaagggagggacctggcatgctagaaagcatctcaaagccctgctgaagaggaactccggcttcccttgggttgctctgaagaaggtgctctccaaatgagagggcctcaggaagacagtggcatctccctgactgggtgagtcaggtgcagctctagccgaggtgagtgggacctgccgtgtccgaggtggtgacagcaggcactgagactgctctggaatcatggctctctgaggttgttgctctgaagtcctgcctctgggccctcgtccagtgtcgtgacagctcttttctctggaagagggaggacagtctctctccctgcacgaactgccttcagcctgacatttcttctcctgcttagggccgttctctgttgactgcttcgtgttgtctgctgtttctcttagctcaatgcttctcaacgagggtgcttttgacctcccccaggagcatttggtaatgtccacagatattttacacagtaactactggaggtgtgctactggcgtcaagtggttggagggcagggatgctgttaaacaccccacagcacacagaacagactcccacagcaattatctattccaaaatgtcagtactaatgaggttaagaaacactactaatgatgatgttcccctacctggtaaataaaattcaaggttttcagcctccacatcagtacagaatgaatgtttcttaattgaaatgcttggagccagaagtgttttagatttaggattttggaatatttgcattatatttgctggttgagcattcccaaactgaaaatctaaaatctaaaatgctccaatgagcatttcctttgagcatgacctttgagcatcatattgatactcaaaaagttgcagaattttgagcatttcagatttttggattgctcaacctgtacttttcacaatatcttgaaaacggaccatgcttatcttttctcttttgatctagagcctccttcttttccacgtccataccatgaattcctattcaagcccagagaaaattattcattactactatgcattagctgctgaaggccaggtgatgttttcccagatctgactcatcatgatcatgatcatcaattatcattatcatcatcatcaacaacaattaccttagggtcatcataagaattgcatataagctagccaccaagcagtcatcagtcatctgcctttagcccagtgctacctgaattcagtttctgtcatcatgtatttcttaatttcaaaataggcagcagcactaaatctggtccatgggctcattaacatcatcatcatcatcatcattaatattaccatcattgtcatcatcactgcaaagcaggcaacaagcagtcattaagctcatgctgattctgatgctgatggtgaatgagaagcagcactgcagaaaaccacctcatgcctagcatcccagggccacaggtgctgtgtgttagattgagtgttcacttgtccagtgtgaatgtatttttgttaagagttattggcctttgagtttctggtgaccagatgcttctttctaaacacacacacacacacacacacacacacacgtggaagactgttggagaaacccaaatggtgtcataggaggcaggtgtgagaagacactttggttgcacaaccaggtatgattctgccagagcagaagaccctatatggttctcttttctgccccagcactgcctcattatggctatgataggtttattgaagctaaagtttgggcattctggggcagcctttgccccacacccacacgagtctttttcatttttcggttgccactgaagtctggaaatagcactctgccttttcctctggccccatagaaaccgggacttctgggtgtttaacttagcatctgactccattagatgctcagggtctcctgcacttacacctagggataggaaaaaggggtgttctggggagagtagggggagcagtttgccctctatttggtggctttccttgtacagtggagagagcagccagaacctgaagtgacaactgagacatcgtcatctgacgtagagtctctcttccctccctgacctcgttggtgtgccacctctccctccctcccatttccaacagcatgcttaggaatgagttatgaagtgtcttattggaaaccaagacctcaatggcaatgaagggaagacactatagttagttattattgatcatctctacctgcactttctatatttgcaagcactttttgggacttagtgagtaataaataaagtgtctctagatcaccttgctgcttcccactgctgctgcctcgtgcatccagttctagttgtgtacctcctggatacacacactaaggaggtgagaccttcaaaagaaatgcaaaatatttccacaattgtgtttgtgtacaaactgacctgtcaaaaccaaaactatatttaggtactagattataatcaacacccccagtggatgctattggtgccttgcccagggcccctttaccaggcggatgcactcatctcccagctttgagtattgctcaccgcagccacctgcttcctgaagaattgcccttgcagagcagaagccaccatgctaggaagttatccactccctcggcatcacatagccaataaccaattgctgtcagggctgtgttagttatctgtttctcaaaataaattactccaaaacttagtgccttaaacggacaatgaatatttgttatttcacagtctgtgtgtgtcagagatttgggagcagcttagcagaatggttcccgtttgggtttctcaggaggttgcccacagactgtccatcagggctgcaagtgacctgcaggcttgactgaggcaggtggccttgcttctggggtggctcactggcctggctggcaaggtggggctggttgttggcagaatgctcagtccctctaaccatgggactctcccaagttcagcttctagagtagctatgataacatactttctataaaacctatattctaaaatgtatttaataaaataactttcctctaatttttaaatctgcaacattgcagcagttcattttagacattgagaggctgaacattttagattctggttctaaaggcatgtgggtgccctcaacatcaatagcagcagctaataattcccaaagcttttccaggcgccaggccgtgagaagggcaaaatgtgttgtgattctgttgaagtaatgcctaccaccccttcagtcccacactgaaaatgtaacaaggcaactgggaaactgtcttcaacatcagtgctttttttcattttgcttctcttgatttttacatcttacaaaactgagaatccacctatatttattctttcatccaatgcacgttggcttctgacctcacccctgaaatggcttctccagaggtctgcagtaacccccctgataccacatcccaagtgattcttttcagtttttttattacatgacctttccatggagcttgaccccagtggataacttcccaagctcctcctccttgaaactctcctctcttggattttgagcttggatgacagagtgagaaaggcctggcgtttttgctctggactgggtaacccaatgaagctatgtggattttctgcacaaatttggaatgtaaacacacccaatggggcttctgcccagaggattgtagctaggctgggctggaggtagggaaagcagggaggaggctacgtgtttgtgggaggaggctgataaagcctgaactcggggaggcagtgagccttaggagagcaggtagattctagatacttaggagagccactgtcacagagctttgtaaagggacttgggatggagtgggcactgggggagggcagaaaggaaaatagagacactgaagatgtgtccaggcttctccgggggtagttagtaatgccattgacccaagtcaactgatgtatttctgtgtttttgttggattcttcttcatttttgactttccttggctatatgaatttccagaagtacctgttccaggggcaactgacaactgagaggggtgtgaggcatgggagggcgggtggggcacaggcagctccaccgggcgccacccctctagcaggagtggtttctttatatgtaccagggatatttctgcattgaactctagaccatgtggaacttggctttttagcaggtcaaatgccaggcacaactttctagctggaccagatgcagccacactcaggaaccgtgcttcattaaagtgtgtgtggacccaggttctcttccttcacaattttgtgagtacagatgaggttgtgtggacattaacatcacaaatatgagaaggctgggcctcacttgaaaaaaaaagaaaagttttattgagatataattcacgtcatagatgtcacccctctaaagtttataattcagtggtttttggtatattcatagaattgtgcaaccatcaccactttaacattttagaacattttcaccacccttctctcccacaaaactctgtactcattaggagtcatgcctttctctttcctggcaaccttgtatctactttttgtctctacagaattgtctattctgagcatttcctataaatggaaccataaaacgtgtggctttttgtgtctggcttcttatacttagcataatgatttaaaagttcacctgtgttgtagcatgtatcagtaatacatcattcatttttattgctggataataatccattttatggatatatcacattttgtttgtccactcattcgttgatggatacttgggttgtttccatttttttttggctactatgaataatgctgacatgaacatttgcatacaagtctttgtgtggacttatatttcatttctcttggagagacacctgggagtggaattgctaggctattatggtaactgtatctttacattaacattgaagaactgacacatgggctgcatcttttttctgatcccatcaatgatgcatgagagttccaatttctccacatcttcaccaacactgttattgtctgtcttttttatttcagtgcatatgaagtggtatgtcattgtggttttgatttgtatttccttgatgattagtgttgagcatctttccatggtcatttgtatatcctctttggagaaatgtctatttaactcatttgcttatttttaaattgggttgtcctttttttgttgatttgtaagagttaatttattctggactccagtcccttatcagatctgtgacttgcaagtatcttctcccattttgtggctgtcttttcactttcttgattatgtgctttaaaccacaaaagatttttattttgaagaagtccgatttacattttttttctttttttgcctgtgatttcagtgtctaagaaaccattgcctaattcaaggtataaagatttattcccaggttttctcctaagagttccatagttttaactcttgcatgtaagactatgacccatattgagttaatttttgtatgtggtttgtaataggagtccaacttcattcttttataggtgaatatccagttgtcccagcaccacttattgaaaagactgttcatctcccatatgattgcctaggcttgtctaaatcaattgtccataaaagtaaagatttatttctattcataatttaataaaaatgtagttctattccattaagctacatgtctagccttttctagtgccatgcggtcttaattactatagctttgcattaagatctgaaatagagaaacttgagtcccccagttttgttgtaagattgtttcggctattctggatcccttgcatttttatattaactttagggtcagtttgtcaatttctacatagaagccagatgacatttttgagaggatagtgttgaatctgttcatcaatttgggaaatattgccgtcttaatacttaagtcttctgattcatgaacatggcatgtctttccacttatttaggccttctttaatttctttcatgatatcttacaatttttagtgtataagacttgcattttctttgcaagtgccaaatgttgctgattagaagtacactggaaaaacctttcagtcgctatacccttttctggcttttattactgtttttaattgacacataataactgtatatatttatgggatacagtgtgattatgaagccttgcacctatgttgtttatctcaagtattttttcttctagatgctattgtaaattgtttccttgatttcatcttcagattattcatcgctagtatatagaaatacaatcgattttttatatattgacctcatatcctgcaactttactgtacttgttcattggttctgaaagcgtgttttgtggattttccagataagagatcatatcatctgtgaatagagatagtttcatttacttaccattattcttactaaatgaattaataagtaagagctgtgggagtaagacatgcagtctagacagtctctagaaggtggccttgacaaggccagcagtgatcagcagtggatgagaacaggtttagtactgtgagattggagcagggattgaggcagagaaagtgaggaggaatgacaggcaggtacaaggtagaatcaagtgagtggtagatcaggaaatcctagataacaggttgccggtggcacagtcatttttattacctttttagcatgctgggtgcctctcctggaacacatttaaaggacccaaaggactccttccaacagtgccgtcttagcaggaaaaagatataagtctaagccattcttgttggctttgtgcagccaggataggctgtgaagtaggcaaagggcagaagaggagagagaactaacatttattatctagtatgtgccaacattttgcatatattgtttagtttaacccttacattactcctacttttgcaaatgtgaatctgatgtttgttttgtaaaacattcagaaaatgcatgatatttatgtagtggtagctgccatcacaccataagtcagttgcccatttctccatccatgaggcagccatcctctctattataaggagctcatttctcaattagttctttgaaaactgaaaagcatgtagatatagaacaatatcctgcattagtgcttcttaaccaggagtgtgtcaggagaaaaatccccaggagtttcttgtatttctgcatgtttatgagcaggggcactgcacttttgttctaattatctttttattttattttatttatttatttatttatttttgagatggagtctcgctctgttaccagactggagtgtagtgccacagtctctgcttactgcagcctctgcctcccaggttcaagcgattctcctgcctcagccagtaactgggactacaggtgcacgccaccaagcctggctaatttttgtatttttagtagagatggggtttcaccatgttggccaggatggtctcaatctcttgaccttgtgatccacccacctcagcctcccaaagtgctggaattacaggcgtgagccaccgcgcccagccctttttttttttttttgagatggagtctcaccctgtcacccaggctgtagtgcaatggcatgatcttggctcactgcaacctccgcctcctgggttcaagtgattttcttgcctcagcctcctgagtagctgggattacaggcacgcaccaccatgcctggctaatttttgtattttcagtagagacagagtttaaccatgttggccaggctggtctccaactcctgacctcaggtgatatacccacctcggcctcccaaagtactgggactacaggcatgagccactgcgcccagccttgttctagttatcttttcaactatttttttcaagaagattataaaggaaatcatcttggcagacaaaaataagagtccccctccagggaagacagattttcttactgtgtatgataataaagataattttggccaggcacagtggctcatgcctgtaatcccagcactttggaagtctgaggcaggcaggtcacttgagcccaggagttcaagatcagcctgggcaacataatgagactccatctctacaaaaaaaaaaaaaaaaaaaaaaaaaaaaaaaattagccagacatggtggcatgcatgtgtggtcccagctactttggaggctgagataggatggttgcttgagcctaggtcagggctacagtgagtcatgatggcaccacagcaagaccctgtctccaaaaaataaaaaaaagacaatgtcttactatggtgtaaaagttgggcaggtttacctgcagtcctttcagcctttcaaaagatttgggtttctgaaacttggggctcctctgctgtgatgaacccaatgtgtgctctgtattcacctgggccactctgcatcaccctgtggtgccagagaacaaagggaaccaacctgaacatgaagtttatgctgcttgctgtgctttgtttctgactcaggagtcttgtgtcttctgacggtgtacatggaactgcggcagactaactcctgtcaaggtgctcatctaaatcacctgtggggtttcaaaaatccatacctgcctgggtcctaccccagtgattcagattcagtatgtctggagtggagcccaggtacctgggtttctttaagttctctgaattgtcctgagcacatgaccaactgagaccactgttctcacaacagtcagacccccaagccgaccaaactggccaagcttctggcaaggatcagtgcacagttggaagtactcagccgggttctggagacactgtaagaagaccgctgcaggggtgcctcatgggaagagatggacctcctctggtggtcgcaacaggctttgtctgataatcacagcatccccctctcagggcatccggctgggtgcatggggcatgtgcaccgacaacttgaacaaccttccccagagggcagtgactgcagaaccaggacctgccctgagcattttagccaggctgtgagagggtgccctctcctggacatgctgctgctgctcacatagttccttcacttaaaaccaagtctctgaaatgataagaaaacttcaataattattctaaaaacatacatttgtgttacacacacgtgtttctctgtctctctcatacacacacacacccctctagagctatatggcttgttataggctttgaaaatcttttatattcaccaagctgtccccgatggcacagctagaaggagctggagaaaaagacaagtcagtctgaagctttcttgtaggctgagagttacatttcccacagattggcttctccaggaaggggatgtggagtgttggactttcctgtgccaaagttgagactggggccctggggtttgctgaacactaatagaatttagcagactcttgttctccctgaagaaaagagcttttgaaagcaggcattgtccacagaaaagagatgaagtgtttaggctaagaggaggagggtcaggcagctgttagaagaggcttgtggttacgttggttgctatgtgggaaatttttgtaaaaatttaaaaagggaaaaaagaccatggcaagagcatcctgagtctcaggggttgtgtattggaatctgagaagtggagaggatatttaccatcacaggggggctgtcagatcacggatgttaagcatttggcgcattgggaacactccctactggtagctgtaaatatcatcattagctgcatgctcagctgttttattttttcccccatcccagggcagagggtggggggatgtaggcagtggtgtcagggtctagctgggaggagtgaggggacaggaggttgaagatgaggaaatgcctggtctgctatcttggtagccctagcttcaggccctgtcccacaggtagatggataaatgtcccaggtggagcccatagcaaacacccctctgcaccttcccaccagagttcttttcagggctatccaagagacagccagaatccattccctgcctaaagcacagagaatctgacttgagccactgtcttgtggctcgatttccctgcagttactaccgagtgtgagccccatccataaggaatatttagaaaaccatcttcagaggcagtttcccaccccacaatggcagctgaagaggacaatgctatcagagcctatgctggttatgggttctctgcagctccccacaaaccaccccaataccacatgcatctcagccaggctgacccaagttcctttttcctttaagtcaggggtccccagcccctgggctatggaccagtacttgtccatggcctgttaggaactgggccacacagcaggaggtgagtggcaggtgagcaagcgaagcttcatctgtatatacagctgctccccatcacttaaattaccacctgagctccacctcctgtcagatcagcagtggcattagattctcataggagcatgaaccctattgtgaactgtgcatgccagtgatctagtttccccactccttatgagaatctaacacctgatgatctgtcactgtctcccatgacccccagatgggaccatctagttgcaggaaaacaagctcagggctcccactaattctacatcatggtgagttgtagaattattccgttatatattacaatgtaataataatagaaatcaagtgcacactaaatgtaatgcacttgaatcatcctgaaaccattccccagcctggtccatggaaaaattgtcttccacgaaactggtccctggtgccaaaaacgttggggaccactgctttaagcgactgcaggctccatttgcacatttgggtttgcccttttgcaaacttctcagtcctttcgcgcctttcctttgaacatccactgggcatctgcttctcaccctgcagctgtaattttcagatttacagaacttagctccccagcaaaaccccagccaaccaccatcgcctcatccccagctgcagtgattggctccaagggtgaatacgtcacccaaacctggccaatcagagtccttttactgaacttccacatgtagggctcttctatcttggatttttattacctgggagggcataaagctggtatttcctgtgctgatgtcccagtcccctgactcacaaagaaagagtgtctgtagggagagagaacaggcccaacacatgaggtgtggagagctggagagcactcatgcctttgctttagttcctgaatccagttgtgcctgcagccacttctgtccctgtcctttcacagttatctgtcccaatacatcccactccctccttgatgatttgaattgttgctgacactttttaacctctaaagttgtgatgactacaaacttgttccccaagcagttcttcaatgcagggggtgtggtgtgtctgtatccatttagtctcaatttgaagattagaaacttgctggcctgtctcaggccttccaggctccgtcctgtgtgatgacttcttccttctttgctctgcatatagcactactgtcttcatcatttattactattgtgatcttcgttattatttaaatcatacaaagttctgcattgaggatttcatgtattatatttgttttctccacaacaagatgacaagcttttggaattatttttacatcttaaaaaacagtcttttcaggactgaccttaattctgggcacctatccaataaataacattaattaaataaaaaacattttcccaaacgcagaagcaactgtgtggcctcctctgagcacgatcacattccctggtgatcgagtcttcagctgatgctgatcatttgaatgttcacattctcaatgtgaagaggccaagcagaagcgcatacggtgtgagccaggggaagagatttttgtacagctcctctaaagtaaacattgttttggggagaatcccagaaaaacacacattcatcgttgttgctgttttttcctgattagtctcaggaccacagtgattctgaagcagcaggtcctggtgaagctaaaggaagagggggatctgagattagggtgcagggaaggagggacaatacttcagcacagaaacaaggcccagactttctaatttgggatgcttttcgcatgtacttctttactgagggagacagagcttttgatgcatttaatactggcaaattaaaatggctaaaacacagatataatttaagctctctcctaatcctctaaacaaatactcgagaactgcaaagaaagaaaactaagctaatctccatctgagaaggtctccttagtttgacttctgttcctgtgaacccttggagagaaggccctggtacaaagtccttgccagggagctcattgttactgccaaggacaggtggatgtttaaggagtgtgtgcagacaactcaaggagcatgaaggatggatgtatgatgtttgtcagaaaatgggaagagctgaacaaattagccaagaacttttactaggttcatttacctttgtgttgtagtcagggtgcagtaaagaaaggcagggagttttgtggacggaatttaatacagcaggctagttagaaggacgttataaaaccaggggagggtgaggcaacccagagattagcaactgcaggaagccattaccactgctaggacggaggaacaaagggaggggactgagccaccagacccaggaactgtgagctggaactgtggaggaggggctgcatgagatgccacctgaggaccctatggctgaaaccatgggggaaaggccatcatggggaatgggaaatggaagccaagaagaggctgtgtgatggagctgggtccaaggaggaaatgtggtcacctacagagagagatgtagtcactgcccaagaaaagactggaaagggaggtggagctggtgtattaccaagtttccctcttcttccatccatgcctccattggctcaatctaacaggaagcaagtgggcacagaagccatcccccaacaataccaagcagagtaggggaaggtgggtaatgggtctgaaagcaagcagataacttgcctacctgtgccccctatttttctgccacacaagtctgcatgctttggggcacagcagatgttccaggctgagatgagatgacaatgatgatgaaaaactgtgtacagcggagtagatgttcccacttccaggcttcgataaacataaaccagtatatctattgatggttgacaggaaaagattcccagtcttccaagagtctcagatcccaccacccctgaggggcagagactagtcctgctcttcctgagtttctccacagtcagcaggtgccacaggagactcagatgaggcagggaaaggagagcctttcagctcttctccctgagccctgtttccccacctcttccacatctgggtatgaaaatggaccgtattgccactgggagaaagccaaatccctaaatgtgagctcgcatagcattactaatacacctgatcttcagaattttggttaacacaagtttacacatattttcaaaaaatcattgaccttacaaagcttttatttgactttcaattccattctattgactgcccttgcccccctccaacccccactgcccagtgggcaaacaatcctgatcaagctcacccttccctcctccaaatactctttccaaatactcaggactagaagctaggggttcgaatcaaaaatgaataagacacagtcctgcctctttttccttccatttccctagaacagtagttgtccctctcctgcaacccacccctgcggaatccttcgtgcagatgtcatgtcactgaggaaaataatgcacaaagcagggaaagtgaaggtgctgtgcttcagttgggcataggagccccaatcccctcctcaccacctcccccagcctgggctcattctggaaatccctggaccttttcaaagcagagtttgcaaatttctgcttcagggcaattcagtaaatgcatgtaaactccttagcaaatctgttgggagatagaacctaaattaggcttgtcataaaaattgctaaactttactgcttgtgtgcttgttggctaataggaatctgtcaggtaatggcaaataatctctattcatgggataaggctttgtagaaaaaaagcaaatgaaataatttgaaattgatttgtaaactataagctcttaaaaaaaatcaaggcttttctcttggtaatttttcttcctaggcagaaatttccaagaagattgaagagaaagggaatgaaggaacctcataatgaaggcttttccttgattccagctggctgaatgatcactgggctgtggctgccagcacattccgtgtgggccccaaacacaagcccatttcttatgtttgtgtctggtacataatttggccacatctcatgtcacagccctcctaaaaaagatgttaccacagtagcaccttccctgggccctcatgttcacccaaacagacttgtgtacaacattcatgacaacagtggcaaacaaaagttcaacaaattgagtttaaagatctaattggcttttattgggcattcatgcattgaacagtaacctatccaaagatttaaaaaagatgagctgagcagacgactttagttttatagacagaaaagggctaaagaagcagaaagaaggaacaagaatcacattagtcagctcagagttcctcatgcacctagcacgagtgactccattctggtttggtctggtctgttgggtcctagtgcaggagctcagtccaaaacacaagcctcccgtacatttcatttaacataagtttgtgtgcacttgattctgctgggtgtcttagtccttttgtgttgctataaaggaatacctgaggctgagtagtttataaggaaaagaggtttatttggctcatggttctgcaggctgtacaagaagcatgatgccagcatctgcttctggtgagggtcctgggctgcttccactcatggcagaaggtgaaggagagccagcacatgcagagatcacatggcaagagaggaagcaagagagggagaaaggggagggagatgagaggctctttttaacaactagctcttgtggaaactaacagagcaagtactcactcacccctagccagggagggaattaatctgttcatgagggatccaccctcatgatgcaaactcctcccattaggccccacctccaatattggagatcgaatttcaacatgagcttttgggggataaacctccaaactatagcagggggtgtatagaccttgtttccattgaacaactgtagctccctccgtatttagagtgctcaaagatgaggactgcatccttgcatttgtagctcactctgagctgaggtccctcacagccaccaccagtgttgctcagcactcccaggcacttggactgcgccccatggaggagtctgggaagcccctccatgcaccccgttttaattgttcctatcctcttggtctgccacaagaaaataccacagattggctgggcatggtggctcacacctgtaatcccagcactttggggggccgaggtgggcggatcacctgaggtcagaagttcaagatgagcccgaccaacatggagaaaccttgtctctactaaaaatacaaaattagtcgggcgtggtggcgcatgcctgtaatctcagctactcgggtggctgaggcgggagaatcacttgaacccaggaggcggaggttaaggtgagccgggatcgcaccattgcactttagcctgggcaacaagagcaaaactccatctcaaaaaaacaaacaaaacccccccacacacacacaaaaaaacaaatcggattgggtggttcaaacaacaggaagttattttctcacagttctagaagctgaaagtccaagatcaaggtgccggcagggctggtttctcctgaggcctctctccttggcttgcagatggccactttctcatcatgtcttcacagggcctttttctctgtgcatgcatccctggtgtctcctcctcttcttgtaaggctacagtcctgttggttcagggtctcacccttatgacctcatttacccttaattacctctttaaaggccctatctccaaatatagtcactttagaggatagggcttcaacatatgaattttagaaggacacaattcattccataacagaagggatatgaggaaaagtgtgaatacttttagaaaagccttttagaaaagcaatttggcaatatctattaaaattgttaaaataaaaaagatactcttctacccagaaatttattgctaagaaattatctcacagctagaaaaccaccagtaataacgaaaatgtgttcaagggtgtttatcacagggttgttattgtggcaaacagttacacctggacacaatgtagatacccatcagtgggaaagtggttaaaaaaatcatgatgaaatacacatcaccagagaggctctgtggccattaaaaagaattaattagaactggccgggcagagtggctcatacctgtaatcccagcactttgggaggctgagctgggtggatcacgaggtcaggcgtttgagactagcctggccaacatagtgaaaccccatctctactaaaaatacaaaaaattagccaggcgtggtggcaggtgcctgtaatcccaactacttgggaggctgaggcaggagaatcgcttgaacctggaaggcagaggttgcagtgagctgagatcgagccactgcactccagtctgggcgacagtgtgagactccatctcaaaaaaaaaaaaaaaaaaaaaaaagaaaaagaaaaaagaaaaaggattaattaaaactgtaccaatttacttggagtgattcctataaaatgctgtcatgtgagaaaagcaagatgcatgaagtgtgcatagggtgactataaagtgactgtaaatgataaggcaaatcttatatgcatctatattggtatataatcacaaaggttgttaacacgggtagcctggaaggtgcttatggaggggactgatgtgacagggaggttacagaggtgggatccctgaaagaggaaataaatttttataagattgagtcaagtaggctgggcgcagtggttcacgcctgtaatcacagcactttgggagtccgaggtgaacggatcacctgaggtcaggagttcaagaccagcttggtcaacatggtgaaacaccgtcactactaaaaatacaaaaattaggtaggtgtggtggtgggtgcctgtaatcccagctacttgggaggctgaggcaggagaattgcttgaacctgggaggcggagtttgcagtgagctgagattacgccactgcactccagcctgggcaacaaagagcgaaactccgtctcaaaaaaaaaaaaaaagattgtgtcaagtgaaattacaatatgtataatgcaatcacactttaccatttatatgaagttatataggtgtgtatatgtttaaagatgctaatgaaatgaaataaactcatgtctgtcccagaaaactagagatgactgggcattgggaggtaggcataaggcagagcaggaggcagatgaactagaaatggcccaacttgcctttactctcagcagccccttgttccccagtgggcctgaaatcttccagaatgggaggagaaggaagtgaaggattgagaagagttggcagagtcttcaaggatttactgtgccagaaggctcacaattttcctcatgctgtggtctggtcgtggaaacaaatacctctaattccctttaagtaggccagaaaatgagccacataaggatatgcattactggattagtgtggaggagcaagctcaaagccaaggactttcacagcagaaacattcattgtctgggcatgtcctgtctgtcctgggcagtctgtcagcaaataaagcaggtgtatagaaagatggtcttcattttcgaaatgaaaaattgtgttaatatcatctccttttatttttaacaaatcctaaaagaaacaaaatagagacgacttgaatcactgtttcccttggttctcctttgccatcttggggccccattcttcagaatcctgcagcttaaggatgtctaagaatggaagcagtgctcaggtaattgctaaatagttgtccaggctagtcagttaatgatgtttatagagtgactctaagaagtatgggcggctaaccaccagttggtgaaggcattcaaatgacaactatcaactcccccataagaccaccaggcaaacctttacaccaagcaaagctaagtttatgagacttaccgcagtggagagcacactgccttgtagggacttagtagcggctcaaaagaggaaaataaggagaagacctttatagcgttttagatcctaggctgggtaattttaaggtgggtcttgcaagcggagaactgattgggattgggtagaatttctgatataacagttatggactggtgagcacggtaaggtaaagatcttcaagttagttttgaggagtcagctaagtcttcagaagttaactattttagttggtttgcagtcttatcattcagaaacaagtactttctggagcgactaagttatttgacttggtctcagcattgtttagcacagggaccaaaatatatttggttttagttttcactacttaattatttaccagccggaaatttcctgtaattgggaacttactaagatggaatcatgacagctccaagatactgccccaaatctttgcttgtaatggattatgttgtagtaagtataacttgaagtaagaatgatgtaaaaaattcagaaaatgttttatctatagaaaaagataataatctttatttaagacaccaacagtggagaggttaagagcattggttctagagatagactgcctggtttcaaatcctagtgctgccctttactagctttgtgactttgagtaagtcacttgacggctctgtgtcttacttttctcatctttaaaatgggaataatataagttcattcctcacagggtattttgaagattaagtgagttactatatgtgtggcatttagaagattgcctggcaggtactaactgttcaacaaatgtgaatattattgtttaataacttgacagctatttaaaactaaaaccaaagtcctccacctgctggctttttaatcccaacttctccttcagcacctctttgttttttccagagtctgcagtcatttggatgcttgtcatctgcattaatcttagtctcttctctcttgagatctctacaccaccttcccaaaccattaccttgagggtaaaattcgtacacaaataaaggagaatgatgggtgtgatggaaggtctaggtaccaggcggggaagctgaacatggaagaaagccttctgaagattacaagcttcttcctttatggagttttgagtgatccaggaaacatcatgacctcaaagtttttgtttggagcataaggctggcaagctttgtatatggccctcgctatatttttagaaattctttgctctcattgggcatttatttgtttggcgtgatttcagatgggacagagactgaaatctgggatcctgtggtttggtaatgtggtcatgtgtctaagacattcaattccacaagaccagagtctgactgtctatatacaaagggaagtgcctaggaggggaaacttgcttctgtacaaatagtaaagccagcccagagcctggcttctttacaagtctttttgttctacagagattttattctactgtaatgtattggcaactgcaaattttatacatgcccatttatttgctgttatgctgtgatatggttaaattcaaatctcatcttgaattataatcctgataatccccacatgttgtgggagggatccggtggtaggtaattgaatcatgggggcagtttaccccatgctcttcttgtgatagtgagtgagttctcacaagatctggtggctttttaagtgtctggcatttcccctgctggcactcattctctctcctactgtcctatgaagaggtgccttccaccatgattgtaaatttcctgaggcctccccagccatgcggaactgtgagtcaattaaacctcttttatttataaattgcccagtctcaggtattctttcatagcattgtgagaacggattaatacatgctatatatgaaaattgagtgaaaaggaataagtgtcacatccagacacaaatgagtcttttcctgttggtctctttcaagagagacaaaagtgttcatggatacccctagcagactgaacttcacatcttattggacagaaatgggtcaggtgctcacttctaagcttagtggccagacgatagaattaccatgactgactttgactggcatacaaatcatggcaccaaccacttggaccccgaaagcatcttctgtgcctgagaccgttgtgtaggtggtaaaacactgtttcatttaatcctacaccagccctatggactagctataacttcctcattttacaaacagggagacagagacttggagagtttaatcatcatcataaccaagcatttactgtgttccaggtgatgtcctaagtgctttacatgtatcagctcagctaatcctcatcagagccttttggggtaggctccattttaagttccttgttatagatgatgaaattaaggaatgcagagaaaattttcaagctctcacagctagcgaggggaagagtcagggttcaaacttgggaagtctgactccaatgtcagaggacctcaccatacactactgaggtcatgtaccaatgtcagcatacatgaccaagtcaggtggaggggtcaggagtcaaacacaagttgatctgcttccagtctccaacattttaattgtcaggctgtaccatagtccacaccatacattagtacactgctttagggctatcaactattcatttcacatatttgttcatgttgttatcaaactaaccctatgaaatataatatttgcaaaggagagagcaaagcctgggacatctaaataaagtcacagtgaataggagacagaaacaatctcaaacccaagtcaacattgccacaaccaattttcactttctaggctccccatctgtggaaaatgtaagatcaaccccaaatcctgcatgttgtcaaatacaggttatgggtcatttccttatttactgtggaaatgttagggatgtgggaggatagccttttctagaagcaaaccttaactattatagaattctggcctgagggtgcatcattctctacctctttattgatgctacatgaacactggtcaataaatgatagtgattaagtagttggtatcacttattgatggtaattgaaaacctagtccctccacgttgccagtgtttccctcactcttccaacctaaaagggcaacacagacttttactttgacatctttttaaagtattttagttacaaagggaaagagcagaatggatgaaagctggaatataaaacgacaaaggaatggatgtatcaagggaagcagagctttacatggatggaggagaactcacaagtgcacttggcaaacacaagccaggtgtaggcacaattcaagtgtcatcattagttgtgttttcaaccagtagcaacaggagacaaattcctgggcagacagggatgagtccctggtgaaacctgaacttcaaaccaaagacagtttaaagcctgaaaaccgagctgccgggcccagatagagtccacaactagagtccctgtcttaccctctctgtctctattgattctttctggatgatgccttttaaccaattgaatggtgctttttccaaagctcacccatggaccaatcagcatgcactcccccttctaagcccataaaaaccccagactcagcctcacagacggccatccactttagggccccctctcacagctgagggctgcccacttcaggccccttcttgggtcaagagcttttctgttgcccaagaaaattcttctctgtcttgctcactcttcgatgctcacgtacctcattcgtttggtcacaggacaagaacctgaaacctgctgaatggtgagtgggaaaaaagctgtaacatacccctgttcactgagctgggggcagttgagaacaagagagctgtaacgtgcccccatttgccaagctgcaggtgtgaagaagagaatccactgggcaccgttccctcctggctggcttgctgaactacaaatgctccaacatttcttgggagcttagacctcaggactccctgggcaagagctgtaacaccccttggggctccacggttgctggcatctccaagttttcaggtgctactgtgttcgtctagacagtggcgcccaacaaggaagccactcgtggcacacccagtccagccacaggctgagcctgggggcatggtgggcacaggaaccaggccagggcaccagcctagtgcagcctgctgggtggagtgggtggagcaaacctggtgggcctgagcaaggccctgggcggaggtcatggcagctgcagacatttctggctggcaaagcagcactccaaggaatcctgtaacacaactgtgtttatttttttggcctttattttatttattttattttatattttttatttgttatttatttttattatatttattttttattttttaatgaaaagtttgtaatatttacacttttacagactagatagaaccatcacttaggtttcaccatttctgaagccactttaatatattcttggcaggtttttcatggttctgatggcaattgtcctcaccccccatgccacccttgtgtcccttcaacacttttataactgttggttcatttgaagaagtaactagattatgagatattgtgaccacgctttggtatttctacctgtctggtttttaattcttaggacgctaatttacaaaaccaaggttagatgctggttaaggaaaattatttgggatactactgcttcagtattctatttaagatcagacaataaacaagcttatacctggggataacatatacagcttttctttcagtaggaagtaggagtctcagcaatataaagacccaacagtccaattccaaaatgtcattaagcacagttaacaatgtatatattaattattgaaaacagctagggtaactaaatgacatcatagaatctcagggactgtgcttggcacatattagacattgaatgaggttttgatgaataaatgagtggctaatttatgcaatcccaacaagatcatagacatacgtggttcagtcctaaaacaatgtcacattcaaagaaatacaatttcgtaaatgaaattgttttaaataaatttttctttatcgttgtctttaaattctttagtctcacaccatagaaaatagattaaatgctaatccactcttaaacaccacacaacccttaccaacacctcatgtcctctttctctcttgcactcctactgttttagttcttttggggtgctgtaatggaataccataacctcagcagcttataagtaacagaaatttatttctcacagttctggagcctgggaaatccaagttcaaagcattggtagatttggtgtctggtgagagctcatttcctggctcataggtggtgtcttcttgctgccccctcacatggtgggagggcagctctctggggcctccttaataagggcactaattccattcatgagggctccatcctcatgacccagtcacctcctaaagaccccacttcctgctaagattaccttgggaattaggatttcaacctatgagttttgtgagctcacatacattcagaccacagcagctgttttttagagctttgtgttcactaacacccctccccacttctgtccagcccttgaagcttttactcctcctacttcctctttctattttccatcagataggttgatttcaaattcttccattcctcctgccgcctttctagtcctttcttcatttctcattatctgattttttttaaaagagttattataatataataaactttcaaggcacaccatccatgtcatctgtaacctttcaggctgttaatattagaactatccctggtgaatgacaatttaccctgttcctacagccccagagaagagattttacctcctttccagaagagaacaaccatcacagtaagagcctcagcatgtgtgacctaaatccctgcttactgctgcctccacacctttccttcagtgttattcagttgttcggccacacccagaatacttggtgattgttactggcttatccttcagcctctttttactctggctatgcaatggcagttcacctaacttttcagtgtaggccatgatcacttcagtcacctcttcccaacattctccaggaccttggctggaatttatttattacactttttatttccataggtttttgggggaacaggtgatatttggttacatgtgtaagttctgtagtggggatttgtgagattttggtgcactcatcacccgagcagtatacactgaacccaatttgtagtcttttatccctcaccccctccatagctggcagttagatgctgctgaccaagatctgtggttttcttgtggcacccatgggacggtggggcctgctgcccacattcaaaaatgtggccccaatggaaaaaaatagtcttgaagaatttcaacttctagatttttccttttagtcattagcatatgtttattttgtcaatttttttattttattttaccagagtgtaatttctacgggtgggaaggtagtgtggggaccgactgactttttcctttgtattgttctgtcatttaactttgtacaacaaacagtgtgactaaaaaaaaaattccctgtatgtttcatcatttacttaccttcttggttttcccaatcaggtttttaaaaataactgattctaatttccaaatactttaatactacaggcccatgcctcagggtggagactcataattatacaggttctcttcaagtatttcaatagatcctcagtctttctttgttcacagcttagcttagagtccttactttttttttttttttttttttggtgaaaggaattgaatttgaaagtcaacaatctagaaacttcaaaattactgcagccacctactactttccaaaaataagcacccatcaaaactagactctatcatttgttacccatgcatgttctattactaatgttctcaaatcaaatttgagcttaaaaacagaaaatctacagtttcgttgacgacccctcccacccccaactattccacccttcagccccatggcatgttaaagggaagaacaatgaattctggttgttacaagagaatatttggagcatctgactctttttgctgtcaaccagggtgtcaacttgaggcatccataatgactcgactccctgtttgattccttctctccttttattctctagaaagcccttcctggaccctcttgttggactaaatgacctttctccacattcctaaccaccctgtgcaaacctctctttgaacacctgccacattctgttgaaattaagtcttatcctcccactgtattttaaagtctttgaggacgatgcccgtttgcaagtcaccgttgtatgcttggtgtctggcacaaagcaggtgatctgaaattcctggtggaagtggaagggtcatgtgtatgttgggcgggtgtgtgtgagaaggtaaaggacacgtttttcatttgcctttatatagcgaccactcatcttaacttcaacccctattccaaatcttcctctgaattgtacaaatttttaattgttacattctctgtagatgggtttggatgacacaggaaaccccttaaagtcatctgcaatgttctcagccctgagtttgatggattacttctgtgagtgatggtgagtcgtggcagtagacagctcatccaatcccttgagttactgttacttaagactttttcgctttcaagaaaaggaacatgagctaacataagaaaatgcgaaagtcttatatgggtactggattatgtcatagaagaacctgggcttaggaggtcagggaccagaaactggcatgctgtaaagagcacaggaagtccctgtgctgggctctcacctcgctatctctgcaagtgtgttttgttctttttttcctcctgcagactggctttctctgtttctcagcctagaggaaaaggagacatacattgtcaagaggcccagttctgcttacgttcccattgaccaaagtggttacaaagctcaaaaatctttgtctgtttatttgtgatctgtggggcccagggctgtggcttttctcgtgcacagtatctcctaagggaggctctgctgggccttaaattaccagaatctctgtgtaaatacaaatcaacctgtcatgagaactgagagcaaaaccatgaagcccaatgttaccatctttttattatgtccttttggaaattctaacacatgcaacaaaacattaaataggaacaagaaatacaaatatattacatataaatttaatatgtaacaaaagagccttcatatagtgaagggaagagtcatttaatacgctgtaaggaaattcctcattagcagtgtagaaaaatctctctggcccttacctttctccatatatcaaataccaatttaattccaaatacattcgagagttacttacttaaaaaataagctattggagaggtgatatggtctggctctgtgttcccacccaaatctcatcttgaattgtaatctgaattgtaatccccaggtgctgggggagggacctcatgggaggtaattagatcatgggggcattcccccccatgctgttcttgtgatggtgagtgaattctcttgagatctgatagtttttgttttgttttgttttgttttttgacagagtctcgctctgtcacccaggctggagcacagtggcatgatctcggctcaccgcaacctccgcctctcgggttcaagtgattcttctgcctcagcctcctgagtacctgagactacaggtgcctgccacgacgcctggctaattttttgtatttttagtagagacagggtttcaccatgttagccagggtggtctctatctccttacctcatgatcctcccgcctcggcctcccaaagtgctgggattacaggtgtgagccaccgtgcccagctgagatctgatggttttataaggggcgtttcccccactttgcttggcacttctccctgccgccatgtgaaggacatgcttgctccctcttctgccatgattgtaagtttcctgaggccttctcagccctgtggaactcttcagccccgcggaaccgcaatttataaattatccagtctcacgtatttcttcatagcagcatgaaaacaaactaatacaaggaggggtacaacaaaagaaaatagcaatgactatttatcccacttatatatgggagaggcctaagtataaattttccagaaaaaaattacaattttaagtttcttaaaattttaaagtgaccacagtataactgaaataaaatcatacatcggtacttaagtagtacaacaagtacaacaagagtgggaaaagaatttgcagcaaataagacaggagttaatatcttcattgtctaaatacttcatacaaattggtaagaaaaatgctgaaagctctggtagaattgtcaatttagacacatcaggaaataatttggagaaatttacctcttggtttgctgtttctactttcttgagccttaactaaagaaacaatccaaaattgggacaaatatattcattgtagtgatatttataatgaagcaaattttaaaacaagcacaatgttcaattattaatacatagcttagtagaatcacttagtaaattatggcccattctctcaagcacacaaacattcattgagcacctacgtaagccaggctctgtgcaaggagctgaaggtacagagatggacaaggcagaacctctgccctgtcttctagtgtaatgtagcatatgacatggggagaaaaggcaggaagtagacatttattgagggacttctgtgtgcttggcattttacctatgttatcacatttaatcttctgaagtgtttagttacacagcatttaaatgataagttgggatgggaagaggccttcagagggggtcacattgtgcaggttggacagagctgtgtgcatcttgccaagctacttgttttctatctctggttctcaatccttgcctctcaggccactcctaggaacactggtgagtgtcaagttttggctggaagaaggggctttagctttgggtctcccttctaaccaaatcttcagtttcatgcagtgtagaaattctggagttattgctgactggaggtcccagatttttcctgctagtttccagatttccagagaaatccacctctcaccatcctgctctccagcttgcacctcaaacccaacaaagtactcttcaaacaaaggattgtctgtttaatggaatctcacctcctataagatagttggggttataaacagcaaaatacatgttcacatgcaaaaacaagtgagcaaacaaagacctttaatggtttcccaatacctaattacaaatttacacaccaaaaattgattttccagaccctctattacctgcttgctcaccacccattgctcccaaaaacatcatctcccttcagtgattccattttagaatcatgaggatataagaccacataataataaaatcagagtgtacaaatttaacaaaagtgaataatatcctaaatgcaaatgatgtgaagttaactgagtattaaccaaggcacagaacaatctttgtagatgtgtgaatctgtgcataggtaatgattattaagaacctaacaggatttctgtacccacagttaaggttcttttcaaactggtgaaatatgtgctaatgaaatgatttcatgacaccctgaattccctgcctgaagatcttttaatagacagaccaccaggggccatatagtggtctgttgaccacacttcaaaggaaaatccaacaggagctattaaaagagaacataatttggaaagaggtcatggtggagtccggggagtttgtggaagatgttccagaagccaagaggccaatgcactgataaatggttcctggttaccctccagtgacatttgttcctttttttggggggaacacccccaggagagctgcaaagaacaaactggagggagggcacagggctgaggatgaaaaggagccggtcagtgaagctccaacttagaaaaagagatccgctctaggaaacctagcagaccagaggcagagagggaaaagtagctaggagagaattgccttgggtgaagacccagaagggaggaagagcaggggagaagtaaagggctttggttttggagttggggtttgcactgatctttgtggctagggaggaaaagacagctgtctcccacaggtctcatacctggaggccttcagtaaggtatgtctgggtggttttgtacaggcaagtgggagctgagcctgaccaggaggctgtatgtgggcttgcgctcatgccctgatcagcagcgcctgcaaggaggttcttttcttcccagttctgtgcccattgcacggctgcaacctctcatcaccccaaaccaggtgaagaaataacccctgggccaagtcagagtctggttgaccctccagtgggtctggagaggggtaggtgggtagaattccaaggaactgtcatcagaatatcttcttggtcatgtgtcatgtgtggtaaaggccttggcatcaaaaccaggtcatctgtggatgtgagcatttgcagtgtaagtagcgtgttaaactccttcactttgcacgctgctaaagaagcaggtatgtccattggtgagcttcctactttagctgctttaagggaaaggcatatgaaagtggctgttgaatgaagcattttaacttggttgaaaaaaaaaatgagttctggagccaaacagcctgggtccaaatccccattccaccttttactggttgtgtgaccttgggctccctatgcctcaggtttctcatttgtaaccaaagctaatactagcaccacttcactgggttgttgtgaggattaactgagatataatgtgatgcacagcattagaacagtgcttaaagcagagtaagctctcaaccaacatgagcaactgttctgttctcaaggctttgctggggtctttgctctgcagcaaagggttaaagccgcattggttagggaaatgtgggtctagaactagttaatccagcatctcattttgttgctaagcaaccagctctgagttctgcaaatgtgcagctcagtgtgcagtgaccgcccctagcaatccaaccccagtcaggctgtcacgaagcattgttttatattacttaagagctcatttcaaattgtggaggaggagggaggcaggcacagacagcgcagccataaaacacgagcaaaaccagcgcttctggctggaggagttcgcagtgggcataaaaataggaaaacaagtgttgaagtgtgctcctacccacctgcaaccgtgagagggagaattcacccgtatgactcacccttccctggtgttaaagaggtgatcgtgatcttcagaacgggatcctccatggatcaagggggcatctttcctttgcctgcatttgggtgtggggttataaggcctggatacaaacctagatgtgtggttcctcattgggaaggggcaggatgagaagcgcctactgtggcctcacactccttccctcagggaagtcagaggtcatcaaatattctttccttcattcatctgtatcattaaacatgtactgagtatctattgcatgcccaagatttgctaggcactgaggataaaactcaaagcaagacagttactctctatcttggcctggttcttagttaaaaaaagagaaagaaacccactcttgctagcttattagagatggcatttatcgaaggatattaagtagctcaggaaatttcccccacagccagagagtgagggtaagtgactacacagccaagaacattatgcagaaaatagttctggaatgctccaaaagagcccttattgcccctgcagcagggtgtgggctctggctcacactactgtcccaggcagggacccctctgccagggcctctgttcctgctcttctaaaagcttgatttcctgccctcacacaatgactttcatatggcatctttctcttcactgaggtctggcatggatgcctgtgattggtggagcctggatcacatgtctgagttctggctgtaagggaggctgggaaataaatttctgactttcacagatgagacggaaaattccccaaacacaagaagggtgttccaaaggtgctgggcagccacaaagcctttgagtattccctgcatagtctctgctctcttcaccttacagtctgctagaagatgggtgaccagtgctgggccaggggaagtacaggtagaagagggaccctagaaggatcgcgaggtcaggaaaggctcttcagagtcagccatatctaggctgatacttgaaggatgaatgtgagctcatcctggtgaaggctgagggaagaacatcccaattactgtagtgacacatgcaaaagtccaacatcacaagggaattagacactgcagggaagtgagagacgttctgtgtggctggagcagaaggatggggcagaacaactggtggtttaacaagccctccggttgattccgatgtatgatgaaattcaagaaacattgctttaagtaatatgcttatcttactactttaaaaatttttagtgttaggcattatatactgacttcccacaactaaaaaatgagcagatttcccatcccctctctcattccaatattgtgtattgtaacttgggtggatcactattcggtgctatttatattttacataactacataaatgccattcacagctgggtatgtagtagaccacactattcttcctttcctgcacaactctttgtttgacattaatatgtaactgttgtttttctctcagttgctgagttttctccatacttactactaattcactctcaaactctcctccagcaatgttcattctccttttaacaccttcagttactttaggagttccattaatttcgtcttgtcttttttaatgacttccgactgctccattctggactggggttctgcctgggcctgggccacagctgtcccctgggatctcccctcccctgaccactgtattggatctcctgcttcctgatgccacctctacccctgtcttgcttaactcccacattttggtggggcttcccagaagagggggcattcgtgtgaattgagatctcatgtgcctgaaaaacgcctttattctaccctcattcttgataattcgtctaagaataaaacttggagttgaaaatcatttctctcagaattttgacattaatgtttccttgtcctccattgttctaacaccctccagtggtgtcattgagaaatctgaagctatttttattgcttgtcttattttatataactttatttttatttttgttacttgctcttgttctgtctctcttccactttttctctgtaggagattttaggccttctctttgctcccagtattctgaaattccatagtgatgtgtcctggttggatctgttttcatccactcttctgggcactcatgagccctttccatctgcaaacttgtgttctgggacatagtcttggatgatttttttgagcatgtcttcccctatgttcttttccttttctttcttttttgatctcagtgtgtggaggatggaactcctggtctaagcctctctctctctctcttcttaaacttcccctatctatgtttgtctttttgctcatcttcttagagagttcttcaaccttatcttccaactcacttcttgaacttttcattcctgctgtcatattgtccaataactctttttttggttttctgaatattcctagcattttgttcttgtttcagtgatgcaatatctttcttatctctctatggatattaataataatttataatcttttagaagcttctttctccctgtatattctctgtttcctccaagctacagttatctgttaattttaggctatatcatattagaggctttccaaaagtgccccgtgatccttggacatctgctcatatttaagagaggagcgataaaacagttattagaagctctgtgtgcatgggcgagtccccagaattagcacttctaggcctattctcctgagctggtcaaattccctggggaagatgcttccattctcctgttagaagggacaagtttggctgccagcattctgggagctgagtgaggaaggaaggctggaaagcctctgggcgtctctgtttgtgtgtgtgtgtgtgtgtgtgtgtgtgtgtgtgtgtgtgtgtgtgtgtgtgtgtgtgtagggggagattattatctatttttgcataacaaattaccctaaaacttagtggcttacaaaaataaacatttattatttcacaatttctgtgagttgggaatctaagaacaggttagctgggtggttctagctgaggttacagtgaggtgtggaacagctgcaaccatctggctcagtctggaggttctgcttccaaagtggctcactgacattcctggcaagtggcaagggatgctagttattggcaggaggcttcatttgctccctatgtgtccttgtgacatggcagctgccttcctccagagcaagtgattcaagagagagcaaggcagaagccacagtgtcttttatgatctagccttagaagtcatactctgtcatcctggctaacatggtgaaaccctgtctctactaaaaatacaaaaaattagctgggtgtggtggcgggcacctgtagtcccagctactcgggaggctgaggcaggagaatggtgtgaactcaggaggtggagcttgcagtgagccgagattgcgccactgcactccagcctgggcaacagagcgagactccatctcaaaaaaaaaaaaaaaagtcatactctgcatttttcttattattccattggtcacacagatcagccctactcagtgtgggtggggatggtccaagggtatgcataccagagggggagaatcactaggagtcatctgggaggttggctcctatggtggggagggggccaggcgggagttggggaggaggaaggtctcaacacataatgtacaattttattttttgccagttttttgtgagataccaccatcttctgcaatatctgatatctgcagtttaaggaccctgagttttgtcctccccaaagaataaacctcctgtcttctacaaaatggaggagcagtttgtaggggagagaatctaagagtttgcttcttgaaaacgtagtcttcctgtccttggctccatctatccccgtgcttcaggaagcacctggcctgctaattttccagccttggtgagagggaggtggctctgtagtataagttgggttggttcttggctttccccactgccagcttagaattcagatttattatttttgctaattccgtttccactcattcctcagcttttctgctttcaaaattgtgttgctattggtttctttctgattctttttgttcttgtggatttctgatttttaaaaacaaccccttctctgtgttttatcgggacttgagggagtagaagccagtgcatgcatttgctttgttatctttaactggacatcccctcctcttctctttcattctcatttcttctgggctttgccctttaatttgaaaattattctttgttttttcttttttcctcctctcataaagcttctgaaatgggccaagaacctattttaaaagccaaaaactgaataaagaccctttctatgtgtatttttaatttatcctaataaaatggatggctctggttaaatagatagtcacacacacaaaaaaaaccaaagaacttttatatatttcaaaatattatccaaccacaacagcactgtcatgctgtttgagtgtgagatcccctccttcatgaccccctcggctccactttgcttaggcctgatgtaagtgacttcaccttggcatcaacgactttcacagggaaaggggtaaccaaggaaccacaaaagccaccataaagactaagaagcagcagctttaaacagctgtcgaatccagagagggtcaaagctagacctcttgaataggatcagtcatggaagaactatcctgcttctccgtcccctctacttctacctcggaaggatccgaacctacatgagcacaaccaggagagaaaaaggagaagtattcatccctcttcgactgcaggatttctgattcctgcagagcgtacttgagggtccagagctttattacatgggaatggaacatcttaattactgaattgaggccaggcgcggtggcttacacctgtaatcccagcactttgggaggctgaggtgggcggatcacgaggtcaggagttggagaccagcctggacaacatggcgaaaccccgtctctactaaaaatacaaaaattagccgggcatggcggcaggtgcctgtaatcccagctactcaggaggctgaggcaggagaatcccttgaactctggaagcagaggttgcagtgagccgagatcgtgccactgcactccagcctgggcgacagggcgagactccatctcaaaaaaaaaaaaaaaattactgaattgggactgggttttttaacttaaagtgactggaagaatccatggtgtctactcgagttttaatttagggacaagggtggagctagccccattgataccgtttaaagggacaagataattcttgatagcacgacgtctaatgctggcacataagaacttaggacatggtccaccctcctcggggcaatgaggaatagctttgttgaggttaataatgtgaggatggagagagcaatagatgaactagagtcagaccttgatcatgacacagctccactccttaccacagccaaagtctcttcactgagcattgttccttcatctacaaaataagggggttcaactagacagccagtgggatgccttctctatctaaactcttgcatgagtctagggatggcaaggtggagaggggttgggtgagtagcccctttcctggagataaaccacagatggtttaaaccagagaagacactggagaacccactgcatttcaaaaatatttcctttcccttctggcagctttgggtaatttgggtaagcacttctgggtggaggcacagctcaggctttgcggggaagatgaatttagtggtgaaacaacagttatgacaatagatgctgtttctggcgcctctgaatcttctagtatctgcattatgattttggaataaaagatgattcatttcgagtctggaactcagctaaatgagcaggactctgaaacaccataaatgacatttctccctgccaggagctcaaagcagggagactgagccactccatagatatttgcctgtgctttgtcttacgaaagacccaggaactctctcaggagttcagccttgctgtcacaggtgctggctaagggaagccagctttggctgctgctgaggttgtggagaaatctatctgcatttgtgctaacagtattaataaaagcccagaagttaggagatgtttctgtgaatgttatctgcactctatctgtgaaacaatgctgaaggtcaggtgattcccagatattagttgtacacagcttacttatccttaggtttccttttggctaaaactcggtttcattcatctctgtgcatctttgcatagcgtttaaagcacactcgagtgacatgcactgctgtagtgctctctcagagaggcagccccatgggcctcttccctcctagcatttgccagattttccaaataatgacattgtgattgtgtgactctcccgcactggacggaaagcttcccgtaggcaagaattagctcgttcccaaacatagcatagtgttggcaaggcacagtggtgatgaataaatacataagtggatgatgaattaaatgatttatgtagcaaagggatgctggctgcacaccttcttgttggatggcagggaacaagaagaaaggttgagttcacccaggtgctaaacaagctttgagaacttcctttccacagcagataaaaggagtctgcaattgtggaggtctagagtacacttttcatctcccttcatcctgaattttgtctttggcagaatctctggggatttttgaatctgcagcttttctctgcactggggttcctgcagtgtgaataccatccaatggcccacaccgtccaggtcttgagtgtgggcccctggcagccctcttgaaatcgaattctctccaccctgcatcctattccccatggcttgctgaagtccttgccctgggacccatggagagctgaggatgggtgtgtgaccaaggagaaagctgctcccactgctctctgaccctgcttcctctgagaatcagaggacttgcagggaacccagactttcccagcgccaatttttccattggccatgcagtaacccaggctttcccacaatcttctgaagcctcagaggcctggctgctcctgggagtcggcccactctcctggcaccaagggtatttgttcacccttgactttgtaaagatccctgtcctctcctctccctagctctccacccccaagccactgtgaaatcctagtgtactttaaggctctcccagtattgacaccactatcagccaagtcacttcccgtgacccagggctgtattaggaaagggccacaataccaagagacagacactgtgggttttggtcctggccctcctatttgctacttgctgaaccacatgcactcacattgcttctttaggtctctgtttcctcatctgtacaatgggtttatgcaccttccctgccagcccacagagctgtggtgaaggtcacatgaggaggtgcatgagaaagtgcttgtctagtagtaggggacccactacggtgaggtaagttgatgtgttaatgacagtgaaggccaggcctaaggaaagggggagcaggacacatttgtcgtggcgtttcttactcccttactccctcactctggtcatttgtgtggcattccctataaaggccatctaatctccccacccccagaagaaaagttgggcacataagttgcttgaccacattcatgtacattcattcaatgtactactccctagggtattttaattttaaaatagatgaaagcaggaagccccccaaaaagaatgtataatacagaaacacagggaccatgagacttatgtgagtgggaatatgtgagggcagggacagggagcatgcccatgcattgcccaggccactccatgggtcaacttgactccctcatcaggggcgtcagtgctcttgggggccgcactcttgagtctcagcccccacgccaaggccccattctcacgctgcctgagtagggcagctgagacgtttggtggaactcggaactaccagtgagtgggtcgtacagggattctgcctgtgtcctccacatgccctaccagaggaggaagaggcacaaatgaagaattaacagcacagaggcctttactggaatgctgccagccctctccaggcctccaagactgccccaagtgaaggagaagtgacctccccacagcgtggcggagacagcggcatctcagctcctctctgtccctgtgtgtctctagctggcatggcccgagcctctcctccccattttgactcttaaagagagccaaagcgtctccacttccaaacacccgcacaggctggggtcactgggagctgcctgggaccgatctctgtggcccagaggtgggaacatgaccttggatcatcacaaaacctggaaaaaatgcagccagccttcctcaaataagttggttttccaaaccttgcctcaggactttattggatctttcaaagcaaggagaccaatgagtgtgtattttctccagcacatgggctcaccctggacttgaatcccaacccaggggagtctggaccacagggccctgcacctgcatgctggctacgccctgcctcgggagaaggccagcaagcgctgccctctgttggcgttgtggggcccatcttcgagcatctgctctccggcaatgtggccattgttctccatccagaaggccctctcttcctcccagagggcattctcttcctcccagagggacgttttatcttcccacagggctttctccccctcaaggagggctctttcctctacccacagggccttttcttcctcccacagggccttgtcctcctgaagaaggttccggtctctttcccataaggcattgtcctctttccagaaggccttatcctccttccagaaagtgcggtactttttccagaaagttttctcttcctccctgaaagacttttccatttcccagaaggatttttcctctttccagaaggttttctcctcttcccagaaaggtctctcctcttcccaaaaacccaggatctggccccggaaagcatggatcttgcctcggaaagtccacatctcttccctgaagtcctctattttttcacgaaaaattttcatctcttcgcgaaaagccttttcctcctgcagcttgtgcattagtttcttctggcgaatactgggagaggatgccgccagggaccggaagcaggcaagccccatccatctgctcaccttgaaggaaaacatcttccttatcagccggaatggcggggtggccatgagggatgacaggacccttggccaggtccaggtcggctggtcagaccctgtgggggcagcagaaaagacagatctatgagtatcacatgccaggggacggcccttggttctgtactactgaatttgagaaaatgtaatcactgctctttgtccacatggtggtgtttgtgagggacaagctttggtagaaaaacatgtggggtggtcatggctttgagctggagaggcagtcagtacattcaagctcaaggctgctaaaaacgtagacactcagccaagaaggacagtggctgtcaactagggtatcagaacacataggtgtgacatgatgaggccaagaagaatttacgtttgttaaatcaatccgaatgaatttaggttttggtgtactcacttgagaattgttcctatctgcctatgggcatgctcacgtgtgaatgtcctctgttacgagcctgggacacagaagacaggcccactgacctcagaggggaggaggagagtgtattttaggagaggagtttattttgggaaaagtggtttaaaacaaaaaggtgagagacgatggtgaatgtttccagggacatggaccaagaaggccctcacacaatatttagtaatatggaacaataagaaagacaccagatgacccgcagctccagtcccaggtataaaccctgaggaaacttaggaactgtgactaggatacatgtacaagtgtgttcaaggagctttgttcataagagctcaactctggaaacaatccaatgaccatcccaatagagtggaataaaaaatggcagtatatccacatggcagacagcatggctgcctacaacagcatgggtaaatcttataaacccaatgctgaaagagagaagcaggatcagggaatttcaaagaatgaagttccaaacaagcaagactaaatgccattgtctaggggaacatacttcaacacagaaagagaaaagcaaggaagtgagtcccaaagtcagagtaatagttgctggtgtgggaggatttggagtgtgggatgaggaggtgagactaaggggtgtgattaggtgagtacttgagagaggcttctgcagtgctagcaggactctttctttgcttggtggcggtttcatgtgtgttgttataaaaatgtgttaagtggtacatggatattttatgtaccccagtcaatacagtatatttcacaataaaataaaagctgggaggaagaaagaaggaaaagaaaaaaagaaaagaaaaagagagggagggaaggaaggaagggagggaaggaagggagggagggaaggagaaagatcttcaaacattgccatatatctgaggaatcagatagcagaattatccatagcaatccctgtaactacaaacatgaatcaagggatgagaaaaagtgctggacataggaaggtggttagagtgcagtaaagagctcagtgttgtcagataaggagtgcaggcacatgctgacagcattgttttccattttgtgctttctggaggaagctgccagggtccggccctcactcagtggatctcaccaacccatcatccgtgagacctattggggaaattttcagggctttctctgtatttttccatttctggtttaggaacagggagtggaggaggagaaaagacacatagctggtgtgtgtgtgtgtgtgtgtgtgtgtgtgtgtgtgtgtctgtgtgcgcgtgcatatgaagacacagtggctaggctgtggacagctggtggcatcaccatccatccagtcacacaaaccagaaccaggggcacatccttgacctttccctctccctcaccagacttctctcctcaaccatcaagccctcctagccgagatccagatccttaacatttcctgaaaccatgcccctgttccatctcccccatgacagccaggtcaggccaggatgcctgtaacagtctcgctgctctctgtattgatcttaccctctcatctgcccctgcactgtagccctacaggtgttttctagaacactctctcgtcctatcacatcagttcacacaccttcaaagaccctgtagcccaaagatcaaagctgaacgccctaggaaggccttgtgcagcccaactccagcttgcttctccctctccttcctacccagcctgcacccaactccaaatctaaggcccagtattaacgggctctattcagctcttggcactctgcctgcagtttcctgcctgtgtggtgaagcacatgtcgcatcctctactgagagccccttttgttcctgtggtgggcttgaattcctgtacatcctttcccctctgaaagctactcggaccctccagacaaagttcctcgccacctctgcgatactgtctgtctgttactccactattacttgtcacacttgattgaaattaggtgtggacatgtcttcctgacatctctgtaacccagcagctatcataatataacgccgcctatataggagggaattggtgaaaatgttggttgaattgaactgaattgaactgcattttggaaatttgattttctatgttgtatggctctttgcctagaatccctccaatatgtgaagtcctccctcacttccatgtcatgctggccccctctccctggatatccttgcccaacctcacttcagttcacctagcgaatccttcagcactcagatacctcctccaggccatctctcctaagctcagactgagcatgtgcccttcctgtcccactagaaacacctcatcttccatctctatgtctggcatccagcgaaatgttctgccacaggataggtgttcaggaaatagtagctggatgaatgggcgtctactgggttaggatgttggaaaacattcacctccaagtttttctcaagtgaacactaaactttctttaagaaagaaagaaaataagaaccatatcaaataggtagatgtgtattaaaatataaagtacaatataaaactgtagatgtgtatctgtatagctgtaaaaacatgcactaaagatacatgcccagttttcagttatactgtaagactaggagcttctttttaaggaaaatattatatattaccttatgcttagaacaaatactatacagtctaaagccaacagttacttactgcttagctgcttcccactggggtaagtcctgtagccctcagagggggcaggcggccattgtcatgtcagatccccagtgatgcgtgcttgcaggcttgccccaacaatgctggcagtgacctgtctgtgccctttcagtcctgactcacaggatggagatggccaagaaggggacccctataaaagactttaaggaaaggagggggcacttgaaaggtttgaaagagttcctcttcaatctttgacttcactgatagggcagtgctgttgatgactcacaagtgattgttaccttagattctgtcagcattggttccgggagcatggttctaggaagtcatgttctggtgggggctttgtgtgggatgaatcacttctcttgctgctttccagattcttcgtctttggcttttgatagtttgactatgatgtgtcttggtcttgaggtttattctacttggagattgttgagcttcttggatatgcagatttgatgccgtttttcatcaaatttcagaagtttttggccattatttcttcaaatattctttcatccattttctctgtctcctctccttctagggctcatattatgtgaatactagtagcgtgagtgtgtcccccaggtctctaaagttacgttcatttttcttcattcttttttctttctgttgcttagattagataatctcaattaacctgtttacaagttcatggatttttttcttctgtcagttcaaatatgctgttgaatccctctttaatttttcattttcaactccagaatttttgtcatgtagtaaaatttttaaatagtcaagtaaattaacatatccatcatctcatatagttacccttttttgtgcactgtagcaagagcacccacaatctactctcttagcaaaaatctttaatacagtgttattaactacagtcctcatgttgtaccttagatctctaaattatttatcctatatatctgcaactttgtaccctttgatttccctcttcccgtccactccccacacgtagcagctgccattttattctttgtctgtgtatttgacttttttcttacttcttctttttaatttttttaatattctacatataagtgaagttgtgcagcatttttctttctgtgtctggcttatttcacttagcataatattctccagtttcatctatcttgtgacaaacggcaggattctctgtttatgactgaataatattccactttatatacatgctgcaatttctttatccattcatctgtcagtggacccctagtccatccagaatttctccagaaattttcactgtgtctccagaatttgtttggttatatatagaaaaggatatatgtgcttttctatatacatatatatacacacacacacacacacacacttctatatatatattttttctatatatctatataaaagtatatgtatacaaagtgtgtgtgtgtgtatatatatatatacacacacacatatatatatgtatgcacacatacttttctgtctctttttggtaaggcatagtttttaattctttcctttaatgctttttttttttttttttgagacatgtttctgtcactcaggctggagtgcaatggcatggtatgatcttggctaactgcagcctcaatttcctggactcaagtgatcatcccacctcagcctctcaagtagctgggactacaggcgtgcgccaccagacctagctaattttttgtgtttttttagagataaggtttctccatgttgcccaggctggcctcaaacttctaggctcaagtgatctacccattcggcttcccaaactgttgggattataggtgtgagccatcacacctggccttgttttcctttaattcttttggaatggtttcttttagttctttaactacatttgtaatagctgactaaaaatcttggtttaatcgcccaatatctgcaattcctcagagacagtttataaccaaaaagacaattactcagagaataacagtttcaggccaggcatggtggctcatgcctgtaatcctagcactttgggaggccgaggagggaggatggtttgagcgtcctcctggtaggagtttgagaccagccagagcaacataacaagaccctgtctctacaaaactaaaataaattagtcagttgtggtggtgcatgcctgtagtcccagctgcttggaaggctgaggaaggaaggatcatttcagtgcaggaggtcgagctgcagtgagctatgatcgtgccactgcactccagcctgggtgacagagtgagaccctgtctcaaaacaaaaaaaaaaatagaataacagtttctactgtctgcttttccccctttatatataactctgtttgcaataaagggtttcctgtttctttatgcctcaaaaaattttgttgaagttggacacttaaaataatatagtaactaaaaatgagatttccactcccaagttttgttggtggcatttattgttgttgctgttgctatttgttcatttagtgactttcttggacaaattctatgaagtctatattttttatcatgtgtgggcattaaagtctgcttattagcttaacgatcagctaatgactggacagagatctccatgaactgatgtctcctttcctttgctgagggggtgtctgtgtgtgtgtgtgtgtgtgtgtgtgtgtgtgtgtgtgtgtgtttggttgggagtcgggggtgcaggttgggcatacctttagtgatcatgcaggcagtttatgattctgcctagccttcgcttccttcttgtgagagcctcaaagtcagcctgaggtgagagattatggccttctcaggtctttctcagccatgtgcacagtcacatgcatgtgacccaaattctcaggactatatcaaaacttttcaaagtctccgtcttattctccagtttttctttttcagttattggtcaagcctatggttaaccccagctagtaatgccaaatcaggcagctatgatattaaacaattaccattttttttttttttacaaatgccctgaggatagggttatttgcacagagtaagctctgagtcaagtcaaataaagacaaattctgtgaaggaagcttttcagtgaactgccaaacaggtcaaatagtaaaaattctttgaggatggaaagaatccatcctaacccttactcagtcattctggaagtctcaatcattggtttttaaccgttcttcttttttaatatgtgtgcttaagaccatcagtttccgaaacagccaagtaaaaagggctcccgggagaacctccgacctgccaccgggtggatggggcgggacctcgagaagttctcactgtttgcaggggggaaggagcttggcctctcatgtttctgggtggcaacctaggattcagtctgtgagatgggggcctgttaacaggaacccctttcgctttgctgagtttttttccttttacacccaataaatttcgtttttcttacccttctgtgtgtccacaagcctaatcttttcctggttatgtgacaagaacccaaagaacccggtttttagctgagctaaggagaaagtcctacaacattttcatctaagtacacttacctgcgtctcacatgttttgatatgtcaccttttaattaccattcagttaaaatattttctgatatccactggaatttcttcttggatctattggctatttacaagtacattgcttaacttccaaatatatggggattttccaattatctttttgttactgatttccagctcaatttcattatggtttgcacaaagtatatggtttgtatactctgatttcaatcatttcaatttgctaagacttgctttatggccctgtatacattcaattgtggtaaatgttccatgtccacttgaaaataattggtattcttcagttgcttgatgcagtgttctctctctctatgtctgaattaggttgagtctttacctatgttgttcaaatcttctatatccttatagatttttctggctgcttgttctgtcagttactgagagagatgtacttgcagatctatttcttccagttaggtcagtttttgttttatatactttgaggctatattattagatacatgcatattttacaattgttatattttcttggcatattgacactttgatttttataaaatgccaccgttttatctttagtaatacttcttgccttaagttctactttgatcttagtataggcacgtcagcttttattagtgtttgcatggtgtatcttttctatccttttatttcaacctttctgtgcccttatatttaaagtgtatttcctatgatgaacatatagttgagttttgttttttctactgtaatacaatttgtcatttatttggtttttaaaaatatttacacttaatataattactgatttatattagatttgaatctattttcttaccatgttttttctactcctacctgttaaatgttacttttccttttttcttttggattaattaaataattttattattccattttcctctattatgtcattagctatatattcttttagcaattatcctggagattataataggcatccttgagttgttaaagtctaatggatttttatctttactgtttctctgataatgctagaatcttagatgattttaactccacttataccccttctacctttttcattttgttgtcataaattttaattctgcgtatattcaagactcctcaagattttgctagtcaacatacatttgtaattacccatatttttaccttttttcatgctcttcatttcttcctgcatctctgtgcttctgtttgggataatttttcaggtactcaaaaaatcatattctttagtatgggtcttgtgatgaaatctctcactgtttatttgttgaaaatacttttaccttttttttttttaatgccagctaacaggtgttatcggtagaatggtttgcttagtgtgtttccactgctgtgtaaacaaatgccactttcattttcctgttctttacattatagagaatttcatagtaatgtgatttcaaaacatagataagaaatgaattttaatctctgtaaacaattgataacaaaatcaacatttgtctctgatgaatttgtattatcatagtattggctctaagtttttaatagaaaggaagaaaacataattaggtactacacaacactgaaatccaaatagaagtgcctttgttttcttattcagacgtattatcctttataatcccatttgccttcattattgaagtgtatttctactggttagagaattataggttagttgttattttctttcagttagtctggtttctgttgtttctgttgagaagtcagcatcaatctaattgttgctttttgaaggaagtatgctttttaaaattctacccgatgttaatttaagactttgcctttggtctttggcagctttattttgatgtgaccagatgtgctttactttgtattttcatgcttgggatttgaagtatttcttgtatgattgaaattacctttgcaaaatgatgacggtaagagaaatctgacatagttgactccatcttgcttctgacctccaggatgttcttggtcattcctgggtgtaagcctgggtaactttgggaggaatttatagtttaactttgaagcaaggatgataataatccctccctaaaacaaatcccttccctgttggggaactgaaaccaccctttgtaagactaatgaaaggccacaagattaggattatgggaggggcctgagttctgataaaatgtaggtatggtttctataatcccttaatgctcaggagtcatgtggcctgaggccacaggatttatgactttccagttgctcctgtagataacatcactactgtagaacctagattggtcttttgagattttttttcagacttcctggcaatcaactgatcctgcctgaatccatgatttataactcagccagtcctgtggccccacccaaatgtggactcagtgcatgtgaatcattttcaacactcctatgatttcatccccagccaatcagaagtcccctgcccaccaaatcatctataaaaactctaacctctgagctcaagaagagtgatttgagtaataactccatctcacatatagctgacctcttgtcaattaaactatttactgcaatgctgtggtctcagtgaattgatttttctgtgcaggggcaggaagaacccatcaggtgattatatctctgtatcttactaaccttcatcacttttaggacattcttggacatatttctttaaatatgtcgtcttattttcttctctttttcacttaacagaattccaataacatatatgttaaacattttcactgggttccttatattaacatttttatgctcttttctaattctccattgtctctctgctttagtctgtatattttctactgtcctatagtccatttcactattctttcttcagcggtgtctaatctactgtttctattcagtctttaattttatttattaaattttattccaatctaggatattcatttggttctcagtttttctggtaccaaatttatccatcttgatttttaattccatttattaattgtagttattttaaagtctgtgtcttattattattcaagatccagttcatctgtggatatgtttctcttgtctttttttccctcttggttttctgtcaaaacttattttcttatacggcttgttattttgatagagtgctaatattctgaggctcttcagcatgttaacttcttccagaggtatttatttttgcttctggtaggcagagaggctagaagtcaattattttaatccagttgggaattgagataattctaaactgggcttcacttcttgtgagatatgcttctttagttgaccctttcttcaaacaaaagcttgtgatgtttttcagagcctctccttgctgatagatccttgggtgcaattttatcccttagacctctttacattgctgaaatctctgttcagacttctcagcctttcattcactgctttcaatttgaaatcaacaaataatttgagggaaaagaatcttcacctccactgtctttattgcttgttcaggtcttggtctcaaaatttttctccctgcctaggtatctctgagatgtccagttcctcatgttgttccaaatacgatattttgcccaaacaacctagtcagcctttacctagtgcagtactcatatggggattataaccaaaagagtgacataatagaactttagaatgttgacctgaccaaaaggcccaaagcagcagtaaataaatcaataataataattaaaataactaacatttgttgatttcctatgccctcggtcactgtcctaagtacttttgcatatatagcccatttaatcttaagaataaattaataaattaggtattaataccatttccatttcacatatgaagaaggaagtgcatagagaatttcagaaacttgcctaaagctacacagaagtagagcctagatttgaaccaaggcagttttgctcagagaccatacctctctaaagtagaaggttactataataacataggcatcaaatagcctgggtcacaatgagcatcatagctggggagtcagagaagaacagattgctacaataaatattttgaagaaagatgcaaaaggtgatcaaatggttgcatggcatgaagatgaaggaagtgaaggaaaggtttcaagtacccagtctcaatacctggaaagtgatcgtgcactgatagaaatgtgaaattgagctggagttgatttagatgggttggggaagtattcttacatgaaactttgggatcctcagtgattcacagttcataaagtgtttgctatttcgggtaagccttataatagcctctggaggaaatagcaataagattattattgctaagtgtgaatggagtacagaaaataaatcacttaacatcagcgagctcacgggattgaaaaggatatactttctccccctgccacacactttgtacaaaatcaatattttctgttcactcaagatagacagtttaacttaaatattttaaaatcagtgcctcatgagtgacacaaatttaacttaatcttttcaatgctattattttaaaaatagtttaccattcttgccaattttcaaggtaatgcatgttcattgtaaaaagaaatcagaaaatagagcaaagatgaagaagaaaatgaaaatcaaccatatcccaatactcaaaggtaaccagtatgaacattttggggtatattcttctaatatatttcctatccttatgactacatatattctatgcaattggttttattctgtgtatgctgttttgtggcttgctttttcatatatcatttacacttcccaatttctttaaacatttttgagaacacaatttttaattactgccagagtgtacattcccctatgttggaaaattaatttattccattagggatatattatggttggcccttgaacaacacaggtgtgaacagtgaggtccacttatacatgaattttctttggcctctgtcacccctgagacaagaagaccaacacctcctcttcctcttccttctcaacctactcaatgtgaagacgatgaggatgcagacctttatgatgatccatttacacttaatgaatagtaaatatattttctttcttctttctttttttttttgagagatggagtctcgctatgttgcccaggctggagtgcagtggcatgatctcagctcactgcaacctctgcctcccaggttcaagcgattcttctgcctcagcttcccaagtagctgggactactggcatgcgccacgaagcccagctaacttttgtattttttagtagagatggggtttcactatatgttagccaggctggtctcaaactcctgacctcaggtgatctgcctgcctcagtctcccaaagtgctgggattacaggtatgagccaccacgcctggcctgggattttcttaacattttcttttctccagcttactttatcgtaagaacacagtatatataatacatataacatacaaaacatatgctaattgactatgctattgtttctggtcaacattaggctattagtagctaagtttttggggagttgaaagttacacatggaattctgactatgcacaggttcagtgctcctaagcactcattgttcaagggtcaactgtatttttttttttttttttgacggagttttgctctttttacccagactggagtggtgcaatggcgcgatcttggctcactgcatccttcacctcctgggttcaagcaattctcctgcctcagcctcccaagtagctgggattacagaagcccgccaccacgcccggctaattttttgtatttttagtagagacggggttacaccatgttggccaggatggtctcgatctcttgacctcatgatctgcccgccttggcctcccaaagtcctgggattacaggcttgagccaccgcgcccggccgcgggtcaactgtattttcctggaaaagtagatcaaactggaaaattgctcaaagatgaagacaatgacaacataatcatcactgctcatggcctcagtctctgtattgaaagaagagaactgtttctagccacaccagccataaaggaatcatgccctggaagcaggctttgtgaaagaggagactttgtcatgttcactgctatatccacagtgcccgttttataaagagcttctgaaattgagcagacaaagaccaccaacccaatagataaatggccaaaggatatgaacaaattggttgcagacaaatgcaaatggctcttaaatatatgaaaaaaattttcaaccatacttataattagagaaatgcaattgattaagaaaactgttgcatttctcatcgatcaaactggcaaaaatccaaaagtttgacaatacactctgttagcagagttggaaggaaataggccctgctatacagtgctggtaggaatacaaactgttataacccccatgtatggggatttgtcagaaactaagaaaattacacgtgaatttgccttttcacccagcaattccatgtctagaaatttatccagcaggtacatgtacacaattacagaaagatacttgtgtaggttattcatcggagtattgtttgtaattccaaaagattggaagtaactcaattttgtagcaatagggaaccacttacataaactggcacatccacagagcaaagtactatgcagctgtaaaaaaatatataacaggctgggcgcggtggctcacgcctgtaatcccagcactttgggatgctgaggcaggcagatcacaaggtcaggagtttgagagcagcctggccaacatagtgaaaccctgtctttactaaaaatacaaaaattagttggacatggtggcgtgcgcctgtagtcccagttactcaggaggctgaggcaggagaattgcttgaacccaggaggtggaggttgtggtgagccgaggacatgccactgcactctagcctgggtaacagaacaagactccgtctcaaaaaaaaaaaaaaaaaaaaggtaaaacaaaggtcttttcgtgctgatttggagagattcccaggatacattattaagtgaaaaaaaaaaatgactacaaatgtagggcgtcttcttcttcttcttcttcttgttcttcttcttcctcctcctcctcctcctcttcctcttcttcctcttcttcctcttctttttttttggttacggaggaggcaagatgtcactctgtagttcaggttggagtgcagtgacatgatcatggctcactgcaccttccacatctcaggctcaagtgatcctcccacctcagtcccccaagtagctgggactatcagtgcacgccaccacacccagctaatttttgtactttttgtagagacagggtcttgctgtgttgcccagctggtctcaaactcctaggcccaagggatctgcctgccttggcctcccaaagtgctgtagtacctcttcttttaaacaaatcttaaaattggaaatgaacacatgaacataaccatacatcaaatatataccatacccctacagaggaaggattatgtcacatgatcctagggcacacttctttgactcaccctccttagcgggatatattctaaagaggagaagaacttcaaataaatttgaaacttcaacttggtcattttatttttgtagaagtgctgtactgttactttgaaacatttctttctattgtatgacaaagcatataaatacgttaataatgttaggattcaaaattttcagtataaaagaaaagggatacaatgataaaaatcaaataaattacacaaaagagtatagtattagatttaaattttaaatatcaaaaagtactcatgattttaaaaatagatatggtatagctctgtttattgaaatggaccggtagcaacaatatcacagaagcaatgcataccccctatccccacctgagaaaaaattattggtaaaataagaattaaaatattattttaaatttattataaatcagcaaacattatacttgatgataaaagactcagggcttactgtgtgcccataattgctcattgatgtaagtgtaccagctgactggtgtctccattctgactgggcagggcccttgtctagtttttacattctttaaaaatatcccagaagacattattaaaataaagaagtggatagcattcaccgttttgtaaataataaccaatttattaggcaaagaaataaaacaagtataaatattataaggaaatcatcattacttaataggtgatttggcttaacacctaataaagagggggagagagaaacaacgtaaaattgtagttgataatagcagtagaatgccagttctccccaaatttgtgtataaacttaatgcaatctcaaacaaaattacagaagggtttttctttccccaggggaacatttcaagtagctgggactacaggcacacacccctacacccagctaattttttattttgttttttagtctcaatacattgcctgagctggtctcgaactcctggtgtcaagcaatcctcctgtcttggccttctaaagtgctcggtcacgggcatgagccactgtgtccatcctgtttctgaaagagacagcccaggtcccactgagagaccacagacggcaggaagcgatggggagggagggcaaagaggcgccagtaggtggcgttgtgcattttcccaaccctgacacttgcccctgggaacttagaccctcggccttggagcccaggttaaggacaggaagacaggagagttattcctttcctcacacccactccaaggcgccacttcagacctgagtaaaagggttgaggcgggaaacctgacagcggcgtgtccgcgcatcctcccacagggcctctgcgaccgctgaaattggggctgaagagaccccgggattttctggagcatgttggacaactgcccggttccacagggcccttagaatgttaggccttgactcccccagcttctcagatccaggagtttgtttgcttattaaactgtgctaaaatacacataacataaaactcaacatcttaaccactgaaaaatgtacagctcagtagtgttaagaatattcacattgttgtgcaaccaatctttttcatcttgcaaaactgaaatgccacatcccttaaacagcagctccccgtgctccccttcctccagcccctggtgaccaccagtctacttccatgtctatgactattctgtgtgcctcacgtgagtggagtcatacagcattcgcctttctgtggctggcttatttcttagcataatggcctcaagtttgcagcatgggtcaggggtgcctgtcatttaactcttcttcttcctgactgtgaactagttgtgggaccatgcattctgtttctctttttcttaaattgtcctcaggaaaattaaaatgctgggaaaagtcaaaaggaaaatgaaaacttatattgaaatgctttttgactcaggtagaagtcgaagtgagggaccctgaaggttttctcccaaattaggaagccgtcaggatgaatagatggtaaatatagaaacggtgactcaaatagaagagtgacatcagaatggaaaacttccaaagaaagcatgaaaagaattaggatgtttacatagaactaatttgttggggaataacacacaagcaaagacgaagacaaagacaaacttttgtgcaatcttggggaagagtgagagtgaacactcatcagtgtcccttggctttctgattgctccttttggaggtgcacaacctggtctttgggcaactttagcatctcccttcatttctacagcttccatcaagaagtcaggcctaccctcattaactcacagttgcctttgtaattaaactcaggcacgtgctcattcactcactactcttttgcatcaaaattccttataggatacatggattttattaagtaatctttttattcacagtatctggcttggagtcagcagtattcattcaatgaatgaatgaactcacttttatgaggagaaccacctcaactaaagacaagcatttaaaaatttatactctgaattcaactttcactcaattctactatcatctcccctaatgtgccctttattcatatggcaatagtggagtggtgccatatgtggactctatcacgtggcctgaattgaagttcattacacacttagtagccatatgcctttaatctctgtaccttatgctactcatctgtgaagtgggggtattaatcgcacctactttgctttgggcagcatttccagtggtggtcttccactcacatctctagggttagcaactgcttccactgtcagttgctaatctctgggttactccaccacgacatcgtgcatgacttttcagctcttccgtggctcttgtaactaattccccatatcagattccccgtttttcttaactgatagagctattattactatcatttatcattacctttggagtctcataatcactttccaaagactcctactttctcccccacaaaaatctcctatttctgtactcataagtacagttgtctgttggcagaaaaatattctttgatgttttgctgcatgtttggggacatgtggaaaagctcctgagtgacctgccattgttttctcccttcctgaactcccaggaagactgcctcatcacctgaaattttgtttgttttgatgtcagggctaaaatgtgctcaaaaaagactgctgcccctttttggccacgtccaggccaggcttatggtcaccgtgtgctcccagacccccaccactttggcagggaagccttaagactctgacctcactgctcacagtcactctgcttccactcactcagtgtgagataagagaagattcaagtaccgtcatgtatcactgaaccatgggtatatgttctgagaaatgtgacattcggcaattttgccattgtgtgaaggtcatagaatgtattcacacaaactcacatagtatagcctactacacacccagtggtccccaatctttttggcaccggagaccagtttcatgagggtggggatggggaaggttttggcatgaaaccgttcaacctcagatcatcaggcattagattctcataaggagtgtgcaacctagatttctggcatgcacagttcacgaaggatttgtgcccctgtgagaatcaaatgccgttgctgatctgacaggaagtggagctcaggtggtaatgattgctcacctgccactcatctcctgctgtggggcccggttcctaaaaggctagggaccagtactgttcccaaaaggccagagaccatggcatgttactgtattgaataatgtaggcagttgtaacactgtggtaagtatttgtgtatctaaacgtagaaaatactacacatagtatttgtgtatctaaacattgtgtacagtaaaaataggatatgaaggattaaaaaatggtgcacctgtatagggcatttaccatgaatggagcttgcaggactggaagttgctctggatgagtcagtgagtgagtgattagtgaatgtgaaagcctaagacattactacacactactatagccttcataaacactgtacacttaggctacactacatttattaaaaatatttttctttaataataaagtaaccttagcttactgtaacttttttactttataattttttttaattttgactcatacattagcccatacattatacatacattacattagcctaggcctacacagggtcaggatcatcaatatcactatcttccatctccacatcttgtcccactggaagttcttcaggggcaataacaggcaggagctgtcatctcctatgataacaatgccttcttctggatacctcctgaaagacctgcctgaggcatttttacagttaacctttttttaatatatataagtaaaggagtacactctaaaataatgataaaaagtatagtataaatacataaagcagtgacttcgttgttttttattactgtaaagtatcatgtgctgtacataattgtatgtactttacttttatgtgattggcagtgcagtaggtttgtttacaccaacatcaccacaaacacatcagtaatgtgttgcactacaacattatgactgctatgacatcactaggtgataggaattttttagttccattataatcttaaggaaccaccatctgtgtggtccatcattgactgaaacattgttatgtggctcatgactgtgactgtatgtcctttcctctagcaggctctcctccccttgctcctctgcttcaccctgtcctgtggtgtgaagtggtcaccttggattcaggactgggagagtggcagggccagccctagagtgagcccggagaggtgccctcctcccaggggtgtgcaatgcaggggtagcttcagagggagcagctccttgcattttacataataggctcttctcttgcctcacaccagtccctcccccagtccctccccagtagactggccttttccaccgaaatgacaacaaaaaacctggaatgtcagggttggagaatgcctttaagtcatgtgacgccagtttctctaagtgtggtccatggagcacctacaggagacttagcagagtctaaactgcagattcctgggcccaggcccagacctacagattgagaatctttgggaggtggtacaggaatctgcatttcaataaagaatctctggcacttcttataaatcagcagctgagaacttctactgctaggtgcttgcttacaatacagacacacaacagcctcacaaagcagcctgcttcaggtctaagaaggccactgttacaaagtttatgacatggggcacaattcagccttcttgtaacttcattctatctcagatctggccgtctgcaatgactcggaatcaatttaatcccttttctacgtggcagtcctgaagtccatagggcacctctcattacctcagcccactttgagtaccttcacactctttcctaagcagccgctgttcggtccaccctttctcgtgtgccaccaacatgcagggagggcaaggggtgagaaggggctcgcaccagaactaagtccctaggtttagtgcctaagggactgaaatgaaatgtttcccgcgggaattcctaactccaaggggtcggccatgtttccacagctcccagggtcgctctgctgcccccctgcgggcctggggaacactgcaggggtatgagccggcggtggggctgctctccccacacgtgggagtgggaaatggagagaacccgccccttagaggaaaagccacgagttgctgttgtgctgcaggagagaaagggagaaagaaagcgtgcgacagggagtgggagccccaagtcaagaggagccccacagaggcagccctggacttcgggaccacagaggtgctgagtgctgcccgattctggatcccactctgcttagctcaggtgagtccggcaaccctgggcagcctgtgaagttggagagacagtcctagcagagggtttcttgaaatcattcttaggaagatgccaatgtgctgattatgcttcctggaaagaaaatgactacattgtggaagtgcttttcttaattgtgtggagggaacgaaaacaatcttcactgagtctaagggagatgggttttctggagaagagaacaatcgtaaaggaataattaactgcagggcgaaggcaagttgtgtgggactcttagaaacaacctaccggctgcaggacagcgagtggggaccacaggcatcacctccatgtcttacctattggggctgtgagcaagtggctttgacttggtcattttaaaggggtggtagagctcaaaggaagtgcatttttcatttcctaggagccaaacaatgaaggcatcctagggaggttgtggaatgactctgagacacagtaggtatgcgataacctccactgaattcatgcattcgggcatggttaggagagaaaacagcacaggttacacagagagctacagataagaaaggactgtgtcctgagcacccgaaatgtttgttgaaaatattcaacaatactagttaacatctgctttgaaggaacaggtatggggatggttaatgtctaatattcaatgttattcaaaaccaagagtgagttggtcctcacagctgatttaggaataaatagtttaatttaccaagccaatcagtaaaaacacaatcatatatatatatgtgtgtgtgtctacacatacacacatatatatacatatatatatgtttactgttgattcatgacacaactcagaggttaacaaaagtagaattttacaaatttgaactctaaaactgggaatgttagacagacatagaaagtttctcagacctagtcctattgacattttggagcagataagtgttgttggggactgccctgctccttggaggatgtttttcagtatctctggtctctttatcgacagccctgctccagccatgactattaaaaatgtctccacatattgccaaatgtgccttggggatcagatcacctctggttgagaaccactgagatatatcaattggactgaaaattgaaaatgcattgagcatatcatttggcaattattattgattaattcccatcgtgccctttattatcactcagctgctaggagaggaagcagcaggggctattatcactgcccttctaggtgcagaggcaggtgtgagacacacagtcctatcacagcatgcccaaggatagacttgtaagtcactgtttgttcacactggagagaaggcactgcccggcctgttaccccaatctcttcctgtttcagatttctaacaaataagaaaactttctatcaaataagaaaaaatgtacgttttcttagtagaagatatagaaggtatagaaattgactaaaatctgtgtcattacagattttagtcaatcatttaatggattgcattgacatgaatccatcattagtatgtatttgctctattgggcatctcttgctgttgagggaccctcttttggaagagctgccgcttcaaagggctccaaggaacgtgcagttttttgtgagttgttcaagtccccaccataatagtgaataggtcttttgtagtgtatttgaatctgcaaattcacacagtgaattctgtgaatcaaaaagcagattcactgctattttctcaaattgcagctttctttgtgggcttcctctgaattgaaataaatccatatcttgggtcataaaaaccaaatcacaagggggaacatacaactgggaaataagcctagaaagaattggcaaaatatcactggcaatcaaaaatgtaaattaaaataattaatttccacttttgcctatgagagtaataaaaatgcattagtctttcagccacccagtgctggttaggtgtggtgaaactgccactctcatattgctggtggcactggaaatggatacagctcatttataagtcaattttacctcaaatccaaaaagttgcttatgctttttaattacataactattccaagagatctacgtgtgcatgaaacaaagcacttttcatggagagaaatgtctcttaggattacttgagtgaaaagtaaatatccaacaagaagatatagagaaatatagtttgatatagcgtactctgtgaaatataattcagctgtgaaaatgagagttctgaagaccaaatggtaacagaaagaatgcttatgtcaaaatgtgatgtgttcacttaatgtgcctgattattgcaaccatgtaaaatgtgtgtacatgcacatatgcatatgtatatatgcatatacttaaaagctccaaaatactaacagttgggctggaagttctgcagttgtttataatgactaatgattttcttttctccttgatctaatttttctgtgaattcgcttttgtaatttttaaagaaagtattccaaaagagaaaaatcttgcctaccaccatcacatcatctctcttctttttgtgtctgctccctggtggacttactccttttctgcttatctatctcctacatgctactttttaaaaatctctggacttttggaaagcaaactacttttcatttcaaataatacttcttgaattttaagaggttttaaaaagaagtttaaaattataatggtaaaacctgctaatgggggaaaaggcaaggcaatatttgggtataaagtggaaatgaaaatactacccacgcctgcctgcggcacattcctccctacccctaccccagccccagtggccccatatccctgtacctgccttcatagggaacagttattcacagtggtttagtgtttatgctgctgatctttttctatgtgtttacgtagatctacagacattattacatgcacgaggtcatatgatgtgtgtgtgtgtgtgtttaacattttattccttgtaagggaagttgaacacaatatgcaaagtttgtcggccagcatttgagactgtacctgggaattctgtcttccctttcgggctggatgccaaagctgagttctactgccactgctacctgtctcttagggaacattctttaaggcgtgacagaattcacagcacatcattctttttttagttctcatccatcttgccagtttatgaaaataacaagcttgaaagaataagagtctcctcatttataaaatggatctaatacctgcgacttgtgttggtgtgttctattggctgccacctcttgtggtctgatattatcaataaagatatcactgtttttcaaattgatgtttctaccttatttgcagttagtggctaaagggatcagccaatttaggacatttgcattaaaaaatgtatatgcagctctattactttttgtggtgaaacattgttcttcaggattcacaggagattaaagcgtgacctcttaccccagggaatggcccaaggtagaaatgtcttgttataatgtgacacagacccatctcgttagtttctgcaaagctgctgtggatttgaagactggaatgtcttagtttgtaggcgctgatagaaaccgttcaacacatttcaaaggaagtttgtaaatcagtggcgactccaccaggcaagtgtaaagagatggctcttgtgtctcctccctctgttctatcccttctgtgatccaggagaaaaatgctgtggttcgtggctggaagatgtgaagtacacactctccctgttatgtgaagtgcaccctctgttttccctaagaagggtgaggaaaggaaccgaccttccgggcctttaggagccgtgatgggccatggcccctttagataactgggcttatcactggatccaggagggttgtttttccaggcagggttttaagtggcttagcttctgtgacacccgtgtggcaatcaacctcatgaagtgtggacatcaacaataaatctgtaattcatacagtagccatttgtccatggcttggggcctacttgttatgtaacaaacggatgtgcacctggcaaaccccattgggccagagaactggtctcatttcaccttgatcggtagaatcccgagtcaaaggatgtggaaggaggctgtggtttcctcagggctgtggtgttcctgattttctgtgtataaggacatcacagccacagtttttgcaagaacattgtgggggaaaatggagccttgtgaagagacatttgaatagtagttcatagaattattcattaaacattactgaagacctactgcatgccagggagacagactcatgcgcatcccccacaattgcttccaggagaacagtgggcagggagcctgcgtcaggaggcagaaacagcagagggacccctggaatccaaagcgctgcctttgggattcccagggattggggggtcagaaaaccttgggtgctcagccctgccactctgtgtcccatcatctcactgcagtcaaaactgtcaaagtccgttctggttaacagagagtaggcacctcaagtttggcagattttaagacacctggattccaatctggctgtgtgatcttgggcaagtccttcacttttctgaccctcagtttcttcatctgtaaaatggggataagaatctttgcctggttaaataggatcaagcatgacaggactgaccagggaggcaccgtgacctccttgcttaatccctgactcactttgggaagcctctcctttccaggtttcttcccctttattgctctggggtgaagtggagagattgtgggctttgaaggcacaaagtccaggtttcagatagagtctcggaggcctcatttcaaaccccagttctaccacttactagctgggtgactttgagcaaacaaattgatctgaatcttggttttctctgtaaaatggggcatacgaactgaggagactaaattaggtaacatgtggaagaccttggcagggcgctggtgatatgcctctggttggggactgactatctctggtcacactgcttcctgccataaaggtcctgttgacataaagccaagttttgagcatgacatgtcctagaaggacagtgatgggaaataagaaccccgagtctcagcccaaccaccgtgcttgtgtgctagcagtggatcagctgcagagagaagctgcgggctgcatggctcctgcctgcaggcccatgctgacgctggcggtggagtgacttgcctgctatgagccacagctctggtcaaagcaagctctccttctgtcatcatgaccatctctgtcctcagaccacaaatcttccccatcacggcctgttccccctgccctaagccctagttcacccaggagggcctgcaggtagtgctgctaaaatgctgtggtcccttggtttgcaaacccctgcagtatgaggaacaaggaccttgttaaatcgtgcttttaaatggagccgcggctactctggacaggttcctggggagacttttgtatgaagtaaggatgcctgccccagatcccgcctggatcagccagcccccatggaggccttactcccaagcaatgacgtggtgggaagtggtggaactacgcacacccagcctcaggaacaaagtgactcccttcctctcctagtgtctttacggggctacctcatttcaccgggcaggaaaatttgccgtcttgatgagctggagtttttttgtggatttaaaatgtatatggctgtttcttccaaggaagggaagccctttctcacagtgtcaaccaacttgctcagaccacagcaggtccacaggggagccggggtggtgctccaggccgctcgggtctccacccaggctgctctggtcaagtccatggttcctcttccgcttggaccctggggagtgcagcagctgcgtcaggaagtgagggcgcccttgctctgtacctggagccatacctggatcaagtttgggttctgccagttgccagctctggccttagggtgaatcttaagctctcagggtctctaaggcgccatctgtaaaacagagtcagtaacacttcccagataggattgttgtgggattaaatatgagatgacctatttaaagagttaacacaacgcctggctgcagccattgctcagcaagtgagagctgttaccatctccccctccaggcctgtgtcttcctggctggtatcactgggcaagcctcttaacctctctgagcttggttctctcatttgtggaatagggggtctttttctcagccccgctaaccactaacaaggccacacctgacactggcacccaggccacccgggctgactgagaccaccctgcaggccaccactgacatgcacagagagggttggttattggtgctgagtaaatccttccaccatcctttctaatgaattatttttgatcctcagaactttgtcagcgagcaagaacaatgccaggaggtctggagaaaacgtgtcatcagtgcatttctaaaatcgccagcaatggtgagtcacaactctgagaaatgccctggttttgtaggattgagacctctgggatcacccgatgagctaaagctggagtggatcatatgagtgggctgtgcttggtatggggtggccccagggtggtagagctggggaagacagtgtccggccctcggttggctgctttctccttccattccttaccaattcatctttagttttccatagttcactgtatgtgttttccatgtaatatgtgtttgaaaaatatgcatgtgaacggagtcactgctacaatcagtgtatgatggcagccgtgctgggcaacacggcagggcaatgtgacaccttggacctgggtagctttcccttactcctacctcaacctgtctccttactaaattggatattcccccactatcacctgctggggtcctttctgtccagaggggctggaccatattacagaagacccagtctgtcttgtgtttggaatatcccaaaatcagatcccaggccttgggggtccctgggatgaaagcttttacatcatggtgagatgtatggtctaacttttacagatgaaatgtggataaagggaacattgtgggaagccttaagcaactcatctccaggcactaatatcaggaagctgcagtcagtgggtagtggcggactaaggtggagggtcagcagaacaaggggctgacagatgggtgcctgggcacctttccttacctgtacttaccatgtcctagcacacactgtccacctcccacttctcctcccatgacgtttcctgcactgctgcatgccagcacctccagcagtgcctgacacacagtaggagctcaataaataggcactggctgactaagcaggtaaatgagtgaagagccacctcccagatacaactgaccttctccattcgctgatgggcccagtgcccatctcattctcctaacgcacagccctgacattttactcccagggacagctctaagggccaccctcctttcatccctggagcacacctactgctgtgagggccagagtgggacagtggtgctggagtctctgcccagggcctctgatgctctggcaggatgaaaactcataggtttactgccggcagggaaaggagacaccatcagctatattgttgctctacatcttcgggaaattagttaccaccacctcccccaacacacatcctacctgtttatgcaacagaagtgctgatggcaacaccaggttggcaagagaggaagtatcatgctcagggtttcccagaaaaagggatgtttcctggctgcactgtaaatctgcaggtcaaggtctaggccaaccttggcctaatgatggcctccttgattgttgagatttctgcccttgttgtatgaataactccgtcttcagccagcacaatggcaaggcctcctaagtgttcttgctgcctcttgcccatcccctcagcacctcctctggggaggtccttcactgcacagtgactccccattcctgcagaataaaacagaagcgtttgctctcttgtgaaaccctttgtgattgagtccccgtttacctcttgaatcactctttcttcttcccttctcactctggaaaatccagccagacaaaaacattttaggtttcctaggaacaccagcttctgttttccccctgggccttccaacatgtgtttctttgcctagacttctacttcctcccacctgccccctcagataaaggttggatcaggcaagaatcatcaatagacactaaatctaagaggaaattttgatgacaagcagtacttggttgcaagggaggaataaaatagtaatcatacagtggagaaagtgggccacactttggggtttaaagtgaacattaccagtgagggacaggtggccgtcacctatgcagtaatccagccaagaatgcacagcctttgtccaaacacaagggaacatctgtcaaatacaaggtgaagaatgttctactaaaaaacagcagagaggactgtattcttcaaaaatgtcaacatcctagaaaacaaaacaaaaagggctgatgagaatgttctagatttgagggaggtctcttaatccactttgtgctgctataacagaataccacagactaggtagtttataacaaacagaaacttgttggcttatcattctggaagctgtgaagtccaagaatgagaggccggcagctggggagggccttcttgtgtcatcccatggaggaaggcagcacgtgggggagagaaaaagggctgaactcccccttttataatgaacccactccagtgatgacatgaactcatttactctgctcccagggcctgatcacctctcatttaagctccacttcccaacacgtttgcattggggattgagtttccaacacatgaactttgggggacacattcaaaccatagcaggcagaggagacatgacaacaaatgcaatacttcagcctagactggacccaaaggctttattaggtcatcaacattggaatatggatggcagattaaaatattgtatcaatgtaaatttaagaagctgcgactgtactaaggtactatattaataagagaatatccccaggaaatgcacactgggattatttccaactaaaaaatttaaaaacttaaaaagcatgcagagggaaacctgagtggcaagtatctgaatgtttgctctattactctttgtatttgtttgaatgtttgagaattttcataattaatatgtcttttagaatttaggctgggaaaaattggcctccttggcctgatcccagacctgataaaatagtacatagatgcaaatgcatatactgtagtgttttcctttcaaatgacttctaaatttacttctttctggttttctacattttccacatttcctataaagctacatatttatgtaattagaaaataaaagttttggccgggtgcagtggctcacgcctgtaatcccagcactttgggagaccgaggcgagcagatcacgacgtcaagagatcgagaccatcctgcaacatggtgaaaccccgtctctagcaaaaatacaaaaaaaattagctgggtgtggtggtgcacgactgtattcccagctactcgggaggctggggcaggagaatcgcttgaacccggtaggtggaggttgcagtgagccgagattgcaccactgcacactctagcctggtgacagagtgagactccgtctcaaaaaaaaaaaaagaaagaaaataaaagttttatttttattttatgttttaagaacaatcttcagatatcccccttagattggttggtgctgtccctatccacatgtggagctgctaagtggtggcggcctcagaggagtagcttgtttatctgggcgttcatccagggagtagggtggtctccgtgctctcagatcccagcaagccacttgggggagctttctggagctctcctgggccactgtgcagccctggctcccagcctccccatctggcactctctctgtcaagctctctgctgcagaacatttgcttccctgcagcctgctgccaccctggaggatcgctttcatccctgggcagcagtgaaatcttgatgaatacatgtgcagcgtgtgcagggctctagccctcataggataactcaatgaaacggacaagtgcagtgaacccaggctgttgcacctgtcagggggtcctgggaagtccccttcaactccacttggagacagcagcagagaagggcccagcaaagtccatgttcaagggggacaccaggagaaagaccttctgctcaggcctgggtgaaggaaccgtgactctaggtggtgtttgcagcccctcagctgtgagagaaatttacacaactcaacatactaaacagagagtggtagattttattctacaattctggccaggagaaatagcacattaatttatttttaatgtacttttaaaacttcaaaacttcttcctctttaataaaattaatttgactctgagctcctacttgccagagtaccaggaacatcaaccctgggctttgtgggtcacacgagaattcaagtatgggagttggagaggaggaatcacgttttcctcttttgggggtctggggcagggtgtgctcctgctctgtggtaagccattatttcctctacacaccctttgtgcaatgtttaaaaggtggcccccggcagtggtagcttccaggacacagtttagtagtagacggtgcttttattggaagaaaagtgcgcccctcttccaagcgagaggatttccaaccttcactcagccctgtagcctcacacaggccctctcttctctgcacaaactgcacagcagcacgctctgtccttgctatcaggtcagcaccggtgtcaagcttgagatgtcggggtctttacgagcctggggacctggtgccgcctccctaggtgcttctagtagcaattccttttggacactgcagggaaggggccaccaacccaaggttccaccctcagcagccccctcttcattgctcctcctctttgggggactcccctgcatccctttttattgggacaatcccatagaattgctcttggtgggcttcaagaagcacaaggttgccctctcttttcagggatcagagaaagagatggcaacatcagtattgtggaagggtccaatatttcttactaactcgtcctgttacatgaacaactgaaaatctcaaaagcaggcagtggaggtggttttagaaacccatactccagttcattcccctggcacattaaatgcagtgaattctgaaccgaatacatcctttccctaaagcccctcctctttctgtccctcacatttccgtcagtgcctccaccattcttgtcacccgagcactgcacttcagtcattctttactcctttcttcccttcattcccacacctaatgggtgctcaaggcgctgctggagcctcacaattgctctccaggctgagttatgaaacagccacttcgctggtctcttcactccgagagccaccccctttagtcctcattttctccaaaggttcagctttgattattatttgatgatattattgatgattatttgatagctgctttccaattgcaaaccctacaactctctttatcttcctaataaaatccagatacccttatgcaaaacagaaatgccctctcttctgactatctagtttccatctgatctccttttctctgttatgatggatgatggacgctcagctccatttcatgatttgccactcccccaaaccactctgagtgtctctgtctctcaaatcttttgtttcctctgggcttttttcctttgacagaaaagccatctccccacaactcagcccgtcaaaaatcctacccatccatcaacacccagtaccaatatcacctcctccttgaggccttccttgatttcctggggactctttcctcctccaggcttcctcactgcattgtgcgctgcccctgctggtcccttccacacactgatttgtactgtcccttgggtgcacatctcatctcccttaagaggtggtgaagtccgcattgccgaggcttctcatgctcactttgcatctacccaaaccttggtcgaatgcaagaatgaatagctgaatatctataaagaagttcatctatattcaaaggggattaagtgctaataaaaataccccctcatgcaaattgctattggctgtgacctctggggattagtgggtggctgtggcaatgcagggtgcttgtgcagggctggagaagaggggtgggtggaaacgaggcagaggcagaatgactgaacataccaggagagggcagaagtggtttgggtgactggggtttgggcaccattacagatacagggaggtggaaagggcagtttggaaagaggagtttagtttgagtttctcttcctgcactctttgccagttgccttctgggtatttgatagctcagtggagccccgaaggatggtgttgcagagaaaaactgctgggtcccagtctcagtttctgcactaaactaagcaaaagatctggggatatattaatacttgctattcataggaaacagactccggagatccttgagaacagaccaaaagctacccacttttcctatcaagattacccatttaaaaatgcattgaattctcccagctacctattttgactgataaccggatggcagcgtatctttaacacctgctaccatgctgctccctctgacaatcacgggcagcagcaatcagcagtcgtgagagcagcccaccctgaaatgcactgcaagaggggagtgaggatccagagccagcaacccaaaagccaccctgaggagggcacccttcccaatagtctgtcttttcccaaccttcagtaagtcaggaatcagcctatctgtgttcttagcataaagaatgacttgactccaacgttttgattctaatatcctcccactattgctctaattttgaattattttctcctttggaccctcaagctgagtttattttcacccagctctttcaaactgactttctagatggagactctcatggcatcagaagccagaatgtggcactctgagttgcattggaattggtgctcaatagaccagaaggcaggacagtattaactagtggtggtcactgctgtcaagccgctgcaatcgcaacagcggcatcaccaggaagctcagcctctgttccagagagctccaaagactgaggagtgggtaaccagatgccccaggaggcagggggatcaggcgagagtggggctccccaattcctgactgtggcttgggtgtccttattaggaccaagtggtaaagaaggcctcgtgctggtaactgctgatgatttccatcccagtggatcctacaacctagcccaaccccagcacctcacaccatgctgagcagacagctgtaggaagcccctgaagattctctagccagcttacagaaacaggctacgatcacctgagagttgcttttattttattttatttagatgaggtcttgcactgttgcccaggctggagtgcagaggcgggattatggttcactacagacttgaactcctgggttcaagcgatccttccatctcagccagcctccccagtagctgggaccacaggtgcaccaccacgcctggctaatttttgtgttttttgtagagacggggttttgccatgttgcccaggtgggtttcaaacttctgggctcaagagatccacctgcttcagccttccaaaatgccggaaatacaggtgtgagcaaccatgccagggtggaagttgcttttaaatgcagatttccaggcgccatttgtactgatcctggtttgtgagatctagagcggccattgagaccctgagagtcatggctctgaggtgcagcgagcaagagtgagcctcattagacttcgagcaagagtgagcctcattagactttaagcaagagtgagcctcattcgacctcgagcaagagtgagcctcattagacctcgagcaagagtgagcctcattagatctcaagcaagagtgagcctctttagacctagagtggtgatccagagaagcggactcactggatgaagccagggcacagcctgagaacagggccagggagtaaggccgcatccacttgggagttaaggtgtagaacagtctcatctctgctcagacaccatgagaaccacagtgtatacctcacctgttgttttctcgattcttcatttgattccgaagtgggggctgaaataaaggggaagcctgggtctccttccatcaggaatggaaaataataatagtaatgataatggccagcatttatcggtgtttattatgtgccagaccctgcgtttagtgccctacacagattatgcagattatgacatttgatgattttgacaagtctgttaggaaagtcttgtaatcgtgcccatgtttgcaatgaggacattgaaacctcagaggttaagagtcctgcagtccatgctgcaggtaatgaggagcggagtgggctgtgactcaggtggcttggttgcatggctgcaggtggtgagtctttacagcctcctccaggtagtcattaagaatgttctggccctggccatctctctcagccctgctgggaggtagtgaagaggaggtaacattttacctctccactcttagggcttttcagctgggcctgagaattaaactcacataagacagattaacaggagaaaagcacactaatttagtgcaagttttacatgacacaagagccttcataagaagtggaaacccaaagaaatagcaaaacccaaatgcttttgtacgtggctgaacaaagagaggtaattgcagaaaaggaaccaaactgtgtggggaggctaagggaagataagagtgattttgacaagatctgtttgtacagaattctcttggtctcaatgtcccatccttgatgataagaatggtgctttcctttggtatagggaggacatcctctatgtggggcttttgtttcccacttttaagaaggaaaaggggagggtcagagtacccttcttccatctgctattttttaagtgcctttagctccaaataacccttatgccacagctgcagagtttggggtggcatattctgccacccttcagtaggaagcttgggtggcaggtgcctccttggggactgctccatttctttgtgtcactcactgcctggattatatatgtggccaggtggcaccatctgcctcaagcttgcagcacagggaaggatttttcaggatgccgatcactttttttcatccttgtaacaagctccaaggtcaaaaatgcagaataggattcatcgaccccttgaatttctatcctttgccagcaagaaatttcttccttgaccgccactctaagttgagaattaaaacaaatgtggctagattaactgaaattctctctaattcaccacacctgccagcagcactgtgtcactcatgaccagcagggccccggagcaaaacaaaaatgcaaagcaccttgttcaaaaagcaggaaagaagcactgttcaagggactaaaatataaaaagctttttcctttcttctgcagtctctcttttggcctttttatttgctgtttaatatcatttttaagtaggggaaatcaaaatgtgtaattattagtatatattttaccgttcatcttaatattgcataatgtcagttttaaatgcaactctaagagcatttaactcatatgttgagtcactgaaatgacacaacttgtgtttaatagctctcatacacattttgtttttatcggaacattggaaacattgtacaaaactaacaagtcttcattttgcttcttgatatgggtgtattctacccacattctccaccttctgctcacagataggtgaggaagttgtgagaggacaaggtatactaatttaggggtcagaaaggggttggtggagttccttcgttgttcctgtttcttagaacatcattgccttctgtctgcatctgaagcaagttctggttcaaatggaagtaaatcttttcaggactgtcagccccctgcttactcagttgaagacacaacacgctttcctcatattggccctgagtcttgcggagtaaatgtgaatattggcggtaaagggcagcagacatgagcatttcacaggctccctctgctcacacatattcctcactgtcctgtccaacttcacttacaatacacgatttcgagagaaatttatttagaatttcaagatggcaacagaagagcgtcaaaccagatgcttggggccgttaagttgcacgcctttgaagctggctctggtgatagcattatatacaactcaggggtggtctgaggggaggagtggaaattggggcaaatcactctgcatgcctgcccccatcaacatttcctggaggtgaaggtcaaggtgggcatggagggcaacttctcgggtctctttgagagaggggcagcaccctgccctgtgcaccctacccgctgtgggtagcaagatcagagctggcgtttggtggtgtgcacgtgaggctcccagccagaggcacttgcagccttagagctcttctctagagaagacagattcccagataaatcctagatctttgacaattcaaaaccacaaaggaccttgcagattaagccaggtacagtgggctctgtataaatacagaaagcccaactcaagctggctaaagtaataaaggggatttattggctcctataaatggcaagtccagaagtagtttagcatcaagggtggtgtgattccatgggtgatgaatgtctctgaggacccagtttctttttacctcttctcttgcctctcagggcgttgttctcattcgcaggctggcttcccctcatgatggcaagaaggctgccagccacccccagagtaattcaattcctcaccagtggccagggagggagaaaccttgtttctggaagttctgtcagcagagcgagaaagctttttcctgactctcagtaaatctcccaatataagtcatgagcccatccactaataacgtatctggtaagtggggctctgctggttaattgagggtgaaacttcatgcccttttctatggccagggtgggatcagcttctgccagagcacataaacggcacagcagaatggggaggtagggaggtgggggtacccgaaaataattaaggtgatgacctagagaggaaggagtagatgctacagaagctaccatgaggttcactcagagatcctctgctctcagcatgacaacaggactcagcagaaagcacagatgtgtgatgctgtcaagactctgacagtgggaactggggggcaggcctacccaagaggcattcaaattcacactttcaaaaaaaaatgctggccaagcaaaacctatatctgcagatatatctgccgatctggagaacagatgaggaaaccaagaagcaaagcagggaagtaattgcctaatcacaaaagttgccataccctgaggtccttgtgcatacatctgtcaccaccttttacagaagaggaaaacggcttccggatgtcaacgaatttgcccaaagccacatggccagtgagtgacagggccaggatttggacccaagcctgtgtagcccccattcctctgttctttcccaatgtctaaaagttggattggtggcattaacagaaagaaaaaccccaagccagttcaaagctctattatactgtgtgtcagcaagaagttttaggagcccatctaatgtcatgggctgtggaatatataaccaagtgaatggaaagggaagaagattttgtgaagcaaatactttcagtgataaagtgagttgtcagtgaattttatccagggaagagaagaaccatctgccctgagtacaggcacccaggaagcacagggtgaatcctgcctggctcagtggatgccggcagcttctggcatcctggcacgggcacagtggcagtttataaactccttttccataagctgtcagacttggagaggtcctgcaggatatctgggccttggcatcggcaaagtgatcacgagagatgttcagctctctgagaagtgcaagtcttggcttgcatccactgtgtgggagccccaggcgagctgcgaccttctcctcctgtctgctgacttgccactggagagaaagtcaggtttcacaggatgcttaagaaactgcagtgaagaggaaatgcaggggtctgtgtgtttctaacccagtgcctgccccttcttctccttgcagcctgcttcgttgttgtgctctgtgctttcctggctctgccgctgtccatgaccttcataggtaagctgccttccgagctgctggacgccacaggtcagccaggttggggcatggacccaaggcatgtaatctttaaacattaaatatgtgtttaagaagaactggccagcccgatgattcccagacacctatgtgccatctcagaatgacttggtgaagatttaaaaaatacacattcctgggccccgccctgggagatatcagtgcagtatatctgggtggggacagacactctcttttagaaatctgtccccagatgattctgatccctccagcccaagtttggaagtgactgggctagaggtttcccaaagtcccttcccagttcctatgttcccttgtggaagcaggttgcaagcaatacaaaaaatgcacctggcgttaggtgatgtatgggcactctatacatttttttttttttttttttgctgaatgaatgagtaaatatttccataaatcacgtatattaaacaacctcataatccagaagtgtgaggtctagcgaaggtcaggggaggggcaggatgggggaagctccttaagtagctaaaaattgttatcacgtgtcagtgaaattaatctcatgctcctgaacattgctaatgggagccctgtgtacaggacctagctacccctatttacctagaagcccagcatggctgggcatggtggctcacgcctgtaatcccagcagttagtggggctgaggcgggccgattgcttgagcccaggagtttgagactagcctgggcaacatagtgagaccttgtctctaccaaaaaatgcaagtcttgacttaaaaattagctgggtgtggttgcgtgtgcctgtagtcccagctactcgggggactgaggtgggatgatcgtgccactatacctccagcctgggcaacaggactgagaccctgtctccaaaaaaaaaaaaaaacacaaaaacaaaaaagaagcagctcagcaggcccagtgttctaggtccaagctcacagcatattggagcagaaagtaaaagagcataggagttgttgcaaaacagcaacaacgaaacacccagtaccctaattgcttaatgggtaggagccttccttttgaggtgatgaaaatgttttcgaactagatggaggtggtagttgcacaacactgtgaatccactaaatgccactgaattattcactttagaatggtttcttttgttatgtaagtttcaccctgccacccctgctaaagccacaatactaaaaatggaaacaaaaacagtatccttagatctgtaagacatgaaagctaacagcctgacaggaaataaaaaagaagataagattttaaggtttgcagagaactgaaacagccaagtagtctggggccatttagtgtaagagtgaacaattcaatcacttcagcaggccctggtgctgtgattattacagtgcaattcaaaaattaacacttattatatggctctgttcttccaagaagagttcacaagatgttaggcatgccctgcttatgaagtcgggggtactctccagagggcattctatgcaaaatctgtaaggtaagagaaccctagcctttggaccctgtggttagttacctttctttttgctttcttttgagacagggtctcactctgtcgcccaggccggagtgcagtggagcgatctcggctcaccgcaccctctgcctacccggctcaagtgattcttgtgcctcagcctccttagtagctgggattacaggcgcccaccaccatgcctggctaatttatatatttttagtagagacagggtttcaccacgttggccaggctggtcttgaactcctgacctcaagtgatctgcccgcctcggcctcccaaagcgctgggatgacaggcatgagccaccgcgcccagccagttatctttcaaatgaacttaactgcaacaattcatccaccaataaggctgcataaaagagacaagaccccacaagccaattcccatggatattatattaaaatcaccacatccactgcggaaagagggttttggaggtgttattgcttctagagcaatattggttatagagtttgtgtttggggtgatgaaaacattttggaaatagatagtggtgatggttgcacaagatgatgcatgtaattatgccgatgaattgtacacttaaatatggttaaaatggcaatttttgttgagatattttatcacaataacaaatattttaaaaatcactacatttggtagttgttatcaactgaactagggagagatctaaaaccaaaaagaataatcgtgatactgcagatcagacaagaaagaaaatctagagttaaggtaggtcctaagaagtacatgagaacacagggggaaagatggcttttattaaatttattaggatcgttttaagccatctgtgcactgattgactctcctgtgaacagcagctgtttttattcattgggaatgagcagatatctaagccattactcaatgttcatttcacagctggcttttgaattgaaaggcagtccatgtccaacaaatttggcaccaagtacttaaaggtctttgtgtgaaaaggctgtgttgagacttggaaagtatttccatttaataacaaattcacctaaacatcagagataactaaaagacaagcctccataggttgatgattggatcaacgtgtatatttgactaaactctgttttgggccctgaatttatggctctctgtatacctagaaaattttgttcatttcaatggaatatggtgtagtcatagaaaaacagtttactccctctgcttaagtatcaaggcatttatagggaataaaattccaaatcaaagctaaaagtctaaatgtcatttaaacaggaggctttggttctacagtaagaattccctttcttggactctgttgacagatgtgttagtcagggtaacttaactgtgctacagccacaaattaaccctggaatcccagtggcttaacactgtaagagtttatttcttgcttacgcaaattccatcatggctcagggggcatggggacttctcaggcaatgtgatgacataatagtccagtctgcttcaatcttgagaacaatccatctccacccatggtttccaggtggtcaaagcagaggaagcaaacaacgaatcatgtatcagtttttaaatgctttggcctgggctgggcacagtggctcaggcctgtaatcccacgctttgggaggcccaggcaggaggatcacttgagcccaggagtttgagaacaagctgggcaacatagtgagtccttcttctctacaagaaaaaaagaattagctgtgcatagtggcacatccctgtgatcccagatactcaggaggctgaggtgggagaatcgcttgagcctgggaggttgaggctgcagtgagttgtgactgaatcatgctactgcactccagcctgggcaacagagcaagactctgtctcaaaaaaaataaatgctttggccccaaggtgtcccacagcccactggtcagaactggtcacactgccttgctacccaacaagggcacatgctgggcagtcagtgtctcccatagcaaaggtgtgtgttagaattcatctggagcttggttgtttgagccagactggtccctgagggaaatgggcatttcttctttatatgttaaatagacacatcatatcattggttaataggtctagggaacaaagacctgagaaaagtagacagagcattgctttggggagaaaaactaccattaagaaagggtagactgggtaggctggcttggtagtactctgtatctggtagctaaggatatgtgagtacacgcgtgtttcccagcatggggtccagcgagtggcatggtcaatggttatcatatggtgactgtgactaacacggcagagggcttgctgcacagggaggaagagcggctcctccctgccacctggcccctggaagcagagtagatgagaacctcattcacgcagagtcacattttggaaatgtgactcataaattgaaccttattttaagcatatcaagaaaaccgtatatttaaagggatcctttgaatcctgaatccttgaaaacttgagttctcatacactggctattcagaaaggcagagtgcaacccatagccagttaatacccagaaaaaaggtgcagcgacacctggtccctgccctgtctgcgggagtatttatcgccactccgctgtgagagccatttctgcggtgtcaatccactgagcttcctgaggatcaggtgactggtgaggctgagcagatcccacaagcatatggtttgcatgattaacattttggcttttgaaggtgttccactcattttcaaaactgggctttgtgctctcgaatgtatttctctcaatcctcttctgtttgccctatgtaggaatgaaatttttggaggactgccctatacagcccctcattcctttatatttgctagtgggtggcatcgtcggtaccttaaaggtaaagtatctttatctgctgtttgtagtccttgtagaaattaactcacaggcatcctgtaatgcacctgttatttgcctgctattcacaggggagacaaaacaacttccccctaagcgtggttgctgaagtgatggggctagctccagagacacagatttttccagatgcagggcatttacccagggctgtgcatatttgcaagagcttccttcctgctgttgagttcaatgtgctaagctgtggctttggtctgacaagagttgatgcagaggagtccctgactgccagttataccattgaattcagccagtgaaatcatggtctttctctgcgctgctgctgctgctgctttttttttttttgctttttttttttttttttttgaggaaaaaaaagcttcctgttgaaggcagggtttgcatttggttaaaatatgtttgatttagcagttcctatttctgcttttaactatacttcctagttctcaattgactaacataggattaattggctgcagttatcaatcaactattaaagtattcttatgcctgaggtaggagtgcttctctgtgactctcaaggttatgtagttaatctgctcctgggctgtattgacatttgtttaaacagaaaaagcaactgaagaagaaatatcaggggcgtgcatagcctgcaattgttttcaagatccctggcccacagaaatgttacacctaccaagagaagcttaggtcagcctctgtctatcaacaactcttcccagtcttccaagcccacctcaccactttctatatcaaagccagaaaacacaagcatccattttcccaagatggtttcataaaaacaaagccgtaacacaagagaaaactgagtcaagagtgccaagtatgaactctcattcggacccagtgttgggtttctttgccagctgccttctggtgcggggatccttggagagatcctggccagtggcgctggtcatgctgttgatctaagacatcaaaggaacgtcttgaaaattgctgttctcatatgcaattggtagccacaagctcaactctgtcgtgggagacgtctgatttggggcaaaccttaggaggcttttgtgtttgaggtaacctcactgttaaatgtccccatctcctaacagcaatctggtgggcagtgtcctaaaatgtacaagtacacacaatcatccccatcacaacatccccatgggatctacctgggactctgttcagctccaagaaaacccaaaggctcttggctcagcggggccacattttccccatggcccccacagtgttaagggaaggctctaacggtttgagtgccatagagatgcttaaaacaagggcagcgttttcagcagtaattacctctgcctctcctgttctcactcatcgtcaagctgcccagcagaactttcctttagagatgctactgtccgtggggtctgttcctcttaaaaacagcaaacttttcctttctgaaagccagcccaggacccaaaggtaatttattttagtgaacaaactaaggccctaataagcagcattgattttttgccctggcaatctaaaaccgtttgaagccaaattaaatttttgtgctcatgatggcaaggtaatatacagtgagtccataaccattagagcagcggcaaacaggattagagtccccagaggcagaagtttgcctgtgataatgatggtttgtattcaacctcagaacctgcctagggggtcccaacatccttcgtgaaatgcatcagatagcttcacagtattgcattctatgaagagaaacttgaagagatgtgagctgacatttcatggagctaccagaaagaactgagggtcatgccccattaaaagatcaggaaatgaattaagtaggctgtgtgtgacctgctttttaaaaaataaaatagaaaattagagtgcctagtaagttaagtattgtgtgatacttacatatggacatgtgtgtgtttgggtgagttgaccgtgtaatttatcatcctaactgggacacttttgagagtacaagggggctctaataatcatcctgccagagcaacagcataaaccaggacttctctaagccaacaaggacatgcagttacccagtgactaggacctggcataaaatgtatttgttactgagggtcatgttaaaagacagtttccaaaagacggattcagtgaccattgcctaccctgcactccccctcatcttcccacatcacccttcctagtggcaattgctacccctagtaagcatgtgctttttgctgatgccatgctgacggctctgccctcatttggaattcattcagtcctcaccgtgcccctttgaggcaggtacttgcttcaggaaggattctttgactacaaggaacaaaaaatcaactctggctaacttaagaggtcattgattggaagagctcacaacctcaaaggttagtgggagagaagggggccaggtggctccaggaagcctgggcagtgggacccacttgccacggctctttccttgggctggttcctttctcctggcatcattgtagccaagaaccagtcctgggagggcagccagatctggggacacgtggtgggtgggggaattcctccaaggaatggggccctgcaaggaagggaaatgcatctgagtgatggaaacttgagctggactctcagttccagcttacagtgaggaaacagcgagctggtgttcagcctgggctttcccaaccacacagccaccgtcagccaacctactacaggcaattggtttttcccctaccctaaacccaccacccttcacctttgccacaccactccccctcagaggaggaccctcgcacctctccttgtgcataggggtcccaagtatgccccttcttccaggcagccctccctggatgagtcagctctactgtgggtggctctctgaactcccccaaggcctcactttccttttcttatggagatgttctgcctcccagccgggctgcaagtcttaggcgagaaccctccaatttaatttcctccgatttaatcatcagtgtactgtggtgtagacagtggtcaaagaggtgtggaccactgcccttctcattctcttactcactgtggatctcagtgaagtgacttaacttctctgagccttagtttcctcatttgggcaacagagataatacgcggccccaggctaggatggacattaaagatcacacataccaagcattaaactaaccactctccttaggttttgtatctttacataagtaataactctccattttggaaaatcagagaatgcagataagcacaaagaagaaaatcaaaatcatctgtaaatttcaccacccagagaaaattgctgttgacattttggcccaatggctccagttttggtcctgcgcccatgtttatttagtacctctagcctcaggctgggagaattcattgagataatgtatgtcaagcgctttgcccagcaccagggtctatttttgtacaacatccattcccagagtcactatcacctcctcacgggtaacccccagatctctgccaggagtcctcacctctctctgttcacctccaggctctgactctgccccctgtgggccactagaccctgcatttccatccaaaattttaaatggaacaagtccaaatctggagttatcacctacccaaggcacagcttggggttcgctgttcccatctctctgtctctctttattttatccttgcttctctttacagtttggagcccagttagctgcatctcttggctcctgcttgcccttccatttcactcaagctcagcatctctccccgcctctgccagtcggccacatcctccgtcatccaaggattctttctaatgccctgctctccagggttaggggtgccatgagtgtggcctcgggagagatgggtagcctaggaagccagagagagcagatacacaggtcaggctttcaaaaacatcacagatcaagttgctaggtagagaagacggggagctgttaaggcattccttagcaaagaccacctgtgtccttccaccgctgcatttccagggggaaagtgtgctcccctgtgacaaaggcatttgtggccagttagagtcgggtgggtcgtggtgctttgtgtaaccaagtggcagcagaatttcgaaggcgtgtcaggctggagtcagggaccatctaccaggggcccagatggtctgtcccccaagagtatcactcccaggacaagggtctgtgctcttgacttgaaagatgtacgaggactgagagggactctcagtccacagccccacttgggaattccagatgcctgagatgggcagtggtacaaacttccaagaagagagaaagcaggctgggcggggctggggtggggaggaaacggctcacggtacctggattcggccaagcctgttacatggcctggaagtaccagggaaaagtctgctaggggttcctcccaagacagagggatatatttcaaggtcctctagcatgcggaccaggtgtcatttttacattatgtgtgggtgcaaatgtgctagcacaatacaggagagagtcagtctgaaccttgatgcagagatgggttaccccagccaatcccttgtccaaaccaactcacacatctaaaaggaaaacaccactgaggatgctggcgatgaatttatgccttcattcttgccagttttaattcttattcttcaaattaaatttcgttgcttgatggcatttgtaactccagtgtgttgttcacttttcataacaccttcctctctctcctctttctctctccctgccaacaccccaccaccgctaccttctatcccctctcttcccgtctattttgctgctctgccttgccaccctggctccccaccacgccccaggtgtctctcctgttgtacgactccaccaggatgaggcggctgctgtccaaggccgtggtgattgatgacgatgacgatgacgaatacccctggaggcagaatgcgcacagatactacatccacctcctgctgagcctcttcctcttcctctggttcatcctgggaaactactgggtcttttctgtgtacctgcctgattttcttccccctttccagcagcctcaggactactgtgacaaaaccctgtacctctttgcagtcggagtcctggcgctcagtcacactgtgctggtcttgctcctgctgtgcagcggctgtgtctacctgtgctccaggtggagacttgctgccgatgaagactgacagctgccttgtccagcataccatgtatgcatatgcgtgtgcatgcacgcgcgtgcacacagacacacagacgcacacacacacacacacacacacaggttcagagaagggcataaaggtaataaaaccttccctgaaggcatttaaaaagccacccaaaggcactgaatataatagcagactaaagaaactcttgccttcctagacatggggaaatcacttctgctcttttcagagtgggaattttgttctcacaagagttttcaaagggataattgtttttgagggtatgaagtgtgggaggcaaagaatgggagaccttttcaaatcatagtgcaatttcaatgactggtgcaagagcaaggttggttgttgctactgctgctgtcattcagccatggtcaccttgaagttatagaaagtgcacagactttcacacaagatatatcttaacttcactcgctatgatggcttttgttattaaaaggaaaaagatattcttttagtgactctagctgccttttgggaaagtgaaggagcagtctcttccagccctatatcagataggtttgacgtgatgggtggaacatcccaaggtcagctataaaatctaacaacgtcaaagcagtagcttccacatagggggcgggctggcctgctacaggcattgcggagtgcagcgccgtgtgcaccgtgtgccgctgctgcaggttctttgcttggccttgagtctgtctctgcctctggctattcaagtacctctctatgatctgcggctggctgggtggcataaaccagttttgtatgtttctggacaggttgcatgagttggggtgccgtcagtgtagctgtttttggtttctgagcttaaatatcgaataatagctcctcaacctaatgaccagttaggctttggaagccttttgtaaattgagatgtctggaagtccaggatgacaccgaacagtgaccactaaccttccctctggctgccgctgttgagagatgaagtccaggtctgttgtcagtgctcgctggggagcctctttatgagcaaaaagtcccatgttttagaattttgtatgaagatactgtcatgagtgtttctagggcagtgcccaggggtgcgtggcacctgcttaaccgtgcttctctcagccacgtgcatagcatttctgtatatttacacactgctgagctgtgtttattttttaactttgttatgttttcgtgctttctcatcaaaccaatccctgagtggccatgaatggaggcacctcccttcatcagaagtgtcagctcaaaccaagaggctcattcttctccgtagctttaagagaaaggccccgtgagtcccatggggtcttcccatttcagtttagaagcactccccgggcagtcaccgttagtccccctttcctcccaggtgagaagaaagtgcttggtgtgccatctgctggacaaaggaagaacagccctttttttgcccctgtccctaagggcagtttctgttttcattttcacttgagccatggcagaagaccagcgggtgtgcagtttgcagatcctacctcacctatgatgcccaattccatcctcactgtgtcccacgttgccctctctgtgttggggactggggagagtctgtgggctatgatactggggtggacaggagttccatgggctcctctcccaccctcctttccccagtccatgactcgtcagccattcccagtcacttagccaatgcttggacatctgtgagcagcaaagacctgggcccagggacacctgcatgactcccacatgaaagcctctgaggcttctgttgcgagggccttggcaaaggcggaaagagctgtgaacaaccatgggcatgaagatttctgttagcagatggcaggtactggttagtgctttggatacatcagtagctaggtctcaaacgttggacattcccagtttctggtaggcatgagtatcaccagagtgttgcagaaatctttcccagagggagtggtggatgaagtgtgctcattctcatatgcaccccaccagcccacccccagttgcaatggagaatactggtcataggtcctaaataattgctaaaatctggactatatttttagctttgagttttcttgtcaccaaagcagtaaggaagaggtgatgatctctttgtataggtcatacatcttccctggtttgaggttacagtgagctatgattgcaccactgcactctactctgggtgacagaatgagaccccatctctaaaaaacaaaattacccccttctggggaaacaggttagatcctaaagaaaatgttcatgtgcatccattcatagaggggacactgaatggttcagtgggtgacatcttcaagcgcagcaggctttgaatgataactgattaaggcctccctcaggagatggtgagatggttatgataaggcacatttcaagaaagaggctctggggctaagtaaggcaaatggtctataactgtggttctttgaagtctggcttaatccagggatgacacccagactgtctaggaagggctgagctgcgtgccctttaagtgatcacctcttagtataatttcactgagctggaggtgagtgtaagaagttcctggttatagaagaagttataatccttggcatggcctgaagtaggcagtccacactgatatgaaatgtgctgtgtatacctggagaatgaaaatgcccatctaagactggcccaagagctgggcagccttcctccatgggaacctggcaaggcaatgggaagtggacatgggaacacctgaactttctggatgctatgaaacctcaagggaacaaattatgtggcagagagggataatctgttcttcccatctgagaaaagactgcagcaaagataaactatatgttgagatcattttatttgctacatcgggcatcattctaaaaaccattctttgcctgaatctatataaatgacagttgaaagcagtaaaagtgggactgtttcactggagtcagccacactagtggttctcaaatcttggtgaaccctgagagctacccaaggacttgtttgcaatgcagaatcacagcccccagagactgacttgtggggcccagctggttctgattcggtggccagagaaaccgcatgtgtgcactcgggccacacatacagcctggactggcttatgtcaggcccatcctggttgtcaccatgaggacaatataatgtcacttccagtacttcgtgttatttccttctcttttagtatgagaagtggccaagtggtcaatagctttcatctttgtgtaactgaatcttgtgcttcatttccttctgggcatttttcattgttgatgaaataaactttgttcaatttgttccccagtgtcttccttgaataccctgggggaagagaatcctccagtccttgggatgcttcatttgttctttcttccaatgggatttctgagggtagaagactgtgtccacagaagctgacaacctgttctaggcaaattttgctccataaaactcataatcctcataatcctcaggtgagtagatgagtctgtagtggagaattgagaaaaatgatctaacagaaaattcttcttagtaatcctagtgataatttatcttttataagtatagaactaataagacaactagtctgtcttttctagagctagaatttcagtagttcacttttcaggttagcctagcatcacagcagctacgttatcttggatatcccaggagacagcattttgccattgcaagcagaagagaaataagagaagagtgtttccaaatacatctgttgttttctctctctcttttttaagagatggggtcttgctctgtcactcaggctggagtccagtggtacaatcaaagcccactgcagccttgaactcctggactggggtaattttcttacctcagcttcttgagtagctgggactataggcatgccaccgtgcccagtcaggtttttttggttggttggttttttgttttttgtggggttttttttttaagagatgggggtctcactatgttgcccaggctggtctcaaactcctagcctcaagcagtcctcttgcctcagcctcccaaagtgcgcagattacaggcattagccacctcacccagccctgttgttttctctaagacacttcctttgttatactggtcagcttttaaaacttactgcattgttcagagaagtaagctctgcttcataggcaaaggaaaagcaactgggacttgctgctggtattaagagtttgcacatacagcatgttcccaaaaaggcttgtgactcaaaacgtccctctgttctgattacttcctacttaccctattggtgagggaggggtccctgtcctaaatagtgggagaagcccaaatgcaacccttcccccactggacagatgtgatggacagcagcttattagtcactagactcactgcctgggggaggaggacacagcatgttatgcagggccacatggggcttgcacttgggaacagagtggaccggcaggggccgtgggggtcatgccttgtagtagcaagaggaccaggtaaccctgtgttcccatgggaggagtttcctgtcttgcttgagtaatttcacagacgggcagtgaggggaaacccattaggttggtggctgggtgagtggtggtgactgacagggtactggtcaggtgggagaccttgcctgctgggtcaggggcatgcctggtgagggcaggggaactcacagaggaactcacagttaagcccttgggcctctgtgaggctcagagatgtcaaggcagcccagagaattgtaggccttagaatacagcctcctagagccacccctgcctttctttggccttattctctgggttatctagtcctgggttcaaatctgtctttgaatttcctcaacttctcaatgccggaagggagatataatcagtggtgagatatacattgccaaggaagtgaaaaaaataaaaaagtcttcttgaccactaacagtagccagatcagaaccctcgccgcctgcttcctgagagcaggctggcacatcctcttctccagccttccagtgattttcccaccactgcaaaagtcttgctgtctgatcggactcttgcaaactgatgttttttactctttatatctttttttgagtatttaagctgctatttaatacaatgtcctgtagcctgtaccttcccatagccatcaaaaagaaaacagaaaagaaaaacatttcctacatcaatttacagtttatacatttgtttataaggaagccagtttgggttcgattcccaagtcactggggaaaggggttgaagcccagattcccctgggatcccttctggcagcccagcgtcccctcccgcccccagcagcaggtgctggcgctaatggcgcacacctgcacccttttgtgggggccgccttggttgactggagccagctggagcctgagagttctccccgctcccagttcaccccaccgacagccatagctaagggctgagtcggggaagagggaggaaaagcccaactcccttgtttcagggcaggtcaaacttgaggcatttatgcaccagagctgcccgcgggatcaggtgaaagcagggcttcgtggaaagccacatcctttcccagcgcttccctttccccagtgcttcctcccttaccctagttcgtttctcccaaggccacaccctcaacacatcccttatcccagagcttcatctcagactctgcttccagggaagccggcctaagccagggttatttctccacagctggaggcatgacataaattactagtatatccccttttacaaccctttttattttcctaaaatgacaattttaaagctttatttttattataaaagtgatacatgctatggctagagattcaaatcgtgtaaacgagtatgaggtaaaaagtaaaagatttgaagcacccccccaactcccggtccccaaaaaggtacccagtgttaattctgtagtatccttttggaatatgtctatgtatcgttaagcataaatataggtactttttacctacattatgtcggactaggctgggcgtggtggctcatgcctgtaatcccagcatttaggtaggccaaggtgggcggatcacgaggtcgggagattgagaccatcctggctaacatggtgaaaccctgtctctactaaaaatacaaaaattagctgggtgtggtggcgtgtgcctgtagtcccagctacttgggaggctgaggcaggagaatcgcctgaacccgggaggcggaggttgcagtgagccgagatggcaccactgcactccagcctgggcaacagagcgagactccgtctcaaaaaaaaaaagaaaagaaaaaaaaattatgtcagactattcatattatttgacaagctgcatttttctatttcctggatcatggatttctttccattaccagcgcagagctctgcctcaaacacgactaatatgtattcataggacttattttaagaggctcatcctctgtaacttgcctggtctctcatttctgtgaatcaaaatgggaaaagcagtaatgtgaaactgtattttgacaaatgaacagctgagaggtcagtttgagaaactgtttgccattcctcctgtcgtgtacctaagtaggcccctggctgaactgggctcctagggaagttcgttgcagggcctttggattaggcacatgatgcacctgagggagactcacctggacgcgacgactcatcgagctcctgagaggagagaggttgattagggtggatgctattctctatgttccccaggagtgtgagagtcaacaaaatcccaccatcaccaaggaaaccattaaaaaatcccagcactttgggaggccgaggcaggcggattacgaggtcaggagatggagacgatcctggctaacttaaaagtataaaaaattggtcaggcgtggtggtgggcaccggtagtcccagctactcgggaggctgaggcaggagaatggcgtgaacccgggaggcgtagcttgcagtgaaccgagatcacgccactgcactccagcctgggcgacagagcaagactccgtctcaaaaaaaaaaaaatcaaagccacctacttaaggaccaaactatccttccaatatcgtgtgattgtgtgaatacctacaactgagatatattcggcaacagatacaagacggaagcaacacctgaatattgcagaaggtataaaatgtatgttgttacataacaaaaattaataatgtaccacaatgaggtgcaatctcatacgcatcaggatggatgccattaaataaaaaaaggaacgaactctgaagataacaagttggtaagaatgcggtgagccggagcccttgtgcaatactggtgggaacataacgtggcacagcagctatggaaaacagtagggaaggtccccccaaaattaaaaataaaattgccatatcacccagcaattccacttctgggtatacacacaaaagaactgaaatcagagtcttaaagaggtatttgcacaccaatgttcatattaatattattcacaatagccaagaaattgaagcaatccaagtgtccatctatggatgaatggataaacaaaatgtggtttatacacacaatggaacactatgcagccctaaaaaagaaggaaattctgaaacttgctacaacatggatgaacctggaggacatgttgctaactgaaatgagccatccacaaaaaggcaaagtgtgattctacttagatgaggtccctagagtagtcaaattcatagggatagaaagtagaatggtggttaccaggggctggggaagggggcaatgaggagttcttgtttaatggatacagagtttcagtttaataagatgaaaaagttctgaagatggatcgttgcgcggcaatgtaaatgtacttaatattgaactgtacacttaaaaatggttaaaatggtaaattttatgttgtgtgtattttaccatagtcaaaaataaaaataagtaatgtattcctcagtcctcccaagcctccacagtcgctcaatattaaatagctggccagtgcggggtcatttggtcattgtctgcatatgcagggccaggctgcaaacccagtctcactcttagtgactgcagtgctcagcatccagctctgagtgccactggcttaggggtttgggagtgggaggaatcctggtagaaaaaactgtgggaattataagctaccctgtcacacccaagaacaaatcaaccaaccgaaaaaggggaggggacagtagtggaaatttccagtcccacagaagttactaaaagaagaaatgaggagacaccaccatgggacatgtccctcgtccttacagagaaggggttaagcatgtggcatctggacccagaccgtcaggctgggatcctggctctgcccctttccagatgcgtgtgatcttggatgtgccactgaaactctctgtgcctcgttttcattggtaaggagattaaaacagtgcttggcacatagtaggtagagcatttgttaaataagagaaaattttctttatttcactctcattacaatgctgtgaggactgtacagttatgctcctctgtagaggggaaactgaggctcacggaggtaaagtgtcttttctgaagatgcctcagagctgaatgtgggccttctgactctctatcccagttctcaccttgcgtctgcatccctctcccgcctgtgtaggtggcccttctcctgaggccagaggtgggtacaaggtggtacagagtgtgggtagggcaagctacaaccacctcaccaagcagcctgcatgccctcgcgctactcctgccccaggcaccactagagaaagcccacggcttttgcactcagaacagaacttgcttgccgtaaaaccgaagccctagaagcaggctgcatgagagtttaagacgaacacgagtcccgtttgtggaaaatcactttctccatcaacttggctacatggagactgaccaccctggcttcactactgccccactttgggcccatctcactgccaatgtctgcagtccttggagggtgcacagggctggggaaagtagatctctgcatgttttaaatctaagtaagtgattcatgcacatggtacaaaattcaatggcacagaaggcattcaatgtaaactgagtctgtctcccgcctcggctccccactgccaaagttctggccagaggcccacattgtgattagcttcttgtgaaaggaaggaaacccctaaatccaattgatttgttaggtaggaagttggttcagatgggcaacagacagccctgggtcaagccagtctgtaaaggatgatgggcaccgagggacatggggaggcagctggaagggcctttctacacggtgactgtgtcagctgcggagtggggaggagggtgggctggtatctaccacatacctcttccctgtgctgctgctctcttctgctaggagtgaatgccagaaagcagtcgccttgggtttctgataaggcttttgtgattgaggctgggatcccatgacccgccccccacttcttgtcattaggaagagcccagttccttaatccatgtacaggtagggtcagcacctgtgcatggtccacactgaaaaataaggatcagcatcagagaccttcttctccgctctctgcctcatcctctcttcctttttgttcctttcccttcgctgtcatttccattccccacccccaattgtacactaaacatgtacatgaatggtgcctagcttcctatgagtttatgacttatggttattcatcttaataactaagtggctttgccaggtaaaatattaaggcaccattgccattatgaccttgtcttccatgatctcattggcagctggtgttgccatgacaacttggctagaggaactggtatgagcttcagtggaaggcgatatgaacactggttgtgtgtgtgtgtgtgtgtgtatatgtgtgtaagagaatacagacttctcatcatgtgtatctgttgtgcagaaagccatgggtttccacaccttctgcttctccttccattttggtcaaaattagcctcagggatctaaatcaattggaatggaactctgggggatgatttctttgtttggctttttgagtggcaaattggaaccaggaacacagaagaaatattttagtggctttccacccctgggaaatgaagcaaccctatccactttgacgtttctcttaaaagcaccctgggcctaacttatttagcatccatatgtaattttcttagtagatgtatagaaagttggagctgaaaggagccctgggtggcgcctagtctggccccctttctgttcagatgagaaaaactgaggcccagaggctaagtgacttgcccccatttagtatgatgcagcagggaaggtgtgggctctggaatcatactacctggtctcaaagcctggctccaccatgtatttactgtgacctgagtcaagttatgtaacctctctcagtttgctcatctgtaaaatggggataatagcaggagtaaccatatggatcagtgtgagaattaagtgctataatccacaatgcttggcacactttaagccttctatacattttatcacatgggtcacacagggaataactggcagaaattggactagaatccagctcagctgactccagttaaacgggaacattcccttgtgaactccatactgccctttgtttgtgtgtgtgtgttacttggcatccaggtgagagtggaagctcattttgagacagggtttggcttttcctaagacctcctctttaaatgtatataatgtatacactaactacctcgtggatgcttgatttgaggctaacactggacacctcatgccctcatggaaatttcttgaatgtacactgcatggctgtaagcgcaggggaaaaaggaatgagaagaaaacttaaggagggaaaccaacacttctgatcactttgtatgaaactaagctctttataatgaatgcctttaatcacaaccaccccacgaggtgcgcatattcattcccattttacatattaagaaaccaagactgagggtgtatgcagcatgctcaggttcacctggctaatgcagagagctgggtttgcagccacacttttacttcaaggggctgctgacaccctccaagagacttggtggttcaaaactatttctcatcccctctctgcgagccaaaagcctatttcctgaggtgttcagagagattcagagcagattgacaccttttccatcactgacacaaagaggagggtataaaaaacagtatgtagccctggggatctaaaatattttcccagccaaatcggacaggcattgaaagtcacacaggctggggtggttttacaaaatgccacttgtttaaatttcctttcatcactctgtcaggaataacagcaacgtagtggagcctcagagtcctgttgagaggggcgagctgttccggggaaatttatttcaaaagttattctgaagtaaaaacttgcccactgtggagtgaggttggacagtgatcctatatcctaggtaatgaggctattaaagcagctggtctcttcagcttatgtaagtggggcccagtctctgggcgacttgggtaaaccggtatagaatttaacagggtgactaggagtgacagcagcagtaagacccccatttctaatgtggcgttagggctggaggttagatgtggacaggggtgtctgagtcctacataatggggctggatgactagtctgagatctgggttcacgcagcaaccacactcttttttactcacactgttcatctgggcttgggtggaaagaggctgatgaggatttgggggaaatcaaggggctctccctggcattgcatgaagtcgcagaaccagtggcaaaagtccaactttggagacaattacttctcgggtgggagccccagccctgcctcttgcctgcgatgtcgccaatctgactgcgcttgctggagacgggaaatgtggcacggcactgcatcccccaacacgtgtagaaacttagagaatgccagttattaaaataacccttatgataacaccaattcgatgcagaagtcttttaaatatcataagcctcgtcgttttattccacatggttttctaggtaaccaaattctaggaggtgcgttgcagggccatcttcgcatcccggccatgcccagcaggacggtgttctctaaacggcgctgatgcccgatttcgaccccgaggagactgcggacctcgactgcggcccccaccagggccggtccgccctcactccaccctctgaggctggggcggagtcgaccggccggccccgagaccccttgccttaccggtggagcaaggaaccggaagccgcggctcttacataaccgggatgatgtcagggcgggcgactcccggggggcgggaccagggcggaggccgcgccgggagcgcggtggggctaggcgtggggcgctcccggcatgtccctgtaccgcagcgtcgtgtggttcgccaaggggctgcgcgagtacaccaagtaaggcggcgcggcggggcgcggggccccgggctgtcacgtggcccgcctcggcgcgggcgagcagggttggcggggacgcgcccgcggctccttcgccctctcgctgggccgactaagcgtgtccagaacgacgggtgcgcccgccgtctagcgacccacggctgggcgtggggcagtcgccagactccagccgctcaatgcccgcgaccgagactggcgcccgaggggcggggctgtggcgcgcccaagcccagggccgtcccactgacgtcaggcggccccggcgccaaggagcctcttgggcggcacctcggcgccccgctgggtgtgctcgtggaagtgtcttcgtggtgctgctggcggcgtcagatagggctggatctaaatcgctagctaaggctctgtcctagtgcctttgggtgtgtttcctttaaaaagatgcagcacctggactgcgacctttggctccagctggaactttccagccagtgtgtgcttctggggaacggtgcgtggtggtttcgtcgccccgtgaccacgctcagtgtgccctagttggctctccacctcattgtggttttaagaggtgacaggttcctgtgacggaggagagatggaggttttctcttagaattgattaggctaaccgctggttctcaaccctgtctgcacatcagaatcactgggcgagaattaaaagtacccagttttcaggccccatccctacagattctgatttagtggatctgcacaggggcctggactggcatttcatccaaatgccccaggtgattctcacctctgagaggcttctccctgcactggggctttatcagttcccacggcaacctggccagcactcctaggggaggtaggagttgcaactccctgctcttcaccccacatcgttttggagaaggttcagctctgtctcaggagcccctgctgcagagaatggtggggagtgtagtcgtgagccctgtcccacagtttttaggggaatacagtggcagcctctttctttcaaaggggtgtcctctggcaatgaccattaattgctggatctttccacattacacagcatgaaagcttaagtcagtttccaaccaggggtgggccccaaggaaagcagactgtaaaaatttctcccaggactctttcgctctgatttccccaccttgagggaaggtagaagtgaggccaaggggcccaatccaccacagattggtgggggaagggaggggaggggaaggcagttggcaaagttagatgggttttcctgctgttgtggatttagtgaataggagagaaaaacaacaaccttgttttgacttcagtgtgagagcgcggagttagagtttacaacgtttctcttggcacaaggatttttataaagcctccctatattgggctcctaaggcaggaggatctaatcactgtttcctaaactttgctgaacctaataattccctggggcagttttaaacagactcctaaaccctgggcaagtgtggatgggtcctaagcaaatttcatatttgggtaaattgagggtgtggggagacacagatacctgccagcttcctcctccccatccctgtcacctcagcttcaggaaacagtaagtacaaatgtcctctcagcttgagtcaaaatcactggcaaggcacatgaaaccacaggttgccaagcaatcacttctgagtcagtaggcagggcatttccaacaggtttccagatgatgctgatgcagcttgtctggggactgccctttggcaccgaggctgggtgttgaagaagatcacctaccttctggtgaccttgggaaagtcgtgtgtgtgtgtgtgtgtgtgtgtgtgtgtgtgtgtgtgtgtgtgtgtgaaaaatagagactgatatctagagactgatttctagagtgaaaataaaatgcttccccaataaggggcagagtacataaaagacaagtcttattaacaacagatcggaccaggatggaattcttgtatggaaggcaagatccaaggcagaggacagagggcggggacatgtcctgcaggccaggctggtactgcccgcttggcagcactcccagtctggagtttgaggaagaggttcaacccagaggagccagcctcagcaaacattcgtctctaatacggatcagtgtggagcccagaggctaatgtcccctctgactgggtatcacagagaaaagcctgtcagcttcctgcccctggagaagggctcttcaggcctgttccctgtggactgctttttttctggctctattgtatttgggaagttctcactcattccccacaatgcctcctcctagctaagcccctattcattgactcaggcccttgcctctaccggaaaagcctttcacagagattccagggctcacgtctgtgtttagggggaaaaaaatcttccagtttcctctttgtagtttaaaatgctctcaaagtccctactgatttgaaggcttgggggccaaatgagctcaagtgtgaacatggacggtactgtcattattaatagtgataataataatgtcacctgggtgcggtggcttatgcctgtaatcccagcattttgggaagccaaggtgggtggatcacctgaggtcaggtgttcgagaccagcatggccaacatggtgaaaacccatctctactaaaaaatacaaaaattagccgggtgtggtgacgggcgcttataaccccagctactcaggaggctgagacaggagaatcacttgaacccgggaggcggaggttgcagtgagccgagatcgcgccactgcactccatcctgggcgacagggtgggactctgtctcaaaaaataataatgtcagctgctaattattgagctcctaatatgttccaagtgctgtcataagtgccttagatgcggcatctcatttaggctgcccaagaggtatctcttattattccctttctgcagatgaggagataagagctcagaaaggttaaatcaacacacaagatggcacagctagtaagaggctgagctgtgacttaaacccaggttgttcaagcccttgttactgatatttttaagtttcaagtcaacctttttgggaaggctttggaataagaagtcttgcttgccactcacagcagaagcaatgggtagggtgttctctaagctgccctgcatgttctggtgagttacagatggtgaaaacaggaacatttttcttgttctcttaagaacatctggcttgactgaaacaagtggcaatgcctgccccgtggcaatgactttcaaaccaaacccaagctcataaacatcctttggccacttccccgagttccagagcatgtaactggcagttgtgctgtaccagggcatggggcaggaggccagctgttggctacccttttgtaaacaggtcctgtgggagggctctcagcatctgtggagccttgagatcagagtcccatcctgcattgcccaggagaaatctctcggctccgtaggtgagagatgtaagctctgagaccccagcctgcctgtgcgtgggcagagtctgccctctgggcctccacctgccaaccccaccattctgccaccactgcccttagccaatttcatagccaggaaatactagaagagtaaaggtagagaggtatcgcaaaaggaatgggaaaaagaaacagttaaagaactcacaattgcatctatccaatatgatgcctttgtgcaaatcagaaaaaatacctcttctgcaatatgcttttctgccacctgccagaacattatcataatgcagatacaaatatcccatcattctgatccgaatggcactccctagagctgtgcagtgcacaccttgtgtccctgaaggagccttggcttcctctgatgggtgcagagcttaaataactctaccatcctcctcctttattccctacttgcaaatctcccccgtttctccaagtaggcaaggatatctgtcctgcaatgcaataagcacaatgcaaatggtctcctaagcttcctgaaacctgccccccacaaaagggaaaagagcaattcatctgtcaagggattttttttctttttgccactccccaggatcggggcagtcagaggaagacaatttggatgccaaaatgttggaatctccaatattttcaaaagtttggaaagatcatggtccaggaaatgcaggccccgagatagtggtgtttgtgagagcagggagggcaagggagaaaggagtttcgtgatgtgttgggagaggcggagacagcaataatgcccatcctagaattaggctttctcctgcaggggtttgtgttccccactccttacagctggtcttcctgtgggtctcctctttctaggagtggctatgaatctgcatgtaaagactttgtccctcatgacttggaggtccagattcctggaagagtctttttggtcactggaggaaacagcggcattggcaaagcaactgcccttgaaatcgccaagcgaggtaagcagctgctaacacgtgtgtccactgagccccacggccagactgcggccggtccacactgaggagggcaccctgtgtcacaggcaggccaggaagtcctggacggcgatcccatggttctgggcacagctgccagctttctgagttttgagctccaggtggctagagcaacaggagccctttcctcaacacttaattaattctcaggcgagcttggggtcctgcccacgtgtcccagtgttttctgattaagaacagcgaggggctcaagcaaaccctggacatcagaatccccagtggaatttaattaaaaaaacaaaaacaaaaacatgaacacctggtctctaactcatgtcttctcaatgagactctcctggggtgagagacaaggggagggggagcctcaaagtccactgcaatttggatgtggatggtagttatgaaccaaggcccccaaaatacctggagagaggagtgcattgaactaaacttcctccttgctggggtccagcctccagggctagagcagcctcccgcttccctcccctaagcttgactataaagaggtgcttcaggtgcactgtaaagtcttcagtcagcagaagtcttcctcatggtaaatgccagaatttcctgcatgagctcaacgatcctgggtcaccaaatggctctgcagtggctagaaaagtttgctgcatctctccagagcctcttcaggaaaaatggatgttccagcagaaggtggggaactaggttgtgaatttatcactttttaagatgctgaagatgttttcttttttcctctctctaaatccaagttaggcatttttcaggggactattatatcatttgaagctttatttaattatctgccaagtcagggagaggattaattgcatcttagcagctgggaagcactctgaagtgcggagaggaggagagaagaggggctagtgttgtggttagcctgtagcctcccatgaaacaccccatttaatcaagtgggtgatttttagtaaagaaagcagactccataacgattcgttcttagctgccacggcgaaggcattctgctttaaattgaccttgattgatgatggtgtggcatttgctgggataatatgagggctgctgatggactcaacattcagtcaatacttgagtctctactacatgctaggcaagtggctgtctactttggctgaacattacatcaccaggggagcttgtaaaacatacccagtcctgggcctatcgcctagatctttaaaagctccctacatgagtctaaagtgcagccaggtttaacacatctgggtcagctactatgctagatgctagggaggcatatgtgacccagatcaatgtttcttatccttgatgtgttcaggccctcaaaaaatcaggatgttattccagacgcactgtcagcacaggtaggcaataaggttccagcacctccctcaccatcgcccttgctgctcttaactctgggaaccacccatctaggcttaacagaagagtgtcaactgtgagcccatatgtcttcatttttcattaggaagagctggtttctgtagctctcgctgtaactcacagatggtttcattgaattccaccaggtggcacagttcacctggtttgtcgagatcaagccccagcagaagatgccaggggtgagatcatccgggagagcggtaaccaggtgagcagctcctcacccctcctgctgggtttccttgcctccatggtcagctgtgaggaggctggactcctacccgctttccctgggttgaagagggcctgtgtttgtgcttctgctttggaagcagcctcggccagcagggagctgggccctgcttttgaatggctaggtttgacaaggggataagtgggggcactgaggcttgaccgcatggtcctgagctgcctgtgaaaccagcagaggccagcaggcagaggcccattacactggacagtgatacttccagtctcctcacctcagagggagcccacatcagcaacacacagcaagggtcacccgggtgccacggagccatgcattgacccgatgtgctctaataaagagaaacaccggcagcatttgggtcttgatgagagctactttctgacacgagccttcagagctgcctcacattttgtggtctttctgttctgaaagagctggaaccaggattggctacataattagtggggctcggtgcaaaatgaaaatgcaagacccttgtgtaaaagttatttagaatttctacacaacaaaggcaggacattaaaccaagcttgaggcctttccagtcgcagggcgtgtgcagctgtatagatcatattcccatgatccatcgtgtagccataaggctgccctgaatggaaaaccctgacccccaaaaggaccctcagtcatggctgctcgctcactgtcactaaagaacatcctcattccattcctacctcttctctaggagaccccacaattggagggcctgtaggagggaagctggggagggacagacagtacccaccctcaggcatggaccctggtcaaagagaagaatgcccctctctaggatggaatattttgcatcaactttgaaataacattttcacaccaagtgtctgttcctttccctttctcatggaaatccccagtctcatgccatcaggtgccttacagaggcttagtgctggcggcaagtgtgagggtctctaaatcttcctctaatgtctgcaagtgccgctgcgatctgcgggctgcagttctcgagattgaaagctggctgtctgcctgctgataactttcggtggtgctgctgcaggatgcaacaagaatactaatctcaggccacggacaggaggaggtttgcctggattccagcctgctgtggtgtgggccacaggctttaaaaagtatatttaaatgaaaaatgatgataatatggatctgtttggcttatatctaattccaccatgtttaggaggggtagagagctgaaaaggggagcaagcatgttcctgcactggggagaaagcaagcccttgcctactgcccccctcacctccatacagatacacttgacgggatttgaatgcacacacaggacattcactgctctctcgggtttataagtggcctccagcactcagaggtggagcgtccaggatgagggtacctgtctgcttatgccagtgtctgtggtttccctgactcagtgtctcctccaggctctgccagggatcagctgtccctccctgcttatgaagaggccccactccacagcttcatctggtctacctttggtaggcagcccacacacaaaagcgtggtatgaaggagggagttgggctctgatacgagtcctggttttgcactttctggcctgtgagcttgggcaaagttcttagcttccctgaacattcatttcctcattaaaaaataggggtaacttgactttattagttttttaacatgtatttaagggtgaaccgtatgccaaacagctggagacacagtgattgggacagacacagccccagacagtcttgtgcaggatacaagtgattaacagtttccttgaagtgtgtgtgcctgccctgggcctggccgccatgctctgtatcatagtgggggtgggttgggggacaaatagtatgaaccccaaggtatgtgtttcttcagctcctacaaccagacagcttttggctgggtttggccaatggcagttactagaggaagattgctaggtgaaaggaaggggggaattgagatattggcttccctggtgatggcgaatctcctctctggttcttccttctggttcctgggctcaggccacactgcattctccctttgttccttgagcctagggctggtggtagtttcctgttgttactaatctctgggttacttcaccaatcctggttgagttctcaccttccttaatcacctgggaaatcaatccctgcgttcagttccctctgttgaaagaggtgtctgttagatgttactgaaataacatgataagggctacaagatgggaagctcagggtatcctaagaacaaacagctctcaatcaatagaagtagctactattattattgttggtattatcattattgtttatactaatattattaccactcccaaccttacattctctgcttcaagtgtgttctgtttaatcagtgcttaggccctgctcagtgggaggtggaagcctgcaagcccccagtagcagaaaagatgtgtggtagagctgtgagggcagtggagcagctggtcctgcgtgcatggttgggtgaacatcaaagaaagaaggtcccttgggcaggagggtctgggtgaggtgtgcggcaggccagctgagccagggagcacaggcaccaggtaaggctcaaggtcacgtggggatctcagctgcttgtacacgctggcttggtaagatcaggtgtttggccatatagagaggtgaatatcatgctgaggtgatctttcagagaggttatgtgtggcttaagcttggggaaaggagtactggttactgtagagcagactgctggctcaccagtccactggacacgatgctcccaaagggcctaggggagaaacagggtgtacctttttccccaggcttctggttgcagttcagccccaccttagtacctggctccagactttcgtctagcagttatctccatgggtaacattaaaaaaaaaaaaaacttctattttatgtattattttttgagataggctctcgggatttttgagataggctatttttgagataggctttcacagttgggatttgtctgatgtctttctgatgattacactggagttatgggttttagagggaaagatcacagagggacaggtgcctgggcaacatttttcagtcctgcaggcctcctgatgtggctggaaggttctgtgaaagcacttatgtcttatgggtgattgactccaccaacatcacacaccatgataaaaaacgggtttcgactctccagctcttccaggccaatgtggatttctagcttcttgagaatggttgatttagcttcccaagacctcagtggttttatgaaataccgcctcatttctccagaatgatttctacttaacaaaacacctccatgcactgtttaccgtgctcattgtgggaactgctctgatggggggatcagtccccatgatgtcacctcatgactcctgggtcacacagccgctatagatggtggcttgtctgcagaaagggtcccagttgagttttgttttgttcaatttcagtaaccatgcttgtatcacagtggggcccagtggctcctaaggtgagccttctcattgtgtggctccgcagattgggacttttacacacatgcacctgtttccagttccttctcctggccacagcagactgccagcctctccttctgggtgctttgtggcctcctgttttgcctcagagggacacagatgatttccttcctcttttcttggtgcttcatgtcaccagctccgtggctgatttgtctaggacagtgattctctcttccctgctattgcctccttttcactctgagacatctcaggcgcttccaggaagctcagataacttgtggaacgtttaaagcagaattgcttttagttcacttgagttttgttgctgttttaacctggattttgtatacatgttacacagcgctttctggtaggagggagttttagggtggtggcagacaaggcctcaaaatggaaggattaggtgtctagactcagtttgcagtcattggtacaggctcctggctgactcagatatgactcagcagccttgttcgctctggctgggtgagggccttcacagacattttaaaagagaatagctctgtacagacaacatttttcctatcctttgaaggcagaggaatattcagttgggccaggcttaagctgaatatggtgttcaacctgactagactttctgagtcatgaaaatgtggagttgctttgtctcatttgtctcaggtgagaaaacaatatgttttaagatgagtagaaataaattcgactacagctttgagttttatagcttgattaatggggaaactcaggcagggcacggaacttctctgctttgtcaaaggagttgtggctcttgctcagatcctcgtctgtaggttcaatacttaggtgccctctgccttgggttagtgataagtcacgtatgtccactgatgctcagagaggatgccgttgcattcattggatgctaagaatgcaagtttggacttaggtactgggtacagagaaaaaggtttaaacagccaagatccattagtcgactaccatgcctatgactgtgtgtaataccataaggagaaacggcacattagacagggtcccttactcatggagttctaagcctgctggggaggtggctgtgtccagtgataaccatgatacaaggcagagattgaaaagtgtcatgagcaaggactaagggtcacagcagaagttgtcatcttatttatgatgtgcctgagatactgtctgaagagcaaacttttgaccaaaaaaaaaaaaagatcagcagcaggaaaccctgacatatccatgcaaaggtaaattatgtagtcattaaaacgaatagggtggattcatatgtaacaaaatcatctccaagacctcttgtaagtcctacaactcaatagcaaaacaaacaaacaacgacgtaacttataaccggatttgaaaatggtctaaagacttgaatagacatttctccaaagaagatacacaaatggccaacacaagctgggcacggtggctcatgcccgtaatcccagaactttgggaggccaaggcagacagatcacttgaggtcaggagttcaagaccagcctggccaacatgatgaaacaccgtctctcctaaaaatataaaaattagctgagcatggtggcatgcacctctagtcccagctacttgggaggctgaggcaggagaatcacttgaacctgggaggcggaggttgcagtgagccaaaatcatgccactgcactctagcctgggcgacagagtgcagtggcactctttttctcaagaaaaaacaaacaaaaaacaaatggccaacacatatatgaaaaaatactttcaatgtcagtagtcgtcagggaaatgcaaatcaaaactagagtgaaatatcacctcacacctctcaggatgctattgctaaaaaaacaaaaaacaaaaaatgtttgttaggttatggagaaattggaacccttgcacaccatttgtggaaatgcaaaatggtgcagcctctatggaaaacagtatggaggttcctcaaaaaattcaaaatagagctaccatctgacccagcaattgcacttctgggtacttatccaagggaattgaaatcaggatcctgaagagccattagcaccttcacgtccattgcagcattattcacaatagccaagatgtggaaacaacttaaatgtccatcgacagaagaatggacaaagaaaatgtggtacatacctacacacattggaatatcattcagccttaaaaggaaagaaatcctgcaacgacatggatgaacctggaggagctaacccaagttcaataagccaggcacagaaagacaaagactattcgatttcacttatgtgaggtagccatagtactcagaattcatagaaccaaagagtggaatggtggttgtcaggggctgggggaaaggagaaatgtggagttactatcaaagggcacaaagtttcagttaggcaaggtgaataaactctagaggtgcactgtacaacattgtacctagtcagcatgctggaaattttgttaagagggtagatctcatattaagtatccttatcacaataaaataaaaaagtaaaaactgtttttaccaccaaaaactaaaagacatattgttaagtgaaaaacacggatgtagaacaatgcatagtctgatcctatttgtgtggtgtatgtatatataaaatatatatcttaaaatatatgtattgtatatatagtatatgcttaaaatatttctggatgattcacaaaaaactgaacaatggtttatttttgaggagtgggactggtattttccgttttatatcatttcaaagtatttgctttttaaaaaccgtatacttttttaaaattaaaagtgctagtttatatctttttaaaaagggttttttttttttttgctttctaatttagaacatttttctgcacattgtggacttgtctgatcccaagcaaatctggaaatttgttgaaaatttcaagcaggaacataaactccatgttctggtgagctttgtaaacataagtggagaataaattcatgttggcccattgtttccgtctgtggatgtggacggatatgtatgtttgcctgtctttatggaagaatcttagtaagactctcttatgcttgggcctgttcatggaatcaagtttactcattggatttaagaggagacgcatgtggttagattagtggggaaaggaaggggccatccactgggtaggtgttgtgggaggatagatatgttccatgttttataaaatgatgatttgtatataaatttttctcaattctgtagatttggggattggtgtgttgaaattagaagctctttttgtccaaaagaatacctcctgcagacaggcaaatcttttagtaacataattagcacaaaactccatggagagcctgggtagactcagatagaaagagtcccagtgtgctcttcccagatactctacttggagctaagttgcttttctatccgaagagtttctgatgtgctctgaaacgttgttccagagtctggaattgtgctgtccagtgtggctgtgaagcatttgaaatgtagctagtccaaactgagatgtggtgtaagtgtataaattagcaggtttcaaggcctgaaaaaaattatctatgccatctcattaatattctatattgattacatgttaaaatgatgctattttggatatatttggttaaatatattattaaattaattttaccagtttcttactacctttttaatgtggctactagaaatcttaagattagatatttctattggaccgttctggactagatgaatttccagagcactctctcatgaattaggttgcctggccaagctgtctcacttggcgatctttgcacagttctgtggctgaatcctctgcacaagtggtattttcctgcaaagggtttggagtaaagaatcagttgagcaaattgtcattgtcacttgaaagttgaaaaagagctgggggtggggtagtggaggtgtggggatggaaataggtcttttggccctatttttctttattttgaaatgagaactataaattttagatcaataatgcaggttgcatggtcaataaaagagagctcacagaagatggacttgaaaaaaactttgctgccaatactctgggtaagtacaagaagttttcttatttgtttttagcaaaataaacatagaatgtaccatagaagggtaaaaaaaaattgaccaacttttttggttcttggtcctgggcctgatgacgtttgctttaagtttattctgaattgtacttatttttcttcataaaacactttctcttttcatgtttcttataataggtgttggtgccagaaatacttagtattgaagtgttttttttcctaggaagcgctaggctgtttatagacattgttttgaagaggagagcaagttcagcttaagtgttgagtgcaagtctaaaaactgcaaccaaaggaacttccagccagggctgaggaaggtgcaaccagtgggcaagaagatggaccaagaagcgcattggctagagcacagatacctgggctctggttgctactctgtaatagcagagtgaagtcattttatatcaggccagtggctctccaagtggggttcccagaccagcagcctcagcatcacctgggaacttgatagacatgcacattcttagattccccacccagatctacagaatctgaaactctggaatgaggccaagagttaaatccagtttgacaggccttctggatgattctggtgcacactaaagattgagagctaatgtactatgcttttagtctccttggagtttctccttctcaatccaaggggcctttcaactttgagatgcagtgaatccaacactcttcccaggacctatcctacttccttgtagtgaggggggtgttttaattaagtattgttctaggtcacaagatggatggcaggggttttggtggttgttggagtcattgagggtgtccaatatatagcaaccctattcccaaccaagaactgaacaaattgagtaagccgatggaataacagttggaagccaacatatcactgttgttactgataaggctggttgaagggcatggctcagtgcaagagccaaatgggtttcctcatatggaacccaagaattagaagcattcacctacctggtcaccggggactccccttctcttcttccccagaaagaggagaaggggaggagcagaactgagcaagccccgctgattgtccccaaatttactaaatttactatttttttttttgagacaggatcttgttctgttgccctggctagagtgcagtgacgtgatcatggctcactgcagcctcaaactcctgggctcaagcaatcctttcacctcacgctcccaagtagctaggactacggcatgtaccaccatgcctgactaattttttttaattaaaaattttttgttgttgttgaggtgggggtctcactatgttgcccaggctagtctcaaactcttggcctctagcaatcctcctgcctcagcctcccaaagtattgggattacaggtgtgagtcactgcgcccaggctaaatttactgtggaaacgtgctccatctccctggcagatggaagaaggtccaagggagaaagaactcaccctaattgcactctcttctcaaggaaagaaaggctaggagtgggaagatgccttctccccagtgatgaggttgcatttttcaaaacaaatatacctggaagcttgtatgaaatggcacaggtttagtacaaaatattttcatcactgactttgttccaaatatgttatctttgctgaaatgaccaaaagtaccaaaatgtggggtcatgctagagtttggctcataactcgatgggacagctgagactcccagagtgccgcagctggccccgaggcactgttccgcaggactggttacataatttgcagagtccagcaccaaatggaaatgcgaggctccatgttaaaaaattattaaggatttcaatgcagcgaccacagagcattaaaccaggtgcagggtccttccaagtactgggctttgtgtgacctcacaggatgaagccagctcttgctcacccatccacccaccatctgacaaaattctgctaagtgttcgctgcggccgggccacgagtgagagttgcatatatatgtatattatatataattatatatataagtatatattatatataattatatatttttatatatatttatatattatatataattatatatttatatattatatataattatatattatatgtttatataatttataatatataaattatatataaatatatattaatatattataaattatatataatttatataattatatataaaaatatataatataattatatgtatatatgttttatataaattatatatttatatatatttatactttttaatataatatatatacttatatttaatttagtgctataatggaggtagtcctacatcacagatgaggaaactgaggttgagagagattgtttcacttgcccaaggtcaagtgaaggagccagaatgtgaacctcggtctgacttcctccacgacccacgctcattaccagtgcacagttccacccatcccagcatgtcctccctcaccccatcaccgtgttatcctaaataagtgctaagaagtactgggagggggtgaccagctatgccagggaaggctgggctggggtttgggggcacctctcagagaagcttaaaggttttggaagatgaaaaggagggtaatctggggaccttggccttgcttgggaatgtggacaggcttgatagactctaaaggggctgtctatttgattatttagctggttaagttgcacctttgtaaggatccagcctgcttctaaagaccttgctatctcttccttttcatttcctgtttgtgttagaaacatcttactgattattccaacctctctgagaagcgtaataattctcgggctttgatatttattcatcctctctcaagtgaaggaagtagtacaatacacaaagaggcatgccagcacagaggggcagctccatgggtctttgcttgagagagaaggagatacagagaggttaaagtgctgtcattcttcagcaggaccaggccagacaaaaaacctggacccctgtccgagtcctggaaaattgctggctgcctttctaatatgaaacatgttttcctggcctgattatgtaatgtgggataggttgttttctattttctaagattcacatgagctgtcagaaacatttgcaatctccagccaaacaccagtaggttcctgatactctgaggagagcgtaaacctcagcattcgcaggatttatcactggatcctaagggttttgaagctggtagaatagttaaatgcaaaatgccttcagcacccatgcctacacacggctttgttgagacatcacagtgtatgaattagatagtttggaaagaataattcttagccttttgcgggggcgggtggggcctggagagattttcatatcctactgagggacaaaagcgagctgccctgggtcagttgatgcacagttgagccatggaggggaagagattgcaggagacagcttctgttgggtggctgttctcacccctttgtttcaggtctcctccagtcacatacgttttgcctgttagcattcagtggcattaagagtccatgaggagtgaagacagatgggagagggagggcggggaggctgagctaagtgccctgctggcagcctgccacagcctagcgttagcagattaaaactctcacccgcatcttagcctctctcaccacaggacacaagacgaggacactgattctatctccaccaggacagctgcgtcaccaattaattgactgtgataaacaggcagtggtgccttagctctttggcaggaggcgaggaagttcaccttaggtcactttggaaggatgtacgtcgtgagacagagtgttgtcgcttgacattctgttacgtggcaccctcctcgggcacatcccagtaactagtgagagctgctgttcgacacagggaccccaggtccagagatgctttcataacaatagcacatactgagcacagtccctgtgctgcaggctgcactgaaggcttttcttggattctctcattcagtctcataaccattttacagattttacaaatgaggaaactgaggctcagaggtagtctaaaaccagtctgtgactcacttcctaaacaaaggacaacaaaattgtggttggggcattttttagtgtagggttgtatcatcagctattgctatgaaacaactccaaaatctcaggggtgtacaatgataagcatgcatttttgctgactcttctgcagatctattgagcaggctgatctcagctgggctcagctgtgtgtctccaagctgcaggtttggtatggagtatgtgccaaatatcttgtatcctccttggaccaaggcatattctggccaacgtatattctcagggcaatggcagaggcccaggtgtgcgagcaattccaagcctctgcttgcatccaagcccctttgattaactggacatgatatccagttaaccaatccagaaatcagcagatatccaattaatcaaagcaaatcatttcacagagctccaaatcaagaatcagagaagtgtacttctcccacagaggtggcgaggagagaatgaatattgaacaataatctgccacaagggtttgtttttttttttacattccaattctttgaaaacgggtcacctgaatttaatatgttaactatttattaatcaaaatacctaacgaacaaaggcaccttatttgttccataaacattctggttttttttgagacagagtctcgctctgtcacccaggctggagtgtagtggcacaatctcagctcactgcaacctccatctcttgggctcaagcaattctcctgcctcagcctcctgagtagctgggattacaggtacacgccaccacatccatctaatttttttatttttagtagagatggggtttcactatgttggtcaggctggtcttgaactcctgacttcaggtgatccacctgccttggccccccaaattgctgggattacaggcatgagccactgcgcctggcttgttacataaacatttataaagggcccattttatgccagatgctgtggccagttatggggattgagaaatggaagggactgctggcctagtgggggaattagacacatacataatttcagtaatcatgtggtaaaactctgttttcatccatgaagggagtttggtatggagactcagaggaaaacagagaacagtgcttccaaggcagaatgcttccttagacagggcacgcgtttggtgccaggcattcttacttatcaataacctttacctgagctatcctcatgcatcgttttgttcctaatatctccttccagctcacaaaccttcaaggctcccagaaaggcacagagcctgggaagtagcactgtagaaatggcagctaatgttgttttaacatccagattccttaacctggaattaaagtcctttgttacagaccccacctcctgtccaaatgtatttcccattattttcctatatggaccctgtagcagtcagcctcttattttggaacttggcactggcagtgctacctctatgcttttgtcctgctgctcccctgcctggaatgtcccctacctggctaactcatactgctcctctgtgactctgctggacacattccttcccctgagcctggtcagatgctcccctctgggctcccatggacccctctgtgtgcctgttgtggctcagcagaagccacctgctgatgggtgggtttcttgcccagagcatggatccttgagggcagaatccacctggctctcaggaggcgctcagtcacactggctgcactgagcagggttgtagtccagttcctccagttacctgactctgtacaaatgtcctcaacctccccacgccttactttcccattctgtaaaatggggatgatgatacttttataggccagaagtgaagatttaaaaaagacttgtaagatatttaaccaaagagaaataacctgtgtgcacacaaaaatacgcacacgaatgtttatagcagcttattcataatcgccccaaacaggagtcagcccagatatatggtgaatagataaactggcactcccattcaatggaatgcaattcagcaataaaaaggcacaaaatgtcaatgtacaaaacaatgtgagtgactcttagatgcaccagccaaagtgaagccagaccccaaggggtgcagactgtgattccatttataggacattctggaaaaggcaacctagggggctaagaagaggtcagaggctgcaggggcgggattagggagtggctaggggcaggaggagggtgtgacgacagagggaatgtgagtggctgtgagggaacatctggggtgatagagttcttccgaatcacaccacagtctaatgcgtagttacatgactgcatctgtcacagttcagaactgtgtacacacacacacgcatgcacagattttactttatgttaaaacattatatatatattatatcaacaagaaaaaagaaagcattgtaactttcagctcaatgtctggcatgtagtgagtctgtttcatcctaagaagcatattattcattatgattgtttcttggtgctcgtcctcagtaacaagtgagctgctgttggagagactgtgtcctcagcttgaggtgggggcagatttcaggccacaggggaggctggtggagtctggagctcctaggaaccccatttcccctcgaccactagaagggccccaggcgaggctcttggtttaaactgtaccggggagccgtcctaaggagagagaatggacaagctcagaagtcagagatcatttttcccattgattttcggttttctgccagccatggaagctgcttttgatgagacacaaaagcttcccagactgagcctcctgggccgcgccgtgcaccccgctctgggccgctcttccttctcggcagctccatggtggtgcagagtcctcgccaggctccgtggtgtctgcccttctaggtcttctggcctaggagcaccggccccaaatccaagtcctcctgtgggccaggaccttacctaattacctggctgggatttggtgagtgttttaaaggtgtgctggtaacaaacattcatttgaggagttttagaaacacaatcccaaataagcacctttgtccttttaatgagctgaggcccaagtgcccatactcgggttctccctgcagtacagcaggttctttcatacatctcagtgaagcacacaggacccccatactgcggctgtgacagcagggggtgacatcagtcacctggctaggccctggagaaaagcctgcacagcacttcctccaccagcctctcatggtccccgagtcccgggcatcctgcagctcactccagtcggcttatctccctgacctttggccactctcatgctgaggtcacctatgaccctgatattcctggttctggagagcgcacctctaccacatccatgggcagcactgggcacagctgtccgtgctcccatagcgcgatggcctccaagccacctgtgattccaccctcggaggttggctccttctcaacctccttagccagctgcagcgtgtctgcggggactttaaatgttggcatccctcccagaccaatcctgtgccctcctttctcctcccacactctctgttgggatctcatccttgccccaatgccatcatgtgcctggctcccaagggcccccttccagcccagatctctcttctgagttccaggtccagatctcaaacacctcagactcagcatgtccaaaactgaagccttagtccctcaccggtctgctcctgtaatgggccccaccccagtggccagcatcatctccgtcaccgcttgtccttgacaccccctcacttctcatatccaagcagtgatcgtgcctttggactctctgcacaacgtgtccccagtctgtctcctgctcttcagctccactgcgaccactctgcccaagccactgcagtcactgtgatgtagtggagtaatatggggccctaggtgccctcctgtacccacctcccgaacagaggcttcctccataaggctgacagagtggtccttatgcatgcaaatctgtttccttctgcttaaagtcaccccttggtttcatatgaggtgcgtgtctctggcgttgcccttggaggctgcagcctcacattgccctaccctctaccatgctcactcggttgcagctgccttggttgcactctccagcctcagggcctctttgcacaggctgtgctccatacctgcagcccttcttcccatccccagccctctacctgcctgttccctcctcttctccaggtcttagctgaaatgtcccttcacagttcatgcagagcctgacacctcccccgccgtcccacccccatgtgcccatagcactctagcacttacctcgaccgtgagtgtaggttagtcacgtagtaacatgtgtaatgcctgggaatgcctggcagagggcagggcgccctcagtctgtatcctgagtacttagcactgggtctggcactcagtgggcccttgataaatacttgttcagtgcgtggaactggataaggtggcggggatgagttgaggttgggggcaaaggggataggcctgactcacgctaaccactctctgagcccaaaccaagaataccccataggaagccagtgccttgaatgtcttctaagagctcatttcctctgggactctgtcctgctgtcttctccaggtaatgtaatctttgaaatcatctttatataatgtgtgagattagtgtgtgagccccccaggctcactatgtttttgttactgtacaaaagaagtaccaaatggtgttcaccagtgcagctgtctgctcctttaaaattaacaccagaaacttcccagggacagcaagacaatggttttctccgtcagatagtagcgtggatggaagcacataacccattggctagtaaccaaagtagctttaattcaaggtggctttgaaggtttcttaatagaaatgccaatcagttttcctatgctaaatttacaaattgcaatatatttttctcattaaaaataattacctttaatgctattaaaatgtcatactcaagatatataatttcagaaatactatgaatttagtatttggaggatgcagacatgggtttcgcagtgctctaagaacacgcggcatctctccttcagcatcacctgtgctccacacagttttacctctcaattagttgatagagagatttgcttcaagtcatgtacccatgtaataaaagttcttgttgccatatttagaagactatgtccaacataaattccactgccagatctctttctcgtaatgaaccgccatcgacataatgagttccttggaagaaaggcattgtgtaaatttaaaatactaatgagtcataatgataatgaattattttccttgttactgggagcaggactaaccttgggcaacttttccagtagctgaaggtgccttccctcctcccaggcctgccctcccgtgggattctgtactctaaaatatctctctttttctctcatcaaaaccttgaatcacccaaatgtccctgatattaataggaagtcttagaggaaaggaagttgttgacctggttcacacgaagatatgaatgactaaaagcacccattaaccatttataacaatgcccctcctgtgtctgtccagagacattcttatttatttatttatttatttatttatttttgagatggaatctcactctcttgcccaagctggaatgcagtggcacaatctcagctcattgcaacctccgcctcctgggttcaagcgattctcctgcctcagcctcccgagtagctgggactacaggtgtgggccaccatgcccgactaatttttgtatttttagtagagatggggtttcgccacgttagccaggctggtcttgaactcctgacctcaagtgatccgcccgcctcggcctcccaaagtgctgggattacaggtgtgagccaccacgcccaggagacattcttattttaaagggtagctggttatcccgggagaactggtggacttcctaactgagacaagccaagtgtcttaggttttgtgtggtcagaagtaacaagaacccacacaggaagactaaagaaaaaaataatttattagtgggctacaagggcagccctcacagaactcaatggcagagacacagctgggctttgggagggccagggacaggacaggagaacctgtcagcagctaaggtgaccttctgcttctctgggactgttgtccatggactctcatcacaactgcttcgttcactctccgtctctgcttttccttgcatctgggtcacatatggctgccactgagtcacctgtcctccattcagcattccattttcacactcttctagggagagtttgggtgggacagcttggaccaggtgtcacccccctggcccagtccatctgcccgtggactgggcacatgggacaaatgcagcacctggcccagggcaaagactgtttgctttgtttgttgttgttataaacaggatgtgtttggggcctacccctaaaaagagggaatggggcatgtttcccaaagaagtctactgcaccaggctgaggagttttttgcttaattcaatgggggccagagtgttgaaggactttgggggcaggagagtgatgttggctcacgtgttaatgacaggcctgtttggatctgtgtgagctgggcaaggagcaactggcgccatgttcactgaggaaagaatgacttgcagaatgggtaccttccttctccttggcatgggttggcatgcagcatggctacgtgactcaagaaaagggagatgcgccatctgttttccacattgtatgaacttgctgggactttggataagtcactgaacctctctgggattctataactctaattctttcaataagagtttatatatatatatacacagacacccacatatatgtgtacacacatatgtatgcacatacatacttatatattgtgtattattttagcagattattattgtgtttctctaggagtttttttaaaagcacctgctacttggcagtcccctagaggagagagtacttggcagggacaagcgacccagccagccctcctgcaggtgactgggaatgagagctgagcacctcccaggtagggaggataggtgcaaaggggctcaccccagctctcgccatcctgagaggagagaggaggtgcccttcgcaggcagcagagccagcccagccgctggctttcatttcccttcctcacaagagccatttatgacaatccgtcagggcaagctgatgcggcagatcgcttttggcagaagtcctttctacttgtcataaatcacagagaaagccaccggcggtgaatacaaagaaagtccaagaccactggctggaggttaacagctgttagcgacccagggttcaggagactttacaaatccacaaatacgaacaaggcaggctcctacaaataaattgggctgtgaacaactaagaatgctgtctgggatgaaagtcacaactcagaatcacaaatgataatacagcaagagcaggacaaaggcggcctgcccagagaactttccagtcctcacaggacatgcacacatttttatttcaccacaaactcctctgatcctgtgaggtgggctggccagctattatctcctgaaaatgccaccgcacttgcctacggtcacaccgctggtaagtgccagagccagggttcagagggaggcccctggatccacctccaggacccttcccacgatgccaggcagctcctgcgagctggatgcaggccacatggcgggcggtgcaggaagctgtggtgagagctggtcacacagagactccatggcatagcccaggaaagagcccagggctcgccactttaagcccctgacttgattcctgcctcactttggggtaaggggctttaaactctcccttttttgtaaacacagagtaataaacattcattgtttaaaaaaatacaggcatgtataagaagaatatagaaacaataatcccaccattcagagatgagcatttttaacctttcagggcatcactctcatccttgcagacattttctcttcatcttgacacatctttcctcaccaaaatggaatggtggtgttcccaatgttttgtaatttctcattccatatatattaggaatgtctttccatgtcacatacacttcagtgtttttctcattccattagaaatgttatatgtatatttcttgattgaagaaataaccataaagttatatgctcattgtaaaaatactcaaatccaaacagtgcagaaatgtatagcaaaggaaggaaaaattttactgaattccacccttgagacctaatttagcggtattgctaaatttcatcttcacatttttctgtgcacagactggacatatagatgcattttttcttctgcaaagtggacccatctacggtttggcagttttctttttcccttcctgtattcctgtagtgtggacatcttttcctgtcggtacatgaggctctaaggcatctttcttccagtcctgggaaaaggaacatttggcttgaaggatcctcggaaggagggactgcccctcaggtggccacttgccctcttgtggggggcgggtgcgggcagacagtccccacatcagtcctgcaggaccccttgagttggggcttcctgcagccccctcatgggatgctgtgtgctgcctcaggtgtgtacattctcacgaccggcctgatccctgtgctggagaaagaacacgacccccgagtggtgagttgaccttatgggatgttttgaggataatggactttgctcctgatgggaagtcagtgggcctaggtttgctgcctgactgccctaagggggccattctgtccacatccacagcaaaacctcaattctgtcagggggccgagagggaagtggaggcatgccaagagcacattcagaccccagccctctctgaacccccccaacccccgacccccactccggctgtcacgtgggtgtcggcaaagcactggggagggaggcctccgaagggcaggggcggcttgtggggtgctcaggtcagggtggtgctgctcttcctggggactgtcctgctcagaggggaagggactggctactggagcctgttctcccccagcgggttgaaatataaattggagaaagcaggaagaagacagttaatgtaggctgccttctctctgctgtggtgggcagaataatgatctgtgccacccccgacccgaaagttcatatccttatcctagaacctgtgactatgtcacctttatatagcagaagggacttggcagctgcagttcagttcaaggccttgggatgagaagcgtgtcctggagtatccaggtgggcttggtggagtcccaagggtcctcatgggagggaaggaggagggtgcgagtcagaggagaagtgactatggaagcagagggtggagacgtggctgtgagccaaggagtgctgccagcctctagaagttgaaggcaaggaatggagtctcctctgagaccggcagaggggacgcagctccgctgacacttggattttagcccatgagccccacctcagacttctgggctccagaaccataggagaatacatgtaggagaatactgtagagtacatgtaggagaatactgtagaatacatgtaggagaatacatgtaggagaatactgtagaatacatgtaggagaatactgtagaatacatgtaggagaatacatgtaggagaatactgtagaatacatgtaggagaatactgtagaatacatgtaggagaatacatgtaggagaatactgtagaatacatgtaggagaatactgtaggagaatactgtagaatacatgtaggagaatactgtagagtacatgtaggagaatactgtagaatacatgtaggagaatactgtagaatacatgtaggagaatactgtaggagaatactgtaggagaatactgtaggagaatacatgtactgtaggagaatacatgtaggagaatactgtaggagaatactgtagaatacatgtaggagaatactgtagaatacatgtaggagaatactgtaggagaatactgtagaatacatgtaggagaatactgtaggagaatactgtaggagaatacatgtaggagaatacatgtaggagaatactgtagaatacatgtaggagaatactgtaggagaatactgtaggagaatacatgtaggagaatactgtaggagaatactgtaggagaatacatgtactgtaggagaatacatgtaggagaatactgtaggagaatactgtagaatacatgtaggagaatactgtagaatacatgtaggagaatactgtaggagaatactgtagaatacatgtaggagaatactgtaggagaatactgtaggagaatacatgtaggagaatacatgtaggagaatactgtagaatacatgtaggagaatactgtaggagaatactgtaggagaatacatgtaggagaatactgtaggagaatactgtaggagaatacatgtactgtaggagaatacatgtagtagaatactgtaggagaatactgtagaatacatgtaggagaatactgtagaatacatgtaggagaatactgtaggagaatactgtagaatacatgtaggagaatactgtaggagaatactgtaggagaatacatgtaggagaatacatgtaggagaatactgtagaatacatgtaggagaatactgtaggagaatactgtaggagaatacatgtaggagaatactgtaggagaatactgtaggagaatacatgtactgtaggagaatacatgtaggagaatactgtaggagaatactgtagaatacatgtaggagaatactgtagaatacatgtaggagaatactgtaggagaatactgtagaatacatgtaggagaatactgtaggagaatactgtaggagaatacatgtaggagaatacatgtaggagaatactgtagaatacatgtaggagaatactgtaggagaatactgtaggagaatacatgtaggagaatactgtaggagaatactgtaggagaatacatgtactgtaggagaatacatgtagtagaatactgtaggagaatactgtagaatacatgtaggagaatactgtagaatacatgtaggagaatactgtaggagaatactgtagaatacatgtaggagaatactgtaggagaatactgtaggagaatacatgtaggagaatacatgtaggagaatactgtagaatacatgtaggagaatactgtaggagaatactgtaggagaatacatgtaggagaatactgtaggagaatactgtaggagaatacatgtactgtaggagaatacatgtaggagaatactgtaggagaatactgtagaatacatgtaggagaatactgtagaatacatgtaggagaatactgtaggagaatacatgtaggagaatactgtaggagaatacatgtaggagaatactgtaggagaatacatgtaggagaatactgtaggagaatactgtaggagaatacatgtaggagaatactgtaggagaatacatgtactgtaggagaatacatgtaggagaatacatgtactgtaggagaatactgtaggagaatacaatgtgttgcttcaagccactaattttgtggtcattggtcacaacagcaagaagcactgctctacagggggtgaagagtggaaggggtcacaggctttagtttgtaaatctctgttacctttattgcagataaccgtctcctcaggaggaatgttggttcagaaactgaacaccaatgatctccagtccgaaagaacaccatttgatggaactatggtctatgcacaaaacaaggtcagtgaggtgggtttcctgagactgcattttacccacgggctgcgagggcccttttccaaggaaagcttactctgggatgcacattaatcggaccttagtagttcatgcagcacctgaaaatgttccctcaccaagagggctcccctttggggagcacagctctgctcagacccatgtgggctttcagcagcatcctgggaggagccacaaagccactgcgtctcctctcggtgtttctcagacccacacagaacaggatcctagcagggggatccattgccctgtgctgctcagagggaatgaggacggcgagcggtccctcctctctcctttgggcggctcttggcttcccggaggctcactgggaggggcggcacattgaattctgagggagggaaggggccacagtccagaacccttgactactctgaacagaaagtagatttctacagatggagcatccttcatctgaaaatcccaaatccaaaatgctccaaaatccaaatcatcttgagtgctgacgatgtcacaagtgggaaatcccacacctttgctttctgatggtttcatgaacacacattttgtttcatgcacaacattattttaaaaatattgtataaaatccccttcaggctatttgtaaaggcgtatatgacacataaatgaattttgtgtttagatttgagttctatccccaagatatctcgttatgtatatgcagatattccaaaatttgaaaaaatctgaaacttgaaacacttctgggcctcagcatttcagatgaaggatgctcaacctgtactgctgtatctctgcttattacagctatatttaaaagccggatatatataacttccatatttacagttcttgcccttaaattcacccgctagggcgcccacattgtctgtaaggctgccagcaccctccgccttccttgtcgctgctgtgtgccttccgaaggtggccctgtctgagactctctgcacctccacttcttctgtttatatgccctgggtgtgccccagttttgctccttgaccccagaccaaatcctggtgaattacatctcatgactccaaatcctgacatttgaaagacctgcacttctttacagttttcccagaggacatgggaataaaccatccacttgtaaatgaggcccagagatggagttctttgccaagcatgatcaaactaccctgggatggggcaatagtgtgactgcagctgggaaaggggaggatttaaggatttttattgtctataactgatgtattctctgtgtctagtacatttgctacactctgcctaaggaaggagttaattcatatatactgcaacctccatctccttggtttaagcaattctcctacctcagcctcctgagtagctgggattacagctccaaaatccaaatcattttgatttgcccaccactacacccagctaatttttgcatttttagtagagactgggtttcaccacgttggccaggctggtcttgaactcctgacctcaggtgatcgtcccgcctcccaaagtgttgggattacagacttgagccaccggccttaattcccatattagctgaacacacaccgtatgccggtctgtgctgggggcctgaagtacagcagtgaacaggacagttaccacccctgccctcagtgagcagcaaagaatagagtcacccaggcgacttgtggacgaggaacacctgggcactgaggggtgtaatttcatggggggtgggcctgctattccttctctctcagtgttttgctgcgttagctcattgcttgttctggcctcctttggagtgggtaggacctgctaggtcctactcagggctgctgagtaaagactgattttggaggagggtgacatcaagtggccgtacatactgcagagtccagtgtaagataagccaggctgggcagggcttatcccctgcccttgcacctaatggcgcctcctctctcctgttcaccccctcgctccttcctgtccagaggcagcaagtggttctgacggagcggtgggcccaagggcacccggccatccatttttcttccatgcatcctggctgggccgacaccccaggtatgtcatagcctttaattgctgagccacttacgtttcatctaaaaatacctgagcagccgcaggattgactctccccaggaatgacctaaaaccagcgtaatgaggactgaggagtagcttcatttccatttaggcaggggcgcgttgggactgcagctgggggaagcctcatacagacacagagcttttgcttccagcttgccctgtgcaagtcagggaaggagatggtgggaacgggagcaggtgcgcctggggcgccctgctaactacagcatatcctggtgagagagggagccggtgaccattgtcatttccacgtcagacaggaatgagcaggagctgaggaaggtagtgggagaggcccagactgcctcaccactccccaggtttttggaaataatgatgcatgaaggtaaatgccagccacaaggacacagctcgaatgatctggaagcgtgttggagcagcggtggaggggagcagaattctcttccggattggcctcaccaactccatgacctcaggcagctcacctgggctctctgcagctctttcctcctctacaaacaagggaactgaaagcagcagcagccacagcacacaccccagggtgcacccgcggcgccaagaactggtctcagcgctgtctgcggattaacgcatttgtcctcaagcctctgtggagtggccactactgtctattatcacacccatttacagatgagggaactgaggcccagagaggctaagacctcccagccgggcctggccatggggttttgggaatcaggctctcacacactgctggcatggcctttctgaaaatcactatttatcagaagccttggaattcatcctaagaaataaagatagggaaaacaaggttgcttatcacagtgctggtggtaggagatgaagttaataaattatagaacacctgtgcaaaatctgttcagggctgaagactctgctgccaatcatgcctatggaaaaaccctgtgtgcactatatcattaaatgaagataccaagttcctgaatagtacatgcctcatgatcttatttttgtaactaccacacccctatagaaagaggtgtgtgttggtgctttgtggcatctcatggagaccagcttggagatttggcagaaattagtcctcacctgtacagatctgagtctcctgtcttaaatacagaaaggatgttctcagcaaagtatactaggggagactcagcctgggagtgctcagagagcatggcttctcgattcttctcacggcctaatgggagacatgcttggttctgcctgtccagggtgaattctaggaggccatggggggcccccagcctcttaccctccaaggacaccattctgacaatcccagcatcagctcagatgtttaaaatctgcttggcaagcccaccagcgggctctatcatctgggtcaaggtgcagtttaccatgtgttgttcagaggttacagagcagctctcaggtgcacacaacctgtctgtggccacaggggcctgggagggctgagcatgcggacatgtgtcaccgcggagtgacacatcacaaggttttcacattttttctttttgcctatcagtttatcctgatttttctacagtaaacaagtattgcttctgtgaaaagaaaaaaagatgtttatttttaatttaaaaaaggagggcttttgcttaggtgatcctttctagctctaaaattccatgatctcagtaaggctcttaattgttgttttctctggtttattttctttccttggcttcgagagagaactattttgtttcccaatgtgctcactgtggagacactgtgttccctgaggtctgtgggaaaatggggtgtggactggagccagagcgtgtggctgggtcctcgaaggcgtgggcaggtagagtgcccgacgctgtggcacaggccaggcccgggaggctactccaggcaaacacctccctgtagccctgggatgcagagggtgggacacctcgaggggcttggcagaggaagtgaagaattctttcctcttatctactcctccctaaaagaggaaaacactaaaacagtccagggaaccaacagccaggatcctctgagcctagatggtttgagagggctcctgaacccaggagactaagtggtttgctgggcccagcctcactgtgagccccacagctcattagaatcctctcttaggatggaaagggagggctctgcgggcgactctgctctcagggctgggctgggtgctggtgccccggggacatggggactcaatcaggcctctggtgagcaccactttccatcaggtgacaccttgggggctttgtaacaaggttctttggaactggttccgagtggcttgggtgagtgctataaaatagaaggagcagtttatgatcccatttcatttttgcacttttttttttttttaaattaagggaagtcaaccacatttgctggagaatgctgtcctaatccgcctgacccttccttctcccaggtgtgaggcaggcgatgccggggttccacgccaggttcggggaccgcctgcgctccgaggcccagggcgcggacaccatgctgtggctggccctctcctctgccgcagccgcacagcccagcggccgcttctttcaaggtgacttcctccctggctgtgaaggcagctgacacagggctaggggcagcagctgggccttcgaggcgcaccttcccctccgtgaaacctggggtgggactgtcccctggggggtgcctgggcttctttggcgagatgattgctttgcctgctgaggttagttttgggaagcgcttcactccaggttggtagcttctttggagacttgtgataaccctgtcatcaaggtcctgtgagaacgggagaggcagttcctaccttgggaatggaagattttctctgcagtttgctgaggcccaggaggggcgctattcaaagctgcactgcaaagggagtaacggactctgcttctctgcagtgcaaagggtgtaagggactctgcttctctatttttggaagcagtgatctgttcacgtctctccccagtgggctcctaagggggcaggcgtgtgagtggacgccatccgaagacagcacttgacctcgggtggaagccaggctctttgcttggcttctctttcctctgttcttgatgagaaccacccttgcttgaggaattctgaagcgctggtgacccctggggtatccgggaggatggccgcaccccttcctgctgatcacccaaacgtggtctcccgtccagccctggctgcagcctcccagttcccaaactgcactttacatatcaatccatgctgcctgatccctgtgggacctttgacagcagggatgggggtctaacagctgtagggtgctgccactccagcaggcgtcggttcaaggcctgagcagcacagggacatggacccagccacgctgcagcagctcacacctctctgcggttccctctcacttttagatcggaagccagtttctacacacttgcctctcgctacagcgtcctcctcaccggccgaagaggagaaactcattgaaatcctggaacagctggctcagacatttaaataggccaacccagacacagtgcggtaccagaattgccttagaagataccagaaggtgcggtctagggaccagtgaataagaagaccccacttcaacttcccctcgaagacgttgtgcctcacagcgaggcctacaagggatgggaacttttatttcaaaataaatactaccgaggctgtgatcaggctcaccttgaactcctgcagcaggttcttttcttattttaagtctcatttattcgagaatggttttctaaagaattcgaagtttgagatgaaccatcatttcagtcttaggggacgcaggggtgggggcagcaggaatgcccccctgtgaactccacttcccctccctttctcagctcctccagtgtcagaggctggcgctgtgcaccccccccccccccccgccccaggagagggctggacactgcctttactgtgcatggtcccagaagcacagcataaccaagggacgatgcatatttacacaaacaatttaatgaggcctagtttacatttgcttaagattaggagtggcttcagtaatgcatctggcattctggtactacactttgataaaacctctaatttacaccattttacctcttagtgactccaggaaaagttgtaataaaaccaatgagcagatttagaatacatctacatacattcttggtgtccatggtggaataaacgtaactcatcccccatagcagaggaaaacccagacggctgcagcttctcagtggtcctggagacactctgatccagggctcatcatcagccaaggaccacaaggaagggatttttctgggtgtgccagcctgaaacatcagcgtctttctgacaaaaggaggcgctatcaagcaagcaccagctccatttaactgcatgcctccttttctgcaggaggatgatgggcctcagcaatgctgggtgtgggcgacgctgtgctggcagcaccaggacggggcaacccagccaccccctcaacggtgattccatagcatgcaggtcacttggtgcctttgcacctatttttcttctccataaaatgaacctcacaagttttaaatgaggctttccctggcagtgtttgccccgaagtcatttctcctcactggaaaagtttactaagcacaagaaaaagctgacttacatgatgaaggaaaagggctccatggcttgagcccgtgtgctgtgcttagactgtggtgaacagggctcatcttcacctccaaacagcagctctccctggcatctagacagcaggtggagtggtctggaacctccccctcccaccaactggacagaacccacagggctaaacagcacagcaaggttgtcggtgtgtgcgtggccacatgtaaccgtgatgggaccatagctgcagaaaggttttcacagagatttattttaaaccgtggcggcaactccgcattgagagttgtacattggtaatggctacacgtatattttggttagaggaaagcacagtgggaaagtgagcggagtaaaaacattcacaatattcagcagcatttgattgggggcctggatacagatgtttcaatatcctaggaaattcttgctcattaccacctaatcacattcaggaagtcaatgtcaggactggcagggagtgtggcaaatgccggaggggtccagctagaccacacgggagaaatctgttccaatgtcaggcttattacattctcagcctgaccccctgaagaatctcctcactttaaaaaaagaaagaaaaagatatccatacggtaatatgcccactgcagccaggtccagacttgggctgcagtccggtggatgtagagaatggaagatccgtgtccctggttagaagtagagcggtgggcaggcactaatgtggggccagcaccttccctgttgtccagttagtaacggtttttgtacatttcatataaagatttccttttgcaaaatgacagcaccttgaaaaacaaagtcatttaaaaagcaaggcaaatggtgtaagacacaaatccataagagtacaatggttacaagtgacgctagggttttggccatacttcatagtggcatatactactgacgtaaggctgccatccactaaaatgataaaaagtgtatatgtgaaacatttttcaaatcattttccctttttttgtgagtgacagctcaccttctcatgcatccccgagaaccaagggaaaaaagaatcataagtaacaaggtcagattctcaatctaacttttcagccaacctgcaattcttgacacttccaagaaagtcagatactcttcttgacttgtaaaggtaaacattttgaggtatctatttttaatgagatggtaccatgattaatttccacccttaccatctttaaaaagaattttttttgccctacaaactcatgaaaagaaacttcaccatcttttctcaaaaccaaacctagcaggctctagatggaaaaagtccagaaagcaactcacttgatatgatggaagacaacaaaggcatgtggtgataggctctccgttatccaagggaagccagcaatatgcgggcaggtcactggtgatgggctaggcatgtccaataataaacgagactcagggaatcagagaatcacaggattggaagggactttaagaatgatgatcaaattcatccctcaagcctttaatctccctttcaacatctctggcaaaggctctacactgtgtgttaaaaaaattccctggtatgggacatgcaaggaagacatcccattccaatttaggaccgatctaatttttagacactgctttcatgtgttaaacctaagtaggcttcttggtggaaaggagataatgcttaaaggcaaaaatacaaaccacaaccctggagggttgacgtggttcttggttaagaaactgagctgaagtttaaacaggaatgcagatgtttctggactaagttttggacatagatctttgggtcctacaaggaaaaggcaaatgatgtgatagcaaagacaggcgctgccatgcccctgcacggtgttcctgcctccacagggccaggtctcccagacagacctgtacctgaattgacgaaactctctgccttcctgttgcaagtgcccctgtaaggaggacctcccacattgtactggaatcatctgtgacttgcaagagcaggaagtggagggcagcagctgcctgtgtctgcacccaaacactcggcaccgcctgtccgtgcaacgccacacttgactagaacaatcctctcctgccacagggccagggctttccttttccacagtggagcagctgagcccaacacacctttggcgttagtctgggagtccttcctggttgcgggccgtgcactgatagtctccacctcctcctctcagactccagtgagaggctgtgcacccaaagatccagaattagttaccctgagtcaccttcagttaacagttctagggatttccaaagaaaaagaaactgatactattataatataaactaatagtagcattggctgcaggaggagcctctggggaaacccctcgtggtgagctgtgtgctgctttcctctgaggccagggagcagcagcatctgatagtgacgagctcaattctgggatggcagctgagccacttggctgttctccggcagctccagcccacttgtgatccctggacacaccacactgactccagctctcaggcctttgtttgtttatgctgtttctgaagcctggaaagtcatttccatttttcccccttatgactcactcctcatcctttaacactgagctcaaagtccctttcctctgtgaagcccctcctgccacacctgctgggttagtggcaccctggcatgcctctatcataaccacattgcactgaaaagacccatttactcactgtgtgacctctgcccagcctgagaatgggcctcagacaccttgcactgccagtgcctaaagcctggtggctggtgagcgctcaacacggttgacatgaacattcaaatctcagggatcatctagataactcagtgttcaacatgatcttaatttctgtgttttccaatcaagttaataaatatctgtcttcgtaccaggaaaaattcaatattattttaaaggagaaaaaataagaatgtattggtaaaatgctttctctcacttcgaaatatcttagtgaacaagaacactgacatagaattaaaattctatgaacagccataaccaaaggaatctcatttagtgaatatttatgtccagtaactgcaacccacacttagagctatccttttgcttaaaaacaaaaatttgggccttaagaagtgattaatatcaggcaaaaataaattatacttttgtttatttattcagggccttgctctgctgcccaggctggactgcagtagtgcaatcatagctcactgcatccttgaattcctgggctcgagtgatcctcccgcctcagcttcctgagtagctgggaatacaggtgtgtgccaccacacccaactaagttttgaatttttggtagtgacaggatcttgctgtgtggcccaggctggtcttgaactcctgggctcagcaatcctcccaccttgtcctcccaaagtgttcagattataggtgtgagccatggcacctggcctttacttttataaaatgaatctcagaaaatgaaaatgtgatattccataagggcagtgctgtaagcctgggaatcgcagccaaacggggcagggtgaattttaagtgccactggatttccatttcagttttgcctctggggtggtctgaggggaatgtataggaaggaatttatgtggatgaaggcaataattacctcccccaccacagggccggagccaaaaaaactgtcatatatgctttcgataagaggaacaaagctggttccagagagcgccctgtctcaaggtgctgaaagtctctcctcccactcatgccattactaagtaatgttcaaaaacagctattccttgaacattcttttagattctcttgtttacatctcagccatatctaactgccctgtataactaatgtgttttctgcttgaaacactctagatctctgaagatcccttccagttttgtgactttatgatttctggaaataattaaaaccaaatgagaaacacgttatggtggattgaccccatacaaaatgacataagattccaaatgcttaatctcaaaccattttgctattgtgaagatacactcaggcagtaatgtcaagtaatgtcattcgtttggaggaaccaagaacatgtggttggttttgccccatcaggtagagaacaactctgcgtatgatatgtgtagatctgccactttctcagcgcaggcatgttaggcattatttgtaaaagctgctatatgtttaagtaatagagcaaaaatatatgtaaagtgcaaatccaacagggtaaaacaagaattatgagagttcacctagacagaacaagagccaagtgctggcgccagcttttactcctaaggaatggagcctccatttccataaaatgcttggaagacacccaacaccagcacatatttctctacaaattacaaaaatgggggagacacttaatgcaaaacgcaagaattcacagtattacaaacacacagttggtttgctaaacgcatttcaccaaattcaagcacccacacagatgagagaaaaggaaagagcaatggataccttgacatatctggttttctgatgatgattctcaacaccagtgggctgtgaagtggcttcagcctctgagtggctctgtgggctgggagggagaaggtagagtggcgtgcaaggtcacaggccagagcgactgtagaggacatatgtgatctgacggggacactctgcttcccgaatgaggtctgaacgcatctagacccatctcagaacccatacaggcttgctgggcgcctgggcctttgctgccctaatactgtgttcctctctctgccggcaggccaagctcaaagtttaggaagggaaaatggagtgattcagctctattactcatttccaacacacagtcctatattacatacaacttagtaagtggctgcagcttctagtaataaactacaaaatagatatttgaatattttaaatttaattcccttgttaaagttctctcaaagagcaatcatgcagaaaagactcaaagtagttacaacagttttgactgacgcaagcaagggtagtctggaccagggcagcgaggcgacaagtgctaacagcctgtgcggggcatgcgtgtgtgcctcttcagagctccggtcacatgggctgagccggtctgatggctcaagtgacagcttccatgtaccgtggctgcatggggcacatgcactggtcctgcttcccaatgctggggcagcagaatcacctctagcaaggccccatcccagggaaacacacgtaggggcagtacctgaggacagcttgtagtacttccccctagttagagaagtaatgaatgattgtgagggcaaaaaacggctttccaggaaaagagggaaaataatagggaggatttcaatttcactcccatgtgtattactgccaaaaaacctgtaaaatcagaagagagcaagacactgtggggtggggcttgggtcgggaaggacaagcaattggcctgtgatcctcaagagactggtgagctccctgatgctcccgacacgtgaggttgaatgagctgtgcgtgtaaagtgcttaggaggggcaggcacctggcgcaggcttgccattaatttttattctatttttacaggtgaaaataagatttttaaaagggacttcaatatcctgagctgaatcactacacacaagaatatttcattttctcaagcttgactggattcccttagaaataagagttcttcaggttcactttctaaagtcctcttttccattcccacagaaacatagcctgcactgtaggtaccattctgtctcggaccacccacataccgttttagtaagaaagtgtgcaaagtgttctgatgaaacacattaggataaaatgtttaaatatctagtttttaaagggatagaatacagagggcgaggaatacagcaggattacaatcttgccgtaatgaacatgttcaagttcagagatgatgtcacacagaaaaacacaacttaaagacacttattttcagagcatgtatggtgggggtccccaaccctgggctgcagatgggtactggtccatagcctgtgaggaatgggggcacccatcagacgtgagcagtgggcaagcaagtgttactgcctgggctccgcctcccatcagatcagcggtggcgtcagattctcacaggagcagaaactctattgtgaactgcgcatgcgagggatttaggttgcgtgctccttatgagaagctaatgcctgctgatccgaggtggaacagtttcattttgaaaccggtccctgctgccaacaaggttgagggccgctgatgtaggattttgtgtgtgtgtcatttgttttcattgttacgagtgagggagagctgcgtcaaaaaagctaaaacaagaggctcaggaggctccaactgaattctaaatgatccaggcactgatcgttgaagctctgagttaaaataatctacttctgtgataaccatggttgggagcagctttctcacagcatttttttttttaatgtgggaaagacagaggcaactgaggcagaaacacagtcttttctacttcataagaacgtgaatgaggcagacattacaaacaaatcgctcttcaggcaattccagcagctggctggtgaatccacatgatgagtttccaaatctctccactgaggaggacatgaaagcagaaacactgggaataaataacataaatacatcccctccaggaaaggcagagaaggtgcaggtaggtgcagagggaagagaagaaaaagccgctggccacgtgacacatgttgaagtaaacacagaaagtataatgaccaaaatactctgagtagatacctcccttatttctctgacaaagcaacaagtaaaatggggtgttgaaaagtataaaaattaaacaccccacacagatttttcggtacactcaaaacaatgcagcacagccagactgtataaaccatttgttaaaaaaatagcttcttttatattgtatgaacaagttggaagagtccccttgcgagtgctcactggccaggtccccactgtgcacatgggtaatctgcaaattcattcagggtctttagtttctttcttacttctcacatgtctgctttaccactctggtaatgatttgggttaaaacaaccgtttctttagtaaatactatctttctgattcctgggagagtcatcaagacacgactggggtcatatcccacaactgcaaaaagaaaaagaagatacagaatgaactaaaattgtgttgaggataacagtccttagaactgaattcttcaaggaaatttttttcatttaacaaaccaccacatactatactaacatgatttccaaatctgtaaaatatttttttcatcaaaaaagttcaaataaagctcaaaaacaagacaatgacagcttgaaattttgatgcagctcatgaagaatcatggcagattcaatctattaatggctgagaggactgggaagacaagctacactgcagatcctcctgtgagtcactaaaagggaaatgctgcagagcactgtgtttacatctgaggcagcattcgatgagccaacatgaaagcgacaatatagatttgttccaccctccaaatagattgaatccattaaataactcaatccattaactggacgccaagcacgtgctgtgtcctttccatttaaacttccaaaccattttacaagatacctcgttttcaaaaataaaggacctgaggctgccagagtttatcctattttaattaattaattattttgagacagggtcttgctctgtcacccaggctggagtacagtggcacaatcatggctcactgcagcctcgacttactgggctcaagtaattcttgcacgtcagcctcccaagtagctggactacaggcaggaaccaccacgtctggctaatttttgatttttttgttaagacagggtcacactatggtggccaggctggtcttgaactcctggggtcaagtgatcctccgtctcacctcccaaagggctgggattataggcgtgagtcaacacacccagccccagagtttattttaaacttcctctcaaagtcacggagatctggtagcttccaaagtgggttattttagctatctcatcctgctgtgacctccaagaatgggtcagggaggtagagctcagtgtgctataaattctcatatgtattaccgttttgactgctacatatgtgacctattacagtctttttagtctgtcccaagtagactatctattccttgcaggctggagctctgtcttatttctttgtgtagagccagtgcctgggatgaggctgtgcatgtatcaggtttgtaataggttctcaaaaacactcaccttcaatggtaacttttttttttttttttttttaagagatgaggtcttgctttgttgctcaggctagagtgcagtgatgtgatcaaagctcactgtagccttcaactcctggactcaagcaatcctccctcctaaatctcctgagtagctgggactacagacacatgccaccatggccggctacccaaggataacctttagaacagtgcctcccatgttcttggtgctcctgtatatttatatgaggccaaagatggaaagcttcttaataagatggcatcttaccttaataaccttgtcagttccagaagtcagtaaccatcctctggttgcatcgaaatgcacatgcacaatgttatgtttactgtcatggaaggtggctgtgggtgcacgtctagaaggagcaaagaaagcttctgaggggaaaaggtggtgacatatgaatgagagagatctaggatgacattaggctctaaattttggcctcgtggctaaaactgcttcactgacaggaatgctcctcagatctgcctttattccctggtgaccagttatgataaaaaaaaaatacaagaaatcttatagtctttaaaatgggaaagagatgaaaatttctaaaagtccttctggagaatgttgctccaatggtgtctgtgataatctccacccgagcttttaaaaccacagggcttttgctaagtttgagctcagaaggacttgccagtaaaatagtctaattaaaaaaaaaaaaaggaccaagatagtactaagtgtcccatgatattactaagtgtcattctaataggaaaactatccccctccattcatttttcctttttcactggtatgactgaagacttggtttttctatagtattctaaagctgtaacaagcaaaacaaaataaaaaacaaacatcattattttttacctatactttttttttttttaagtaagaagacttgtcagctgcctaggtgctctagaggcaatgcaagtgcttccacagagaagaggcagaagaaacagaggcgggaaaaggtgcagggtgcagtctaggagactgctcttatcatgcttcaaggggcccactccactgcagtgggctctcaggacaatttttttttttccttttttctatagctaaatctgcaggatagatcttcagtatcttaaaatggttactttaaatttttagaagatttaggcttaactgtaagtcccttaaactcttaaagtctatgtctttagctacaaaatgaagaattaaagtaggctatctctaaggtctcttgcactctctaattcaatgagaaaactctcattaatttcatcacgtatgatgagtagaaaataatcaatgaacataaatgcatacttatgcaagggcatcttattttatatttgatatggataaataagactacttatgattttactgtaatacaaggtgctggaaggattgagaagacaagctaccctgcagatcctcctgtaagtcactaaaattagggaaatgctgcagagcactgtgtttacatctgggggcagctttcaatgagccaacactaaagagataacatagatttgcccccacacctccacagcacaccaaggggtaagtaacctatgtcctgggttactgggcaggtctgacaagcagccagctgagtaactgggcaactgggaatatttgcctcttgggtaaagcgacttagctcttcccggaaaatgaaaccttctggacccatggactcactcaactcctgtaaagataccagcttgggacagaaagtgaatcctgagcccttatactcctgggtaattctcaagtaaatgagcagacagaagggtttgttctgggagcagctaatttaaaggcacataacctagaaattagaaagaacacagagatgaattctttgagtgtattttctcttctctcatctcacaggataccacaaatctcttggtggcaaaggagagcttttactgcttgccgtggactatattctaaaccagcagaaactagagcaacctgagtgatggttgcggcgctgagtgcaaggctcagattaaattctcgccttaacctgaagcggtctgcaggctgcaggaacttactcttcatctgtgatggcctcgtggcagctgtcacagaccctcacttcaaactcgaagcccatcagggggatggaggagcgcttggagctgcacttgccacagacggccttcccacacttgcggcagtggtgctggaggagggagataaaatagatactcatcacggctccctcagctcctgaggcccccgcatctcacccctcctggcagagaggtgtaatcaactgcatccaggtgaggatgctgaacaagagagccccagaactaaagggaacacattggatgtgttcttctctggggctctgtttattcaacaaggactgttgggtaacacacctgacagggataccaccccactctcctgctttccctactcttggtcctttccaatgatcatactaggaactacagaggaaccacccaggggccaggtgatcttaaagcggggtgtctgagaaactgccgtctcaggagattatgctgctggatgaaggagaacatgcaggaaacctgattgaatctgctgactttggccatggtaagcctaggtgacctaacatttgatttccttggggaagaccaaacagaaccatggaatcagattgaaaatgctgtattataagtagatctaaataactaaaattaatcagaaggagggaaagtaaaataaggagagagaaacaccacttatataatttcatggtctggtttccatacgaactaagcatgacacctctaattgtaaggtgcactgcaatagaggccaacagaattctaaaatcacatccctaactgcttactgggaaccaaccactacagaaactgaatccagtaggaatgggctatggtagacagagtaaattactgtgcaatcacgaggtgactccaggataataatttaccctcaccacaactcccacccaggggtgttatttcttctaagatcacatggttgagctatttccatataattacattttgatgaagcatccatatcactcacctgtcttagaccaattttcttactgtcccacatttgcttgaagttccagaagaaaggctgatcacacttttggcaggaatcactgtccaaccattcaggggtcttgtcaaataaagcacagaacaggtcactgtggccagcagtcaggacaatggaaaccactgaccctgatgaaacttatggagctatcaggatgtgtttaaaagaaacagaggtgtgatttctcagtcaatcattcaaaaaatatttactgaatgcctattctgtggcaggccctggggatgggatgtagtggtgaataagaatctccaccatcatgaaaatatgattaataattatttacataagcataagtgtgtgaaggcccaagagggagaagcacagagtgctttggcagagagatcacaggagcctctgacccaggctgaggttctcagacaaataagacaactgagacctggggatggctggagcacagatggggaaatgagagatgaggctggagggggcagtattaatgtttgtttgtgaaacaatttctcaaataccagcttattaccattaaaattatgtagtaaaaacaaataaatatttaaagacatggaacatgttcaatatataataaactaacacaaaacccccaggttattaaatagtatcatagcacagagttaagagagactaggagaagatatttataaagtttgtaacaaacaactcctgcaaattactgtatacaaagaacccctggaaaatcaatacggaaataacaagaagcagttgagaaaatggcagatgatacaaaagatatgagcatgcaattcacagtcagggaagtctgaatggctaacatatatgaagagaggctcaaatttactgttaagcagagaatgcaaataaaaatgagatactattttacctctgtctccaaaagggcaaaaccagaaagggagggaacaatcactattggtgaggatgtgggatgtcagaaaactccctgttctccatgagaagtataaatgagtacagctgtttggttatttagcaaaatcaagaatataccttcaattgatcccactcttgggtttatggccctgagtctcatacagggcaggtctgtgacgggacacatataagaaggtcatctgggcactgtgtgtggtaccagggagtttgtgccagtctacacgccctttgtttgggaaacagagaagtaaaatgtgaatggtacacatgatggggtcctatgcagaagcaacacaagaaacagcaggatgggagagctcaaaagggttcaatggcaaaagttggaaatagaaccagactaacagtacatcaattaagtaaacttttttttttttttttttttgagacagccttgctgtgttgcccaggctggagtgcagtggtgcgatcttggctcactgcaacctccgcctcctaggttcatgcaattctcctgcctcagcctcctgagaagctgagattacaggcgtctgcaaccatgcctggctaatttttttttttttgtattgttagtagagacagggtttcgccatgttgaccaggctggtctcaaactcttgacctcaagtgatccacctgccttggcctcccaacagctggcattacaggcgtgagccaccgtgcccggctgagttatgtaaactttaaaacacacacacagacacacatacacacacacacacaccttttataaggaagcatgcgtgttcaggacacacatcaaacacatcacagtgggtatctgtgaggaggcatttgggagctaaagaccaataaaggggaaaaaataaatcagcatgtttgtgattctattttttgttcaaaaaaaagtcttacacacgtgttatgtgtagagaaaaatgttaggaaggatgtgtgccaacatgttcagagtgatatttctggatggtggtagtatgagtaattgacatcttttctatttactaatgagcattttgtaacttttctaccaagaatgttatatacaatatatacttttaaaaaatgctaaaagttaacaaaacaaaaatggatttcattaactgtataaaacacctgttcaacctatgcaatgtcactcgatctacatccagccactcaaggtcttccattgtctgtccttatctttcagctagctgccatcctctcatctctgactgcttctctaaaccgctcatgagcattaatgcactgcatcaacctatcgtgttcaccttgtccttactcttgctgtttcgtggcctgcaaagcccatgtgctcctgctcagagcacatccagactctgttgatccttcagcacaatgttcctccctcaatccttcactgggaacattagccaatgatgactccatcccttctaaaatacccagcactgatgctctagcatatatcaactataatttcatcatttacaccatttaatagaattctgaagtttcctcctacaagccttttcttccagaaagtctgtcagtacttcaggttagagatgacttcaatatatgtcgcagacctcccaaggtgagcatcacacagcacttatcataaccacgaagcagctccacagaggctaagatgaaaacaaaaatctcaggaaatttatgtttataaaaatgatacttgcaaaaaaatgaatggaaccatctccattgcttatttagagtgttgactcactgaataagattttaaattagtcaatagtattggatgcctctatatctgcatatcaataggctcataaacaaggttgctcaaagaactgcccatcaaccacttggtttcatctctggacaccacactgttatcttcctttggcctctgtccataacgggtccaggctacgtgcaccaaaggaaaagaattgggtccttctcccctcccctggtttggttaggagggcccagaaagaagtcaggacagaccaggtgtgactgtccctaacccaaagcaggctaccgtgcagaacccaacccaggacataatcaccagccatgcgggaacatggttagcatgaccagcactcatcacaacgatcccagcctttgtattaatggtgccaaatatagttttcaaaagcaatgttctaccatttcccaccttctaacagtaatgatcattttgattagttactaatagaagtcccatggacttaagatctgagcaaataaagctttaatcttcttaagcatataattactggcatttgaaaaggcatgacattgtgggtaatagcgactactctcttgaaatgagactggggtgagggcacagaaagaacgtgggagaccccttttgtctttttaaaatgttgcttttctatgtaatttttgtatcctgcaagaaattaattataagaatgtgcattgtcaaagggaaagtctacccagaataattctaacgtaattggaaaatggttaacttcaaagtacttgtcaaaagagatatgcaggaaacatatttgttgttaagatgctcaaagattaaaatgaaagctcataaaaaagaatgttctgataacatgtaaatacgtgctagaaaactaaggatatattgatatctggggaactatttagaacatgacttataaagtacaaaataattatttctagtatttctattaataccaaactaaggattcttgcttcatcttagccactattttcttccatgacataaatcacgtgagtcctccgtttttgtagtgcattttataccaaaggactaatcaccaggaaatagatggtttcttttcctcacctgtacttttgctgtgaatggtgtaacagatttaaacagcttagtctcagtcaaaattcttatgaactctccatcacagtaatgttacatgccaacttgtgagggaaaaaaaaaacaacccaaacaactccttttatgctacaattctttaacgttacatgccttatttcatggtttaatcataaaagaaataagaaataagcaggaagggaggcagggccagaaccacagggcccaccccaccctgctgtgccacctacctcctgcctctccacgtccatgttccagacgacaatcccaccatcaccgccacaggagatcaattgtcgcgtgtgctgtgcataggagagggcctggactctgtcgctgtgaaagaaaccaagggttattgacagtttaggagaacaaatgcaaggcctcgcagcagaaaccttggcaaagtcagccaatgtgctcactcactccgagcccccagtgtagatcttagaaacctgttggaattttcagcatgttaaaggtcagaagagtatccaggatttaaaataagtctgaatgctcctggcatgttcaggccccaggaagaggtaatctgtcagttacaacttttttccttttttaaggaaaaaagctgattgttgaatgggctgtaacttcttactggttccctccttccttaagtgatcaaaatgtgtagcgtatgttcatttcacatttgttcaagagtcatgatttttccttttaaaaaattatccttgaagagttttggaggtcatccattgagatgcccactggatttacctgacacagccaggtaaactgtgttgcctgaggtgtgcacctcacaagtggcttgggaccaggcatgcctttacttggctcccagagtgaatccatagcagtaacagacttgaatttcacaggctctccatttctctagtttttactctctctctcctgattctgttttatttttctttctagtttgtgcatggctgacaagttattccctcttggcggcaaaaatgatggagaatctagttttatggtctgagtgattgctagcaatggattacagagatctattctctattgggtgagagaatagggtacatagtttcttggtcttttttttttttttgtatgttcgtctattttgagctcaaatcaatgaagaattttgtttctactgggaaggagaacagctctttgatatctggactggtgatttttttgtgtttctatttattcttgatctgtggctgaagttgaaaaactaaagctattaagctgtgtgtgtctatgtgtttataatccagaaaagccttcacctcttgctgtgtgtggaatgctttcctatttccagagggtgtcaataaattggattacgataccttttaaattaaaagaacttgttctgattgtttgataaacaagtgcttttataagttgaatcctcctaaaatcacagaacatcaaacctctaatattttgaacctgctagacttaaacataaaaattcttttaatagaaactgctagccaattcagtaatattttaagaatccaagttcataaaattaagtttcatttggcaaatgagactagtaacataggttttaaaatgttacatctttctctgatttattagtgttgaacagaatacaagtgtgcattttatttttacttctcctaaatttattcaggatagctggtcaagtgaactcatacataatgtttaagattattaaaaatataaatttgtgttcagctgaattgaataactattctgacaaactttttatatgaatagcaattatgttttgtagcgtatcaacttaaagataatttccaaggtctttaggtaacaaaatggactaatgttaacctgagctaatcaataatcattggatacctagataatttctaagtaagttagaatactgtgactttgattataaagtataatattaagtttatatatgtttgcttcttatttttctatgctatagtgaggctatacctttgagttgtgtcaatacaggagttcattttttgccactttaagggaatgtaaaagtgccttatgtcactatggaaatttcagtaatgtgtgttcatgagttttgctagtctgctaaaatgattatatgggacgatttccaattgtccatatcctccctcctcctaattttctctatgaaatataaattagtttctctggttaattattataatttaaatgggtggttgagattatgccaggagcattaatgaaaaagaaatacagtggtttttgtttttcaaatcaaaacagggtagctttgtatcaaagcagtggttcttgaactttttggtctcacaatccctttatactcttacaacttatttgacgacaccaaagagctttggtttagtaagtgataatgatcgatatatacttaatttggaattaaaactgagaaatttttaaaatattaattcatttgaaaatagcaatgatgaatccatttcattttaacataagtcacatattctgtaaaaaaagatattttccaaaacaaaaaattttgatgagaaaaatgacattgtttaatatttttgcgagcctttctaatgtctggcttaatagaagagatggataatcatctttctgcatttatcataatcataatatcacttatcatgtagcttctggaaaactccattgtatactttcgagagaatgaagatgaaaagggcaatactaaagtgtctatttgttctggaatatgaaagagaaaaatgaaggacaaaacttggaaagtcagttttacttgctttggcttataatactttagtctgaaaaaaaggtataagatgcattacaattttggctaagttccctcagttttgatggcttgcttccttactttactgattaatgcctacaatgtgaaaggatgttctttaccttctgtggaatctgcctagctagcagacattctgtgtctcaccagaattattttcagtgctttatgttgacttgattaatgctcttaagaaaaaaaaaagagagagagagaacaaggagtactcacgtgtgaaaagaattttaaattatttaaaattgtgttatcatctatgtttatttttaaatgttttaccgctttgattatataaccagacattgcttcttaaacacctgtgctcctgtcttaccctacttaaaattcccttgacaactcttgttagaaataaagctcgaagtcacaaatgaaatgaacactccaatagttgatttctcagcaaggcaaagtttacttctgcagaagggtgctgctcattagtctgatcacaagagcacatccaacaaaggaaagcagcagctttatcactaacgcgttggctcctactgctgtgtccagtccccactggctagagttggacagcacaatctaagccgaacacggttggctaacttgagaagtgcagggatgtggttacaccggtggaaaaacagttttggcagtcgggggagggggcgttgtgatgggaggggtgatttacagagtgagtagcagatgtggaatgtgggctctatagataaagactgagaggaaggttgtttcccagggcaagggaacacagagagtaagagagtctggccttgaaagcagggaacaaaggacaagggaaccctttgaagaagaaggtcttactgtatacaactctggttttgcctttccaaactgaacctctgttttgaaaaaataaaatttttaggatgtgttttatgcctaagatttcccagagaggtcctagaaaatcataaagacttgttccctcatcttacaaaaagagaaatgtggtgaggcgcagtggctcatgcctgtaattccagcactttgggaggctgaggcagaaggactgcttgagccaagaagtttgagaccagcctgggcagcatggtgagaccctgtctctacaaaaattaaaaactcagtcagatgtggtggtacatgcctgtagtcccagctactagggaggctgagatcagaggatcacttgagcctgaaaggctgaggctgcagtgagctgtgatcataccactgcactctagcctgggtgacagagcaagaccttgtctgaaaaagcaaacaattttttaaaaagaaatgctataaataattgcatttgtttcatgtgttactatgttaagagtaaatgggaataactgtcagatcggaagagatcctcagcctgctctatgttaagtcagtaggtaaaacattttattagtatttcagaaattacatgttttattggaagactgtggagatttcctgatgtcgttattgtctataatatgtttttacccttggggaaatactgatcacaattcttaggaaagagttatatagcatatcccaatggggaattttactttccctcattctgatatcattggtcacaattacaaattaacccttacgttacaaaatctctataatctgtagataatttctgtattattctgatccttgcctgaaggctctgctatagcatttgtgacttcaataaaggacagcctcagagtttcatggaaaagaactatttgtactaagtattttaaaatattgatatttcaaagaacagactctttggcacaggccgctgagctgacattgcttagataatttttaagctgtgccagcggattgagtcaggatttccttggatttctggaccctttttagtctggatgcagatggcttcttgaatgtgaactgctaaaccaagaaccatcagaacaagaattaattacagttcattcatagaactgaatgaacagaagagggaaattttattgtggttatttgtctggaatactgttgatgttgttttaatgttctattttctggatatatgaggatgccttttctctattttaaagctatctctaacccacaatttcgtaaactctgttattataagttaaatcaaaacatttaagaaatgatacccaattctcactcattgcccagaatttaagaaaactattacagagattccttaattttcatggaaacatagttatttgcatcgattcagtgagaatctatccgcaagatataactgggcaaatcaactttataacctggagtgtcatgtgtgagaatgatgctcattgaatcagatatgactagccactttaagaactcatacagccaacttacaaagccttcccaggaaaactggcctggtacctgatttacagggtcctggccttacagctggtaaggaaggtaccaggccaagaacctagcaaatggtggaaactttgaggaattcaactgttgttgcaaatactgtaggtgaaatatagtagagtttcttgggcttggttttctagccttggtatggcaaattttagaggctttgaaaagtccagttcagcagtggctcacgcctgtaatctcagcactttgggagttcaagaccagcctggctaatgtggagaaaccctgtctctactaaaaatacaaaaattagctgggcatggtggcacatgtaatcccatgtaatcccagctacttgggaggctgaggcaggagaatagcttgaacctggaggtggagattgcagtgagccaagatcacaccattgcactccagcctgggggacacagcgagactctgtctcaaaaaaaaaaaaaaaaaaaaagaaaaagaaaaagaaaaagaaaagtccagtgcaagattctttataaaaacttccaggtagaagtgaattttgtgggcttaacacaaaattgttgaatactgtgtggctctggatatgcaaaacaaatccgagtggcctatatggttaattaacactctttactgtaccaatataaataatcaggactaacctcataagaccagcctggtttttttttttttttttttttttttttaaatgaaggataatcactgagattattacgatcacaggggaggaggggggaagcacagtcagataaactgagaaagatttgaaatgggcaaaaagtgatcactgggtatcttttcagcggaacttcaggtgttgtctagcacacttttctgggctatctgattctacaggggactacaccttttagtatttttactgatctatttacaactcttaaagaatactgatattactgcaaacaaatcttgtccagttaagacacacctaatcccacactccaccctgcccatgggagaagccagctgtgcgtctgctaacaaattcattttcacattctccattgcctatgtatgtgtctactctttggattttcctttggactgcagtaaccacttactttgccagttaattaattattaattaatgcctaatataaaatctttgacatgtattcatttttttaaaagccaattgggttttccctatctctcctggttgttatttcacactttttaaagtatagagtgccaccactgtgacactcaagggcaagaaaaatcaatctagttgcacagactcgtaactctatgatttgaactacatttcatttgttgagccatcttgatacacatcaatgatcttgtaaaaccaaaataagctacataaggaactgctttgccactcatagctggcagcaacattcagcaacaaatacataatttatgggactccagtgctgttaatattccaacatagaagagtgaaacacagtgatgaatgctggattccaagtttgataataaagctgctctgggacttcttgatttagggattcaaaatataaccacctttcagttaaaagctaggtgagggaacatcccaggtttacacgttaggggttacgaagaatgaacagataccttctaacattcatgtttcagctgacatcactgtagcgtttatactagaaagcatttcaaactggtcattatttcatggatgagtgttaccatgtactgcactgcaaatgctcttacaagtgcacaaagcccccacttttcacaaccaccaggatctgccatctataaatactacagttagtgggatggcctcatttcctttctcaccagtcctagcagcaacatatgtctgtcaggtccaaacatataattggagggactagtgcaaaatgaaaatacagagtccctttaaaaaacttgattaagaattacaagatggtggcagcagctcattaaaccaagtgtgaggcccttctaagaatggggccttgtgtgactgcacatgtcacatgcccatgaagccagtcctgtgtctgatgattaagggagagggtagagaagaccttatcctttttagagaaacagatctcagacacaagctaacatctgcccaacggtcaacttaagcctttcttcatccctcaagagtaaggggaactcaaatgtatagcattgttcatttctttgatgaaaagtttaggttatttagtgggcatctaattaattatgcttctactaccagagatctcactctcctatatgcataaatcttccaagctccaaggaccagagaaggctgtgagcaatccacacaagtgaggtctcccagacaataatatgtagggtcatcccaagccaaagcaccgtaaaagggatctgcttcctcagggatccttggcccactgccaggctaaacctgaactcagggacccccgtctgggggcactggtttgagcaccagcgatgttctgctgtttggtggcagggtggaggttcagattaggctctcgccctctgtccacttgtatttcctaaacccactgtattttagttcatgccattctctgttctgggtaacctcctaatcctgagaactatgagaatctcttcatctaacatcatccaaaccaagagtgacccccgcactgaggcctcccactttccagtaaaactggcgaacggtgccacctttgcctattttcatacttctagcacgtctccacaaaggcagggctatttcctaactcacttttgtgtcctgagtacctaacacaaagtctggtatgtagctggagttcagtaaacatgtgttgactgagttatgaatatatgttaatatttccataggaaattctacagagagaaacagtagtcagatcccaaggcaggatttttgacttggaattttttattaacaagagtaatcttaacaaccgccatttaacaggcctgtactcctgggctgattattttatatgcattacatcatttatatttttttgacaaccttgtgagggtttttccttccaattttgtccttattttagagataagaaaactgaagatcagaaaggtgcagtgcctcgcctgaggctgcaggccattggcagaagggccagctcaaatatagtttgacctgactcagaggcctgcacactaatgaccacattttccagcccttctgtctttgagaagattctaccttctatgaaaactctcatagctgatattttgatctattatgtgtttagctaaatagttagaaataaaaaagacacatctcgtcccctctatcctaacagttccctagcaccacagtgggaaatgctcttaaatctcacagatttgagcagaaagctgtcatttgtactgatccttgtccacctgtcctctaacccagaagctgaatgcaagaattctactccttttataactttcaatgcaatttacttgatacaaggggaaaagcacaaattctctccatgtatatttatttacaagtggcctatttctttaccaaaaggctttgaggactcttacaacaaaattctcatatgtggtaagagtagtaagagagaaatcaagagcttggattttggaaggagaaagcaaatacacagactggaagtgccaagggtcatggctgtgacctagcctcacataagctgctgaatccattcttggtggagggttccaacatgaggaatagcaaagatctttactggtgctttaagtcaggttatattaaattaccatcaagtcttagaaggataggaaaacactattagaaagaaaaattacgggcgtgaagttggtcaagaaatgacagtattatgtaagaatttaaaagggttctaaaaagaccaagtaccgttattagctatgacaaggtaggcatgggacaataagtgtccaggtttatgtttcggtaataaccatccaactagtaactgatgcttgcaaatataactggtcccggaatctggaacctttttttttttgcccttcctcccacagagctagcacagcatacaatcacgatccacttgctacagggaataaatacaccagaatgcttccaatgcagataatattgtataaaagaatactttcttagctttttttcccttggacttggaaacagtttcactgtcatcaatcactttctttggtgctaaagctttctctgctttatgggatttttacacaccaaatcaagctagttataaaaatgtcacattttctgttgctgaaggatggtaagaagctgtggaactcagaacagaagacatgtgcagctgtccctcaacagaatggctggacatttccataccaaggaaaggcagtctccctatcctggggaggccagtctgctctccccggtttccaggctcaccaattatgcccctaatttggaactatggccaccatcagtcactttaaccaggaactgtaggaaagcaaagggcagccttgaggcctaagcatcagcacacatcaccaggcatgtcggggaccatgtgttagtcaataaatgctcattttagtatccccagtgccttactgagggctgggtatacgaaaggtgctaagcagctccctgctggactcaattaaggttcagagacctaagctaccagctggggtcttaatactgaatattaatattgaatacctcaatattctcttctaaaaatgatatctgagctctctcttttatagtgttattgcaagattgaacggagtctgtgtgttttgaaagctctttcacaaaatattaggtgtactcaaatacgagaatcactgaatgccagcagctgactttcagggtaaaggaatggcggctgcgcaagttgttccctgcctgcctgaaagtggtctccttttctgccagatgatcccgaaaccttctttccatgccatctccctacttctggcagctccagggacttctctatccccaccctggcattcagacccactctaacagactgacactgactgatgctgaggaagtttaaattaaattttggaggagctggctctgtgataccagagcaacccctccccggggttaaaacctgatgacaaggagtccctcatagagctcactttatgtattactaagcttgaattaaataaagcaccaggcaaaggccttctgcccttcatcctgtgtaaagccacttctgcctggtggctcctgatctcagcagcctgcctgcttacctgtgcaagttctaagggcatgattctatcagcatggactccaagcagggtctattccattttctaaaaggacaagtctgtacttagaaactggaagagctatttgttaaagttttatttttctaggactgagagacttatctaaactttatagcttttcctttcgtaacaaactgtaggcgtaagtttcccagaaccacattttccattcaggtcaagggccctttgcacacagtgatgctggtgttaagcactgctgcagttcagcatctggtgcatgaaatcgtgcaaaagtgcttgcagtctttattaaccactgcgtacaaataaaactagttaggagtgaaatgaatgagtccagtgaatattagtcatcttcattcaagacctgcatttcacttctctgagagagtccaagttggcaggaatttcctggcagattagatgataatagtgttattaaacacaactgtgctttggcttttttttttttttttgagacggagtcttgctctgttgcccaggctggagtgcaatggtgtgatctcggctcaccgcgacctccacctcctgggttcaagtgattgtcctgcctcagcctcccgagtagctgggattacaggcacgcgccactatgctcggctactttttgtattcttagtagaaacggggtttcaccatgttggccaggctggtctcaaactcttgaccttgtgatccgcccgcctcggcctcccaaagtgctgggattacaggcgtgagccaatgcacccggccctggcttccttttttcttctcttacgtggatgatgtgaactccttctacaggacctggatgtgtgttcccttgtcataaagataaacgtaagggaatgattcctctaatgaactgatgacaaggtctgagtggccccacaagccaggagtgaccccagacagctgttctgttctccaacatgagaaagaagggcttagtagctacttctctaacactaaattctaaaactaaaacaagtatttgtacacaggccctgccatccaaaatttaattagtttatgtccaacaactccaaactagatttaactatttaggagaatattttgaaactagggtttccaagcagatttacaggaaaagctagtgttgcttaaaaccggttagttcatagaagcattacaaacatttgtttatggctgtcaagggttgctcaatatcattttgaaaactttacaactaaaaaacaattcagatgagcactagagttgtaaagcagatctaacattcttttatgcaaaaagattaagctttggccccagggacagcaaggcgtctcagggtgtgggctgagggtcaccagtggggagttgcctgggaagcttgtcaaagcacagatccacaccgctctggacggcaaccagaatcttagcagacagggaccggacatctcagagattctctgtacccagcaaagtttgagaactgctccaaggaaatgcaaggctttctctgtacttcctctcagccccctaaaatctatcctttaaggaaaaagagcctgacatgaatcaaggcaagtactcaataaatatttggtcaagtacaaaatgtactgtgaaggatcttacctctcctcttttccgtatgctgccaaggagcttgaagccacatttgaactcaattatataaattttgtaagccttcacagcttgtattttcaagcttttttttttcctcactctcaaatttttactgttatattcttcccagttctaatttttaccttttatttattcactgccattactttattttatggtttttgtaagcactctcaaatgctctgtggaataaaatggggtataagtatataaacacagttttacacagttataaatcaaagtggccagtatttgtgttcccgccatgttccttcccatgctaagatcctgccacagactgggctgcactcctttgttctagctgtcagctgagaatcttttctcagagtctttatgaaagcaccagcaaccttacttgtgtccttggagctcgatggctgttccttttctcccaccgatgtcccacatgatgacagagtgatctgaactgcctgagaacaacacccgctggactgggtcccaacagagagcggtcaccccacctgagaggacagacacaaccagacatcagtcacaaggtaagactcttacccacaaaagaaatgtgaatgcagcggagacagaacctagtgcagttcctggcatacaataaattcttattgaaagaacaatcaagtaagtccccaaagagaaaaaagttggctccaaggaaattcccaccctttaagcatttttcaccaacatttcatgtaccataaaatcaattactgtaaagaccaaaagaaaataaaaaagacaataaattgaccttcaaaagggagacataattctaagaagaatggaaaatattgcactgtttggaaatattaaccacattttcttaactgctgcctgcctcccacccctgacaataacagatgagaaggaaatgggtttacaaatgctcaattagattttttattcttgaatatcagatttaattaggccacaatatcagaatttaaaattatgtttgctctttgggaattttaatttacagattccgggcaaacttcttatgttcttaaatgtcagtttcctcaactgtaaaatgcagatgatggtaacaccatgaccactatgactattactaagaatgaaaacatcaacccagccattacctacttcatacggttgtggtgagaattagatcaattacataggaccattctaccactctaaacttgttgtgcagtatagatgtgggttattaggattactgtagtggtatggctataaaatattataatagattttctatggtagtccctttgtaaatcaaacccttatatactgagaacaataagaattttttccacttaagatgtgcacaaagcctgcaaacacttaagaatgtcagaaatactcattttttacattattaaaaatattatattctgaaaagaacataaaatagcttctcatttgttggaatctgacatttttcttattgagattatcagtttgttctaatgaagtgctacacttaagagctttcagggaagtttctctcatacatttgtttcaggagaatactttcttatttgtcatatgactcttcttagtaagacattttttaagatcaaaaagtagggggaaccccaaactctactattctggattatgcttcctagcgtcttcctaaacctgcaccccatgctgctggtatacactcctgctcatgtaagaataaacatggcttccccaagtgcatatgtggttagccactgcatgtagcccagccctcacccccgaccaccaacattccccacaacagcaaccaaacacagtgatggatgcagacaggccgctcactgtgttgtctgttaaaatgtattgtctgctgaatgaaggagcagatgaatgcaaacataaagataattttctccacttcacacaagttcttgcttaaaggtcacctcctcagaaacatcttccttgactacactcatcactctcctgattattctttttttttttttttttttttttttttttttaaattcattgtctcctgccccagtagaatagaagctctaggagggcgggaactgtggcttgttcaccacgggatcaccaaaacctagaattctgcctggcttacccacagcaaacactcaataagcctggacaaatgggcaaatgattgaatgaaggagtaagaatatgaaagaaatgcccttggctttgttcttggcagattaaacaggcatatgacatctattaatgggttaatattagattaaatgggttaattagattaaatgagttaagattaaatgggttaatatatataagcacacaaaacagtacctagcgcatgggaagcatgtgcctggctgactactattgttaatgtgatgcctgcatctgttcgactactcacatctttaggtcatggcatacccatctcaaggacaatctctgagatggtctcacttgactgactaagccactccaactggggggctagataagagaaaggtggcaagtgtttgatttcccctatataacacgtgaaatgggtagcttaggttctttaaggcatcattatcagatttaataatggtgggcactggtaaaaagaatgattagaaaggcttacttgactcagttaaaaagacttaattggaagggttgttcattctgtcagaatcaacatggaaatattgaaatagggcttaccatgacccaggtgacagatacctttagacttccctgaccgatatatacctacacatctaagaacactacaccatggggccgggtgcggtagctcacgcctgtaatcccagcactttgggaggccaaggcgggctgatcacgaggtcaggagtttgagaccagcctggccaatatgatgaaaccccatctctactaaaaatacaaaaattagctgggcgtggtggcgcgcacctgtagttccagctacttgggaggctgaggcagaagaatcgcttgaacccaggaggcaggggttgcagtgagcagagatcacgccactgcactccagcctgggcaacagagtgagactccgtctccaaacaaaacaaaacaaaaaacactgcaccatgaggagccagctctctgccttctttgttggtgactatgggatgaggatggtttatggggatagaagagaaagtttggatatggtattataagtgtacaggctctggaaccagaatctagtcttaaatcccagccctatctttattaggtataggaccttggacaagttacttaacgtttctgtgcctcagaagtctcatctgtaaaacagggatgataatagtacctaacccacagtattgttgagattaattgggttaatatatataaacacacacaacagtgcctagcacatgggaagcaccactcaacaaatgtcagctatgattacagtacaggagacctcatctatacaatctctgtgacagtgtcctttgttgagtcagccttaaggccagtcagcttattctatgctatcccagccatcatgagatcaattaaggtcttaaaaacaagaccaatctctagctttgccacattatatcaggccagaaggggtcagggctaggaaggggagttcttggcaacacagagagttaggaaggcaaatagataaactggttaaagcaagtcagggtatattcatcagacactcccagggcccaaagtggaagagatagaaggaaaagctgcaagacaagaaaaagtttaggatggtgtagggagtaaataactctggggtcccatgcctgctctatataaatgtcctaacaatgaggtcatttgaaagttggcctataaatgataaatcacagcattcatttcaaatcagttcaacaagcatgtattgagcctcttctatgtggaggaactgtgctaggctcagcagatacaatgaaataagacttacattctacctaccaaaaatgtacaatgataagatgatggattacttttgagaacagaagagcatgcacgttatgtttggtcgagccattctcttacgggatatgtgactgcttcccctgtctggagtgcctgtcctgccttttatcacccaagtaactttttctccctccaggaagccttcccaacaccttcaatccaggtgaagttccagtctctgtgcatatctctattgctacacagaccccactatattgaacttggttggattataagtctgtccccaccgcagactttgggttatgtatctttgtattccagcacagcacacagtgactggtatgcaggaggtgctcagtagatgtttactcaactgatctgctgcattgagtggcagagagaaataggaggacaataagcaagaggcatccaggacagcctgggatggcggctggtgggaaggctgtgcaagacatcaggatcagagatgcagtggggagagctgctgatggaaacggcctctcccttctgagggaatttttcctgcatctctctgcacacagggcttcctgatgaactgtatagttctttctcctaacacttctggcagcagaggaagtcaaccaccttcagctaccctgcattccaggcagtgcagacacatatctcataccccaacccacactgggggcagagcccagggcttcaatgcttgtggttttccagtgtttctattttaaatgacaaaaagcatttcttccatttcatttgacttcatttcaagttaatccatctttctggtccctttcagtgtttcattttatgcttctcccttcctttgacctccctaatatgacctacagaataatttttaaataaaaatggtttaattcttacaaataaagttttctagttattctttagtgggcacaggtcttctattaaggatgatgaagaagttctggaaatggatagaggcaatggctgtacaacactgtgaatgtactttatgtcattgacttgtgcattacttgtacacttagaaggttgaaacggtaaagttcaggttacacgtattttatcaaaataaaaaaatcgccaaaatatttttaaaataaaagttttcataattatacaatgtatactactatatactctcataaatataactgttagtggttggctaatatctcccacgtatgtatcttatttcaactatttttagatttttctcaacttttaagtatgaatttttctaagatgaatatttttacacatacaattttgttcaggtttccaattagttagaagagaatcccaaatgtagaaatgaatcagagagtataaagatttttagaaatttaatatatattaccaaaatgcttagggaactaatttttttttgagacttttaccacataccttgcaaaagtgaatgaccacgtggagtgttacaaaatcagggttggaaactgctgggtctgcctttcccagagtgtgatctggtaacttagcagagggagtgtcacaccacaccctcaagggtaatatgtgcaggccaacatgaggctaaaggagactaagagcctgttgaataaaatatctgaccttttgattgctgcattttgctctagagtgaagtgacaagggtttttgtcaagctaaaggccctccatctctagagtataccttcttcctgagatccataactcttcacccagctgtctctttgctgccaccccagggaagtgttcagttcaagcacagtgctattgtctcctagacctgctctcccagcagtactccaggtttcaggaaatgccatcaccagccaatacatgctctagacagaagccttgggagtcactgctactccatgcagttaccaaatgcggctgacccctgttctccaaacagatcttaaatctcctccacttgtctccacacacactgctgtcccccagtccaaacaaagtcagctttccaagggactccagcagtagcctcctaaacagtctccctccatccattctgttcccagtcaatctaccacctactgctgccacagtggcttattaaaatgcaaaccatgtcactactctgtttaaacttcatcactggtttcccgccaacctgagaataatgcctgaagctcctaccactacttgtaaggtcacttgcctttgtgtggttgctaacattttcccactctaggctgctgttctgcaggtctggaatgttcccaccacctacataactcctttttctccttaaggtgctatttaaacaccacttctggctgggcacagtggctcacgcctgtaatcccagcactttgggaggctgaagtgggcggatcacctgaagtcaggagttcaagaccagcctgaccaacatagtgaaaccctatctttactaaaaataaaaaaactttgatgggtgtggtggcgtgcacctgtaatcccagctactcaggaggctgaggcaggagaattgcttgagcccaagagatggaggttgcagtgagctgagatcgtgccactacactccagcctgggtgacagagcaagactctgtctcaaaacaaaaacaaaaacacacttatttgggaagcctccctttaattatccgcaagaggagtggaccttttattatttgcttccaaagaagcctctgtgcacatcagggctccacggcacctgctactcataatgtttggatgaattctctgtaactactggtctaatgcatgcattccatgctggctggaagatggataagggcaaagattatgcttgttttattcacccacatttcctggcaccatcatatacatagagagcggatgactgactatggatgacaattcacatctcttgacctgcactttatataaactggatctgtgtgagtctccactgtaaacaaaaattgaagttctaaactatatgaacttgcatctttacactgaactgtgactttcttagtttgtttagttattcttgttatagttacactgtttccttcaatgagtcccctaacagctcatgaacaagtctgtatttaattattcattaattagtatgctttggcagatttacattcaagccctcctgtttcaaatatgttcatgctaataaaataatttcttagaaataaaagaaaaaagactgtattaacactattaatttccagtggtcaaaatatgatttttggccacgtacggtggctcatgcctgtaatcccaacactttgggaggccgaggcaggtagttcatttgaggtcaggagcctggccaacatggtaaaaccctgcctctactaaaaatacaaaaattagtcggccatggtggcgggcacctgtggtcccagctactagggaggctgaggcaggagaattgcttgaacctgggaaatggaggttgcagtgagccaagatcatgccactgcactccagcctggacgacagagcgagattctgtctcaaaaaaacaaaaaaaaaattctcctctgttcaagttactttacgactttttcatagaaatacattctactttctgcagaaatagcaaagaactatgatatccggcatttagctccagaaagaaaaccagtagagggagcataagaacataaaactagtttcctaaatccctagggattagaaaaatgttatgctttggcctttggacatgactactaggtcgattccctcattaacccacatttttgtatgaccttctgtactgtaagagagaatgatggggtgaagggctacgactctggacacatactgaagacctgtctgcttctgagtttggatttggagtgatgggacctgcaaagctgccctttaatggaactgggttaactttagggtgttcattttgtccttacaaaaatctctttcccagaactgagacttgctgtgtttgggacctcccagggcccagaacgagcctactacttaggaagagctcaacaatatgtctaaatcaccatggactctcttaaaggtcctcactctagctttacaggaatgagttgtgttgtagccacattagtgatgggcagatactactgtttaggaacaataataaggtaaccatctaacctgctacatttgccttcctgttagttagtgaccttcctaggccatttcctgtttttctcaaatatatttcttgataaaaataaagtgaaaatgctttaaactctttaagaaagataagacacaatgccaaggtcatatttcgtatcagaacaagcctgcaaaacacgggacctttgaaccatatgtggctgacaagagtgcttagaaggtgctactgtctcttttctgacctggaggcaacaatacaaaactcacagagctcctatcagccaccatacagtgagtgggtgagtgcctgattactttagagtcaagaagtcaggctgaaagccacctctgcctaaagcaaacctgggaaccatcaggtccatcaccaggcctgcggaatgcacctctgaatcctaccttgaatccatccattccttgttttcccactgtcacagtcccatctcaagggacagttccctactagctttccaattccactctctactgccagacaaccttttaaaatccaatcaggttaccttctttgcttcaaactctttaatggtctctcagtgaccactggatatgcccagcatggtctcagtgatgggaagtgactcttgctttctggctgcccctccaccttgacctcccctctccttccctcatacccagtgttcctgccaaaaaagagtgactggcagttctctagagagccatgctctcacacatctccttgccttgaacacgctggttttctctgcctgagatactcttctcagttgttttccatgaactcaatacttacacatccccaaagagctgaggtcaggcagactcctgaggaggccgtcactaactgcctccacttccttggagtgggctgcccttctgtgttcccagaagcgcaaggtgcttgctccccaccagcccttgccacgatgcactagaactgtgctttagcttttgtctctctcactgggttgtgaagaatttgaggacaatgacaattttactctgggactgggaggaatggctgagatgacaagggacagcacagagcgtaaagagaaggggatccagggaagatcctgggaaaccgcagaccacagtggagcctgagaaagccagcagcgtcatagaagaaaagccaaaggaaggccgttacagccagaaggaatggccacaatgtaaaatgctgctgaaaagttaagtacgacaaggtttacaacgtgtcccagcaggccactggtcacctcggggacagcagtttcagtggcgtaataacgacaaaccagattgcagggagctggaaggcaaattggaagtgaaaaatatgaagcagctgggaaaattatattcttttaagaaacacgattgtttgctacaacttggatgaaccttgagggcattatgctgagtgaaataagccagtcacaaaaggacaaatactgcatgattccactcctatgagtcacctagactagtcaaattcatagaaacagaaagcagagtaacagtttccagggactggggggccgagggggaggatggggagttaatgtccaagggaacagagtttcagtttcacaagatggaaaaggttctgtgatggatggtgatgactgcacaacagtgtgaatgtagttaatgtcattgaacagcacatttaaaaatggttaaaatggtaaactttatgttttatacattttaccacaattttttaaaaagaagcattgctattaagagaataagaaggaacttgctataagacatgggattgagagggtgttgctttgtttttctaccagaggcaaaaaacataagcatattaataaattgagaagaatgagttagtcaaaagagagatcaaggcaatccattttggcgtggagaccctgcaaatagactggggccagaggaaagcagctctcctgcactgagaagagaagaatgggctggaggaagactgctctcctgcactgagaagagaagaatgggctggaggaaggcagctctcctgcactgagaagaggagaagtggggagagaaaaagtttgtttgttggggtgagggggatatacagtgggcaagaaatatgtggttttttttttttttttaaagcttctatttgatagcttttgaaggaagaggcaaggaatgagatggcgatgggggcttgggaaggatggtgaaggtctctgtttaggggcctgggagaaggagtgaactgaggacagggagagggattattaggcaacttcatgagtctgcacaggaaatcgtgagtgtgcaatggtaatgatggtctaagcctcaaggcagcgtgactactgtagacccagcagctggctgcacaagaagaaaaggtggagagttagtctgaatcagacaggcttgccaagaaggcagaacatttacattcacagaactgagaacgctgagaagccgtgggtgaagcgatgcaccactgggaggaaaggtgatgcaggggaagagacgctgggaaaatggaaggaccgcgggctagaatgcgccacaaggggaaacagtaagtggaatgaagaaaggtgtagggaattggaggatgaggaggctgaagtctgcagtgacgcacagaagtttaagacttctgaggtgggacagttctgggtcccccccagaaccccaggcccagtcttggccaaagtgtaggtgagggtgtaagcggctaaaaaagaaattcagtcagggaagaccagggtcctatccataggggatatttccatgtgttcttcctcccaaaggcataaataattaagatgatcttttatgaatcttcttccttggattcaattttttccttactatatgtttcttattctagcattccattttttccctttaggaagccccttatgaaccaggtactatccaattttacatcctctttcccctactttttttcttatatgacatctaaactcagtattctcctgttttacacaaaatcatgggtttgtagctggtagaaaacggaaaagccctttaagaaccatgaaaactggcgatgactcattttctagggtcgataagttctagagtcaatagtacacgttaaaactactagtaaaaaattaatcattatcatctatcaagtctttcaaaggctaagcatgaatattttatattaccttgcttaagtgaccctgagcaaagcaaaaacataaaggggaccttaggttttaacctgaaaaggatatgaaggaaggaaagttggagaggaacttgacctttttcacaaagtctagctactcatgaagagtatatctgtcttttcatgtgacttggaagtgggaatctttcttgtacaccatcttctaactccaggaagggcaaggtcagaccgaggcagctgtctttttggccttctggggtttgagccgtccgaggccacatggtctcaaacaatgcctcattaatgtatgccaacactggctttctctggtgcagtatgacagagaaccaaattatcaacattttcaaaatagattggtttctcttttgtttggattatacagaaaaacgtttgatgttatatcttactgaaccattttgaaatgagttaagcatatcatgtgtatctttgcacaagcatggattgtactttgccactttcaaaacatatctgaacatcaggagatgcagcaggcgatatctcactgtgctatcagcacatgacgattttactgttaatcctacctgtgtgtcctctgaatgttgtgaccagggtgcagttttcttgctccagtttgaggattgttacttggcctgagtggtcaccgataaacacatgccgggtttcaacatcaaatctgtcatgaaagcattaaggattgtttctcaaaattaaatgagggaatttacaatgaaaaaacagggcataaatgtaacaagaaatacgcaaatcccatctgaggaaaatgtgaagacagtgctgaaagacacaaaagtgaacttaactaaatgaaggacatactgtattattggacagtaagacttaaaacttaaagatgtcacttcttgctcctaaattaataaaataaatctatatatttaaaaaatatcaacacatgttgttttctatagccagaagtgttcatatggaaaaataaataagcaaaaagagccaagaatactctgaaaataagaacaatatggtatgtgatagggaggttagccctaccagatattaaaaaatgttataaagtttctttaattaaaagtgtagtattggtgcataaatagactaacagaacagaatacaaagtcgagaaataaacccaaaagcacaatgaaatttagtaaatgtctgatgaaggtagcttttcaaatgaataaggaaaagatgaatttaaaaaaatgatgttggcacaaactggatagccatttggaaaaagaaaatagaatctgtatttcacaatgtatactgggacagattccaaatgaattagggatctaaatgtagaaaatgaaaacataagctttagataggaaagtttctttgtaaccttggagtgggaaaagctatgactcaaaaacacaacaaatattatgagcaaagccaaaagataaactggaaaaaaatatttgcaatttatgtcacaaagggcccaaatctctaatataaaaagagcaatcaagaagaaaaggatcccaaacctaatagaaaaatgggcaaaatttgaatggaactattaatagatagttcaagaagaaatcaaaatggtgctgtgaaaaaagagttaacacagcagctctgactgtgatcctctgaaagtcggcttacgaagttggcatagtgtctgggaatttggattttgggaaggttcccaccattaactgataagagtggctcactgtgccttaactgttcaaataatgtggcttacactgaatacctgctttccttctgggaatctggaattttggaatgtcccaggtagatctgcctacgtgaccagtaaaagccctaggcatggagtctctaacaagcttctctggttgacaaagcctagcaaccctatttctaaagatccacccagagacacacaggcaaaaatacagaatgacacatgcccaaggctagtcactccatgttattttaatagctaaagtttgaaaataacccaaacgtctatcaataagggacttactgaattaactatgctacatccacacaatagaatattatgcagctggggtaaaaatggagatctttatacacagacaccaggatatattatcaagtgtgtgtggagggggcagccaacgcatatgagagtttataagctatactacctttgtgtaagaaacagagagaaatacaaatgtgtatgtatgtgtgtgcatgtgcatgtatgcactcatatttagaaagggaagcactagagggattaagatctaacaaaagtggcaaggtcaggggacagtgatggcagtgagacttctcccttgtcatagttcctattttagaattttgtaaaatctttacatattaaaaggtacaaaaatttgtggccaggcacagtggctcatgcctgtaatcccagcactttgggaggccaaggagggaggatcacttgagcctgggcaacaaagtgagacctcatctctacaaaaactaaaataattagttgagcatggtggcacatgcctgtggttccagctacatgggaggctgacacaggaggattgcttgagtccaggaaattgaagctgcagtgagccatgttcaagccgctgcactccagcctgggtgacacagtgagaccctgtcttaaaaaaaaaaaaaaaattgtgtatatatagatatatacacacacacacacatatgtatatacatacacatatatatctcaaaaaatcccccaaattgaaaacaaagtaaaatgaatgaacctatcaaattggtgacataatcacataattagaacaatttcgagtgcctttaaaacacaacattttcaatgtttcaatgtctcactttgttgcccaggctggtctcaaactcctaggctcaagtgatccttccaccttggcctcccaaaatgctgggattacaggtgtgagccaccatgcctgagcaaaaattttatgtatttttaatatgtaaaaatattacaggattccaaatgggaactatgacaagggggaagtctcgcccccatcactggtagaatatattctaaggacaaagagagttgcaaagaaatctaaaatctcattcagtagtcttattgttatttagtattgctcattattttggaaccatttaaataaaccgtaggataaaccaaatgaggaactatgccaatgttttaacaaccaagattttcagccgaagataaaagaatcaagtgcaaaaaccaaaaagtaaaaatcccataatgttaaatttgaataagaaatattatatgaacttatgatttattctcttttaaaaaatacacacacatttatatatacttcttagctatctctgaatattgttcctcactaaaaaaatggctgattccaggattgggacaggaaaagtacaagatgaacttgagacatgttgagtcagaaggcaaggaagctactgaaggctaagtgggcttatttcagacacagtgataagggatgaactggtagagcacagaggctatttagagcagtgaaactattccatatgatgctacaatggcagatacatgtctttatatacttgtccaaatccatagaatgtacaacaccaagagtgaaccctaaactatggacttcaggtgatagtgacgtgccaatgtaggttcactgattgttaacaagcataccactctggcgggggatgctggtaatggggaggccatgcatgtggaggtcatgaggtgcacaggcaatctctatactttctgctcaattttgctgtgcacctaaaattgctctaaaaaataatctttaaaaaataaaaattgggctgggtgcgatggctcacgcctgtaatcccagcactctgggaggccgaggcggtcggatcacgaggtcaggagttcgagaccagcctggccaacatagtgaaaccctgtctctactaaaaatacaaaaaattagctgggcgcggtggtcagtgcctgtaatttcagctacccgggaggctgaggcaggagaatcgcttgaatccaggaggcagaggttgcagtgagctgagatagtgccattgcactccagcctggatggcaagagtgaaacgccatctcaaaaaaaaaaaaaaaaaaaaaaagttaaaaaagacattggagcccatttaatggagctattactggccaaaaataggataatttgaacataaaataaaaagatggcagtttattgatatatactgaacatattattatttaaaaacaaccaaccaacctaagatttcataatagtgctcaaaaagaaaaaaaaaagattcctattaaaggtgagcagggcaccaaatctgtactctgaaaattaggaactaaaaagacagatataagaatttatcttgcttttcctataataattgtatttcagggtaaccaaatagccctagctaatgaggcaggggaagttatcctttaggattccaacaaatacatgggaaaaatatgataggattagaaaatcaccatttagcaaccttaacgaaaaagtgttcaggcaaagctcagcaacggatgaaactattaaaaggctggtatggaggacggcgctgcagggatctggctgtcaccacccgaactgccaatcaatctcagcataactgaaagggcgacaatccaatgccatgtgccttataatgggaagctctatgaagcacacttggtgagaaccaaatgctctcactaaaaggctgaatctgaatgaaatcaagattataggggcagtttttcagtttactgaaaatatgtgaggagagtaggtaaaggagcaagttaaatgacatcaatttagaatatgggactgtgtgcaggagaactgattcagtaccttcaacaaggcggtggcattaaaaaaaagtgaagggggcactgctctggatgaagaaagatttagaagacgtgacaaccacatgcaatgtgtggatcttgtctagatcgaatttcaaacaaatccactgcacaaaagccattttcaaaataagcagtgaaatctgaaattcaacaatatcaaggagatcaaagagtgattgttaatttttagatgtaacaatagcattgtgattactgaaaaagtaacccatatattttcaatgaagtatataaggataaaatgatataaggtctagaatttgctttaaaatactccagcaaaaattgagagaaagcaaaaagggatagaagaatcaacagtggatgtgaatgactggcattaagtatgataggaagaaattgacataatcttaacagcttttcagaactctttacctgaacagaaataaatctaagagattacattaggtgggaaacattccactacacagggtgacattgtggaaatatctctgacatgaacaaaatcctaaaatagaatatttgaattatttttgtgaaaacaggaaaaatattatcaaaacatggtcaaataacaagacactgacaaatgacgctggataaagtattcacaaatttaaagactaacaagtgaagtggggaaggaacacatttctatttactatcatctacctgccatggggtctttgggaaataaccccattctgctgtacccagttgtgcagagggctggctgaaaaattacaatcccccaattctaatgctggttctgccggctaacagttacgtgaccttgagcaagtcacctactccctgagccttggtttctacactgtgaaaacagagaattaggtcttttgtttttacttcacattattgttttgacagtgaacaaagtaatgtgtaaaagactgaaaatctaagacattttcagggcctgcaaatctgagatttttttcttttcccttttccttttctctccttcttattattgtcattcttgttgttcctattacaggtcatttatatttgaagcttcagatcttcggtcaaaacaatcaaagaatttgaagttattcataaattgataattcaatttatgaaccagtctctttgtcttcctttacttttctacttgaattttggttattttcattgcatatttacttctccactaagacgcctgaaagaagaggaataaaggctgaattcaatctgatttagtctgtcacttgttgccttggctgaatgactgtttgaggtggagatagaagagaatgagttcatctgtggaggtctcttatctaccattagctgtctactatgaagataaatagggttaatgatattattcataatcttttatgttgattcataaaatcttcctcctcccttcatcactaaaacaaacaaacaacaaacaacgacgaaaccaaaacccctgtaagtgtggagggtgacaaaaagaaggaacagagaagggtggggggtgggaggttctcagaaggaaatgtttttaaaagctaaatttaaatgtgaaccctaatactgtatggcttgcctattaacaatctatcagccagctcccagaaaaaacttccagccttagaaaagtcacgtggttcttggctgagaccctctggcaaaagcacagagctgtcatgccatcagtgtttagcaatggaaaaatactcaagaggaaaggttggaactatggctccaaaatcatagttggcaaggcagagctggcagaggtcagggaatcttctgggagggcctgtctgtagtactgcagctctctaccacctgaacagtgaggctggctggatggaactgaaaccagaggctctcacacacacaggcttctgatacccaatcatacgactttctgcttggtaaaccacatggtgtggcaaaagggaatagtcacaaaatgaggatgactcctggagatgctcgaagggaggagctgtggtggttataatcctacatcaaagacaacagtcagggcaaattggacattgtccatttgttttttattttcaaatagtttaaaaagttagcttcctgaggcaagatctgtattttttttccatactccttgggcttggctaagtgatacagaaaccagcataagaccaaattatattgatgccattagttccttcttgaaggagcaatgcagtataatgggaaaaaaacaggagtccaaggcagaaggcctgggttcttgtgaggattttcctacttactagctgggtggcctcagataagacataggaccctttctgggcttcagccagctcatctgtaaaatgagggtagtgtagactgaattctaaaaaagtatttaattgacaaagattgtatatattcaaaatgttgaatgtgatgatgtgatatacatacacactgtgtaataatcatcatggtcaaattaattaacacatccatcaccacgcatagtgacagtgtgtgtgtttgtgtgtgtgtgtgaaatagagagagagagagagagagagagagagaagacagaatgattatgtctccccaaaattcatatgtcaaaacctaattcccagtgtgatgttgtttgtagatgaatcctcatgaatgggattagtgcccttataaaaaaaaaggccacagagagctcctctgccctttcaccatgtgaggacacagtgagatgttgtctacgaagcaggaagcgagtgccctcaccagacactgaatctgctggtgccttgatcttagaattcccagcctccagaattgtaagcaataaatttctgttgtttaaaggacaccaagtttacagtaatttattatagcagcccgaatggataaagacagagggttgaactaggtgatctctaagtgctaacactaagtgcttccagctctaacactataagaagtcatttatgtattggcaagagagttcatgtatttcaacttaagtattatgctcatctgaattggcttttaaaaagtaaagtttggagtttcttttattaacaagtactactaccctctcaaagatgagctgatcctgcctgccattccttatcatccttgcctttggtcttcttggcaacttgctacttttacaactttccacaatggtcattctaagtttcttcaccttgctcttccagtgagaaaaataagagtgatattagcatatatatacataaaaatatacctttgaatgccgcacagtttcaaagaaactgcaatgtactttgtcagatgttgcgaatcactgaataggcattttataaatatggagatgaaattagaaagcaggacttactgtttcttcctgcttttgctgacaagtgacctgtttctacctacctctcaatttgtcagaagataaaaagaccatatgctttttaaactaagaacccagtttactccttacaatggtacctgcatccacacatgctacacactagtcaatactgtgcttgccggagcctagtcgggcagctgtgagcattacccagcatcagcaaggattcaccatgagcatgaggaccctggcaatcagggggacaaaaatatccctctatataatctgaaagtgtctcattcctggaacaaagcttttaacattaccatgtagataccagctcacccactctggtcctggcatggtaacctctcaataactatttaaaactgaacaggattcctatggttcttctcccaggcaccaatgggaatgttcacaactttggtatctatgtgtaaattacttctgtacaaagagcaaagattacattttggtgatttcatcttcatgtaccataattatttctgacagctgaggttcatgaatctgcactgtgttctgtctagatgtcacacctcatgttacagtaggctcacaaatggctcagcagtctattatttcaggtcaagtgaccgcacttcactctacttacatgggaactcaatgatttgtgcctcaggaaattctatgagcattgtaatccacactgggcaactgtcattaacaaaactttcaagctgcacataccccaaaatttcatgaatcaaagagaacaacagttaagttcccactaagagatttttgtccagcaaaggatactgcaggcctgaggccacagcactggtccgataacctcccaggcgctgcccactctcagagcagtgccaggcaaattgcttgtcctgtcctgtgctcagcacccactccagctccaggacaaacaggatcatcgtcactctgctctgatgcgctgaaaaccaagagaaaagaaaacaacctataaagcatcctaaggaggttggaagaacatggcccacagagatgcaccattctcttctccccaccccagaataagctgaacagcagaaccattttaaggacaaggtagaacagtggttctcgtgggggttgggggtattcccctttaaacaggcgtgtctgagtgttttgggtgattaaaaaaaaactatccatctcttcccaatgttccccctcctgccccacttgtgccaacccaaggattactgccacacatagctcctgtaaccaaagggcctgggccacctccctcagacacgctagggctgctggactggagagagccacatccagtgtgaccacaaaacacattaggagtgatgttcatataatatcactaccgtcagtttatgtgcacttacaaaaaaactggagcatactgttaatcttttaatgaagtctgtcttataaagccatacaaaagttctagatgaacactttctttcagaaattaaatgcatggaaaggaggacagaattattcctaagaaccacatagaagaaagtgaagtatcccttatgttacagtgtgtgtgtgtgtgtgtgtgtgtgtgtgtgtgtgtgtgtgtgtatgaatgataataagagcaaatttcctagagttgttaataaacaagagcaatatgatcacagttatcacatcacgtaattccagaattagaagaggctattcatatcagttaacccatctccctattttacatatggacaaagtgaggcacaatgaggtggagtagtttggctgaggtcttacagcttctcagttaccaaatgaaatcaggtggaaggatttttgccttcttattttatattccaggcagtaaagtggagggcatctgcagtcactgaacacagctgactggaatgaacaaagactgacatcctgcaacctagatctcactgggccctgctcccaagggctggcagtctgatggggcatgaacacactcatcatgactgtggtgaggtcacagagaagacactggtttcacattttgatcatgaaaacagagttagacagtatggatggacaaatgcggctctgctgacaataataataccatctgccaatttctgaatgtcttacaagtgccaggcacttaaatacattctctagcttaatcattgtaatgaccctgcaaagtggatgatttcatcattttacaacaaatacaaccttagcaagatggccctttgggattgctaccatacaatacagtcagaaccagcatgaacagccacagggcagtcattcaacaaatgcctgatgctttaagagctggtatttgaagcttggagaatctaagggaatagggaagcagtgacactgtgatgtctctacaatacacaactgctttcggagtaccagtcaccatcaagatcaaaacacaggctttaactaaaagatgtgacttcttggagaaactcgtgaagatctttttatgtctctatcgtcaaatgttcaattcaagttctatcagtgatggaataaaaagtgaactctctaatgagttcaagtatactcaagtcgatttcaagcagaaagtggcccctaacacctcacccctctttttactgagggggcctttagccttctatctaccatattcgagcccaaggggatgacagtagccctagatgataaggggctttagtcctctgagcagccttcctgtgccagaggaggcagaggctagaaatgttaagtggcttgctcaaagctacaaaaccaatgaatgacaaagaatcaaaaccctattctccctgatgtcaaagttggttctctctctcagtgtcaggctacctatgactaccagaaaacaaaaacaaacaaaaaaaaccccaaaactcagatcacatacttctgtttaaggtgaaaaagattcttttattgaaaaaaaatttcaaagatacataacttatcactaagcttcagaaattcataagaaaaaacatgggtttgatgtctggctatacttctttaacaggagtggtgagggggacatctttcttgccttgatcctgatcttagagggaaagcatctcttttctcaccattaaggatgatgttagctgcagggtttccatagatatttctttattgaagaagctcccctctagtcctagtttgctgggaatattttgtaatgaactggattttaccaaatgctttcccacattaattaatataataacatgatttttcttctttaacctgttgacgtaatggattacattgatttttgaatgctgaacctgctttgcctatctggaataaatcccactaggtcatgctgtgtaattctttttaatatatggttggggtcaatttgctagttttttttttttttttcatgagagatattggtctgcagttttctttcttgtagtgcctttggttttgggatcacttgttgattttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaatttttttgtatttttagtagagacggggtttcaccgttttagccgggatggtctcgatctcctgacctcgtgatccgcccgcctcggcctcccaaagtgctgggattacaggcgtgagccaccgcgcccggcccacttgttgatttttaaaattttgtattgagataaaattcacataacacaaaattcaccactttaaacattttatagtgtataattcactgtttattagttactcacaatgttgtgcatcatcactattatctatttccagaacatttccatcatcccaaaatgaaactctatattcccaactcccacttccctcatcctcggaaaacactaatctattatctttctctgtgaattccctcctattcctgacacttcatataaatgtaatcatacaatacatggccttttgtgtgcggcttttttctcttagcataagtttccaaggttcaaccattttgtagcatgtacttcattactaaatggctaaataactcactgtatatatatatatcacattttgtttatccattcatcactgatggacattgaggttatttccatttttttggccattatgaataacgttgttatgaagaggtacatatgagtttttgtgtgaatactgtcatgctccacataacgatgcttcagtcagtgatggaaactgtggcaccataagattataatggggctgaaagggcgtggctgttctagcacaatgcattactcacctgtctgtggtgatgctggtgaaaacaaacccactgtgctgccagtcatttaaagtacagcacctacaataatgttacttgataatgatactaaatgacccatgttactggtttatgtatttactatactatgcttttaaaatcagtattttagagtgtactccttctatttatatatatattttaaaatgttaactgtaaactgtaaaacagcctcatgcaggtcctgcaggaagtatccagaggaaggcattgttatgataggaggtgacaggtccatgggtgttatggccccgaagaccttccagtgggacgagctgtggagatggaagacagtgatactgatgatcctgaccctaagtaggcctaggctaatgcgtgtgtttgtgtcttagtttttaacaaaaatgtttaaaaagtaaaacaaaaatattaaaaatttaaaaaaccaaaaaacctagagaataaaggtatgaagaaaaaatattttgtacagttgtgtttgtgttttaagctgttattacaaaaaagttgaaaagctgaaaaaattaaaaagtttataaagtaaaaatagagtacactaggtttattattgaaaaaatatttttaatagcctaagtgtacagtgtttatgaagtctacagtagtgtacagtaatgtccaaggccttcacattcactcactactcactcactgactcacccagagcaatttccagttctgcaagctccattcatggtaagtgccctatccaggcataccataacattttttaaatcttttgcagcaaatttttactgtaccttttctatttttagatatgtttattgtaacaaataccattgtgctacaactgcctacagtattcataacagtaacacactgtacaggtgtgcaagcctagggagcaacaggctataccctctagcccaggcatgtagtaagcaatcccatctaggtgtgtaagtacattctctcacattcacacaacactgaaatcgcctaacaatgcatttctcagaatgtgtcactgtcattaagcaacacatgactatatatgccttcagttctgttgggtacataactaggagtgaaaatgctgtgtcacaacgtaactttatatttaactctttgaggaactaccaaactgtttttcaaagtggctacattttacattcccaccaacactgttaagagggttccaggcctgggtgcagtggctcacacctgtaatcccagcaatttgggaggccgaggcaggtggatcacctaaggtcaggagttcaagactagcctggccaacatggtgaaaccccatctctactaaaacatacaaaaattagccgggcatggtggcaagcgcctgtaattccagctacttgggaggctgaggcaggagaatcacttgaacccaagaggcagaggttgcggtgagccaagatcacaccactgcactccagcctgggcgacaagaacgaaactctctatcaaaaaacaaaacaaaacaaaacaaaaaaacaaaaacaaaaagagggttccaatttctccacatccttgtcaacactgctttccttttttttttttgaaaggaattaatatttattggaccattaaactatgtttcagatacttcactaagtaatccacatatgttatcttttaattttttactgtattaaaatatacataacaaaaaatttacaactgaagtatacagttctgtggcattaagtacattcacactgttgtataaccatcaccacctttcactctctagaactttctcaccttcccaaactgaaactctttacccactaactcgccatttccccctctcctgggccttggtaatcaccatttgcctttctgtctctatgaatttgattaccataagtatctcatatataaggggaatccttcagtatttctccttttttttttttttttttttgagatggaatcttgctctgtcacccaggctggaatgcagtggtgcaatctcagctcactgcaacctccacctcctgggttcaagcaattcccttgcatcagcctcccaagcagctgggattacaggcgcacaccaccacgcaggctaatttttatattttagtagaggctggtcttgaacttctggcctcaggtgatccacccgccttggcctcctgaagtgccgggattacaggcgtgagccactacgcctggccttgtccttttcttgattggcttatttcacttagcatatgtcttcaaggttcatttgcatgtgtcagaacttcctacccttttaaggttgaataatattccactgtatgtatacaccaaacttatttattcattcatgtgttgatgggcatttaggttgcctccacctttgggctattgtaaacaatgctgctatgaacatgggtgtacatatatctgcttgagcctctgctttcatttcttctgggcatacaccgctaatttaattttgaatgttaatccgacactgtattactgagataaacttcacttgatcatgatgtattatcttttttacatattgctggattttatccactgaaattttgtttagttttttgtacccattatcataaagaatgatggcctatagttttctttacttgtatcattttggtctagttttgacaagaggtaatgttgatctaatagaatgggctggaaagtctttcacttctgcaacttctgaaagagtctgtgtaaagcttgcattgcctcttccttgaatttttcataaaattcaccagtaaaggcatgtgggcctggagctttctttgtgggaaggttttaactatacattaaattcaatttcattagtagatacagaactattaggattatctatgtcttttttagtaatctttcacaatttgtatttttcaaagatttttaaaatttcagttttcaaatttattagtataaagttgttcataatattacatattatcctttaaatatacctagactctgtagtaatgtcacttcactcattcctgatattgataatttgcattttctctttttttttttccctgttaactctggctaaagatttatcaattttattgagcttatcaaaacactagcttttggatttcattgatttttctctattttctgttttctatttcatgaacttctactgatctctccttttttctgcttaggagactcttctttctctggtattctaaggtggaagtcaaagtcactgttaatgagtcccttcttgttttctaatatagatgtttagttctgtaaatttctccttaaatactgctatggcatcataccataaattctggtatattgtgttttcattttttttattattatattttaagttctagggtacatgtgcacaatgtgcagatttgttacatatgtatacttgtgccatgttggtgtgctgcacccattaactcgtcatttacattatttctcctaatgttatccctccccgctccccccacaccacgataggccccagcgtgtgatgttcctcaacctgtgtccaagtgttctcattgttcaattcccacctatgagtgagaagatacggtgcttggttttctgtccttgcaatagtttgctcagaatgatggtttccagcttcatccatgtccctacaaaggacatgaactcatcctgttttatggctgcatagtattccatggtgtatatgtgccatattttcttaatccagtctatcattgatggacatttgggttggttccaaatctttggtatttgctattgtgaatagtgccacaataaacatacgtgtacatgtgtctttatagcaggatgatttataaacctttgggtatataaccagtaatgtaatggctgggtcaaatggtatttctagttctagatccttgaggaatcgccacactgtcttccacaatggttgaactagtttacagtcccaccaacagtgtaaaagtgttcctatttctccacatcctctccagcacctgttgtttcctgactttttaatgatcgccattctaactggtgtgagatgtatcttattgtgattttgttttgcatttctctgatgaccagtgatgatgaacattttttcatgtgtctgttggctgcataaatgtcttcttttgagaaatgtctgtttatatcctttgcccactttttgatggggttgtttgattttttcttgtaaattttgtttaagttctttgtagattctgggtattagccctttgtcagatgggtagattgtaaaaatcttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatgttgaattaatttttgtataaggtgtaaggaacggatccagtttcagttttctacatatggctagccagttttcccagcaccatttggtaaatagggaatcctttccccatttcttgtttttgtcaggtttgtcaaagatcagatggttgtggatgtgtggtattatttccgagggctctattctattccattgatctacacctctgttttggtaccagtaccatgctgttttggttactgtagccttgtagtatagtttgaagtcaggtagcgtgatgcctccagctttgttcttttggcttaggattgtcttggcaatgcgggctcttttttggttccatatgaactttaaagtagttttttccaattctgtgaagaaagtcattggtagcttgatggagatggcattgaatatataaattaccctgggcagtatggccattttcatgatattgattcttcctacccatgagcatggaatgtttttccatttgtttgtgtcctcttttatttcgttgagcagtggtttgtagttctccttgaagaggtccttcacatcccttgtaagttggattcctaggtattttattctctttgaaggaattgtgaatgggagttcacttatgatttggctctctgtttgtctgttattggtgtataggaatgcttgtgatttttgcacatttattttgtatcctgagactttgctgaagttgcttatcagcttaaggagattttgggctgagacaatggggttttctagatacacaatcatgtcatccgcaaacacagacaatttgacttcctcttttcctaattgaatactctttatttgcttctcctgcctcattgccctggccagaacttccaacactatgttgaataggagtggtgagagagggcatccctgtcttgtgccagttttcaaagggaatgcttccagtttttgcccattcagtatgatattggctgtgggtttgtcataaatagctcttattattttgagatacgtcccatcaatacctagtttattgagagtttttagcatgaagggctactgaattttgtcaaaggccttttctgcatctattgagataatcatgtgggttttgtctttggttctgtttatatgatggattacgtttattgatttgcgtatgttgaaccagccttgcatcccagggatgaagcctacttgatcgtggtggataagctttttgatatgctgctggattcggtttgccagtattttattgaggatttttgcactgatgttcatcagggatattggtctaaaattctctttttttttgttgtgtctctgccaggctttggtatcaggatgatgctggcctcataaaatgaattggggaggattccctctttttctattgattggaatagtttcagaaggaatggtaccagctcctctttgtatctctggtagaattcggctgtgaatccgtctggtcctggactttttttggttggtagcctattaattattgcctcagtttcagaacctgttattggtctattcagggattcaacttcttcctagtttagtcttgggagggtgtatgtgtccaggaatgtatccatttcttctagattttctagtttatttgcatagaggtgttgatagtattctctgatggtagtttgtatttctgtgggatcggtggtgatatcccctttatcattttttattgcatctatttgattcttctctcttttcctctttattagttttgctagtggtctatcaattttgttgatcttttcaaaaaagatcaatttttcaattttttaaatagaaacagcatcttgctatgttccccaggcttcaactcctgatcccaagtgatcctcccacctccggaagcattgggttaacaggtgtgaaccactgcacctgtcccagagatttttctgttattaattcctacttcaattccattttgatcagagaacatactttgcatgacttaaatccttccaaatttactgagatttattttatggcctagaatattgtctgtcttgataaatatttctccacgtacttgaaaataatgtataaataaaacaaactttagttggatagaatgttctacagatgtcaatgagagcaagtttgttgactgttttgttcaagtctgctgtactttactgattctctgcctacttattctatcaattaatatcttcaataaattattgaaaatattaaaatttctatctataacttgtatctatttctccctaaagtttcatcagttttggggtcacatatttcaaaaccatgttattagatgcataaacatttacgagtgttatggtcttctggcagactggccctcatgataccttctttatccctggtaatgttctttgctctgaaatctactttgatatatttaaaaagtcactccagttttcttttgactagtattctcattgtatatcatcttccttccttttacttttaagctattggtgtctttatatgtaaaacacacttcttatagtttatacttgggtctcacctttcactcagtctgatactaactgccttttaattgcctttagatcatttatttttaatgtgattactgacattgtgaggtttacatctattactgtgttgttttatatttttccacccgttctttaccccttttttcctcttagtctgctttttttttttaattaattgggaattactatatgattctactttatctccttggtttgcctattagctgtcattttttgatttgctgtttatttttattttattctattatttagagacagggtcttgctctgttacccagggtagagtacaatggtgcaggcacagctcactgtaacttcaaacccctggattgaagcaaccctcccaccttagcctccctagtagctgagactacaggctaattggtattttttttttttttttagagatggggtcttgctgtgttgcccaggctggtctcaaactcctgggctgaaaggatcctccacctcagcttcccaaagtgctaggatcacagctgtcagctgctgtccctggtcctcaatttgttattttaatagttgctttgggccaggagtggtggctcacgcctgtaatcccagcactttgggaagccaaggcaggtggatcgcaaatattagctgggtgtggtggcgggtgcctgtaatcccagctagttgggaggctgaggcaggagaactacttgaacctggggtgtgcccacaattgtttgtgccacttcactccagcctgggtgacagagcaagactcagtctccaaaaaaaaaaaaaaaaaaaaaaaaaaaaaaaagttgttttagggttaatagtatatatctttaacttaccatggtctttccccaagtgctattatacctctttgtgtatagcattctagaacctacaatagtatacttccatttctcctgatctttgtgttattgttgcacattttaatttacatatattattaaccccttgctactttgtctttacttaaagtcaattgtcttttaaagagattcatacaacatatgaaaaaaacctttcagttcccatttttaatactgttctttcttttgagtagacacatagtttcttttggcatcactttctttttccctgaaggacttcctttaacatttcatttagtgaaggtctatgaatgatgaattctttctgtttttgtgtgtccaaaaaaatgcttattttacttaagtttttgaaagatactttctctgggtatataattctatgttggaagttttttcttcttttagaactttaaaaatgtgctggcacagtggttcttgcctgtaatcacagtactttgggaggccaaggttggtggattgcttgagcttaggagttcgagaccagcctgggcaacatggcaaaacctcatctctacaaaaaacataaaacttagccaggtgtggtggcatacgcctgtagtcccagctacttgggaggtgaggcaggaggactgcttgagcccaggagccagaggttgcagtgagttgagatcacaccactgcactctagcctgggcaactgattgagaccctgtctccctgctgccccccaaaaaaagaactttaaaaatgttgttccatagacatcaaatccatctgccactccactaatctgtctgtgtctaatattctacccactgattttttatttcaatgactatattttcctatctaaaagttctatttggttctcttaaaaatcttcctgttttttccataatcgttttatttccttgttgttcctgaaacttttttcttcaatcatttaacatattatgttatggcttcttttgctttgttgatcattatctaagattcttggtactccaatcatcccgtttgtgatatctgctaatatttactcatggtggattgattgcttgttagttttacaatttaaaaaaaatgaagaattcatcttaagcagtgcttgtttttgttgtagggcctttgtgaaattcgtctaactgaaaagagcttgcattgatttctagcaagtaaccgtggggtcttatgggccaaggaccaactttatgttaatttcttaacatggagttccagcatgttataactggttaaaatttatattccaaactcaaaagttttcagttcaggttttgatttatcgaggtaaaattccatcctctatccagagttggggtcaggaataaatttccttgtagtcttcagggccaattagtggaaagtcttgttcctctttttatgggggtacagtcctttatgagattcagccttttatggaaatctcagttccaatttttcatctcactcaggccctaggccttatttcttgtccccaagtgcatgttcatacacaagtatctatctcttactggttctccatctccccaagacagctgcaatgacagattatatgtgtatcactctgagttttagttctctctttggttctggctcatagaaatttttttatttgtatctcccatgagcctagtattgtattaagaagaatgacaaaaacaacacgaagtgtcactttatcattatctccaggaatttgtggagaataggtttccatagtactctagttatcaattttttgtaatcctctgtagataaaatgaacttatatgaaatattaagagactcaaagaataatggcatatgaagagaagtttctagtgatatgctcattatacttatacctgtgaggccaaacattattttaacaaagacataggaaatggcatgttatgcttatacatttaagaaaaacacaaaattagtcagaaattaatatatttaatgacaactgggatttctaaatatcttggtaagctgaggtgatgggctaaataaaatgagattgtgaataacaggatgtaaagtccagcatttaggctaaaaacaaaaataaaaacaagaaacagcttcaaaagtactgaagatatagctttaaaataactcaatacattttaaaataactaaaagagtataattggattgttggtgacatgaaggataaatacttgaggcgacagataccccatctacccttacgtgattattgtgtatttcatgcctctatcaaaatgtcacatataccccacaaatatatatacctactatctacccataaaaattaaaaattaaaaaaaaaaacaaagaaaaaaacaaacaattcaagtgagaactgtggaggagcttgagttgattgctccacatggctgccagaaattcaccctatataagaacagtgctcaggaaaagagagaagggaaatataattttgtacttatcagattacatggatgtattagttacctattgctgtgtaacagattaccccaaaacttagtgccttaaaacagtaaatgttaattatctcagagtctgaagtattggtgcagtttagctgcatgcctctgtcaaaaagtctctcacaggatggaatcaaggtgtggaatggaactgtagtctcatctgaaaccttgatggggagaatctgcttccgaactctcttacatagtactggctggattcagttccttgtgggctattaaactagggtgtcagtcccttactggctgttgacaaggcctccctcagttcctcagcacgtgggcttctccacagggcagctcacaacatggcagctggctttcatcagagcaagcacacaaaagcacagagtgggcaaacaaggtggaagttttggtatctttgtaacctaatctcagaagtgatatccatcacttgccatattctaggtctagcccacactggaggtacagggtaaattccaggaggcaatgatcattaggaaccatcttaaaggttacctaccacagggtatcatattttcaaatggtcttaaaggtaccatatgatatcccaaatatgtgaccaagccaattaaaaaaatttttttaagtaatgtatttttaaaacttgataaataataattgcatatatttataggatacatgtaaaaactgttttaaagaataaaggctcaggtaacttaaaataaaaattacagatgtaaaatatataggctggaaaagagaagtgagagcagaacactcaagattgaaacaggagacagaagggaaggggcagaaactttcactgctgttttaaaataactgaaagattgtcatgtgtaagagagattgtactcagtttctgtaggtccaacaggctaagcaaacaccaatagaggaacatttatcacttatcacacaatgttttaatggcctgcttaccatccgtatcctctccatgattataaactgcttatgcacagacactatacatgtctggttcactattacaattctgttaccagaacacaatagacactcaataaatatttgatgaatgatatgtgagaaaattaaagaataaagagaaataaattttagctccaaattttaaaataaagaacttaatgcttagaattttccaaaatcacaatggttcctgtgtctctggaggtactaaagtagaggctggatgatcatcctctcattaaaggcgagtcaagagaattggaggaaatgacctctaagtgttaaaaggtctacctcaaactttctggttccacaacattgttagtctgaataaagaaatcccttccaaaaattgttgtcagatggcctgtcaatgttgaagacatgataaaaccacaattcttccccttggacaacacactctgagcacttttaaaacatttaaccaaatacaagatgagtcctattaaggcagctttttactggacccactttctaaacctgctgtacgttgaaaagcagcatggtatagtaggaagacaaaggctgtgggtttgggagtcaagctgacctgatctggctctgcacttaattagaaccccaggcaagccacccaacctcattgggcctcagtttcttaattcaaaacacagggataacactcactcaaaaggttgctctgttttgtttccctgatgattgtaaagtatgtattctcttgtggcagtgaaaaccaccaagaagtattttagaatctgggtaatgaaggtactcctctcactccctaccttgatagtttttcacaggagtcatcttgttataatcttctgacaatataaactcctgtaaaagaaaagaaaactattaaacaaaaataaattctttaagtgaatgactatatttggtaaaaccagactgaataaagcgaattgtcatgacgattacatccaacattagtattttgcccatcaactcagaatttttgtacccttttaaaagtaacaatcaaaattatgatccaatgcagttatcataattttaccttataagtgttgactttttgtgtatgcacaagaagaaaaccagatcagttcagcatcttgataccggtcgattctgaagataaacctaattcaaaatatttttctttcaagggtgccacagctaaaaatttgcaaggctctaaccagtaaggaaatggatagcatttctgctaaagaaataaattagatattttaaagattatttttctaagattagtaatttatttccccttacttactataagcatctgaaggttgcatcttactcatccctgtatccccaggacaccgggcacagtaccttggcacagtaggtaattaataatggtcacacaaaagcacttctcaatgtaatgagattagtctgaatgtcaaatttactgaaaaaatcagtttctgtatcgcgcattatatatacccttggtggggacacataagtgtctgttgtttcacccatgcatctgcgtatacagtgacctgtatgtagaagctgattgtttatgagatccagccaggttttgagtccttagacttcattcaaaagcaaaatatccaggtattctttaagagtatattataaaacataaggaaagctgcaaagtataataaattgatgccttcatctgagtttagaaacaacgcaattaatcttttcaaaatatttggaagcatacaggatttttctttgataacttaaaaaaagggggatgggaagacagacacctaaatgccttacttgctatccgggtcttcctgagtttagcagtttgtgtaattttttagaaggaaatattattttattgtgataaacatcacaaaggtaaagtaggagatgatgtgagagaatatacaaagcaataaagttcctttgcttattcatttttccattccagccccctttaagaagcttatctacaaatgaattttcttcaccatgattttctcagtaataacattattcaacttgtcactttaaaaattcatatcattatttcttcaaggagtggcactacatccacttcttgttttggaagagttagacctacaattggacacagcagactaattttttttcttttttttttttgacagagtcttgctctgttgcctggttggagtgcagtggcgcgatcctggctcactgcaacctctgcctcccaggttcaagtaattctcctgcctcagcctccctagtagctgggattataggtgcatgccaccatgtgcagctaattttggtatttttagtagacatggggttccaccatgttggccaggctggtcttgaactcctgacctcaggtgatccgcccacctcggcctcccaaagtgctgggattacaggtgtgcaccaccgcacctggccagagcagactaatttttaaagaagtaaagtagctggcctataaagtgcttatagtgtgggtaaggaaacctgggaggtgcctaagcaacaattcactagcaacttttaatcacaggcaacaggaccttgaccctgacccccaactttacagggtcccaaatatcgtgacacatacacaaataaatttattgaagacaattgttatctggccaagtgttttctgagttcatattgttcatattattttgaatatactgaaatggttctctgacctggtcaaaagatacctcaattcctttcaaaacaatgtaaggtataaaataacacaacgtaatagaggtttgcatttaggatttaatatatacattaaaaataaaattaccagttcactgcattggtaaacctaatttcttggtcatttatttttcctatgataataaaaacatataattatggagaaaatttagattttgtcagcttttgttattactttttttttttttttttttgagatggaatcttgctctgtcacccaggctggagtgcagtggcgtgatcttggctcactgcaacctccacctcctgggttcaagtgattctcctgcctcagcctcctgagtagctgagactacaggtacatgccaccatgcctggctaatttttgtatttttagtggaaacagggtttcaccatgttggtcaggctggtctggaactcctgacctcgtgatccgcctgcctcgggttcccaaagtgctgggattacaggcgtgagccaccacacccagccttgttattacttttttgatcatagaaacacaatatactactctaagaaatgtaagaaaaataaacactaaaaatcccttgtgataccatttctcaaagataagtattatggaacgtacagttgtaataatgtataataaaacaaaacattaaaactacttggcaatgctgttttcttttcacagttcatgcatgcaattccacatgagtacatactcatcaacttcattctttttgatgactgtataggatgtagtataacattcttttttttgagacagagcttcgctcttgttgcccaggctggagtgcaatggtgcgatcttggcccaccgcaacctccgcctcctgggttcaagcgattctcctacctcagcctcccgagtagttgggattacaggcatgcgccaccacgcctggctaatttattgtatttttagtagagacagggtttccccatgttggtcaggctggtcttgaacccccgacctcaggtgatctgcctgtctcagcctcccaaagtgctgggattacaggcatgagccaccacgcctgaccataatattactttaatattcctttattgatgaatctttgtttctagttttccttactgaaaatattacattaaatgcattatatctttatatgtctccagcagtatttctataaaataaaagtccgagaagaattgttggatcagagagtatgaccattgaaattttgatagacatggccaaattgagtttttaaaagattttatctgttaatactcacgaacaattaaaatgtaaaggtttggctgcaattactttgttaggattgaccaaccaaagttcaaaagaaattagatcaaagatatacacatttgaaatattttggataaaatagtttctattccttctttttttattatttctatccttccttctttccattcagctgtccacccatctatcacttagtttttaatgctcactgtaatacatcaaacaatataggatatacaagcaaaaagctaacaactgtcttcaccttcaatctcacccttgtgaggcaaccaatgttaacggtctggcgtatccctccatgtcttttttttaaacccttatacaaacatatatgaacatatatactttttttgttgtataaaaacaggatcacattatagatattattctgtaactttctgttttcacccaaaatacagcagagcactattttccagaagcacgtagttctaacttattctttctgatggctgtataatattccataaaatggatatgccaaactttattcaagtacttcacattttaagtggacattccatttgtctgctataatttacaattatagcaatactttgagaaaggtctttgcaagtatatccatatgaactaatgtctatgtagaagatatgctggctcaaatattatgtacatttaatgtcttaataaacaccgctagattactttccaggaagcatgcagccatgcactctctcacctacccccatcttcatttgacagcttattttcccacatcttatcagcattggacactattcatcttttcaatttttgccaaactgatgtgtgaaacaagagggtatctcattgtggtttatgttcattacactatgagctggataactttttggttattggctattttcattcatttcttgttttatgaattttctgttcaaattctgctgtagcctggttctctgaaaaacagcgtgaagcaaagcgtaagtctaatgctttatttgaaggtgcaatatcggcagcagtgagggtaaagcaaagcaaagcggagaaagacggtgatgcattaccaagctcgcctgagtttcacaagatgcccagctgcttctccagcattcaggaagtctctggacagacagaagtgaaacaccaggttttggaaaaatccactgaaggaagggatggagagggaatttatctgccagctgtctcccatatccctttgcattttaatcatagctccacatgaatctaatttctccctccgtgtagaaagttgtaccacctagccctgttgcagccactggggaagtcagatctgtggccttgcagagctgtgcttcatgtaattcagaagtagcaggggaaccagatcctctgggctttggcctcagggtggaacaaggtgccaagagagcccaggaaacaagtacaatcaagaaaatctgaggcagtatatatgatgtggtccaggcatatcctttggttctttttgtctattgcatttgtaactgtcttactaaattgtagaaattctttgattattagggatagttatcctttgtttaatatgtgaattgacagtattttctctcctaatagtctgcctttgaattttatcaaatctttcgtagtactgaaatgttttattttttttacttaacaaacaaccatggcattatgagttaaaattgcattatatcttttaagttttaatttgggaaggaataatattttaactgtaatatactcaagtacttatatacaatttttccttaatagtttaaatggcatttctcccaaccccatttcaattttcaatgaattacttctcgcacataatgaaaatagctcttggttttgggatacacgtgtattaatagcattagtatgctattgcagcatttaacaccgtatttgttgttgacttacctaaaccctgaccaagattaggtaatcactgctattttagttttatctggaatttttaagagtagctgccaaatttaattaaattgaatggaatttgcttttgatatctattaaacaaaatttgttaaaatccttcaatttataaaagtaattgattattgttaaacagttttctgatattgacccattcttaacttcttgaaagaattcaaacttgccctgatgtattcttcctttgatacactactggatttgatatgctaatattcaataagaatttttacatatacatttaagattattattggtctatagttttccattttggtgctatcttcattgggttctggtttaaagatagcaaagcacggtgcttaagagcttgggcactggaaccaaattgtccagtttaaatccgagctaaaacacatacttgttaaatgatcttgacaagttgctcaagagctctgtgcttcactttccttttgtgtactagcctcataagactgtatgaggactgagttattatttataaagcattttaaagcagtgcctgtcacataataagtactctatgagagctaatttaaaaaaatggattaagaagcttttctttaaatcttttggaagatattgaacaattataattgaagaattagaattcagcttcttaagcttttccccgtgtatacacagaaacacatacaattggaatagtagtactactgatgatgttttgtagctctcctttttaacttaacactattagatgggcatttctcatgtcactacctattttttgaaacagtgaattttaatggctacgtaatatcccattggaaggcaataaagaattttacctaattagtctttaactgttacatttcattttttttttttttttgaggcaggatcttgctttgtcacccaggctggagtgtagtggcatgaacacagctcactgcagcctcaacctcctaagctcaaatgatcatcccacctcagcctcctgagtagctgggactacaggcacaagccaccacacatggctaatttttgtattttttgtagagatggcgttttaccacgttacccaggctgctcttgaactcctgagctccagcaatctgcctgcctcagccttccgaaagtgctgggattataggcgtgagtcactgcatccagtctgttacatttctaagacaccaatgttttattattataaaaacaggaatatccttatgaataatctttgtgtatatttatgattattttctttggatggttttctagaaacaaaactattgacataaaggaaaaatatttctaaagctctgaatattaccaatattttttctaaacagtttgtgccaatttatgtcctttccattagtattctagagtgcctactttatttaattctagctgataagtatattctaaaattactacaacttagataaaaatagaattaaaacattttaacaccttaaaatgtttactggcccttagtatttcctctttcatgacttttctatccacaggattttattgtttttcttatctatttgcatacgattgtcatggactgaggatattttcctttctctgtcatattccacggaactatttgttgcttttaaaaaactgtatttaagtagattctcttaatgctgggaagttctgcattttatgtagttaaataaaataatattttcgtttatgacttccattcttttaagcttacaacattcttcttgatagattgtttataaatgtccagtaaactgacttctagtttttctttttcttttttaaggctttacttacatgtaatgatgcttcatgctcctggaattaattttggtataagacaagaggtgcgaattaaaatcgatctttttcttaaaagcaaaccaactgctccagcaccatttgtttaataacttttcccattcacactgacttgtggtcatctttaccacattttatttgctttcaatgaactgagtctgtttgggggttctccaaccctgttttattcctttgccggaaccaaaatgatttaattatagtagatacaacttatatgttaatataaaggctatgtgctcctaaattcttttcttaaagaaaaatgtagctagatgaacataaataatctttttaatagcaaaaaagaaaaatcacatttacaattttgattgggggctggagccaagatggccaaaaaggaacagctctggtctacagctcccagcgtcagcgatgcagaagatgggtgatttctgcatttccatctgaggtactgggttcatctcactagggagtgccagacagtgggtgcaggatagtgggtgcagcacaccctgcactagccaaagcagggcgaggcattgcctcactcgggaagcgcaaggggtcagggagttccctttcccagtcaaagaaaggggtgacagacagcacctggaaaatcgggtcactcccaccccaatactgcacttttccgatgggctttaaaaacggcccaccaggagattatatcccgcacctggctcggagggtcctacgcccacagtcttgctgattgctagcacagcagtctgagatcaaactgcaaggcggcagcaaggctgggggaggggcacccaccattgtccaggcttgcttaggtaaacaaagcagcccggaagctccaactgggtggagcccaccacagctcaaggaggcctgcctgcctctgtaggctccacctctgggggcagacaaacaaaaagacagcagtaacctctgcagacttaaatgtccctgtctgacagctttgaagagagcagtggttctcccagcacacagctagagatctgagaacaggcagactgcctcctcaggtgggtccctgacccctgacccccgagcagcctaactgggaggcaccccccagtaggggcagactgacacctcacacagctgggtactcctctgagacaaaacatccagaggaatgatcagacagcagcattcccggttcatgaaaatccgctgttctccagccatcgctgctggtacccaggcaaacagggtctggagtggacctctagcaaactccaacagacatacagctgagggtcctgtctgttacaaggaaaactaacaaacagaaaggacatccacaccaaaaacccatctgtacatcaccatcatcaaagaccaaaagtagataaaaccacaaagatggggaaaaaacagagcagaaaaactggaaactctaaaaagcagagcgcctctcctcctccaaaggaacgcagctcctcaccagcaacggaacaaagctggacggagaatgcctttgacgagctgagagaagaaggcttcagacgatcaaactactccaagctacaggaggaaattcaagccaaaggcaaagaagttgaaaactttgaaaaaaatttagacgaatgtataactagaataaccaatatagagaagtgcttaaaggagctgatggagctgaaagccaaggcttgagaactacgtgaagaatgcagaagcctcaggagccgatgcgatcaactggaagaaagggtatcagtgatggaagatcaaatgaatgaaatgaagtgagaagggaagtttagagaaaaaagaacaaaaagaaacgaacaaagcctccaagaaatatgggactatgtgaaaagaccaaatctacgtctgattggtgtacctgaaagtgacggggaaaatggaaccaagttggaaaacactctgcaggatattatccaggagaacttccccaatctagcaaggcaggccaacattcagactcaggaaatacagagaacgccacaaagatactcctcaagaagagcaactccaagacacataattgtcacattcaccaaagttgaaatgaaggaaaaaatgttaagggcagccagagagaaaggtcgggttacccacaaagggaagcccatcagactaacagcggatctctgggcagaaactataagccagaagaggctgggggccaatattcaacattcttaaagaaaagaattttcaacccagaatttcatatccagccaaactaaacttcataagtgaaggagaaataaaatactttacagacaagcaaatgctgagagattttgtcaccaccaggcctgccctaaaagagctcctgaaggaagcactaaacatggaaaggaacaaccagtaccagccactgaaaaatcatgccaaattgtaaagaccatcaaggctaggaagaaactgcatcaagtaacgggcaaaataaccagctaacatcataatgacaggatcaaattcacacataaaaatattaactttaaatgtaaatggactaaatgctccaattaagagacacagactggcaaattggataaagagtcaagacccatcagtgtgctgtattcaggaaacccatctcacgtgcagagacacacataggctcaaaataaaaggatggaggaagatctatcaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagtacccagattcataaagcaagtcctgagtgacctataaagagacttagactcccacacaataataatgggagacttgaacaccccactgtcaacattagacagatcaacgagacagaaagttaacaaggatacccaggaattgaactcagctctgcaccaagcagacctaatagacatctacagaactctccaccccaaatcaacagaatatacatttttttcagcaccacaccacacctattccaaaattgaccacataggtggaagtaaagctctcctcagcaaatgtaaaagaacagaaattataacaaactgtctctcagaccacagtgcaatcaaactagaactcaggattaagaaactcactcaaaacggctcaactacatggaaactgaacaacctgctcctgaatgactactgggtacataacgaaatgaaggcagaaataaagatgttctttgaaaccaatgagaacaaagacacaacataccagaatctctgggacacattcaaagcagtgtgtagagggaaatttatagcactaaatgcccacaagagaaagcaggaaagatccaaaattgacaccctaacatcacaatgaaaagaactagaaaagcaagagcaaacacattcaaaagctagcagaaggcaagaaataactaaaatgaaggaaatagagacacaaaaaaaccttcaaaaaattaatgaatccaggagctggttttttgaaaggatcaacaaaattgacagaccactagcaagactaataaagaaaaaaagagagaagaatcaaatagacgcaataaaaaatgataaaggggatatcaccaccaatcccacagaaatacaaactaccatcagagaatactacaaacacctctacacaaataaactagaaaatctagaagaaatggataaattcctcaacatatacaccctcacaagactaaaccaggaagaagttgaatctctgaatagaccaataacaggctctgaaattgtggcaataatcaatagcttaccaaccaaaaagaatccaggaccatatggattcacagccgaattctaccagcggtacaaggaggaactggtaccactccttctgaaactattccaatcaatagaaaaagagggaatcctccctaactcattttatgaggccagcatcatcctgataccaaagccaggcagagatacaaccaaaaaagagaattttagaccaatatccttgatgaacattgatgcaaaaatcctcaataaaatactggcaaaccgaatccagcagcacatcgaaaagcttatccaccatgatcaagtgggcttcatccctgggatgcaaggctggttcaatatacgcaaatcaataaatgtaatccagcatataaacagaaccaaagagaaaaaccacatgattatctcaatagatgcagaaaaggcctttgacaaaattcaacagcccttcatgctaaaaactctcagtaaattaggtattgatgggacgtatttcaaaataataagagctatctatgacaaacctacagccaatatcatactgaatgggcaaaaactggaaggattccctttgaaaactggcacaagacagggatgccctctctcaccactcctattcaacatagtgttggaagttctggccagggcaattaggcaagagaaggaaataaagggtatttgattaggaaaagaggaagtcaaattgtccctgtttgcagatgacatgattgtatatctagaaaaccccattgtctcagccccaaatctccttaagctgataagcaacttcagcaaagtctcaggatacaaaatcaatgtacaaaaatcacaagcattcttatacaccaataacagacaaacagccaaatcatgagtgaactcccattcacaattgcttcaaagagaataaaatacctaggaatccaacttacaagggatgtgaaggacctcttcaaggagaactacaaaccactgctcaacgaaataaaagaggacacaaacaaatggaagaacattccatgctcatgggtaggaagaatcaatatcgtgataatggccacactgcccaaggtaatttatagattcaatgccatccccatcaagctaccaatgactttcttcacagaattggaaaaaactactttaaagttcacatggaaccaaaaaagagcccgcatcgccaagtcaatcctaagccaaaagaacaaagctggaggcatcacactacctgactccaaactatactacaaggctacagtaaccaaaacagcatggtactggtaccaaaacagagatatagatcaatggaacggaacagagccctcagaaataatgccacatatctacaactatctgatctttgacaaacctgagaaaaacaagcaatggggaaaggattccctatttgataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagacaaaattgacaaacgggatccaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaacaaaaaaacaaccaacctcatcaaaaagtgggtgaaggacatgaacagacacttctcaaaataagacatttatgcagccaaaaaacacatgaaaaaatgctcaccatcactggccatcagagaaatgcaaatcaaaaccactatgagataccatctcacaccagttagaatggcaatcattaaaaagtcaggaaacaacaggtgctggagagggtgtggagtaataggaacacttttacactgttggtgggactgtaaactagttcaaccgttgtggaagtcagtgtggcgattcctcagggatctagaactggaaataccatttgacccagccatcccattactgagtatatacccaaaggactataaatcatgctgctataaagacacatgcacacgtatgtttattgcggcattattcacgacagcaaagacttggaaccaacccaaatgtccaacaatgatagactggattaagaaaatgtggcacatatacaccatggaatactatgcagccataaaaaatgatgagttcacgtcctttgtagggacatggatgaaattggaaatcattattctcagtaaactatcacaagaacaaaaaaccaaacaccacatattctcactcataggtgggaattgaacaatgagagcacatggacacaggaaggggaatatcacactctggggactgttatggggtggggggaggggggagggatagcactgggagatatacccaatgctagatgacgagttagtggatgcagcgcaccagcatggcacatgtatacatatgtaactaacctgcacaatgtgcacatgtaccctaaaacttaaagtataataataaaaaaaatatatatatataatgatctaaatcaaaatggaaaaattttttaaatattaattcattaaaataacaatagcaaatgtattacatgttaatataaataacaatctataaaaaataagtattttttccaaaacaaaaaatttagtgaaaagagtggcactgttttccattttagcaaatctcattaatgcgcagcttaacagaagacagatccccatcctgcttctgcatacaatttgcacatttcttagaaaatgagagtgaaaaaggcaagtaacatcttagtattattatgaaaatagctttcatctcacagatcacagtttgaaaactactggtttcagtgactgacttgatgttaggctttgcttaatcttcatttcagattctgcaaatgtgcctacagagttcaaagattattcttgtttgtttataattatgaaaagaggtttcactggctaccaaacaatgggacattgtttcacccaggaacccagagggtacgtgcctttttcctctccggtcaaatgcctatgagcctaatcttttctgaccacatgtattttaaaaagttgggggaagggatgccttaaatgcaaatcccccacttaggctccgaactccataaggaaaccccatgtcacatttctaagatgggcatatgtcatactacatggaagcgtcggaaacaagaaaactaaagataactggggtttgtgcaaccacagcagctgcttgcctctccagattccatatatcacctacaaagagacaaattcaggtttacaaattcttcctataaattcctcctcaaattcaggtttacacatatagcacaaaaaacaaagcaatttcaaggtttctccacacacgaactgtttggctgctgcccctctagtctgcctggatgcttcacggtttacctgtcatcatcttttctcatcaatggtaacaggtttttgtgccctcccacccccggttccccaacactgactgcaagtaaccatatgcagttggcttctcaataatatccctcccaagaggatggaagggagaaaagacacacaggtttggatgtaaccactttcaagaccgcctctggcaaatttcagaatcttaaggacagatgctcttggaagttattcagtgaatggggaatatcctgctcatggccaaactctgaagccagaacactgatgtatcacacaaagaaagctgctagctaaagtattttgtgtccccgccacccttcagtgaaagagtgttgtacattttaaataacatttatacacaataaaaattctgctgtaatattaaacagcaaatgatatgagatcagtttagacagtttagttgctgatatttatttttaaaaagaaaaaatagctcaaaacttttgagaaaattattctgaacaaaaaagttgcctgctgaaattgaaaactgcttacacctaacatcataatatttagcctaatggttatgaggctgacaattactgtttctctactcaggaaagctgctggtgaaagaagtttggatctttggttgttaagttttggattttgtggagttttagagtttgtaaggggtcttagagattacctagcacaatgactcattttttagatagggaaatgaaagtctagagatactaaggaaaaagtctcagggtcagaggcttacttggttgtatgttgcatagcccacacttaaaatgtggatctgtctcttgattttttatccactgatcttttgactcacacaaacctcaaagagccccctcaaaatgacattaaaactcaggagagtatttcattgaatctctatgagcaaagaaaaaaactacagtgcaaattctgaagtcactacactcttcagaaaatccaggtgacaacgcattacatgaacacaaaagaaaaataagcagaaagcaccacacgccactaatgcctccatcatgatccctgttacccaagtctgacacctggaagcaggaccaaatggttggcatggacaccggctaatcagaacagacactggctgcagacagcagcaactgtgtactgactgaacacaagcttggctgggagttatttttgccaactaccccttctccccactcaatttctcctacacatttagtcatcagatccttacatccttcttgaatccaagccccttccaatgcatttccaagtaaactacgtttatctttgacagtgacctgcgcatccccatttcctagcctttgatctagtgtctcatttccccagccgtcatcatttttcaaacctatccttctgaatggtctcctttcatataatcacctcaggcaggatggagctttctgttctgaatttcaagagactctagctcttttaggctattgatcacagtctgcattaaatgaaagctatcagtgatcagatcattttatccttctttacagattttaaggaatggagttctggttttcctaacatgtctccccaacatgtccagcatcgttcctaatatacaatatatgagaggtaatcaataaatatgaaaaataaagaaataatactccttttttttttttagctcaagtcaggattttcgttgtactactattataaacactcctgctgtggggcttgtgtactgactgttactctgccttaaacactcttcccaagacaaatgctggactcactcctccaaccttcaaggcttctgctcagatgatatcttcttaatgaagcctaacctactggcatccattccctctacctcacactcacattcccaatcccccttactctgttctatttctccccatagcatgtatcacttctatgaccttctaacatatataaattataatgttatttataaagagattagtaaatgcaacataaacaagaggaggggtttttcagcaggggagggtatattttgatgtatctcaagtacctagaacactgcctggcacatagtaggtgttcaatatatattttaaaaattgaataaaaatgttaagtgttatattaatttacataatagctctctattaatatacttttaaaatatatgaaaatattaatacataatatactataaaaatattaagtataattttttcagtgatggttttatatatatatatataaataagtgtgacattattagtgttttcatttagataggccatcaaagaaagattcaacaatttgctcatcaatagtaggcttgaaagtaggaactagatttctcaattgggggttcaatgttacccacagtaattttgaatgaaaatatgtgcaattaccagacattcaaataataaaagaaaaaaaaagagaggctaattgctaagctattacttttcctaatcaatactgaaaaatagaacagtacatacttttgactctaatctcagtaataaccaatgctttacttcttgggttaatagaaaacacagtaatgtgttgctttttcaagctgtttataaccatggtctccacactaaaatgttataattatctctttttctatatttaaattcatatattttcagtcctgaacattattcaaacaaaaatatacatttggcaagtaatgaacaccaaaagaaagccaatattacatgtaaaacccaatcttttttgtcaaaaatggcacgcacaagaaactagtttaaaaacaatgagttttttaaattattgttaaatctgaggtggcaaataattgtgtaaaatacactgctctttaacttcagataaaattaaccttatctaaaagtaaattaaagttcacctactgctgaaatgaatataatttctgccatgaaaacagtaattaccactttctgagggcttactgagtgccaagacctttaaggtacctcatgtaatcctcacagcaaccccatgaggcacagatcaccctcaatgaacagtgagtaaactgaggagtatgtgaagttaaccaacttgttcatgatgatcaagctagaagatggaagacctgggatacagatacagacctttatgggagcaaagttcatacctcaaccccaccacatctgtccttgctatatgaaggcaaggtatgttaatcatttctcccacaaactctgagaaagctctacttgataaagggagggaagagaataaaacaattgcttccctatcagagtgttgggaagaaagggcttctataaggatgactagattatgagaatgaaggtgaaaggagaacgaacttctggatggaaacacaaaggaaactggtttggcttttattcactcaaaaaatattgccattccaatttgcacagggctctctactaggtattggaaatgccaatgcatacgtttcctgcctccaagttgctccggctaatggagataaagaaaacaatgaaattaaatgttatttactagacatgtttagggactacattgacccttgaaccatggatttgaactgcacagatctacttatacatggattttcttccacctctgccacccctgaaaccaacccctcttcttcctcagcagcctactcaacgtgaataggatgaagatgaaggcctttatgatgatccacttccatctaatgaaaacatacttttccttccttatgattttcttagtcacattttcttttcttcagcttactttattgtaagactatagtatataataaatataacatacaaagtatgtgttactcgactgtttacgctatcagtaaggcttccagtcaacagcaggctattagtagttaagtttttgggcaatcaaaagttatactcaaattctcaactggaaggggaggtggggtcagtgcccctaacccccacattgttcaaaggtcaactgtatatacatcttacttaatacaaaattatataaatgaaatgcacatgtaatctaatgatacacaaatactaaagtagaaatttgaactaagggctgtgagaattcttacaaagagtctttcaactctgctctgtaattaaggcaggcttctcataagaatgggtttggggcttaaagctaattcttgaaggtagaagttccatagaggcggcaggaggtcagtgaaggagaacatctatttttggcaaaggactgcatgtacacagccatggatatctgaatcaaaaagtttgaagtttggtgggaaagttgtgacaggtgagactgaccaagtggggagaatgaagggcttggagcttcatttttctaaaagtgattgagagtctatacacaggggaatgtgtatagaactttggatatctgacggcggagcagctggagaaacctagagacaacaggcagtttgaccaatctagggcttactgcaacaatccaagtaaacctgtaagagatggaaatttcaaaagtactcttgggaatagacaaagaaggccagagtctggagacaggtctgagctaagtcagcaggccatgggcactgataccgtgaggttagagggaaaatgtggggcttatttctggttggagttactcattgatgccatttactgaaggaagagagaagagcatatttggagggaaagagaattatttctatttagaatatgctaaactggagtgcagtctcaggctcatgagaacagaatgggccacagtcttgagaactgtaggtataggataattaagccacagatgcagatcaccaaaaaaagagtaagcagcaggagggcagaaccttcgggagcctcacatctaaggctctaacagagaaagaagaaccaacagaaaaatctggaggtaactcagggtttactaaacttaaaaaaaaaaaaaaaacaccaaatactcaaccatgatatgactcaatccactagaaggcatctttttggctcctttctttttctacccgtagcaatagctctgggctgaagaagctgccctaatgttttgacttctctccaatccaggaaacaagctggacttgcatgattgctgcagatggaaaagctcttctgttctttgtgccaatatggttagaagtctttttgcaaccgtgaaatttgtttcaatgagcttaaggtctaatactgatggttgtcttcctacactaaatgagtacatatttataaaaatgtaaaacattcactggtaactgagagaagagctattcctccatctgtaatgaggtgaagctgcaggagagtgaggtgtggagcctgcattcaaggcttagtgtaggaggatcagtaaataaacagggaagggcacacatcttggaaagaaaaactactcaggtttccaccaacctgggtcactgtagcatccaagtgcagccaagcaaagacatacaagcccagcatttaaccccagcactaaaccccagagactaggacatacctaataccactcccctctctgctaatgtaagcatctagccagcaagggggaaggcttttgccaagactgcctcagatcacacagtaggtggagcaacaccaggtgacagcagttccgcaaccacaggggctataaaagaatgagtgcttccttcatgcattttggctcttgtgagttcccaagctttacagcaaaagaataaatgtcagatgattccctggaagatatatttcatgactctgctgttgtcaaggtactcttgaaaggaatgccttccaaggtgagtaacagtaaaatgccacacaccagcccatctgggcttgaaaccttgcaatacaaatgacagtgacatgggaaccatggttcacctctagtttgtataaaagatgaactcaaagtaaaaatcagcaaaatatttgtgtatacagagaatattttcaaatgtgtagatggaaatggttaagaaaagaattttgataccaacaggactgattcctatcgttgattttaaaagttgtaggaccacagatggctctctggacattggtctatcaaatccaaattcctaaaacaatagaaagcaatttaacccttaatggcttgcaatttttccttattccatactctcaatccacgaaaataagggagtcacttgtgatgacaaatttgctacatcttctccagtcatccattcagagcatcttcagtactctgtacacctctccaagcccaaccccttttcttgaggacgatgaagattaaaatggcaacaacttggataagaaactcctttgcagaaaaaagagtgtccatgtcagaagacagcccatgttttgcaaatcactggtaaattcctgtgatgcaacagcaaagactaaagatgggaccagaaataagttgaatagtcctaaggaatatgccatgactaagacatttcctccccttggaactggcccactaaatgctcatgacatagactttaaccaaggcttcctggttactgcaaatggaggatgctgctactgatgatgatgataatgacactgacaggagttaatatttatggagcatttgatacatacagggactgttctaagagctttccatgtatatatcagatagtcctaataacaaccctataaaattggtacaactattactcccattttacagataaggaaactgagacacagagagtaaagcaacttgcccaatgtgacacaacttgaggggggtagaggcagtctgataccagggcttgtgctccgaacctctttgtaatatcaactcaataaactatattcattcatttactcgctcattaattcagtctataaatatttacagagcacttaaaattcatggacattgtactgggtgccagactgtaacagagtcaagtacacacagtccctgctttgcagagtttatgctgaatatatgccattaataaaataattacatcagttattattccaggggagatagattatttagatataaggttcctaggacaaagggaaagtaacttggaacataatactctcatcagttcccagccactgcctttctgaagtgtacatgtgctgtgttgatgtggccaaggtaactcctgtagatagtgcataaatgacttcaatccaccactcactctactgaatctcttcagtacctaattcaaaacacagagcaatctgggtgctcctacgggtattcacactacagaactggtctaaaagtcgattcaagagggcctttgaaaattcacaactgcaatggaagtgcaacaaattaatctcaggtcaaaaaatgctcttggtatctgcattcacgactgcttgaccaagtttttagataacatgtaggtactgagcaaaagatgacagggctacacgcgcaatgacataactgagggagaaggttagtttttgagaggtctttgattcacacaaataccaagggcacaatacagcaagagttttctttgataaaagaaccttcagcaaatgatattaaatgaataaatagtaagcaactggaatgtcagcactctaagactattttcctgctaagcatagctccacacctatagtattaaaatatgcatatattttcatatattacatatgtaatatatatgtttaaattcattgtaacttagcacaagctcagaagaaaatgtctacttaacgctgtataaaatgaactcttcacattaggcagtccagtgactcagaatgataaaatgactcagaaatgctggtcttctatggtagaaaccatggtataatgacagaatcataagctagtgtaaataatggcagggttatgtaacagtttaaaaggaggaggccccatagattccacgcacacatttctctgaacacagagcttcctgaaattttcttcaaattcaccttctatgcccacatgataaggatattattcataaatggtatcacactagaagtcctggaaaacagaaaatttcagaagcaacatcaattctcctgtaagtacaaaacttggaatgcatcatgatgactgatgagtgagagtctactattacactgctgttttgaagctgattaaggtgaaaattttcaagactgtctctccagcagagtgaactaactgtacagtcaacttgcttgggtacagctgaagtgctttattcagaggccatttgtcgtcaccgtagaacatgaccttaccatttgggttcagttccccataggctcgttataatccacggtaataaacaactcatccaaaacaccttgttagattaaatgctgaaattcctgcccccaacccaacacatattttttaacagtggctggatgcacagaataacacaagctccttcctaattcactagtgaataccctagggcaattccttgcagctgggctgtcctacttgtatgaagaaattggcctggtataatacaaagaaaatttgtctagggctcagggaagtcctagctctgccaccattatcctgacatggggcctattcaagatatcacttagtctagaggagagtggcattagctgcagaagaagatcctttcaattatattttcttatctcccacaagaggattttgaatcatcttcttttaatatccttggatacttcttcctgaagacatcatgtctcacattgagaaaactgtttccaaatcaactgctctaacactgttagggaaacacagtagatacaatattaccagatgtactgagttaaacagtattctctcaaaattcatgtccacccagaacctcagaacacatccttatttgggaaatagggtctttgcagatgtaactaagacaggatcatactggattagggggagacataaatccaatgactggtgtctttataagaaggtcacgtggagccgggcacagtggctcacacctgtaatcccagctacttgggaggctgaggtgggaggatcccgtgagcctaggaattaaagaccagtccaggcaacatagtgagaccccatctacgaaaaaagccaaaacattagccaggtatggtggtgcacatctgtagtcccagctacttggaagtgagaggcaggcggatcacttgagcccaggtctttgaggctgtagtgagctatgatcacgctgctgcactccagcctgggcaacaaagcaaaaccctgtttctaaaacaaacaaataaacatccgtgaaatgagccaagcatggtggtgcacacttacagtcctatctactccagaggctgaggtgggaagattacttgagtccaggagctcaaggctgcagtgagctattatagcaccactgctctttggcgtgggcaacagagcgagactccatgttttgttttgtttttttttaaaggagtccatgtgaagacatagagacatagaaaggaaggcaatgtgaagatgcaggcaagaactggagagacacattcacaagccacggaatgccaaggattgctagcaaccaccagaagctaggaaaaagcaaggaggaatgttctacagctttcagaaggagcatggccctcctgacaccctgatttcagacttccaggctccagaaccatgagagaaaaactgctgtttggtactgttatggcagccctaggaaactaacttactacataacccacatgaactaacagtaatgtatactgtaagagtataataatcacaatcacaagaactaccaaaacaacaataaatccatacacagtcaatgtcagttatttttagacaataatcactattctgagtgctaaccatttatagatcaatcctctcatcccaatcaaacttcccataacacacacgagattaatcttcagagaatagagattttaccattttaaggcctttttcaaaaaatcttcaatgaccatgcatttatcttagcaagatattaataaaaactgtggctccctgtaagttttgatggagaagaaaataagtatttataaagatatatatatctctctccaccctatactatcctatagcaattactcagggttggtgaaaattagtttaatggaaatgctttacttctgtgttgacatttcctcaccagtcaattatcccctttaaatatggtatgaagtcttggagtgggatggggagaatcttccatgttacgatccagtacctttacgttacataatgcttactactcatcctgaatcaaggctttcatattatttcattaattctctaccaaattagtttatatctctccaaacatctttggtcctttggtacctccatggtttgggtggtttttttcccccactccattaattttgtctgaaatatgttactttcctatctttagctaatccaatcctagccagtcttctaaatccagttcgtattcagggagctgccctagaccattatctcccactgtcttctgacctcactgctttgccaacatcacactcattggtgtaccggtacttctgctattatttgtttactttgtgttacttatttcataatttcatttttcataaaaatgaaaaatgtctccctaactgaattataaagtctttgagaccagaagccacactatgttagaattgagcataatcttttgtacagagttgatatttaaatatttgttagttggctagaatacatgagacataaaaatgcaaagtttaaagttccacttcagcatgaatagcagttagcacaatctgactaacttctctcaatattaaaacagaagacattactgaaaaaggtcaagacaagttaaactattggcataaatttttcccctacagaaggtcattctattttgaaaaacattttgaatggtaatagaattgtacaaataaactatctcagaatttaagcaagtgcttactacaatcagctatattaaataataatagtgtttatactttagtcaataaactaacaaattattcattgagttcccaatttgtaaaaggagccacaataagatctaccagaggagagatgaataaaggactggccaactcttcaacacccagcggtttaatggaagagacagacttttcaacagtgtgcaaagcaaaagttaaatacacaatacaacatagctaacctactgagtaccgtgtgtgactaatttcaattggtagggctcaggaatcatctgccaaaaataaaaatacaaacaaaaagataacattttaatgaggtggggaagataattaaaactttgtagaccaagatggcagagcagaattctgagctatatgattagaaaagagcaaaaggtataggtaggaaaatttactctcacctcattatctttaccttctctcagtagatgacctcacctgctacctcacaggaaaaaataaaaggcattcctctcctatatcgcaaaactgaatgacatttctctctcctttcctgctctctcaactgtccccattctttcccacagctaacttttccaaattgttcaggaccctcttgctgcttgtctcctaccagatcttgctccagtactcacactctctctcctgctctttgtggccacattttttgaaagaatggtctctacgtcttatttctacttcatctctaattcactactcagctgcctaagtttaactgtctatcttacacaatgtgttctttttattcagtaaaataaagtgaaataatgatgttactttctgatttcacactttcttagttttaaaataagttaaccactatttcttcttaaaatttatttgttataaccaggaaacagaatatatagtctctgactaggatttcttgtgtctaaaaagtaaattattaaaacagctgagactaagtattttcagtaaagagcctgttattgcagtgatcaatgtgaatcctgaaccttaaacatgctgttctctcaatgtatctttccctaacatagaactctttctaattccatagatgagaagaggtagggtatgcaattcatcttcctcaacaatacaaaggaggtacttttaaggaaattatttcatataagccagggtcctgaatctttttcagaagactggagtaagttaaggtttgatgtctcaaccctgtactgacatacttggaaagatggaccctgactgatgctttgcttccctggcagttttatttactaaaagaataatggctaagatggtttcgcctcttatatacaataaatagctagaattctccataacttactttgctcatctttcttgccttcaaagccaaatttatcagtatccattaaccacctacattaacttcaaaagtgcaacaaaccactcctatgttatgtaaacctaagtttttccatggacagtgagcgttacgcaaactatcctataactgttgggaaatggaaggatctcagttcaccttttcatatttcctttgtaatgaacacttcagaagtccactgaataatgatctccctttatcttttaaaaataaatttatctcatatgcacacctccttttaaaaatggctctcctcaaagtagacaactttgtatcataaacttctatctacctaagaaacagagtttacagatctaccaaatgtattggatattacagaaatttcataaatacttgtcactaggctgatttatatttaacaatattgttaatagtcacagaaaggacaccaagcaaatgttttgactaaagatcaaagacaaaactttaggcccactaacatttgtaggggctggggcaagattacaaatggaggcccacattccatgtttacatgtttaaaagttacaagtccagttgaactattaaataaaatatggtctcatcctccaatcttgacaaatacacccttcaccagctggaggtacaggttcaaatttagaattcttagtctcctttaagttccacgccatattgtggtgacacggggggccagcccactccccttctctttctattcccagttttgtcaagaccttgaggggccctgcactcaagggtggacatcctgtctaccgcaaactgctacctctttgccacctctcaggcctaagagcatactcactggttttatctttctaaggacacatctaggaaaaaggtcagtgaagactctggaagcaggttctgagcagtttggggcaggaaattccagggtcttggtagtgggaggatggagtgggagagagggaggacttgggctgatcacatacatccccttgagccctcagatcctccaccctgtggggaagtgtgagcagagcagggccttctaattcataggttctgaagcagggcttctctcgcccaggactaaaggcaacgctggataatttaccaaatggagaatttactagatcagtcttgttattagttaatatactagttgaaacttagtatgtagaaagattaagtaggtaaataaaagccaaaattccaatctttaatcacttcagttcccccaacatctataatcaaagggtctaatatttatgtggatctatctacagactaaatctagattctgtgctttttttcacaaattcatacaaatttacagaattctattcagatgctaaagggagctggaaaaaacaagaagcagaaggaacaaagaaagaacacagagtatcaaagacaggatcagacatgcagacataagggaaagcattttcctcctgttctgttgcttatgtggcaaagcttaaggcaccatgattaaccatctgattaaagccactagtatcatagcttgctctcactaatgcagattcatgcagtttactcattggcctccgattgcccccattctagccactctgtatagggtaggtcaagctgaaccttgtcagcatttaagtggatactgatgatagctctccctacattagaatctcttacctcgccataatttgctacgctgcaattttcattctacttagcaagaaaattcttctgttaacttgaaaaaactaataaatacatatacatactccacaggaagggaagtatttcaactggaaatcttatttatgtgtacttactgagattgtaccattgtctagacctatggacagtcttcttgtttccgggttaaaagacatgcatgaacatggagctgaaagaaatgaacatgttgatgaaattaacaaaaccatgattctcatcgactcaggagtgcctaactagctaaaagtgtggggctgtactttccccactatctcctggaaaacatttcatttaacatccactcaccaaaaaataaaaacagtaattttacagccaccccatagttgttcagttatccttttaatgaatataacaaataagatattctcaaactgggcaagttccaaggggcttggtcttggctggttctgtcagtatggactctaaatttgcttaactagattaacaatactttgtgctgtgtaacgtttctgttaccactctctctgtaccactccaattccatcttaaatagaaataacctatcctttctgaactagacaaacaaaagaaagatcttattatccctccaccctccccacccacatacagacacatacacacaggagtctagaagtctattttttgattcagaattgattcggggcgtgtgaattaacaggagttttttgcttttggcctttgggggtgtgctggagtctgctgattgaaaatgacagaggaggatttgtctcaatctaaaaaagaaccaactcatcatagggcttggcattgtaggaaagaaaccaggtaagtcagtacacccaggcctggactggttctccctgttccgcaggactgacggcctgagtacacccgagcctaagcaaattaagtatgcttggaagccacgtgtggtcaacaagtgcttactaaacagtcagctcccaggtccctgccttctctacctgtgcttgctcctaactgctcccactaaatagggggtcttttgacaatttacccaatactgaaatatttaatagttgttctaaagagcccagcacagtttttatatgtctcccttcatattcacagaagccatgtagatcatgaactacctattatcataatcacaatcagcatcaaatattttttattcctacttttcacgggtatgattagatgttttacccaaggtcacataggaaacactggagaaggttcaaagacatcattcaaacacacagtcccattttcaaacaaccaacttagattatttttaaactaaaaaagaatttcaagttctactgacagccactaagtgaacatatcacttagtaacatatttttcattctttataaaagggccctgaataaaacaacaaaaagaccttctaaactgcatatttactttttttctaattttctatcatgatatattcagaaaataaaaactagtagaatttcccccaaaaacttccacctgtataacagactatcttctttctacttagctacaaaataaaaccagattcccaagagtacactcctgaaaacagcaatcaaatgatatttaatgcactgccctaagaaagtcagttttattgcccttgaccagtaaactatgttggcacaatttctatacaatattaagatgccgggtctcataatcccataacatgtgtgcagaattagaatctaataatctcatggaaaattgttagctgaaaaaaaatctaaagaaaaaatacactgtgattacaattgtgtaaagtacatacacacataagtacaggatacatggaaaaattattcttgtgttcaaatgacaagattatttctataacactgtctttactcttattttgccattcctgttaaaatgaattttaaatatgtcacaatttatgaagatgtaagtatgagcatatgaagcaaaactcgattgcagcctcaaggggctagtgactagccaggaacaaccttatcatttagctgcccacttgaccatctaaaagtatttcctgtgtgatttcctccaaagtccatatccggttatgctataattagaaaacccactgaaatttgaatgtgatttaaaatacttttttacaacactgcataggctactcttaaatcttcattgccattcccttattccttgttttttccccaatttcctatatttcttgttattctttcaagaaaaatttagaatccttactatgttcaaggcatgtcctacaatgatatataaagtattactgctgccatcatggaattaaaagaatttatagattgtgaaaccaaaggtacataggaactgtaagacaatttcaccctattggttcaaatcattttatgcatagtaagaaacaccaccatatttcaaagtaaagaaccgttcctataataaatgaattcagcaaattttcagaatacaaaattaatgcacacaaatcagtagctctgctatacatcaacagtgaccaagctgagaatcaaatcaagaactcaactccttttacagtagctgcagaaaaataaaataacatacttgggatacctaaaccaggaggtgaaagacctctacaaagaaaactacaaacactgctgaaagaaatcacagatgacacaaacaaatggaaacatatcccatgctcatggatgggtagaatcaatattgtgaaaatgaacataccgccaaaagcaatcaacaaattcaaggcaattcccatcaaaatagcaccatcattcttcatagaactagaaaaaacaaccctaaaacctatatggaaccaaaaaagagcccacatagccaaagcaagactaagcaaaaagaacaaatctggaggaatcacattacccgacttcaaactatatataaggccatagtcaccaaaacagcatggtactgttataaaaacaggcatacagatcaatagagcaggaaacagaacccagagataaacccaaatacttacagtcaacagatctttgacaaagcaaacaaaacataaagtggaaaaaggacaccctattcgacaaacagcgctgggataattggcaagccacatgtagaagaatgaaactggatccccatctctcaccttatacaaaaatcaactcaagatgaaccaaagacttaaatttaaaacctgaaaccataaaaattctagaagataacactggaaaacctttctaggcattggcttaggcaaagacttcatgaccaagaacccaaaagcaaatgcaggccagctgcagcggctcacgcctgtaatcccagcactttgggaggctgagatggacggatcacttgaggtcaggagattgagaccagcctggccaacatggcgaaaccccatctctattaaaaatacaaaaattaggcgggtgtgacggtacacacctgtagtcctagctactagggaggctgaggcacgagaatcgcttgaatccgggaggcagaggttgcagtaagctgagatggtgccactgcactccagcctgggcaacagaggaagaccttgtctcaaaaaaaaaaaaaaaaaaaaaaaaagcaaatgcaacaaatcaaagataaatagatgagactcaattaaactaaaaatcttctgcctagcaaaagaaacaatcagcagagtaaacagacaacccaaagagtgggaaaaaaatcttagcaattaacgcacacaacaaacaattaaaacatccaacaaaggactaatatgcagaatctacaaggaactcaaacaaattagcacacacacacaaaaagaaccccatcaaaaagtgggctaaggacatgaatagacaattctcaaaagatatacaaatggccaacaaacttgaaaaatcgctcaacatcactaatgatcagggaaatgcaaatcaaaactgcaatgcggtatcaccttactcctgcaagaatggccataatcaaaaaatcaaaatataatagatgttggcatggatgtggcgaaaagggaacacctctgcgctgctggtgggaatgcaaactagtacaaccactatggaaaacagtgtggagattccttaaataactaaaagtagaactaccatttgatccagcaatctcactactggatatctacccagacaaaaagaagtcattatacgaaaaacatactcacacacgcatgtttatagcagcacaactcacaattgcaaaaacatggaaccagcccaaatgcccaccaatcaacaaatggataaagaaattgtggtgaaccagggaatattactcagccataaaaaagtaacaaaataatgccattcacagcaacctggatggaattggagaccattattctaagtgaagtaactcaggaatggaaaagcaaacatcgtatgttcttactcataagtgggagctaagctatgaggatgcaaaggcctaagaataatacaagggagtttggggattcgaggaaaggtgggcaagtggggtgagggataaaagactacacactgggtacactggtcgggtgataggggcatgaaaatctcagaaatcaccagtaaagaactttttcatgtaaccaagcaccacctgttccccaaaaacctactgaaattaaaaaaaagactgcttctataaatgagcataaacaaaagaaatctgaacagaaatcttactgttctacaacctatatgcctgaacccaggatgttctggaaaggggagtgtcagagttagacagcattagctcccaggcacatccaaaggcataaccaccccttcaaacaggcatttgggaaaacaccaggcaaacatctgtgtgtgtgtgtgtgtgtgtgtgtgtgtgtgtgtgtgtgtgtgtgtgcatgtgcgcacagtaggtgagacgtacaatgctcctcaaaccattttccaactgtgacactcccacaggaacaggccttggattggcccctggtagatcaaagaagcagagagccgattcaaaagaatattgatgcctcgatttgttgttacagtaaagtcttccttttcttttatggatcagaggagtaaacagattgacacacagatccttctaacttcaactcaccagaaattaacaaaaaagcaaaaaaactagtgctgtggcccatacaaaatgggctcccacccatgcaagacaaatatcaaaggggcaaaactctctggggaaggataatgagacactaaagtaaaagtaactatgacccaatggcaaagggaatcctttggcaggaagaataagaggaagcaacaaacatgcaaattacagacaaactggctggggactggtctattcccccaccttaaaattactttctccaaagggtgagtgaagtgcctgaccagacccataaaattataatacagctgccctccactgacttcctctatcaaaactgcattcctgaactctagatgaaataaatatagcatgatacaaattgtgaagatctatttatgacccccacttttaactgtttccccatgagaataaccatacagaatgaaatgtgtaaggtgatgccatttgccaagacttctcacatatatcatggtatatgtaggttgcctgagacttctttactaacccaataactgaaattcaaggccttgctactggttttgttgatgttatattctagcttcctatattttccccaacatttttattaaaatctagggaaaaaaatgattacagttttttggtaaatagtacaggactcatcttccatgttacctgaataagatttctcatctaccttttctgtctcggactaatgacagtcaaaagaaatatactagaaaaaatttaggaagcaatgaaatgcacaaataagataaaaaaaactaaactgtgcaggtctatgagtaatgtgacctcttattatcttatattagtatcaagactttagatctgactggcctgtcagagtctcacctttaaaattagaccctttatttccttgaattctggatatttggtaaaataataaagaaagaaaataaaagtaaacactttcataacactgagtgtttggtaaaatgaagtctttgtaacttaagacaaacattcagcttaaaattcagtgaaaatcaaaacaaagagaagctctagtatgggcgattaaattaatggccatataatttgaagagaggaaagcacaggagacatagccctagacaaaggggacccaagagatcagcataaaaatctcagcagagtcaataattaaatggattagagggaaagtgactatttgcatttctaatacttctatctcaaaattggtatttttaaaattgcccttgtttatttaaaaatcatgtacttaagaggaggcaatctcaaaatatttcgatttgggaggaaagttttctaatttctgttacgtacaccaataattctttcattttatgactaatgtattttctgtcctttgctgaccagttgaactttgctcaaataaacacaagtttcattgaaggttaagctgcggatttcaatcacactgcttcacaatgctaagggcattatttggcaggagacactaatcttcctcatgagatgttctggttcaaactttaaaactaaataacaacggtgacttctgcaaataaaaacttcaggtgctaacggtatcctggtgaagttgaatgtcaagatttcacaataagagggtcttcaatagagcctccaatgagcaatacagcccgacaaagcaaaaatttaattcatggacactatttcattcagccctgcttataatagaataatatttattagatttgcagtactcaacacgttttattttattaagcatacctatatttaggacttcaattttctagcactaaaaagtattttacatctaaatccaacattttatttactctactaacattaactatttagttttcttttcatctaggctgagtaataacagcaaagcaaattagaagtggtcactcccagacaagttttaagttacactaaagtgatctaactacactaaattttaaaatgccccgtcagatgaaaatcaaagaagagtatgctaaataaatgctgtacttaatcagattaaatgatttctagcatgtttagtttggatttccattagcttcatttccaataaaaatgagaagttccgggccgggtgcggtggctcacgtctgtaatcccagcactttgggaggccgaggcaggtgcatcacgaagtcaggagatcgagaccacagtgaaaccccgtctctactaaaaatacaaaaaattagccgggcgcagtggcggacgcctgtagtcccagctacttgggaggctgaggcaggagaacggcgtgaaccctggaggcagagcttgcagtgagccgagatcgtgccactgcactgcagcctgggtgacagagcaagactccataccaaaaaaaaaaaaaaaaaaaaaaaaaaaaaagaagttcctcaggtacctttttcttcttagtaaatacagaattaaaagatcacattacattatggtttataagaatatgaatagtaaaaacaacaaatcacacatggttccataatataacctataccaaaaagaaagcaataaatggatcaatacatttcacaaccaggaacccagaggtttttttgaagtaaggtataaattaaaacaacagaatgagcatatctcaagtatatacacattctcccaatctgccaagaaactctctcaactgagttaaagatgtttaaaagtcaggaaaacaatcaccaccttataaaagcagaactgccaagttcataattggaaatatcattctataataccactaatatacccacatgaacttttcccccaactccaaaacacccagcagaggaggtggaataagcacaaacaccacctccacattctgaagttaccgaaagtcctccttaccaatgggaaaactaacactttcaacttacttacaaaataactcatttccattccagataaaagcatatacacattaatcaacttaattttccaaatccccaattttaacttgtctgttaccttaagattatagtcccaataaatgacaaaaagaaaccaacccagccacaacctcacaaagtagccaatttttcctaataactccgggttaagtatcagcaatgacagtaatattgttaaacatcaagaacctgaagccattttacaaatagttatttggtatatctaataaccaaaatatctttgcaaatttgagaacaaagataacagtttatctgttaggcttcaaaacaaagaaaatgtgaaggacttgcccaaagtgattcagcaaattgtagcaaaaatgaaaatcaaattccagtttcccacccaggcacaaggtctaacctacaagccattctgaatactgcaattggaaacaatacatttttggaagttgaatttaatgtaaacaatagactatgttcaaatatcctttccatagatatcttaactaagattatttatttaatgtattacctaccatttgaaatggctttaaaagcagatacaataaaaccaataaaaccaaacaatacaaataagcaaaaataagttatgactaagagagagagagagtgtgtgtgtgtgtaaacagaaagaaaattaaaataaagatctgttaggagattcagttaagtttcatgtttcacattatccataatgacaaagtaccaggtcctagggctactgctcccaatcttttctgcctcataatacacatggaaaattatatttgtacagccactggaataaacagaagagactagccctccctccatcctcttctccacctccctgctcagctaaggggatcagttctcatgttctaatgtaatccatttagaccacaccagtaggctgtgtcacataggctgggaagttctgcctttgagagagcaaagagttcctggccctcgtgtctgaaaaatattccacctttttgctccttcataaaaggggcactgtacattaaggtagatgattacttcaaaaacagccataaagcacttcatataatgtacacatcagtgtaagctgagggcacaatgaatgaaggcatttctgcagagggctaacacaagtgggaaaactccaaatttaaaggaataatcagactatcgttcatgctgttcaccacaaatagcctttctctcaaacaggcttttgataaaaactgggaagtaagcagttcaaaatcacgtttcagagaggacttgagttcctatactttaaacgttaactgaacagatggtaggtatccatacttgtgtgaaaactgagcggcccaaccacacttcagactgggtaaatgccatcccaccaggccaaggcagagaactgggaaggtgacaagacaggtcatttcatcgctacattaggtgtgcctctttatttgtaactacctttgaaaaaatgaaaaaaatgtcttgtttggctttgtggaaaaatttataaatacttaggagccaaagtaaattccatttgcctgccctggcaggaacagaacccacagtgggttttcaattctccaacacacccggcctgaggttccagccctctcaagcctcctattcacaacatctttggcagccaagttgatcgatctattctccatacccagggagaagttggcaatacatgccaggcttgacatccaatcctctgatagagtaagaaaaatctccaactctttccaccaactcctgcaagaggttcctctgctacctctcaaaggacaaaggtctgaccccatgaatggcaaacctagtttgtaaagtaaatatgaaataaatcaaccacagaaatagaaatgcttgtgctttttacatgatttttctctatagtgtgatccaactgtggtggttgaaattacatctattagaagcctggaacaaataatcacatttatggctgtaactgaaacttccactcttaatctgagggcctggtttacaagctcatgcaaggtcccagataggtgtgttttaagttgatactgtcacaggcaatgtgcagctactacgtaagatacaccaaggggatattctttttgaaagaatatttgataaggaaaggctctgatttctcattcatccataaaaatcagctagcttatagcaaactacaaaacaagccagcagtcatccccaaattctctatagagagtagggtttaaaatgaactttccttaggcagactttgtgaccatgtccccattatgcctgcttcccacattaaaacactcaccatacatgatggttggtattcatgtaatgtctgccttccccaccagactgtaaacactgcaaagacaggaaccatctgccatatttaactactacatccttagtacatcgtacaatgttagatgtggaagaaacgcttaacatttgttgaatgaactatccaaagaaattaaacaagatcaaatactactttttgttttccttctttacatgccctcacctttcccaggctatgttaagctcaactctaccgtgtcaccaatagggccatgactcagtcctttctcattaaagatcacagagatccaggaaaaactgaaagagtaggaattaggaggtgtacaatgaggcctgggcttagtcaaatacttgcagttacaagtaacagaaatctgctcaggtgaacttaggcacaaatgggcatatccaataagagagagtggtatcttttgagctcaaaggcagaacacagccaggattctcaggggattaggaggatgaggaaaatcttgtgcatcacttgcttgggctttctctttatcaggagccagatgttcttccttccctggttcaccctaccttttctgcagatcagcttttttactctttctccatgcacacaaacgcctcacagctcttgggtttatatgttcccagtaaaatggccctgcccaggctgagactagcatttctgcctccaaattctaaattcctgggaaaatcagattggcccagggacaaacggccttaaccaggccagcttggtttttcctggctcccttctacggaggaggagcttctcagaaaagacagggtaggaagacatccccaaagcagtgcttgtgttttcgaccatgatgcgtctgctcttctttctcttgtctgcaactcccccaagatcactcaacctcatcacactctgccttttaagctggtttcctgtcatcaaacttggccttcactatttattctttctcattcaatgccttccactttcttcctttcattaaacttcaaattattctcaaagctgtaatgcatttactctcttacctggaatatgacaaacactatatttaaaaggtattttaatggacaaaattaacaaataagtcattttaataaatgcacagaatattttctttttattttcttctgtacttggaatgctacttattatgtagtagaataaacataaaatatggtcatatctgctttgtggtatttattttatagcctctgaatatattgtgcatttttacttgttttgaaaccaatatcacataaccattatttaagaataataccgagtaacctcttaacaaaacccctctcaataggaaggactacaaaacaattccttggaaactcaaatctatttcatgttctctaactgattgaaatgtagcttatttcctcatgcaataagattctgcctctctcaagttaaacaaatcttaaattcttgcccaggtcaattattacatcatctgaatgcgtaagattcctaggaacacaaaagccaatttctaaccaattgtgatgaagataactttctttttcacctctacacagtagtaatcttttgaatggattcaaaagatcatttcaaaatgatttcaagagaaatcatcttgaccatatacatcttgtttgtctgcaaatccctggcatctagatctgtggcctgtatacagtagatgcacagtaaatatctgattgactagcatgtatacttacatccatatatttaccaatcaacactatatacacgtggctttacatgtgttcatataaacatgtacatagatcatcaacatgtttgctataatgtcacaagacaatgttttcaaacctcaatgtatcttcaaattatctacggtttgggtttgtttcattttttttctttggagacagagagagagaggtggcatcttgctatattgtccaggctggtcttgaactcctggcctcaaaaaatcctcccgccttggcctcctacaacactgggattacagacatgatctaacccgcccagcctatctagggattttgttaaatgcagattttgattgagcagctctggggtagaacccaagagtacatttctaataagttctcaggtgatgctgatgctactggcccacagaccacattttgaatagcaaagtaatccctttttaactctatttagtagaacaccgaaggcaaagtatacaaataatcacaaggtcctctttctcaaagttcttgttcagtcataaggaaaatggatggtaatcctctcagggaaacacatctttattatcagaccaaatccttcaataagtatttattgagcacctatgccaggtgtaagagctatagtgagcttaagtcattcttgcatatagcttactaaatgatgaaaacacaactaaaagcttctctgtatctcagtgatatccaaataaagacagcattacaggatgacaccaaaatgtatgtgtatttgtataggggaaagggaatgagttagcaattaggatcctgtgccttcatgaggtccctattaacgctcatcttatctcaataagattcctcgcttgccatccccaaatccccatcattttgcccaggtcagcctctcccttttgcagcgtcatgggacctattgatctctgaggccaacttcaacttgctggattacagccctccctcatctcttacagttagatactgtggcaggtttgatgaagaagcaagaccagaaaaaatactggttatatcatttaaaaaacaggaaaaaaggctaggcgtggtggctcatgcctgtaagcactttgggaggccgaggcaggtgggttacctgaggtcaggagttcgaaaccagcctggctaacatggtgaaaccccatctctactaaaaatacaaaaattagctgggtgtggtggcatgcgcctgtagtctcagctactcgggaggctgagggaggagaatcgcttgaacccgggaggtggaggttgcagtgagccaagattgcaatactgtactccagcctaggcaacagagggagactccatctcaaaaacaaataaacaaacaaataaacaaaaaaacaggaaaaaaaaacctagagaattctctacttttccatttatctaaaccctcatcaccgccatggcttaaaaagaaagttcagcttgatcctgtaatgtacgacagtatcttctagaagcaaaacaggtaaaggaaggatatagcattcggaattacaagaagtttcttcttcccaaaaaaagcgttgaatactttgttcagcttggttattatcgtctatttactacaaaattctaaagacatgcaaagcctcaaagataatttgaaaatcatttaaaattattatatcattaataatcatttgtttataaacaagcaaaattgttgtttgagttattacagtactcttttgccagaagcagaattttaagcaaatctacaatttagcatgaatttattttggcatatgcttctgagactgggatacttatatcaagagatgaggtacactgcagcaagccagaaggtataggactccaaacaacaaacctgggggatttttctacaatgtcaattttaattaaggtttgaagggcaggaagtaagggaaatgtttaatacaagtaataataaatttaaataattattttgtgctaaaataaacatgggataggatgcccaaacttcattaattttaaagataaaagactagactaaaaagaaatttcctattttggggggccaggtcttcttcagctgtgggggaacttctgccagtggaataatctaagaatcacacatttcttttaaaagtgtacttggaagatccattatttatcagtgcaaggacataattctcagataagatcttggggaaatgaaatcaacatctaattagaatgtttcaatcctaagcaaatccttctgagaactgaatgctcaatgctgaatgtcttgaatttgaataaatgatataacaataaggcaaggacaaatttacttcacaaatgtaatcactggacaaaattttgaattgcctaaggacatactttacaaaatagctgaacaaaaagttggaaaagagagggagactgctgtaatcagaaagcctacgtgctgtagtccttcttccattaatcttattcagaagctatgaatatagagtcaatttcagaacaattttcttactttacatagtgaaagccttagaaaatctaaaatgatttaatatggtacttttcattataatgagaatcccaacctcagtcttctctacttaagaagaaaatacagagaaggcaatctgggaaggacatgtctggtttttcaagacagcgatttggatacttacaaggcattgcatggtatacgcttggccaatactgtccactgtctctctttaaccaaacacgaactgtcctacaacagaagaaaatatgtacatgaaatcacattattcttagccatgggaaaatgctgatacatagaaaacaaatctcttaatattatatatagagaggccaggcgcggtggctcaagcctgtcccagcactttgagaggccgaggtaggcgtatcacttgaggtcaggagttcgagaccagcctggccaacatggtgaaaccctgtctctactgaaaaaaaaaaaaaaattagctgagagtagtggtgtgcgcctgtaatcccatctactcgggaggctgaggcaggagaatcacttgaacaccagaggcagaggttgcagtgagtcaagatcatgccactgcactccagcctgggtaacagagagaaactccgtcttaaaaaaaaacataagagagagagagaatatcttaacatacctatgtatcttaaccataaatacatatatatgaacaccatatatacctgtctaaagattctatattccttaaacttgcggcttctacatattcagaattatatataactctttaaatatcatgccacacatgtgtaatcatgatagtgtttgaaaattattattttcgttcttgttgttttgcctttccaagcatctgacctttgcccttgacggctagaagcattcatctggctggggaactatttggttttattagtgaagggactacaaagagatcaaatgaaaaaatatgcagtatctgacatgaacagaatgattatacagtccatggtcttgtaagccaagccattgtctcaagggagtttttctaaacatgctcaagtaattataagctctgaggcagattttctgagctagtggcgtccatgaggcttgctatggaacagagtgatgctgcagcaaaggctgtgcatgaagttccaggccagcagctgtagagagacaaggcagacacctaggaaaagtcagagagcagacaccaaagactcaactagctgggaagtatcatgatgttctgaccaaacaaaaaggcccgaccatgaattatactagccataacatcatcagcatatgccagcaaggcaaacacaagtaggaggttgaaaggtattatcccggagaccagaggaaatagtgaacatcaaacaaatggaaaaagtcagtgtcccactgccaggggatcataggccacacacctcaccccacactcttaagccatcccagggttaaaagcagagtgacaaactgagcacttttatctcagagagagttggatacttcctaaagatactatttaagtcatcacaatggactaagttttaaattatattggatatctgccacctgccccactccagctaatcaggaggtcttctataaataagcaggctgtgcgcggtggctcacacctgtaatcccagcaccttgggaggccaaggtgggcagatcacctgaggtcaggagttcgaaaccagcctggccaacatgacaaaaccccgtctctactaaaaatacaaaaattagcagggtgcagtggtggacgcccataatcccagctactcaggaggttaaggcaggagaatcacttgaacctgggagggagaggttgcattgagccaagatggcgccattacactcctgcctgggcgacagagcaagactctgtctcaaaaacagtaaattaatttaaaaataaataaataaataattagtaggaaaaagactagaccaactacagatataataaagaaagaacatttaagttatgatgttaagtttgcatatacatgcaaaattcagtctttttggtcaattatattaatttgtgaggtgaacagatacaatggtaaataacttataagaattaaatctatgcatacacatactgctaatatagcgatacgcatatcggcattcactcttctcttaagcaagttctttttacaatacatgttaatacaaaattgttttattgagattattacctcaataagaatcaataccagagtaatatcacagaagatggtggactaagacactccaaaatcagtccctccactaaatcaactactaagctggcaagaactgtcagccccatccctacggcaggcagccatggagattgcggctcatgttccttgagtggcctgcttgtaccaggaagcgaacattgtcctccacagtttgtagggggtgtgtttgatttgtctggaaattcattgagagatttaagcaaaggctggctattgtttcaaacccttagggctgaagggcttcccaagcagtgtctttcaaaagaaattagagacagaaacttttttatccttatcggacgcaggcatttaaggaaatcactggctgactttagacataacagaacagagacctcagtgatcacatacaacaaggaatatagtatttgcaaaaatagtttagaaaagtcactaaacaaatggataactacagcactcaacaagtaagaacagcaacctctggagagggagaattatatgacttccagaattactgcattataatattcaaaacgtccagttcttaacaaaaattgcaaagtatacaaagaaaaaggaaaagaaaaacaaataaactgacagaaaaattcacagaaaattgacagaaattcacagaaaacagaaaaaaagaaattgacagaaaccatccatgaagaagctaaaacaggcttactataccaagactttaacagttttaaaaagacaaagaacaaaggaaatcaggacaaggttgtatgaacaaatggggagtatcaataaagagacagaaatttcaaaagggaatcaaagagaaattctggaattgaaaagtacaatagctgaaatgaaaaattccataatgaggctcaacagcaggtttgagagtcagaagagacagcaaacctgaagatgggacaactgaaatttcccagtctgagaagaagaaagaaaaaagaataaagaataacaaacagagcgtaagagacctatgggacatcatcaagtgtaccaacatatgcaatatggaattcctatagtaagacagatgaattctctatctagctgcactatccttccaaatgaaggggaaattaagacattctcagataaacaaaagctaatgaaattcattactagtagatcttccttataagaaatgttaaaaggagtttttcaggctgaaacaaaaggacactagatggtaacctgaagccatacaagaattaaagattactggtaaaggtcaccacacgagtaaatataaaagtaagtatcactgtatattttgtttataactcctctttctgtttcctaaatggattaacagacatatgcataaaacaagaattttaagtctatgtaaatgggcaacaaaaggggtaggaacagagctaactaggagcagagttaatgtacactagtaaaaataaattgatatcaattcaaactagattatataaatttaggtatacagaagagaaaaataagggaatcaaaatggtacatgagaaaaaatcaaacgtagaagaaggcaatagtggagaaattgagaaacaaaaaacaaagagatttaagacataaaaaataaatagtgaaatggcagaagtctttacttatcagtaatcactttaaatataaatggattaaactcacaaaaacagacactggtagaatggattttaaaaaaatatggtccaactttttgctacttaaatgagactactttaaacccaaagacacaaataggttgaaaatgaaacaataaaaaagacattccattcaaatagtaaccaaaagagagctaggtgggtatagtgataacagaaaaaataggttttgagtcaaaacttattacaagagacaaggacactatgtattgacaaaagggtcaattcatcaaaaaaataataattgcaaatatatatactccaaagaacagagcccctaaaatattaatacatgaaaagtaagcactgacagaactgaagggagaaatagagagttctacaataattggagactttcacttacaataaaagatagaacatccatacatataaggaaacagaagacttgaacaacactacaaaccaactagatctaatgatatataaacaacactccaactaacaacaacagaacatacatgtttttctgaagtacacatggaacattctctaggattgctcagctgttaggctgtaaaacaattcttaataaattttaaaattgaaatcatacaaagtatcttctccacgtataaaggaataaggctaaaatcaataacaaaaagaactggggaagaagttactaagaaaattagaaaatacttccagatgaatgaaaacaaaagcacaacacattaaaatgtattgggggctgtgaaagcagtactcaggaagaaatgtatagctataaatgcctatattaaaaaagaagatcacaaatcaataacctaattttataccttaaggaaaagcaaactaaacccaaagccagcaaaggaaggaaataacaaagattagagcaggaaaaaaaaaaaaaaaaagggaaagatagagaatcaatgaaacaaaaggtcagttctttgaaaagatcagcaaaagtaacaaacctttagctaaacagaaatttaaaggattataggagaaaatttatatgccagccaattagataatctagattaaataaacaaattcctagaaacatacaatctaccaatactgactcaagaagaaatggataatctcaacaaacctattacaagtagagattgaatcaataatcaaaaacttctcaacaaagaaaagtgcaaaaccagacggcttcactggcaaagtcaatcaaacacttaaaggagaatgaacaacaatcctattcaaacttcagaaaaatggaagaggagaaaatactttataacacattctatgaaagctggacaaagataccacaagaaaactacagacttaaatcttcatgaagacagattcaaaactgcacaacaaaatactagtaagccaagttcaacagcacattaaaacgattatataccatgactgagtgtgatttatcccaggaatgcaagggtagttcaatataagagaaatcaatcaatgtgatacggcacattaatagaatgaacacacacacacacccctcaacagacacagaaaatgcatttgacaaaattcaacaatctttcatgaaaaaaaaacatagcatactaggaatagaagaaaatttccttaatctaataaaggatattcatgaaaaatccacacttaacatcatactcaataaaaagtgaaaacatactccctaaaatcagtaataaggatgctcaatttcatcactgctattcaacattattggaagtcccagccagagtaattagccaaataaaagaaataaaaggcatccaaactggaaagagacatgtaaaactatttctattggaagatgacataattctacttatagaaaatcctaaataatccactcaagaaaaaacgactgaagctaattaaattaattaagccaagttacaaggtgcaagatcagcaaacagaaaccatctgtgtttctaataacaaatatttctaaagaaattacagcccccaaaacactttacatatatatttaatctttacaataccctattaaatagagctctcttcactaaatttactaccctccttataccaacttgtattgaaggcaattgataaatctttacacctaaaaataaaagtacagtatataaaaatatctgttctcttatctcctgaggtacaaaagcagcttaaaaaagaaaaaaaaggttctgcatcttagagatcaaaagtgccatatggatggttaggaatttcctaaatgaatgtgaattttactatacaaagccttagaagtaagttttaatttttctgaaaattgttattttaaaagcaacatgaaaaacatttttccctgaagaaaattttcagaaaatgacaactatggttacgagtcatattaagcccgcagaggttagggtattgggggaaaaaaagtctgggtggagccaagatggccgatcaggaacagctccagtctacagctcctaccgtgagcgacgcagaaggcgaatgatttctgcatttccacctgaggtaccaggttcatctcactggggattgtcggacagtgagtgcaggacagtgggtgcagcacaccgagtgtgagctgaagcagggcaaggcatcacctcacccgggaagcacaaggggtcagggaatccctttactagccaaggaaaggggtgaaagatggcacatggaaaatcaggtcactcccaccctaatactgtgcttttccgacagtcttagcaaacggcacactaggagattgtatcccgcgcctggctcggagggtcctacgcccacggagccttgctcactgctagcacagcagtctgagatcaaaatgcaaggcagcagcgaggctgggggaggggcgcctggcattgcctagggttgagtaggtaaacaaagtggccaggaagctcaaactgggtgaagcccaccacagctcaaggaggcgtctgcctctgtagactccacctctgggggcagggcatagccaaacaaaaggcagcagaaacctctgcagacttacatgtccctgtctgacagccttgaagagagtagtggttctcccagcacacagcttgagatctgagaacggacagactgcctcctcaagtgggtccctgacccccaagtagcctaactgggaggcaccccccagtaggggcagactgacacctcacacggccaggtactcctctgagacaaaacttccagaggaacgatcaggcagcaacatttgctgttcaccaatattcactgctctgcagcctctgctgctgatacccaggcaaacagggtctggagtggacctctggcaaactccaacagacccgcagctgagggtcctgactgttagaaggaagaaaagctaacaaacagaaaggacatgcacaccaaaaccccatctgtacgtcaccatcatcaaagaacaaaggtagacaaaaccacaaagatggggaaaaaacagagcagaaatactgaaaattctaaaaatcagagtgcctcttctcctccaaaggaacgcagctcctcaccagcaatggaataaagctggacggagaatgactttgacgagttgagagaaggcttcagatgatcaaacttttccgagctaaaggaggaagttcgaacccatggcaaagaagttaaaaaccttgaaaaaagattagacgaatggctaactagaataaccaatgcagagtagtccttaaaggacctgatggagctgaaaaccacggcacgagaactacgtgacaaatgcacaagcctcagtagccgattcgatcaactggaagaaagagtatcagtgatggaagatcaagtgaatgaaatgaagcaagaagagcagtttagagaaaaaagaataaaaagaaacaaacaaagcctccaagaaatatgggactatgtgaaaagaccaaatctacgtctgattggtgtacctgaaagtgacggggagaatggaaccaagttggaaaacactgtgcaggatattatccaggagaacttccccaatctagcaaggcaggccaacattcacattcaggaaatacagagaacaccacaaagatactcctcgagacgagcaactccaagacacataattatcagattcaccaaagttgaaatgaaggaaaaaatgttaagggcagccagagagaaaggtcgggttactcacaaagggaagcccatcagactaacagcggatctctcggcacaaactctgcaagccagaagagagtgggggccaatattcaacactcttaaagaaaagaattttcaacccagaatttcatatccagccaaactaagcttcataagtgaaggagaaataaaatcctttacagacaagcaaatgctgagagattttgtcaccaccaggcctgccctaaaagagctcctgaaggaagcactaagcatggaaaggaacaaccaataccagccactgcaaagacatgccaaattgtaaagaccatcgaggctaggaagaaactgcatcaactaatgagcaaaataaccagctaacatcataatgacaggatcaaattcacacataacaatattaaccttaaacgtaaatgggctaaatgctccaattaaaagacacagactggaaaactggatgaagagtcaagacctatcagtgtgctgtattcacgaaacccatctcacatgcagagacacacataggctcaaaataaagggatggaggaagatctaccaagcaaatggaaaacaaaacaaggcaggggttgcaatcctagtctctgataaaacagactttaaaccaacaaagatcaaaagagacaaagaaggccattacataatggtaaagggatcaattcaacaagaagagctacctatcctaaatatatatgcacccaatacaggagcacccagatacataaagcaagtccttagagacctacagagagatgtagactcccacacaataataatgggagacttgaacaacaaccacactgtcaacattagacagatcaacgagacagaaagttaacaaggatatccaggaattgaactcagctctgcaccaagcggacctaatagacatctacagaattctctaccccaaatcaacagaatatacattcttctcagcaccacaccacacctattccaaaactgaccacatagttggaagtaaagcactcctcagcaaatgtaaaagaactgtctctcagaccatggtgcaatcaaactagaactcagcattaagaaactcactcaaaactgcccaactacatggaaactgaacaacctgctcctgaatgactactgggtacataacaaaatcaaggcagaaataaagatgttctttgaaaccaacaagaacaaagacacaacataccagaatctctgggacacattcaaagcagtgtgtagagggaaatttatagcactaaatacccataagagaaagcaggaaagatctaaaattgacaccctaacatcacaattaaaacaactacagaagcaagagcaaacacattcaaaagctagcagaaggcaagaaataactaagatcagagcagaactgaaggagatagagacacaaaaaaatgcttcaaaaaattaatgaatccaggagctggttttttgaaaagatcaacaaaattgatagaccactagcaagactaataaagaagaaaagagagaagaatcaaacagacgcaataaaaaatgataaaggggatatcaccaccgatcccacagaaatacaaactactatcagagaatactataaacacctctatgcaaatatactagaaaatctagaagaaatggataaattccttgacacatacaccctcccaagaataaaccaggaagaagttgaatctctgaatagaccaataagaggctctgaaattgaggcaataattaatagcttaccaaccaaaaaaagtccaggaccagatgcagtcacagccgaattctaccagaggtacaaggaggagctggtgccattccttctgaaactattccaatcagtagaaaaagagggaatcctccctaactcattttatgaggccagcatcatcctgataccaaagcctggcagagacacaacaaaaaaagagaattttagaccaatatccctgatgaatgtcgatccaaaaatcctcaataaaatactggcaaaccgaatccagcaacacatcaaaaagcttatccaccatgatcaagtgggcttcatccctgggatgcaaggctggttcaacatacgcaaatcaattaacgtaatccagcatataaacagaaccaacgataaaaaccacatgattatctcaatagatgcagaaaaggcctttgacaaaattcaacagcacttcatgctaaaaactctcaataaattaggtattgatgggacgtatctcaaaataataagagctatttatgacaaacccacagccaatatcatactgaatgggcaaaaactggaagcattccctttgaaaacttgcacaagacaggaatgccctctctcaccactcctattcaacatagtgttgaagttctggccagggcaatcgggcaggagaaggaaataaagggtattcaattaggaaaagaggaagttaaactgtccctgtttgcagatgacatgattgtatatctagaaaaccccattgtctcagcccaaaatctccttaagctgataagcaacttcagcaaagtctcaggatacaaaatcaatatgcaaaaatcacaagcattcttatacaccaataacagacaaacagccaaatcatgagtgaactcccattcacaattgcttcaaagagaataaaatacctaggaatccaacttacaagggatgtgaaggacctcttcaaggagaactacaaaccactgctcaacgaaataaaagaggacacaaacaaatggaagaacattccatgctcatgggtaggaagaatcaatatcgtgataatggccacactgcccaaggtaatttatagattcaatgccatccccatcaagctaccaatgactttcttcacagaattggaaaaaactactttaaagttcatatggaaccaaaaaagagcccgcattgccaagtcaatcctaaaccaaaagaacaaagctggaggcatcatgctacctgacttcaaactatactacaaggctacagtaaccaaaacagcatgttactggtaccaaaacagagatatagaccaatagaacagaacagagcctttgtagggacatgaatgaagctggaaaccatcattctcagcaaactattgcaaggacaaaaaaccaaacactgcatgttctcactcataggtgggaattgaacaacgagaacacttggacacaggaaggggaacatcacacaccagggctggggcctattgtggggtagggggtggggggagggatagcattaggagatatacctaatgttaaattacgagttaacgggtgcagcacaccaacatggcacatgtatacatatgtaacaaacctgcatgttgtgcacatataccctaaaacttaaagtatttaaaaaaaaaaaaaaagtctgaccgctgaaatgcagggaaagtgtcctttcatcccccacataaagccctgggttcgcagtaacaggacagggccaaatgcaccgcacagtccatcttgcacgtgctgttttcttctctccctgcctcttcctctctcctaagctcccagcacgaggcacaaaccaacactgggagaagacaatgctcatctaaaaataccaagatgaagtagcccatagtcggtctcaagcagttcagcaactgggctatttatttttattttttattttttgagaccgagtctcactctgttgcccaggctggagtgcaatggcacgaccttggctcactgcaacctccacctcccaggattaaatgattgtcctgcttcagcctcctgagtagctgggattacacgtgcatgccaccacactcgggtaatctttgtatttttagtagagacgggatttcaccatattggcttggctggtcttgaacctctgacctcaagcgatccacctgccttggcctcccaaagtgctgagattacaggcgtgagccactgagcctggcctgagctatttaaaaacagcataatttcattctgtgttggatacagctgatcacatttcaacaggttaaaattacttttaaatatcagccctattctgtagacctaaaacaaaattgatttttattttattttactttaagttccgggatacatgtgcagaacgtgcaggtttgttacataggtataagtgtgccatggtagtctgctgtacctactgacccatcctcaagttccctcccctagccccaaaattgcttccttaaggttaaaacggatgtttgataaattgtggtgtttatatcaaagttctactaggatcagtgctggtttgctccttgactgggctataaatgcaagcagagaaggaaccacattttaccatatttgatatttgccccaaggtcaagcactacatcaggcccaaaagtggtgctcattgtttgtgaaagattaaaagaatcaatcaaaaatctctccctatggccatggccaccccaacctacctgtccactgtcagaaagtcctctgactgcacctggacagacatctagtgcaaaaaggcagcaaggaagctaggttgatactgagaagtctatacactgtgctgcataagatgatgggagggaactatgaatccttaattgcacagctccagcccttatttcctaaagaaatactgacgggcagggaattcccacgtgcctcccatctcaccccaactctctccaaaggactaaattcagtgcctgcctcagttacaaccttaaccaggacaagtgcgacctcagggacagcactcagcacagtagccagtctgatcaggcagagggggactcacatgttcaactaagcagggaatcatatgctccctttctgagatcccaattttttagtttgtatttgactttcttgttttaaactgtgctgacacacataagctggcagtagttttatcagacacagttgctaaactgactcgtgtgtgtgtgtatacatgcatacacatacatagtcatgggctgcataacaatgtttcagtcaacattggaccacatatataatggtggtcccataaggttttttttttttttttttttttaagagagagacatggtcttgctttgttgcccaggcaggaaggcagtgacacaatcatagctcactgtcactttgaactactgaactcaaatagtgatcttcccacctcagcatcccaagtagctaaactacagatgctcaccaccatacctggctaattttttaaaaaattttatagagacggaggtctcactgtgtttcccaggctggtatggaactcccggcctcaagtgatcctcctgccttggcctcccaaagagctgggattacaggcatgagccactgaacctagtccccctaagattctaataccatatttttaccttacgctttttatgtttagatacacacatactcaccatttgtgttacagttgcctacattattcagtatagttacatgatacacaaatttgtcgcctaggaatgacaggctatatatatcatacagcctagggacgtagtgggtagaccatatagttttgtgtgagtacattctatggcaatcacacaatgactaaactgcctaatgacatatgtctcagaatgtatccccactgttaggtgacacatgactgtatccatggggactggttccaggatctcccccagattttgtatgctcaagtctctaatataaaatggtacagtatttgcatatgacctacatacatcctctcgtaggctttaatctctaaattacttataatacctaacactatgtaaatggtatgtaaacagctgttatactgtattgttcaggaaataataaaggaaaaaaagtctatacgcattcagtgcagatacaaccatccttcctccccacttcccccaaatactttccatccaagttttgttgaatccatggatgcagaacccacagataagaagggccaactggatatggcaaagcaccacaccaggttcatgcccctacccatcctagcctgcaaagacatatcctttgtgctatattctagcaatctttaggagtctgcttatagtgatgcagatagtgaacaacaggttctgacaacttggattttccaagactactaaactctagaagttaggaattctcccccactgcctcacaagtgcacttatatacattcattcattgacttgttgattcattaatttacacgacacacatttatcaaacacctactaggtactggtatgtgaaacacactggaaccacaaagaaaaacaagtgccacctctgttgtcaggaagctcacagggggagacaggtcatagaacattacaacaaagcaaggtaagagctaaggtatggagatgcccatgctgtgataggggcacgtgggggcatctaactctgactacagagcccgggctcaggcagggttaaacaaagcttctcagaaataatggtgtctgaaatgcagggtgaaaaggcatttggcagaggaaagtggagagggcgtaggagcacattctgcaggagcattgcctctgccgcccagggaggcaaggcgagcaggagtcgtgagaatccagcctggacaaagaacaggcagaaggccaccgatgctgaggatgaggagctggtcacaaaaccacgcttgttcttgtttgtttgggggcagcctggaaaaggcggggttaccctgaagtaaccagtttggaggatgtaggcagcaaaccaagtaaaaaaggatgaaggcctagaagagagaggacagattttagagcagtcaggaagtagaagcatcaggacttgggggctggctggatgtagggtgtcatatgaatggtggtgtcattcatcagtaagtgatttttgtggaaggcaatgttgagttcatcttgaacaccctgagtgcagggaaaatccagttagggctgttgcagagaaaactgtctacatgaagttcaggggtaagacctgggctgaaaattaagatttgggagacatcagcatataaggagtagttaccagagaataagaaaagaaggccaacaacaaagacaaacaccaagagttaaggggtggtcaagagaaaaacatctgcaaagaccttagcacaagccagcagagaggcagaagaataatccttctttactttacagacacaaaatatgtcctgaattttggtccagaaaataaggtcatcataagcacacctaagagctgaactatattcacagtggaaacgtgcctacaataaaacactatctatataggtcatttttctgagagaaaagggaaggctgggggtggcaacaaacagtataccacaggttgctaagctactgaataaaataagacggggcgtctacccatgttgaaatcaggcttttaaaaatgtgccctagaatgatgcaaccttcattagttaccatagcaatgagcttcatttcccaggggacaattgttatttttgccacaactgaagtaacttggggtaggggctgggagaagtgaagcccactgggttttgaaggccctgaatttccagggaatacttttctacagatcacaccctgcaacagcaatacaaacagaaggaaggcagcccctagcgatctgcaaactaatagaaaaactttgagcaacaggatgtagttttcatagtcatttgtttaaagagaaaaaaaagaaaaaaaaaagcttcaaacgcagaaaatgttgcagagattcttagaaaacatagctgattttttaaaagttgatttctctatgattatcagatttctttaattacttgtaataaaaacaaactgagaggttcccagcaaatgcattccaaccacatatagtaaataacctaaacccaatcttctacaatgcactgtgtatcttttgtttccagggtttctccatgatagacagatgctactgtgtggaaactgcaagtgaattgaggtggccagcggtttcaagactcagagactcaagctgggtgttgtccagtattgtccagcctctggtcccctcttgccaaggagctcagttctcacattaatgaccttggtacaacagacccaaataactttgctgaatcatacacctggactttttttttcctcacagctgtagcaactcagcaatcagtggctagagaagaggtatggctattttatatttcaacaccttgggcttttaatggcactcttgctttcaaaacactcaccgccattccagttatttgcagttatttgcatcagcaaggtgtattatttattccagccatctccccttggagtttttatcagttgggtcatttctcttaatccaaaggctgtgaaagccttcacaatttagaatttttaaaattacagtcaagtgacaacattttcagtgtttttaaaatctataaaatgaagtctcaacatgaggttaattggacccatataccaggtgagaattacaaacaatatacctggaaatggttgtcttaagcagtcagtagtaagaccctcgagagggggaaggaaaagatgagccacaaggtcttaattcggagtagttttcttacaaatagcactattttgtgtctgcagatagtgcccttgtattgcagacttggcttttgtttttttagtaatttaactcttactgactaatgcttaagcactgcttcctgtccttgcatagttgtgggttttatacttccctgactccctctgtctctccccagagatacacacatatccactttccctatgaagccttggcaattcctcaggcaaaactaagctccagaatcccactgtaccttgcacaggcctatgttaggacacatcacattaatcaatgttagttagcaagtccttcttcctatgacacaagaaattccctgaataatcaataattccttatttgaataaagattcaaacatttttgtttttttagagtacctacaatactttcatttttatcacatacagtatttagcatacaggaagtgcttttaaaaggtcatataaatacagggaaaaaaagaaaaaagaaagggaaattaaagagaaaaacgaatattgtccaagcagtggtgaggaagaacccacaaggaagtagcaggaacagcaatgcaccagaagatcatggaggctggacagggccctagttattagcatcagccatgccatctgcaacacagccagagtccctcacaggcaagagaaacatgagtaccacccttgaactggcagcctaagcaattcaacaatatgagagtgttcatcaataccaccctgtaggagaaatcgggatgatatcattagaggaataatatagatttaaatattgttcttggctctatacacagtgggagggcatggtctgtgtcatcctactcaccaccatattcctccagccagttacagtggcaggcatgtgaaaaatgctcagtagaaacaatgaaacagtaaatggaaagagcagtgattcagaggatgcccctggctgctactgttctgaatctgagatggattaactgttgtcttccaggatagtcatcttaaaaatgcagcagatcctgggggaaggggaacaaggagtgattgtgtaatggatacagaatttccgcttgggatgatgaaaaaattctggaaatggacagtggtgatggttgcacaagactgtgactatacctaatgacaatgaattgaacacttacaaatagttaaaatgatacactttatgttatatatattttacaatttaaaaaaaaggaaaatagcagaatgattctctctctccacaactgtagtcttcatagagttgccaaaggtgcagcaattaaagacacatggccacatggctgggcgcagtgcctcacgcctgtaatcccagcactttgggaggccaaggtgagcggatcacgaggtcaagagatcgagaccatcctggccaacatggtgaaaccccatctctaaaaatacaaaaattagctgggtatggtggtgtgcacttgtagtcccagctactcggtaggctgaggcaggagaatcacttgaacctgggaggtggaggttgcagtgaggtgagattgcaccactgcacttcagcctggcgacagagtgagactccgtctcaaaaaaaaaaaaaaaaaaaaaaagacagatgcccacaggctggtcacgaagcaggtttataaaagttattctggttgagaatgttatcattaaaataaaaacctctggctgggcacggtggctcaagtttctaattacagcacattgggaggccacggtggatcacttgagctcaagagttccagatcagcttgggcaacatggtgaaatcccatctctacaaaaatacaaaaaaaataataaaattagccaggagtggtggagcacacctgtagtcccagctactgtggaggctggggtgggaggattacttgagcctgggaggtggaggttgcagtgagccgagattgtgccactgcactccagcctgggcaacagagcaagactctgtctcaaaaaacaaaataaaataaaataaaaatctcaagggtcaaataaatcaaattagctacaagtgaagaaagaatatataaattgtaagataaatgaaaagcaatctcttaatagaatacggtattcacagagacaaagatatggaaaatgtgaaaggctgaacatgaaaaacaaggtaaaaaagattagaatgaaaaggtctaagatatagataactggaaagactaataagaaaatgggggaaagggtcaataattgagagataatatctcagactcttagataaattttgaaaaatgccaatcctaaaatgaagacaactaatgacaaggaaattagctcaagatcagatcaaaatgtatttccttttccagattaaataagattattacgataactgtaactcaactacactcccattttcctgatatcctggaacattagacaaaatatttttttttttttttttttttttttttttgagacggagtctcgctctgtcgcccaggctggagtgcagtggcgggatctcggctcactgcaagctccgcctcccgggttcacgtcattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcccgacaaaatattctataggaatgcatgcagacctcttcagagaaaagaggaattcaatcatgcatcattagattataaccacttttctttgctatgctctcataaaaaacatgccaaacacatttttcaataccacctcttatatttcagtggtgactagaaatgctccatgaacaggctggctgcggtggctcacgcctgtaatcccagcattctgggaggccaaggtgggtgatcacgaagtcaggagttcaagacgagcctggccaagatggtggaaattccgtctctactaaaaatacaaagaattagccgggcgcagcaggcgcctataatcccagctactcgggaggctagggcaggagaatcatttgaactcggagggcggaggttgcagtgagccgagatcataccactgcactccagcctgggcaacagagtgagactccgtctctaaataaataaataaataaatgctccatgaataagatggacccaacttggatagaacgtggttttagaaaataacttccactaacaaaattaaatacagcagagcagaagacagaaagtccaactcttctgcctgcgctgtctctatttctctttatcctttatgaatcatcccagtgagcaaagatataatcatccccagcaggtgtgtgaaggtactagctaggactctagaggaattaaatgattcgataaatcttgttgcccaggctggagtgcaatggcgtgatctcagctcactgcaacctctgcctcctgggttcaagcgattctcctgcctcagcctcaggagtagctgggatgacaggcacccaccaccacacccagctaattttttgtatttttagtagagacagggtttcaccatattggccaggctggtctcgaactcctgacctcaggtaatctacccgcctcagcctcctaaagtgctgagattataggcatgagccaccgcacctggcctattcatttatctctgtgtgataaagaggcactagggtatgtggaaccagttatcctttatagatatgtactgtagcattaccaggtaaaatgatagagtaatctaaaatttgttcacagcaaatcccaacatccatacccaacaaagggtggaaggagtagatgcatgaaatacgactgacaaaggttgataactaaagctgcatgacggatatattgctatttctgtgtgttgtatatatttgaaattgcccacaagaaactgtttttaaaaatcttcagcttttgactcatatcaacaattgtataaattatatacaacagcctcttctgggagcacagattataaatagaaaaacagtagtgattattaattcaagcagtactaaacacttttgtcatttacttagcaatctgaattgatttaatatcctttattgatattaataaaaagttcacagataaaacactttatctctagataacaaacaaattctgggcttctaaaatgaatgaaccaccttgaataaattgtgcttttaaagatttgaacagctgaggctaattatctagcatatttgcccaaatgttaaaaataataataattgatacacagtatcagaataatcctgctagaaattttttaaaagctctcatgtcaaatattctcaatatatatgatggtagtatatgtcaatgagaaaggagacaacagcatatgggcgtctttgaagttagcagagtagatgaaaatgcctacttctgcagtgcttaaatgtatttcattagaagattaaattctcctcactactgaaaaacaccaaatggcataaaataattcagattccacattacataatctacattatttcgaatatccatctactttcctttatgacaaagagacaagtactgagtttctggatggaatcataaaagccctcataatccagcctatattaaaaaataagactaaccatttctcacaaactttaaataaatctgatatgttttgtagggatacaaaggaggtataaaacaaaaaaatctaaaagacaatgatatatcattcctctgccaagtcaaataaacaaacgacagtaactactgccctctacaattttgcttggaataaagtgatgattttgaataaatggctgaaaaaagtctcatgttatcttggaaaaccacagtatacagataacccctcctcctataatcaacctttcttcctgtgggttttggtgatgcataatgtatactcatgaatgttaataaatcccataaatcaaaatcacattaccttttcttccacattgagcctttcccataagcttctatagaattgtgcatcaatgttccttgatatatcaaagtacatggtgtaaaaaagtgcagatgaacccacgatagcaaaatttctttatatttttggttgagaaaagtctcttgccagagacaattcattatattcttgacctcccttgattttgtgacaataaaaaaagcatacatgtaaactcattaaatgcacagagaagccatagaaacagaaacttctgtttattagcccttatttttgtttttgtggggaaagtggggtaaaagcaatagctgtaactaaattattttctaaaattttcttcaagaatttatcaaactgcaaaaagattctgaaattccaaagaatcttgagcttgagctaaggctgataagccacatagtcccttcgccaaaggccattccgtaatgaagcataacatgtaaatcattgctctgcatattatgcatcagtatcaagttaagccctgcaaaaataaaaatccaaaaagtttagcagtgcccaatatttttactagccagcatactttcaaggagttatgtaggtaataaaatgaatgaaatcagcattttctgactcacacagcatagcttttcatgaatgggtatttttgtgtgcaaacggattaaccctctgatctcattttaatgagtttcttttcgtctttgagggactacactgcacggaagctcaatcattctatagtcatttaaatcaatccatctaagagttttaagaaatccactcacttgcacttatttgggaatactaaattcaccaaaatttaaacgcagagaataaagttatctcttccatccaatatgttgctcagccctgtcaaattcttcctccttaatgtgactaaaatctgtcttctctgctatccgtactgccttagttcacactctcattaataccccacccccaggagcatactagctggtctccttactccttttcatccttctctgatcccttcttcacccaggccctggcagtcatctttctaaaatccaaatctaattatgtcagaaccttcaaagatttgaggaccacgctcaactctatagtttaccaggccctccaggatctgacctctgtctgtttctctgaccctatccaccctagctgcccaacgctggccccattagtaaactactcttgtcagaggcattcaaaccagagtgactccatctggagtgagggctaggaaaatgaggctgggacttgctgggctgcattcgcagaaagttaggtattcctagcctctagatgtttacggttaaaagaactggtaatgtttactaaacagacccagacttgggagtgtcctaatatcccaatatcttgagaacaaaagcattcctaattttgctttaaataatatcaattcttgcaaaatacagtaattaagacaattaatcctttatcacaaacccttgtagcagagcacatctccccattatcttttttatcctatatgtacaagcactgtacctagggtggacgcattcctccttttactttcaggaatgccctactctgtctatggagtggttattctttcaccactttactttcttaataaacttgcttttgctttgcactgtggactcaccctgaattctttcttgcaagagatccaagaaccctctcttggggtctggatcgggacctctttcctgtaacactcagttctctaacatggtagctgacaaacatttggatttcataggtcaaaaaaacaataacaaaaacaactaaaagggtagtgagtgaaacagagggttgccaacttttcatttgccaaaaaaaaaaaattatttcaaacaaaaacaaaatctacaatttgctagcactttcattttacaaaaagttaagaaaaacatgatcttatcattttaaaacacaaagaaatttaattctagaaataaaatgctcattgcattgccccatccccttttttaaaaatttcactgcacactggtaaaaccttttgcatgaacttgctcaatgaaatccctgccctaactcatcatacctctatgtccctgcacatgctggcctcctgcttaggcaactgttcctcctccatccccagttttcacctgcaaaactaacacaccttatagtgccaggcagtccttttcaaattttaatgtgcataagaataacctagggatcttgttaaaatgcagattctagtcacaaatattttgtctggtgtttcttctagaagttttataatttgaggttttacatttaagtctatgatctgctttgtattcatttttgcatgtggtatgaggtatggatcgaagatcattttttcacatgtgtgtacccaattgttccagcaccatttgttgaaaagcctgttctttctccacggagttgccgttgccctttggtcaaaaataaagtgaccatataaacgtgggtccctttctggactctatcctgttccactgacctatttgtctaggccaagtgatctcactcacatgtatctagatggatcatgatccaaagacaaagagcattctgtcagatgacagaggacctggaatatcccagacctcttgaacgtttgccttgttttctttcccctgctgtactgtatcctgtctttattaaagccttaggtaaatatactttgtggagtctcatgagtactttccatacctgaccccgggtaattgctgtggtattttgctttccgtcattaaaaagacctttcttatcacgaagcccaaggactggctgttctccatcatgcctcaatgggtcaaggttaattccctctttgcctctctgctagaactggcacttcccaggttaactgagggctgatcatagcctataggcctgttttgataataaccagttaaccatgaccaaggtaactaagatcattgtaaaatgaggaattttttagtctgaagcgtgtttacaaatcagagtgtgtgtgccagtgtgtgaactgcaaatatgcatgtataaatgtgtgttacagaggtagctgaagctaacagactcattgacctgaaaatgaacaaaactcagcaaaaaccaaaatctttcaagaaatatcaccaattacctaatggacgattgttggggttcctgatatatgtaagggaagacaaaattgtgcacccagcatgttgaaaaaaaagatgatgaaacttccggtgggcattccttccattaagagagtcaagccaggttaaagtgtatgtaggtgcttccatatctgagaagggaattacactttggtactgcccagatatagggacaccagaagagaaatggggaatgagggtatggttacagtaaagctgccagttttccttccattagttgaaaaaattaaataatagtagcagaaggactaataacatattgagcattcattattttcagacacattgtgttttatttgctttgtatcatttaatccttacaaaagtactacgagtaagagagatcctgttttcacttcccctttagaagtgagaaactgtagtgtggagaccctcacctgtctgtagttcccaagccatggggaagaagaaccaggagttcctcccgggagtttgactcgaaagcctaagccttaccatgagactatttctgaagctgtctgaatgctcagagagaggaagaaatcagacatggaggacaaaaggtgaaatgcaggaagtttggtgaaaagttttcactatttagaaaacagaagacaggaagccgaaaaaaatggcttataggcatttagagcaccttgcacagtgcattagctagatctggatttgatcacgtctaatttatgcctcaaggtacagagacaaaatacatgctgttctgtgaaattctctcaattacgcaaagctgctgttcttcacagcctggcatgaaaaatgatgatcacgtcataatttctctctcaactcttgccatttaaaaggtttaggacttcctgccgggggtgcagtagctcacgctgtaatcccaggactttgggaggccgagatgggcagatcactgaaggtcgggagctcaagaccagcctcgccaacatggtgaaaccctgtctctactaaaaatacaaaaaaaaaattagccaggcgtggtggcaggcacctgtaatcccagctactcgggaggctgaggcaggagaattgcttgaacctgggaggcagaggttgcagtgagccaaggtggtgccactgcactccagcctgggcaacagagagagactccatctcaaaaaaataaaactaaaaaattaaaaaataagtaaataaatgtttagggcttccttatggggggactctgcattcttcccttccctctactccaactctgacctatggataaatccacttaacccaaccatgatgcaccctattgttttgatcaataaacaaatgtcttcacaaaaaagtcctccttgctctactatagttctttcctggtactgaatatatggggaaaaaaaaaacaaaacaaaaaaaacagccttttccaatcttatagacatgcaccaccacacctggctaatttttgcattttttagtagagacggggttttgccatgttggtcaggctggtctcaaactcctgacctcaggtgatccacctaccctggcctcccaaggtgctgggattacaggcgtgagccattgcacctggctgccttttccaatcttagtgctaacaagtattataaatttacaaaagcttaattgactcttacctggattcatgatatatttttaaatctttgtgtattaaaaggctaaagtactacttttccttaggtttggtaaatatatattgagtatttatcatgaatcaggtctagtactaggaatacaaagagggtaaaaatgggttcctggccctcacagaactcacagagtaagattttcatccactacttctgaaaaaaaaaaaacacttctagggctttgcaagactacactatcagttcttggttgttaaagccctgtaataattcaaataactctcataaagccaagctcagttttaatgacctgagaattatttaatctttacaatggtcctctaaattgggattatcctcatgtccattttggagctgatgaactgaggcaaaaagaagttaagtaatttaggtaagtaattaatttaacctcttagaaattaatcaaaggagccagaattcaaacccaggcaacctgtctccaaacatcatgctcttaacaacgattctctcctgtcactgaagaaagactaaaatagtgtggcactgcaccagattaaacagaatgaccaatgggaaagaactgaaagctcagaaacagaccaaagtatatatactaactagcatattaaaaatttattaaaaatcatagggggacaaatgaattacacaataaaaggtgctgccctatttatttatttggttctaaaaacttcaggtggtttaaagaattacctgtgatggtctagaatcaagatgatgcatgtgactccctcccctcatcacttcttgctaaaatgatccaactaattcaggagaaaaaaagtctccaccactgactggctacttcataagtgacccatccacaaaagtgaccccttgagaagagctaacaggaataatttagcaaacagcagagtgagcggagaggccaattagcagccagttcccagaacacccacaacaaaactgctgccattcatcaattatttagatccagataccctactaagtgccttaagccgttaacaaatttcaatattattatacacacgagtaaactggggctcagaagttgaacaagatgaccaatgttatacagttctcaagtagcacaaccaagattggaacacaaaggcgatcagactcaagtttaaactcttaatcactccactacacatggggtggccaagtccaccaggatccccacttcagagcctactgacagctccagggttggagcagaggctggaggccaggccagtgctggagcagcagccatgctggttggagtttctgcctggatgcctaggccaggcagctattcagggggaagggaaactaccccagcgggccagaagctgccaaggcagacacaaaaggaacactgttcctgaacaaagacaaagtctgccctgcagttgtctcccactgcctacagcttcaaccctgccccacacaaactattagaactctaagctgcagataaaaaaaatcacagtaaatctaacgtttttccctatttttgcctggaatgaaaagaactgaataatgacctacacaacctctgacaaagcatatttcagttaccaataatgaacaaattagacctacttggcagatgagtgaacagagaagctagcaaactagacaggggaaagacccagtattttaggtgaagtgaaaatgtttgaataattagggtaactgctagaaacaagacaagtttgtacatttaaaaatttttaagattgcacattttaaaattttctcagtgagatttaaacttttttatctgtatcattgattacaaaagttattatgaagagagatgaaaaaggagcaataggacatagcaaatgaaagtaaaaagcaaaatgggtagcctaaagaagagatgcactgaaatgcagactggctcctgcataaaaccaaacgggaacctgaaagacctgctccacgaaatctcccagaaagcacaagaaaacaaggaaaaatgggaaattatgactgaaaaatatagcacctgaatggtagaagatcaaatctgtgtctaataggtatttcagaaagagaaaacagaagaaataatatttaagtaaagaaaaagtaataaataatgggaaaaaaaacagaactcaaaatgagttttttagaatataattattcattcagagcttggcaaaattaatcacaaaagaaccatgctcatcctaggagagctttggaatgtcagagagaaaaagagtccaatagacatccgctcctccaccaagattaaaaaaataaaaaggaacatgaatgagatgaacactgggtttctcatctaccatactaagtgttaaaagacaatggagtaagatttataggactctgaaaagataagtctatgacacacaaattctaaatttagatgaattatcaatactataattatcattactataacatagaagaaatacattaataaacaggggaatcaaaaatatactttccacataccttatctgtagaaatattcttaaggaagggaggatatataatcaactgaaaaaatagaataaaaaactcaagaaagtaaaagataaatagaagtataagagaaacagcagtgagcaataaagctaacaaagctagagaggtctaggctggccacagtggctcacgcctgtaatcccagcactttgggaggctgagatgggaggactgcttgagccccacagttcaaaaccagcctgggcaacatggcaagatcctcgtctaaataatgcgtgtcaatgttgaaatcataatgcaaattatgctttcaacattgtaagttgaaagcatgcttgaaggagcataatgtaaaaaaaatgaacaaatgtttctcattatttcaacaaaatttagacggtaaggagaagaaaagaaaatgtgctgaagtgatcacatggcttaggagaactccatagatactgttctaatgataaacaagtaagttcaaattttaattacccacaagaagaacaaaaattggacatataacttccaagtcacagagaattgttttccttctttttaaattttttttttttttttttagagacaggatcttgcttcatctcccaggctgcagtgcgatgacaccatcatggctcactgctgactgaaattcctgatctcaagtgatcctcccacctcagtctctcaagtagctgagactacaggcacaagccaccacacccagctgatttttacattttttgtagagacggatttctccatcttgcccaggctggtcttgaactcctgggctcaagtgatcctcccgcctcggcctcccaaagtgctgggattacaggcgtgagccaccatgcccagcttgttttctttccttaaaaaacagaaaagcttgctgggcatggtggctcacgcctgtaatcccagtactttgggaggccgagatgggtggatcacctgaggtcaggagttcgagactagcctggccaacatggtgaaaccccgtctgtactaaaaatacagaaaattagctgggcgtggtggcacacacctgtaatcccagctacttgggaggctgaggcaggagaatcgcttaaatccaggaggcaggggttgcagtgacccgagatagcgccactgcactccagcctgggtgacaagagcaaaaaactctgtctcaaaaaagagaaactaaaaaaaaaaaagaaaaacttgaaaaaaaaaatttcagtgaaagctaaacaatcagcataataacttgaaaacataacacaaaaagccaagggtaagaccaaacattcagtaaacgctaatgggttaaatacccctataaaagagaaacccctcatcaactgggtgaaagaacaaaataccacccatctgactgggttattaaatgaggcaatgtgtgcaaaagtgccacacgtatagttgttcaaaaagtatgcataaagaaagaaagaatgttgcgggcactgtggtgacccaaacataaaaaaaaaaaaagaaagaaagggaactctaccagtttaaaacaccaaaaaaattcactaaaataataattttttaaagtcttatgatgagctgacaggaaaataaaacaaatcatcagaaaacaaaaacaaagtatatagtctgtgactcagaaattccacttacagaaatctactctacattcacatgctataaaagtaagaaatcgtacatgggaataaataagaaatttaggacagctttctcagtttaagatgatttgggctgcaaataacaatacctaacctcagtgatttaaagaaaacagggtctgacttaaaacaaaatgactagaaggtagttccaggttgattcagtaactcaatgtctttaatggctaaggctccatatttctgctctatcactgttaatgtgctggagatattatgttaagtgaacataaggtttataagactgtgtatataaaatgattttaactatactaagatcaaagaagaagtagttaggaaacatattaatgtttgctaacattagtggttgctccaagattgtgggatcatgagtggtttcatacctcctgcttcacatactgtttttgtactttcaatatttttcagatgtaatacatctataaaccaaaaaaaaaaaaaaagaaaagaaagaaagaaaagaaaaaaaaatcaaagaactaaagagaaccgttactgaagaaaacaaaaagcctcaatcaccccttggccacagtgacatagctactttctccttgttttccaattagaattatttcaacttgatttgtttatgaggtttttaaattctccatgacacacacagtagttttgtataaaaaggaagctcatgatgttattaatgattatcctctatgtagagtgcaatgcttgtacagaacagttcacagagtatttcacacacctttatttcatttatattactgaatacaacccttataaataaatagagaaaactaaaaaataggtaaatagaccattttgtagtgaggaacctcttccaaagtcatattaaattgagaaatttaaaatcaacccaaataacatcctcttttcatataccatgcttcataaacataatactaaaacaaacacatggttatatcaattgccaaagacttaaaattcttttaggtatctaattaataccagtaaccatctgcattcctaaatctactgtaatctatctacatgaacgtttagagaccaaagcaggctagggagaaacccacactatccacttggtgtgcttcatggtcttcctctgttagccttcctcactggaagagagagaacagcttgagagacttcccatgtgaggagtatcacttatcccttagtttcataggcattttccaagactgtcttctccatagcttaaaactaaaactctgggtctcagaatttcaacttcaaagttgaaggggacctaagaaataatctattcaaactcttcatttcacacacaaggaatctgtcaatgtatagtttaaaaccatcaaaatggatcacagaaacagaaaagtcccacagagcatacaaatatgtcttcagaagaggtcaaaaccctggaagaatttagtctgctgctcaatcttaaagttatgacactattttttaaatgctggtcaatgggtttctaaggccctttttagacactgcaattccacctgttagaaaattccattcagttaaacatgacttgcagagtaaagcaactaactggcatctgtgatgcatcaagggctctattagctcatcctgcctctcttcttccgatggcagccgtggccatctggagggaccactcggaagaggccggctgcagcagggggggtgccgctagggatactcgctctgtgaggccagtgggagcaaggaacaggcggaaaccctgccccctaccgagttggtgggatgggaaaccggtgctcctgggtgtagctgcagccatccagctgaagctccagacacgagcatccctggactctcaggggcctgggaagccctcctgtccccacaggctcaaaaagacctgctcccacgccctggcctctcccacctcctggcgtccgctctgatttcagaacaaagttgaagcaaagcccaggcactgccgtgacatggtcgggtgtgcatgcacatggggcagcactgcacaccagcatcccccaacaccacctcggccccctctgaaactttgggcactgaggagctcagggagggagcccagtggggcctgaggggcggctcagcgcaggactgcaggtgcctctcagcacgaacagcctgggtgccgtggatggcatgttgatgccaggacgcagacaggttcctgggcagaaaggggtgggtccccagtgaaaccccaccttcaagacagggatggcctgaggtctgccagttccagctagagtctggggcccaaaacgagaacttatggtgctttttctgagcctgcccatggctgcccacgaaccaatcagcatgcacttcctcccctctgaagcccataaaaaccccctggactcaggcagactccggcagatgactggaccacctgcctgtggagaggagctacccactgtgggtctcctctctgctgagagctaagcagacaatgggatgacccaccaatggagaggagccacctactgcaggctcctctgagctgttctgttgcataaagcacctctttgccttgctcaccctccacttgcctgcatgcctcattcttcctggacatgggattagaactacggacccagctgggcatggtggctcacacctgtaatcccagcactttgggaggccaaagcgggcggaccacctgacgtcaggagttcaagaccagcctggccaacatggtgaaaccacatctctactaaaaatacaataacaacaaaaaaaaaaattagccaggtgtggtggcaggtgtccataatcccagctacttgggaggctaaggcagaagaatcacttgaacccaggaggcggagattgcagtgagccaagatcatgccactgcactccagcctgggtgacaagagcaagactccattaaaaaaaagaaaacaaaaggactacggacccgtcaaatggaggtcctgaaaaagctgcaaaacaaacagggctgaaacatgtccccctccctgccccttcccgctcaccacactgacagtgacaaggagagaagacctgcagcctttctgggatcccagagcaaggagctccccaagctagggctgtgacactctctttggggctctgcagttcctggtgtctccaagcttccaggtgccaccatgttcccctcatctggacacaggtgcctgcagcagaagctgcatgcagtatacctggtccagccacaggctggcatggagccggcacccatgccaacatctgaagctgcccgcccttcacagcagccagcatgcctggctgtgtgcagtggccagatcccatgctggctggctcacacccccattgccactctgcacctggcttgcccttggtaggtatgggatctgggctggcagcacaagccaagcacagcctgctgggctgaatgggtggaatgagcccagcaggcatgagcattactcaggcagaaggcaccactggccacagaggttcctggctggcaaagcaacaccccaaggatcccgtgacttctacaaggaatggaaattaatctctgcctctttttattattgtggttgtctctagtaatgtgatatgaaacactgaagagaggaatttataaacaccaaatagtaaacaaaagcatgctaaaataaaaatttatattagatgtgtttcattttttttagcccctgccacactaatcacacaacttgttaattatatttgatatacaaaattgaacaaactataaatacctgttaatcatccatcaaaatttatggagtgaacctcactggtggagaaagagaaaggagctattactgagccttgtgctatggaaggtgcttcctgtattttgtgtatgttcctatatttttgtgtatgttggtataatccttagaacacctctggtaagcagatattttaaaaacttcttttacagagaagggaatggaggcttaggaggttaagttgttcaggcctcacagagagcagaaagagatacttgaatttcaaccagcccagtctcactccaaaccctatcttctttctattgtacaaatgctgcctcaagtatttatagaaaatggaaagagatccaggtcttattgttgaagaatgtatgttctaaagacaagcttgggcctcattccctcatttcctcatttatttaagagttcaggatttcaagtgaaatgtgaaacattctttccccttctgcatctgtcctccttcagatctgtgctgtcaggccactggtgtaccagccagcaggccatgcttggctgccagggtgctccgggccacccaactatgaccagagggtgcatgaaaaattgttacctgggcttatttataaatatataaacaatgcatgacaacattaaaacaatctaacaggaggaactcactggagtgttaagtatatgaaatgctgcatcagatgaaaaattccctccattgatatcagcttccttttcgaagtcctggctgcgcctcatccttgccccgtcagcattccgccctcagccagtgttggcagtgctctggactggttaaatcttggctgaattccataggatttcagttggcctcagtaatatttttgcttagctttcaagttcagagatacttattctatacatgactgccacctttgtatcgaatttctgaaaccctctgaattgaggaggatttttaatggactcttattaagaatgggtaccgaattttagtgatggttgccttgggatgggaggaaacaaagcaaaatatcaatttgttttttaaaggatatattacttttaagatgaacagatttaccttttctcttttattactagttaaggctaaaggatagctacattccttcccaccttaaaacagaacaaactaaaactgatgaacaggagcgttacagtgcaaacatttacacacacaaatgctgggcacatgcactcttaagtgaggaggaaaccatgcagatactagaaatgtctctggcttaagtgttgtccaatcagatgtacttaaccagaaataccaagccaagtctgaattatgaaataactattaaagtatatccagaccttaccacctcttaccaccctggccaccatcacatcaccttggtcacagccacttttacgtctcctactgcaatgtcctcctaactggtcctccagcctctggcctcacccaccccaccctgcacctagttagctgtcacacaacagtcagttgatactaccaaaatgagtgaaatcccaatcttgatctgctcaaaactctgcagtggctccccattttactagagcaaaagactaaatcttcaccgtggcctacaacactttttgtcttgtgacatccccctaatcttgcctcctaatactctcctttctctcacttcctcccagacacactggcctgctgaaaaccagggacgttcctgcctttgcactggctgttccctcagccaagaagagtcatgtccaaatagccccagagcaaaccccccaacctccttcagatctttgctcagatgttgcctctgtgagaagtgctctagccattccttttttaaaaggaaaaacttcacctcctccccaactcatacctacattctcagtcctttaccccgatctgtatttgtgtccacagtgcttatcactttctaacataggcttatcaatcatgatcattgcttattacgtattttccccccaagaacataagctccatggtggcagggatctttgtttgtttactaatattagcccatgcctagaatagtgcctggtgcagagtcaggggctcaactaacagttgttgaacacatggtgaattaaagtaaaattagcagagtgaaagtggtctgataatacagtcatatcaagaactcaacacacaagactcttgccacttccagcaatgaatggaacaggaaaaagcaaatcaggggtggaaaaagtgcaggagcaatagctagcaccacagttcttgggggcagttaaataaactgattatttaactataaataatcagttaagacctgagacatagggttagaatacattgaatcaaatctgaactcccgctttcagcaagttcagactctatcagaatccagcagtaatctgtccaaactgccccaagaaaaagtgtatgccttgagtagcctctgattaaatgaatcaatttcaccgtatacaggtttctcccaacctggtcctttctctaattcgtcatcctttattatcttaaaataggggtcaatcacttccaagacagctctttaaaggaatgctgagcaaaactgggaacacggctagttatgtttctttattctgcctctttgttttaaaagcttggtgtgcagggcagggatggtgtggagacacagaagaaataacttctataggttaaaaaaagtgcctattcctttaaaaaaaaaaaaaactctgtaaaaactgcctgttgtggaagaaaagaaatgaccacaaaattagaaggacaggaaccacagaataaccaaaatttcttatgggaatgagaaaaagttggaaacgaggtagcttcccaatgttcacaggatgtgcattctgacacgtggtgcactggagagatagatggtactgactgatagaatgatgaggtctgaaagattaaaccacaaacatctgttgagaggctacttgtaaaaaacacaacacaaaaaatcagcaactataaccaagtatagtcacaactggttatttaaaaaatggagattttttttttaatggaactcttaccttaggcagtaatccaggaccctgaattaactcactgaatcctcacaactgctatgaattaggtgctaaactcatgcccattttatacatgaggaaagtaaggcacactgttctttcacatccctgtcgttctccccactcctcctccagcctccttttcatctttccagtcatattgctcttacttagcttgcccattcatctcatttgcccaggactgtctgggtttatgtcttttggcctggcctgaatattaatagcacctaccttcatttttttttttagaaaaattacgctttaaaaaaaacaagtaacataaattgtatcattttaaaagtgtacagttaaggccatgcacggtggctcttgcctgtaatcccagcactttgggaggccaaggagggtagatcacttgaagtcaggagttcaagaccagcctggccaacatggcaaaaccccgtctccactaaaaatataaaaattagccaggcatggttgtgcgtgcttgtaatcccaactactcgggaggctgaggcaggagaattgcttgaacccgggaggtggaggctgcagtgagccgagatcgtaccaccacactccagcctgggtggcagagctagactctatctcaaaaaaaaaaaaaaaaaaaaaagtgtaaagttaagcataccttcacttttaaaggtattccagttcaaactataattacatgatcatccttattttcccctactctactgtaactatttacttacctacctccctgactgaattgtgaactttttgagaacagttatgtgtatcctgtgtttttatgctttcaacccagcataatgccaggcatactgttaataaatgtttaataaatgaacaaatgcatgaatgttatcctaaactgcctcctggttcattttcattttacagagggaatctgccctccaccaggctcagaatttgaaacttataaactgcttcagctgtatctgagatggttaatgcaattagagaaagagccaatggtctagaaaatgctgtgaatgtgtgttgctgcccaagtaaagaacagtcatttactcacctgtgggtcaccacaggagacagtggctacaaagaaatgtatgtgggcttataaatatttggacagattcacaaggctaaaataaaaaacaataataaaaacaaagagaaattaactaaaggagaagggactcaaaaaaaaggagggggggagagagaggaatgtcaactgctccacttaaacattcttttaaaattcaaatatcatcttcaggaatacaaatattgcaaagcttagcacggttggcacatggcctcctgcagcaatcacagcacaaatgtgcttcgcattaatcctgtgctttagtgaaaagagaactaataacgacctccaatttcagtgcaattttataaacccaaaatataatgttgaagatgaaactaaacaatccatctttcccgcctcccttctctctctcacacacacactcatctttctacatcaagctacattgagcaaaaaaagcttaaaaaaatttaagaaaaaaggatggagctgtgatttttaattgaattaaagacagaaagtcccactgcaataatgggagaaacagggactgtttctcataatacttcagttcttttttttcaaccctccacccaagttttagagtcattagtaccacatggctgctccagaaccagtctaatcttaactgcattttttctgatgctgactgccatttaggcctgagggaacccaaaaggacgaatctggccagtatcacattgcattctttaaaactttcagagaggtgaggcagtcgccactttattatttgcaactctgtttaggacatgaagtccataagaatcttcaattcaaaatagtctcaactgcatcaaagtctgctttcccaggtaactgatacccctttaattcctctagatttaatgaagagagtattttctttgttttttttgagacgaagtttcactcttgtcgcccaagctgcagtgcagtggcgcgatcttggctcactgcaaactccgcctcccgggttcaagcgattctcctgcctcagcctcccaagtagctggaattacaggtgcccaccactacgcccagctaatttttgtattttcagtagagacggggtttcaacatgttggccaggctggtctcggactcttgatctcaggtgatctgccctcctcggcctcccaaagtgctgggattacaggcgtgagccaccgcgcccggccaagaatattttcaaaagctattaatatacttgttctgcacataaccacttccaatctattaaaagtatgcgtttgtgtaggaaaggcttgtactacagcagaaatgcaggaagggggaagagagaagaggacagaaagtttacctcaggctttattcagagaaaatttattctaaatccctttcacatcaataaacatattaaaaacaacaggacttgatggcagagttttatatattgtgtgtaagggcaggcagtactattctgacaggatgaggacagagggaaagcctggaacagaggaaaacgggagataggaggagagccagaggcaagagaggaagtggatgagatgagtgcgtccgacttccctcttggaagcagtgctgaccgggtgagagaaatattgacatgtaaggggttctgccacacttcccatttaggattctggggaaagactgcctcacaggccacatcacaccatccccggctcagctacatcaaagaaaactcagtgctacagcaaagtcagagagaacaatggctagagtgtatccttcctctgtggccctgacttttgtttacacagacccagaaaaatcctgtctggatagaggtggatgggagtgagcaggtgcagacgggctgggatgggttgagagcccacagtggtacgggagagataatgccactacaaaggtttcagggaccactagggcaagagcaggatgaaggataagacagagacccagaggggaatcatgccatgagagatgaagtgaagtggagcccgccagagcaccaccaggcatggccaagcaaagacaggcaaggacccgccacagtcttcaacagaggacaccagggagggatgccgtcctcagccatctccagtccaggcaacaggccagagcagctgttccatggcagagccaaaaaggacctgaggtcactccatgggggtctatggattccatccacccacacagtctcccaacccacccacccccacccagatgccatcttagtgaggaaatatgagaagcatagcattttacgttttttaaaaggaacatttatctaaaagttattaaattgttgcatcagactaattttactgggtggaaccagatttgggcgctgcctcccctcctgtatttctgtactggcaaggggcttataaggaggatcagcccagattattagaaaagaaggactattaagtttgatctaaagctgcctccatacatactttaagttaggcctaaaggtttctccatacatagggaacaataacctaacctgatgaacaagtaggcgagtctcagccaactataggcagccaactatgcaaggcaggttcaaataaggcaaacgcccagctgtaaccaatccagctgtttctgtacctcacttctgtttctatccatcactttcctttttctgtccataaatgttatctgaccatgtggcagctctagagtcattctgaacctattctggttctggggactacccaattcatgaatcattccttgctcatctaagctctgtttaatttgtctaaagtttttcttttaacaggacttattttctttgcctgcatgctccataaataaccattgtttgttctgacccttattttaattgctcacatatgagatagaatgaggaaaatagtccccagttgtatctgaaagtcctagttttcattatctaaatttaaataggggatggaaatatcttctgataccttctggaggctttttgttttttgtttttttttttttggagatagtgtctggctctgttgcccaggctggagtatagtggtgtgatcacagctcactgcaaccttgatctccttgcctcactgggaccacaggcgtgcaccaccatgcccagctaattttttgttgttgttgtattttttgttacagacagggtcttaccatgttgcccaagctggtctcaaactcctgggctcaagcagtctgcccgcctcagcctcccaaagtattgggattacaggcgtgagccaccacatgcagcctcgagttctttatttgcctgtttttgaagatggaggaagtaggtcttatgaagaataatagaaaagacatagatgtgagagaaaatcaaagaaagacagtgaggcacacaatctgcttttcctacttggagctctgcagctcaccattagagtaatagcattttcagagcagcaaaggggatcacagatttggttcacttccctagccttagcaaaggtggatgagctccagcagtcttgtgattgctgcttgatgaaaggtatgtggtactgcccattctctcttcaacacaccctcctccactattcacaatggcaaaaggcagggagaaggactctaagcctttattgttttgcattggcagacctcccatcttctagaactgagatgttctgtgttcagagaaattcccagcaacaatctgtgagaatataggttaattagccacaggccgtgatgcaacataatagcaatgagggtttgcagtggtgtcatgagtgacaggaagaggtaggctcaccttatacaaggtaggcaagctgcattatactctataaattaggaaaccctttaacactcactaatcattttcaagattcattaattataaagttatccagataagggaccaggtggtataactgattctatgtccactcatttgtgcacttattcatccacatacacaggcattcattaactaattttattaataacacattgtgccacaccactgtggatacacagaacaagatacaatccctgcactcaacaggctcagaagctagcagagaaagacaaagcaccaaactgtcaattctccatttattatcaatatcattgctactagtaggagaaatgaggccatctgtgagcctaaagcaaacttctaacaaggtatgtcataacacggcactggcacatagtcagtgctcaaaaaaatacaaattctctctcctgtactctcttaaagaagtgttgatactaatatgcttcaggtagtgctgccaaaatgtagtgctaacaacagggggcctgaagataatgacataaaattgtattgaataaatagaatgcttgtcacttgtacttaacaggtatctcaaatttgggcattaatgtgtacgtctacatcaaaaaaggtgtgatggctctcttaactagatgttagtatctatagttagaccaaggctgctgaataatgatggctgaaattaacagtaaatagaaacaaatgggcagctttatcttttgtaaatgaatttctttaaatatgaaaatgacttagctttttgcagtcaatggctaaagaaaaataaaaccaataaatcaaacaagtgtggaaaattcaaggcctagaatgttagcccgcatctcaaataaagcaggctgtggacatatgacttgaaatttcttgagatttaactcaccattttactaaagtctcagaaggaattttccacctcctcctggattgcagatgaaaggtttgtttgtcttacagatgttccaccctaaggaatctgaaggcctgaaaaatctgctcatttatgggaaaacacaatgaaacttacagtcaagagttgagtccttgaggacagttaaggatgaaaaaacagaggattatgggggaaaagaagataagagagggaggaatgacttcatgatgtccagatgaggacaactttgtactgaatgatgaacatcataataagaaaagaattctcgcttgaacccaggaggcagaggttgcagtgagctgagatcacgccactacactccagcctgggcaacaaagcaagactacatctcaaaaaaaaaaagaaaaagaattctgtacttggacttcatatataaaggatctaaaaagatttcctttctcataatggaatgaaacttcccactcagccaaacctagaagcagacctaaggagttactgctgttaaacacatctgatggctaacagaaataggaattcttattaaatagattaagttagagttctgttagagttaacactaagagttttgtataagcacaccaaaattccacagaaatttcctttataaaattggaataaacatgtttgagaggtgggggagattttcaaaaaatttaagaaaagttttcacaaaatctctcctaaatatatacgaatcattttatctttcacagctttgtcacaatgacatgaactcaacaaatatcttttgatttaataaatagaaaaccatttcttacgtatttcttaagaaattcttctagcttggtgtaagtgactgtatctctaaaaataaaaacacttagaactatgtgccaggcactattctaaaagctttacatatggtaactcatctcatagtaccctgttgaagtgtcaccaaatattctgattctcctccttctaagcacacgataggatagcactttccagcctccttaaatttagccacgaccatgcgactaactttgatgaagaataagtggaagaaacgtgtgtcacttctgggtgacagaagtctttaaaagccagtgcaggacctgccaaatcttttcccctatcatggtgagtggaaatgctcaagttggtagagcctcagttagcctatcacacagaactctcaagaatcaacgaccatgagtgagaaataaatctttgggttaaaagcctctgagatttaagagttacctgttattgcaatttaacctagcctatcctgactgatgcaggtgagtactaggtaattgaaaaaaagaagacagcatttcttttccaatattctagaattcagattgttcattattccagactttctccccgccatatcatttgctccccaacctctcccagaaaacaagtcataaaaatcgctatctgaattttggcattatgagaatcatgaatttatacagtatcttatttattcacattgagacagggtcttattctgttgcccaggctggagcgcagtgatacaatcacaattcactgcagcctcgacctcctgggttcaagcaatccccccacctcagtccgcccagtagctgggactaggaacatgcactactgagctcgactaatgtctttataaagatgaggtctcactatgttgattaggctggtcccgaacttctgggctcaagtgatcctcctgcctgggcctcccaaagagctgggattacaggcaaaaaccaccacatgtggcctgttcttttattttcgaatattctgctttttaaaaagtcattactggttaaaaaatagaaatccatccttgcaaaacacacacacagaataattcacctagcaaaaaattcaaacccctaagtataaaaagtaaaaaataaccaaatctcttaccttgattcctttatatgcatacatagattttttttaaaagaaagagacatggtgtcacaaaaagagtatacatattactttgcaaagtcgttacttaacagctttctagttaataattgtattgtatggtcataacataatttatttaaccatgtccctactgatggacatttcagcttattccacatttttatttaattgcaatgcatgatttatcccaagaagtaaaatttgtcccaataagtgggcctgtttaaacggcctttgttaaacaatcaaagggtgtgtatatttcacatcgacaggtactgccaaactgttcttcaaagtgatggtatcaacagtactatcaaaatatatgaaaagtgccttttctccttagatccttattatctattttaaaaaatatttaccaatctgggaatcaaaaaatgatgtttcagtgttttttttttaatttgcactgatttaattatttgtttccaactttattttttactatctgtatgttgtctttggagaaatatctacctgtccatattttttattttttaatagggttagcttttttatattatttgaggcttttaatctattatgaatactaagacttttcaacttgtgttgcaaatatcctctctaactcttcatttatgaatgctggctttcaacatatgaatatggttaaattagtcacaatttcccattataatttctgggtttcaagatagtttttaaactaattccaagcttaataaatcaattgagagaacacacccacaaaggatacaattaaccccgtgtttttacctctttatgtgcactctgagcttactttattcttttacatcaatgtgtatatgatctctcagagtgctaaggcactcaaagaacccagcaaaacacccagtgtagattttcaataaatgttcatttatttcattcctcctgagtcccattagtttagagacaacagacacataattctttttaaaatattttccaacagaattccaattgtgttcagggtgacaacgtgcccggccaaaactacatttcccagccttgtctccagctacgggtggcaatgtgacacagttttggttaatgacatgtaagcggaagtcactgaactgagcttccaggaagctctttgaaagagaacaggcacagctggtacgtgccttttgccatctgcccttctcctccttcctgcctggaaagcagatgcaatgctgactggagagcagccatcgtgaggcttcaaagggacaagatcactaaggatggctgaatggaaaggcagcagcaccatgggtctctgatagcatctctgagccactgaccaaccctagaatgcccacctctggacttcttggtataaaaggaaaataaccgtttacttgtttaagacattgtgaatgagtcaggttttctgttcgttgcagcaaaatctagaatctaaactatatatcagggttcactcaacatcttcatataaattttaaaacaaccctttcattttcatagcttgagataatcccttgaagaacagctatgctggtttgaaaggcaagttctctattcacagatacacttttttttttttttttttttttttggagaccgagtctcgcactgtcgcccaggctggggtgcagtggcacgatcttggctcactgcaacctctgcctcccaggttcaagcgattctcctgcctcagcctcccaagtagttgggattacaggcgcccaccaccaggcccagctaattttttgtatttttagtagaaacggggtttcactatgttagccaggctggtctcaaactcctgacctcatgatccactcgcctcagcctcccaaagtgctgggattacaggcatgattacatgggacgcctggccttattcacagacatacttaattttaaaaggagaaatcaaatcattaaacacttcaagtacaaaattcaagaacacccttaaggagaagtcagtaatcagcaacatatggtgtcacctgtgctaacttggtgttaaattacccttatcagcacaccacatggcttgttttagctgtgacataaaatttaggcatctaagacttttccacgaaaaaaaaaatcacagctaagaaggaattcttaacaattatacaagactgagtatgtatttttgtcattaatccattcccaagaatttgggctcacttgtagcttgaaatgaagaattaagaaaatattacagaatgtgcccagggaaagacccaccactgtccaaaatcatgttcttcaaagtatttcactagataaggaaggaaatgcacaagctgatggaactatttaaccactctactactggaaagaacaatctcaaaatgtagtcctgttttagtcctcactttagctagccagcctctcagaaccgaagaatgagcaaaagccccgcaagaggagcagattgagccctcgacagaggtcctctccaggatggcagtcatttcagcttgggaaagaaggggagatggggggcatatgctgtaagctccaggagactggagctttgtcatctttgcagcttctttttttttattttttagagacagggtctcattatgtcacccaggctggagtgcagtggctatgcacaggcatgatgatcacacactacagcctcaaactcctgggcttaagtgatcctcccacctcagccttccgggtagctgggactacaggcatgcaccaccgcacatggctgcagcttcttcatgatcagccaccacggcctccaccaagaataattttcttttcaaaaacacctaaccctcccccaccaaagtgtctttcacatggcatcagatatttttaaattgaatttttcaactatgaataaactcccttactcacattgaacactgtcctgatttgcctctgtaataagaagaaatataccacatgctactgatcacaatctctgcaccctctacctgtaagggggaggaaggtggagaaagaatagagtagaaaacagagaagaaagtcaacaaagaaggacaatgcacagaacataatgtatatggtcaaccataaactttccacattaacaaagaactatacaactgccaaagccagacataaatcccctattcccaactagtccaaagcattggttagttattattttaatacttccttttacaaatggactatatcacttctcagagtttaatacactttttggcatatgtatctacaagcatagacagagcttaacaaactttttgaaatgtgtacctataaaacagtaaaaaaaatttaattgtaaaaagacttctaagtgttaatttgaaacacaatttgaaagtgttcaaagttctaatttatgtcagccaagttaagaaaagttggtaacaagatatcagtaagaattccaaagcagtatctgtcataggtaatcaatcaccaaatacttaggaactgtctaaaatggatttcatacataaatacctaaatttggtaatccagttccctcctaaacagggaggcagggctgctttatagagaagctacacagtggagcaggccatagactagaaatcagtatgtgtcttaattctcctagcttcacaagtgaattcaccatctaatgatgatcattccatgtaaagctctgtaattctcagtttccttgcctgtaaaaggtaataatgatatcaatatgaattaggatgctctcaactagaataaggaaaatgtattgtctggtaagaagaagtcaagcagtagggcagctccagggttggttcatttgacggctggctctttccatatttcttttctgccatattcagccagtcaacttattttcaggctacctttccttatgtgcgcatgattgtagctccaagtagtcacattcagtcatgacaacaggcagcagaaaaacagggatcattcctgtgtatttcttcccagaagggagtgaactttcctttcccagaggtatctccttccttatgaccagcagacttccctgctcctatcactggccagaactgggtctcatgcctaatcctaaaccaaacccctggcaaagggaatgaatttaccataacagacttggagtcatcaggattcagtcctgagtcgtatgaggtaggggtaaatacctaaacaaaattgaggttcgaccagcaagaaagaatgaagcagacaactgaacagataaccaacagtgttgtgaaccccttacttcacagtaccatagtgacaatcaaatgataaagcaagaaaaaactgcaaagtataaaatgctttatagatccaatatattattattcatttaagatttgttgtatgctgaggcaaaatctcaacgataaaataaattcattgaaaacaaaggatattctttttttaaaaaaatcacaaaatagcaaactataatgaccaccatttctaacacagtaaaatgtgaggttttgaaaaactgtgactatacatattcttcaagtatatgcagattgaccaagtgaagcaacagcaataggttttacagtcaatacatacttccattttacattcaacaaatattttctgagcacctactatgtaccaggcagtatgtaagcactggggatacatcagtgaacagagcaaaatccctgccttgttggtgcttacactgtacacttaactgcataaatacttttggagacaagcattcttaattactagcataagctggactccaattagcagaacacatgtaatttttaattaattccaataactttggtttttgtttacttctcttacttccccataccacccaaaaataaaatcatgaatctaggggaaataaattgacaggtgatcaccaacagagcaaaggatgagttactcaaattcctctgtttctccccccaattccagatgaatgccaaagaggaaggccacctttcagctatcatttctgaaaatgacacttgcaaagggcagaactaaaatagcggcaatatctatagtataaaaacaaccaaatacacacaaaatacagacaaccagagaatcaatcataagagcagactacagtggatgtttttcatgactgttgtccattaatagatagtagatttggcattatacttttatctgggagtcttacaagtaaatgttacattcatatcaatccttactaaacaagataacattactggatgcaaagagggtttggttgtcttactcttcaaatgaagttaaatgataccttagagtaatacaacttaaaaatgggaatgaaatttatgtgcttaatctaatattcatcacctgggtactagtcaaaagaattttctccagtaatttcatacaaaaaaattcatacaacaaattcatacaataaaggaaatttcatactataaatatgtaatactcattactattcctttaaactttccattttaattattttcatgcttcccaaatccctgaaactttatattcataaaaatcatcaacgaaaagggatagatggtgggcttttagccccccaaaaaaaaaaaaaacagtcaaataagtttgggagcaaaatcagcaaagatgataactctgagtccaactcaaaaggcattcccagctctaagccacttcagatgagggatgagactctccatctatgcacacccctctccacacattcaccaccccaaccccagaacctagccaagtctttcatagagaaggagctcattcttgcctttttcagcgctaccctctggacttgggtataaatcaggaaaaagaaagacaagaatcatacatgttgaggtttcagttccatctttgaccaatcagcattgatcagaaagaactcctccagggagtttacaaagcagaatagacttaagaactagaccttcaaggctgctctaaatcagatctcctaggaacttcccttagaatcaatttagcttttaaagataaagatggggttgcttaatgcaccatataatagatgcatatatttgacatctcagtacattaaggcaatctctcacactgaattttcaaggtaacaagcagatagcttttcaaacactattttttttcttttaatcacttttatggtctcctttctaaaatattctcctgtgttcttaaacatatgttaacctggttttttggggagggcgggggggcgggggttggggtttttattgtttttttgtttgttttgttttgttttttgatgccttaaatacaggaggcatcctgtcccaggagctacagtcttgcagagagggttgcttataccaacactaaatgtcccaaattctcactttatttttagttcttgtatctactttctatactttttccaaggtcaactatcaatgcttgattgtattattatgaataccctaatcagcccttttcacaaatctaatcttttgaggactaaaaagacacatgaccaagtttgttagagttctattcaaaataacagcaggaaataaaaggcagaaccatgcttccctcctgggagttgtgatcagtagagggtatacaaggtgctaacaatattcaatttcttgacgtgaatggtgattatatgagtgttcacttttcaatagtgcattgaagcatacatttatgtcatatgtgcttttctgtatatttcacaatttttttaagttaaaaataacatataggcaaagagttgaataggaagatacacttccccctactctcacttcagcacatgcacacacatacccacacacacacaacaacattcaagtagcaattccactgcttgcaattacatctgtagatgacagccaatgatatttgtagaagagagttcatttaagcattgttgataacagaaaaaggcgaaaagaaaaaatgccctggaaataacctaaatgccccctaatagagaaatggtaaaatacattgtggtactgaatgaggtagatcaatttattctgattgaaaatatgttcaaaaatatatttaattaaataagcaagttgaagaacaaaatatgcatatctgatataatcttacttgtccaaaaatgagaaaataaaatgtgattgtttctttttctttttctttttttaagacagtctcgctctgtcacccaggctggaatgcagtggtgcgagctcgtctcactgcaacctccatgtcccaggtgcaagcgattgtcctgcctcagccacccaagtagctggattacaggcatgcgccaccacacccagctaatttttgtatttttagtagagacagggtttcaccatattggtcaggctggtctcaaattcctgatctcaggtgatctgcctgccttggcctcccaaagtgttgggattacaggcgtgagccaccacacccagccaaacgtgactatttctgaagaaatgaatgcatatgaaaatgttaagagtggtaacctataggatgcaggaatagttcatgaggaaaaataggggattttactttctaccatttgattctatttgaattcctggccaataaccatgtatttcttttaaagtaataaaaattaaataaacaaatatattaatttccatttgctgctgtaacaaactattacaaatttgtggcttaaaacaacacaaatatattatcttacagttctgaaggtcagaagtccaaagtgagtgttaaggggctaaaatcaaggtgtcaacagggctggttcctctggaggcacttagggagaatctgttcctcaccttttccagcttctaaagacttccagcattccttagcttgtggccacatcactccaatctacacgttgccttgtcctctctgattctaatccttctgcctccctcttacaaagacctttgtggttatactgggcacatcctgatagtccaggaagatctccccattcaagatccttaacttaatcatatctacaaaatctcttttacatgtaacataatcacaggatctggggactaggacatagacatgttggggggcctcatcattcagcctatcacaacagtatttgctgaactgttgtgcagctaagttctgagacatggcatatgggagcaggggagtactttcactctgatacttctatattatttttattttttacattgaatttttgttgttttaattagaaacccaacagactatatttttatcaactctaagatgccattgatgataagatacattattttatgtatgactcagaaagaaaaaaaaaacactcaactttgatatttcttgtaatatcatggtggattgtttgcaaaaatgttctcagaaatctctcccatcccaagatatacactccttggcaacatgactggagtcctcctcttatcaagaggcagtctatttctacaacaggacattagcaaacacgatctgaagaggctggagaagtgctggtgcactgaaagtggcctcttgctgctgcctttctaccatgtgaacacatccaagcaagtctactaaaggaaggagactatggccatgccagctaccccagcctcccctagacaactcactggactttgcacaaattatgattgttgttttaagtcactaaccctgatttcagagatacttaaaggtgaaaaactgtagatttttgaatcaatgaaatatgctatgttatggtatcagtatataagtatctaaagggtgtttctaagaggagaaaagcatacaaattttagggaacagagtttttatgccacattttggctgctagaggttatttttgtttattttctggttttcagttacatttcatatagcttaagtcactgaacaagtgacggctggtactgaagggatactgctttctgccacagaatattacagcaagataaattatcttgtccattcaatgagaaagaaactagcaacctctagaattacatggtgaaaaattattattttgttatttagataggcagtatgaatcataaattaagagtgacaacactggaaaatgtctttccattttactatataaaataaatatttatattataaagcagaaaatacagtgacatactgtgcattccaggacttattacatttgcaattttttaactaatacaattctaaatacaataatatttacttattacaatattgcatgtataggcatgttgtgacattgctgttcatattccattgatatgaacaaaatatatttgttaataaaaggtcaaatgccagtttcattgtgaaaggtaaattttccacactgttgcttttaaaatccaagttctggattattataatagctcccatttacaatatttgtttcccaaatacctagttataaaagcatctaacctggatatatcactttagataaaaaaagcaatagaaataacagcataggtaatttcttctccaaatatacaaagagttagataaattcttggattaatctaatgcacagttactgaggtgcttacaacatgcctgatgctgtacttgagaccaggtacacaaaatcctcaacaaaaatcaaatcgaaatttttgaattagagataccaactgaattaaagcatttctgtaatatctaaaaatcctatcatgtgctaggagctttacatataacttgtcctttaatcctcacaacaccatgacacatttctaaaatgacttaatttctctgagagaagtcccacagctagtcagtggaggagctgggatatagtccaagtagatgttactggctttcttcaccatccaacactgccttttgccatctctgcattgtgcttttttatttaaagtgagtagagactaactgcgattgatgttagaatgaaagagaaggaaaatctcatacagtgacaatgaaagacgaattgtcctggaagcaactcatcataataaaatgctggcaaagtcctcttcccatttcctataaggcatgtgaccattcgtccccaaggagaacatttacaatggctcttgaatcttaatatgctctctcagatgcaccaaataccctttgcattctccttcatcacgcagtgtggatatatcatcaatgaattcaaaattctaaactttacttaaacttatttctctacaaagctctgggtaataagtttcacgggtaataattatgtaatgtgaaactttccatttctaccaaaattatttctttcacattctaaatttctgacagggtattttcataatatatatttggtgaaaattcttcatatttatacaacccatgtctaccatgatactctattgaactttcacctttcaaggatggattctaataacaaacactaacatctattgagtatttaccacttatcaggccccttactacaacttcatatgaattatatcccttaatcctcacaaactttgagataaattctatttctatcctcattttgtacctaagaaaacaatggtccaggtaatggggtgttgcgtgctaactgctgcatatctagttacagctagaaagtggtgacactgaacccaggtctgactccattgcccgctcctgatccaatgtgctgtccatatgtggacaatgatcaacttagagatccagaatccactcatcttttgaaacacagtgagcacccatctctttccaaggccttccctgatggccattcctcagtgccagcttccgcggcattctctttgattgctgtctcaccctcctctcttttcattctacctattttcctgcaatattgcatccatccccaaggcttcaataatccccacttatcatctaggaaactgagccttaagtaccttgtctgagagcatacagctaagtaaaggtaaagcaggaaccatctgacccaatccttgctcttaatccctgaactatgctacctctcagtaactctgaaatccttctcaatgtgccctcctgacaatccttcagttcaggcaccaccatcatttagtttaacctttaactagacctcccactttatgtcccctgacactctatccacaatgtccaatggaacttcctgtgatgatgaaaatgttctacaatctgcactgttcagtatggtagccattagccacatgtggtttctgagcacctaaaatgcggctagtgccactgaaggattttttatttaattttaattaatttaaatttaaactcaaatagccacatgtagcaagtggctaccatacgggacagcattgtcctacatagtcctcaagtctctctgtcccaaaccttgacattcataatgtctagtgaccttctgaacttggcttccaggagttactctgtaggctcataataaactgccctttccttaggtttttggggacattcctgtttcttgactaaaaaatcaagacatagtctgattcccatgaaaatggcctcttctctgagtttctgtttggcagaagcagaatcatagatgtttctctcaactcattcagaggctaatctgaagcagagatttctgaggcggcaagatgagggaggtcactgagatagaaatgtcttttctagttggaaaccttgtcgataaatattacaaattggcatgtattattttctaaagaaattatcctttacagcacaaaagactggctccagcgtgcattaatactatgcttggtcctgtagagtttaaaaaaaatgtttttgcattaactttaaacatgtaaatatttcacacaaaaattgatttctagcacttctggaaaaatccagtgatctggagacactgggtccgcattcctacatggcaaacatcagctaatgccaagaagctgctgccctctttcactaggcaaacactccagttgccacaatccccactgctccctcttgtataatatttctgatacccaggtaaagcatgccactttactcatttatgttacctgccttgtgcctaaggccatatgagtcagcaacccctaataataaagctttacaaagatttttttcatatccattattttgcttaattcttaccaaaatcctatgaagaaggaagcattattcttcccatttgtaaactaggaaagtggccctcagaaaaattaagtatacactggaaaagcatggttttaactcaggtcttacaactccttcttccatgctgcttttgctacaagacaatgcttgacaacagcccaagaaaaagtctatgatttaaattgcgggcaaatttcttacattagaatgtaaagaaaacatccttcaatattttgctgaaaatgtcacagagaaagtatggccaggttgatgtatacagaacatgagaagtcatgagtatccccaaagaggtgcctctcacccttttacagcaccccaaggaactaaccagggcttctaacagctggaagcacacaaccctgaggctcctgctgctccaggccctaccaggcattactacctcacaatgccccacaagggaacccaatgccccacaa

SEQ ID NO: 36661 - DNA, 3851 bp, Homo sapiens
agtgcgggctgagaaggcggtggctgcagcagcagcggcggcggaaaccctaaagtccgagtccggactacgagtgcgtggcctcctaatccggatcctagtcctgagcgtgtctgtgtgcgagtgggtgagtgtcctggcggagcggggtcggggcggctgcagatggatgcgccaggtccggaggggtcccgggtgagggcgccgcgacctgggggctgggggagggctgcggcgggacctcggccggagcatcccgcctgactccgggttgggcaggtgcgccccgggtcccgcctccctcgcggcttacacggccactcgggttcctgatcccctagacggtcccggacgcgatgaccctgaacggcggcggcagcggagcgggcgggagccgcggtgggggccaggagcgcgagcgccgtcggggcagcacaccctggggccccgccccgccgctgcaccgccgcagcatgccggtggacgagcgcgacctgcaggcggcgctgaccccgggtgccctgacggcggccgcggccgggacggggacccagggtcccaggctggactggcccgaggactccgaggactcgctcagctcagggggcagcgactcagacgagagcgtttacaaggtgctgctgctgggggcgcccggcgtgggcaagagcgccctggcgcgcatcttcggcggtgtggaggacgggcctgaagcagaggcagcaggtgaggggacccagctgttcaggggaggggcgatcccggggctaggactaggggctgagaccggtactcaaagccgcaaataccgtggaattatagttgttgttgttgttattattattattattattattttattattattttgagacagagtttcgctctttttcccaggctggagtgcagtggcctcgatctaggctcactgcaacctccgccttcaggtttcaagggattctcctgcctcagcctccagagtagctaggattacaggcgcctgctaccacgcccggctaatatttgtgtttttagtagagttggggtttcaccatgttggccaggctggtctggaatttctgacctcgtgatccgcccaccttggcttcccaaagtgctgggattacaggcgtgagccaccgcacctggccaatactgtggaattctattggcgctttcagaatcatgcctctacctacccacttcataaatggggaaaggaaaggagaagggacaccccccagcctttggtagggaagaaatgcccagagtagaaggccagggcatagatatggctactctgtgggatgggactggacatccctccctgcctatcagggacaggtcagagtttctaaccagagggatttctaagagaggagccctaggtggccaaggtccccagggggggcatgtgggtggaggtcaggcacaccatgccctccagcccccacttccctgcctggcactgctgttgccacataccagcatctgcaagtggagtggagggtaaggagggctctggggaagagttggagggtgtggccagaacaggaaacctggcagcagcggctttgacaaccagctggtaacctgtctactggccttctgcctagggcacacctatgatcgctccattgtagtggacggagaagaggcatcactcatggtctacgacatttgggagcaggtagggtgcaagcagagacccagggcaggggagggaggagtgagttgggttagaggtctgggagtgccaggctcgtgtcgggggcatgaggactgttgggcagatgtgtgttgtgtgttctccaggacgggggccgctggttgcccggccactgcatggccatgggggatgcctatgtcattgtgtactcagtgacggacaagggcagcttcgagaaggcctcagaactgcgggtccagctgcggcgtgcacggcaaacagatgatgtgcccatcatcctcgtgggcaacaagagcgacctggtgcgctctcgtgaggtctcggtggatggtgagtaggcggcaggttgcagggggagggagagcccagctgggccctgatccaggcagtcttggctcagcttgagtccctggggatcatcagaggctaaaaatgttcagaaagaaaactggcggggagggaaatgggagagagctggtgcctgctcacagggctccggaaggccccagagggctggggaaagaaccaaatctgataggggagctgggcaccgcagggccctcctctcctgcccctcttggtcctggcctggctggttgggggggtaaatgggtggaagagagtgtaggggaacaggccaggaggtcagagcctgtgtgctaggtctgggccattcttagagtagacttggccctggggaagacccttcccacttggcctcagcatccttttctgtggaccccagtactgagcccctcagaggaacccagcagtgacttggtgaccttgcctccgcaaccccagtccactggatcattcatcatgatataacctcgaattaaaaaatactaagttgtgcggggcatgggccagggggtggctaacgcctgtaatcccagcactttgggaggccgaggcgggtggatcacgaggtcaggagatcgagaccatcctggctagcatggtgaaaccccatctctactaaaaatacaaaaattagccgggcgtggtggcgggcgcctgtagtcccagctactcgggaggctgaggcaggagaatggcgtgaacccgggaggcggagctttcagtgagcagagattgtgccactgcactccagcctgggagacagcgagactctatctcagaaaaataaaataaaataaaataaaatactaagttgtccaacatagttctcattttcctgtgtttactactgtcgtactttgtttaaatatcaggcttcaaattatttcaataaatggatctccttttgagggccactgttttgggggctccttaaatgcaggcactctgcctactgggtgacgcagcagtgcccagtaccctcagtacaggagctggggtctctgtgttttcggggaggaccttgcaaattctcgagtggcagcttccatgggtggccactgttggaggggactcctcattcacccaccctttgtttactggtgcctgcctttccccacccacacagagggccgggcctgcgcggtggtctttgactgcaagttcattgagacatcagcggcattgcaccacaatgtccaggcgctgtttgaaggtgtcgtgcgccagatacgcctgcgcagggacagcaaagaagccaacgcacgacggcaagcaggcacccggaggcgagagagccttggcaaaaaggcgaagcgcttcttgggccgcatcgtagctcgtaacagccgcaagatggcctttcgcgccaaatccaagtcctgccacgacctctcggttctctaggtcccacccgctcccactatggtgggagacgaacggaagggttggtgggctggcccagccaactgccccgggtgcctcagagcaggctcagactctgggtccctcggagctgccagccgggcacccccaacctcatggtcatggacagatagacagtgctgccctgcgaagtggctctcaggggccagtgagggctgggcccacagagatgcatgcgcaggctcatatgcgtcccaagcagccgcagcgcagccgccgggcaggcctgcgtgccgggagaggactctgccttttttcacagcccgggtgtgcctgccctggagggaggctcttcagtgcggtagctatttgtttacatgcagatttttgtaataaaggctatttcctgata

SEQ ID NO: 36662 - DNA, 3851 bp, Homo sapiens; identical to SEQ ID NO: 36661

SEQ ID NO: 36663 - DNA, 12880 bp, Homo sapiens
ctgctttctttttcctttcttcggaatgagagactcaaccataatagaaagaatggagaactattaaccaccattcttcagtgggctgtgattttcagaggggaatactaagaagtaagtggggaatgttgattagagcctgggctacaatgcctgggaggacaagagctgaatcgctgagagtggtgagtgggcatgcagggagagtacttgcccagggaaaggggtgcagtgcctctgtgtgtgtgtgtgtgtgtgtgtgtgtgtgtgtgtgtgtgtgtgcgtgtgtgcgcatgggcacccatgcacacatgtgggcacatggagaagaggcaagtagtgcaaagaataaagacctgcagatattgggatttggtggaaggagagggagacaacataaatgaagaaatattccaactgcatgttcttaagaacttattgtggtcagaaaagggcaaaaaagtcgctaaaatctgttttggccaacacaagccatctattctaagagattctagaaagagatgtgccttatagattcatatgtaaatttgttcattacagaaatacttataatatagaaaaatctgaaccagcatacacatacaacaggcagggggtagacaaacagtgcgtggctctatcataaaagagatttctatgcagcttttaggcatcatgtttttaatgaagggcaattatttctcattttaacagcattagatccatacattaaaccttgttttgtatgttttaggtacagtatctgtttttccttccattaatcatttcctcataacccaatatatgtgtttcaatggacacaatctatttcattgtgtgaatatataattattttgtaatactttactaattttggctatttcaattatctacatttggctactgtatagattttattatatttaacaacctcagacataaatttttgtcttaatttctgtcttttttttttgcctcaacaataattcctataagtggaacttttgggtaaagcatacaacttttttttttaatagcatttccttggtagagcatgtaactttttaaagatgcttgctgtatatatgaccaaaatgctttgagaaatatttatatttctactaccaaagtatatgattactactacagagttttaattttattgattgactaatttgtagaaatgggggtctcattatgttacccaggctgttttaaacccctgggctcaaggaatcctcccaccttgaccatccaaattgctaagattgcaggcatgagccactgaacttttattcctttatgcttttcttcatttgcaatattgactataatcaggaagaaaatataaacatcctttaaaaagaatgaaaacatatgtctcactctaagcagagcagagaaattgttaactttgaaaccagtgataataaaaatgataccccttctatagcaacataaagagaagttttgaggaacagaagatgtgaaatgcaatatttagtctgggtcagtgcaagatccaggcgagggtggaggatggccggctgcacagacctctgttccggtgctttctcttcatccctccccacctccctctgcagaccttgttctcagaggccattcccagactcaggtagctacagcagcgggtgttgtggctgcaggcctcatgctcctttgctttggaagaaactgttgaggagttagtatttactgagcagcttatatgttccagtcagtattatcactcataataattactgttaagtaatacatgaaaaatcttaaatttaaagcatttcaatattttaaaagtaaagggagcaaaaggccaacgtgttcttttgctcacttaacttccgatcttcagtttagcatgcatctttttagactttttcaggcgtttacatctataaatatgcagaaatgtatagctttgtttttgtttttcagttgaatcattagtgtagttctgcaacatgctttttgaccgcttagtgtatcaccattatctaggttcatgacaataaatcaactctttttacctgctgcattgaattccctctgagggatgagccgtagttcctctaaacagtctcctgttgggtggctggttcagtcggttaccacttttatactttaaaaacagtgctgcagtgtcattctcacagaggcttctctctgcactcatgcaagtactttgctagactagacatcagaaagtggaattgctggacccaattgtgcacattcgaaatttcacacttcatgatattgtatgaatcaataaagttccaatggttttgtcccatgaacaagatcacacagcttgtgaatcttagagcctttacctattgcttaccttctttatgtccttaacactaatatagtaggcctcacccattgtgggtgctcagtaaatacttgttgaatgactttatgaagggaagaaagaaaagatgagtaaggcctggtcttattcaaagctctcctaatcaatatctttgtgattaaacgtggtgggttcagcccctgactgacttcagagcctctgccaggcagtctgcctggatcccaccaggagccaccaggccataagttgactgtagtaatggccaagagtttgatgcttgaggagtccacagtgttggacacccacagagctgaacaagggtgggaccagggaatccagtgaagagggtccttcatgaatcagagggggatgatggaagcttggacctggcaagggaagtgtggggaagtgataggattatgaatattttaatattttaatgcagtagagtcagagatgtcctgatcagataacagatattatttttacagatggttttccatactggaacccaaaggtaaagacactcaaggacagacatttttggcagaggtaagatcttctttggtcaccatacttgagttagccctggggaagtggacatttccatgcagaagcctaaagcttcttccaggccatagtgtctgtcccacaccttctggtatctcttgatatgcagcatagatgaaaatggcaagttccctggctttccttctgctcaactttcatgtctccctcttcttggtccagctgctcactccttgctcaggtagggaatgattccatgattccacatttatgtttctgaagcagacaattatctcaattacctaattaagcagacaattacctaaatgccctcttagaacctttaactcattcccatacctggaagtccatcccaacctgaaggaccacctgtcacaaagagacaaatggtccttctgttaggattgtgttcccctctaggttctctgtatctcgccttccctgtctgagaaggacccttcctctcgtgaccccaactccaaaaccctctgatggagcttcccccttgtgctgacagctcagttttctgtgcttggaccctctgggcccatcctggccatggtgggtgaagacgctgatctgccctgtcacctgttcccgaccatgagtgcagagaccatggagctgaggtgggtgagttccagcctaaggcaggtggtgaacgtgtatgcagatggaaaggaagtggaagacaggcagagtgcaccgtatcgagggagaacttcgattctgcgggatggcatcactgcagggaaggctgctctccgaatacacaacgtcacagcctctgacagtggaaagtacttgtgttatttccaagatggtgacttctacgaaaaagccctggtggagctgaaggttgcaggtgagcctccaggttttgttctgagaacacttctctgtaggatctagagcagatgcagagtccctcttccaaaagtactgcagacactcctggctgctcactagcaattgtctgcactgcctcccaacttagcttctctgcaacccttaagaaagacacattctttctttagaaagaattcctgctgtaccttacatgccgaagtaaacaactccctccctctgacaaccagagatataagggaaatgaaggacgacggataggaaacattagaaatcatctctttagtgactggtacacagtcattttggtttagtcatgtaacagacggcttctgttgtgtctccaagtgcacgttaccgtgggtcctgggaggtggaatggtgactgtatctgctgccagtgttttccaatcagtgactcccagaaacatttttgtagtataatgaggcatgtttcttacttgttgctttgaggaagaacacacatcatggggagctgtggcgaggtctcagtaaggttttagagcagatttattttacaatttgggcttgtgttaggggatttgggggagggtttatagacttagctctcttctctggatgagatactgtcaggaaggtgtggggagatgaattctgagagtgggagccttaatcaagcttatctaggaggaaggagactagggtgagactaaagctgtaaatgatgaagaggcagcaattcctcattgctgatgggggatgtttggttattgttgtggtttgtacaatgttcatgtttttctctgcactcacaaaagattggggtggtcttgtatttcccatgatctgtcacagtgataaagtactattttttgtgttctgtgaaattacttatgttcaacaggaggataccaagacctggtatcaggttccagacgccgaggagagcttttttctttctcagtgcaatcccttgcctcatggcttctggttgggtttggtttaaggggagctgtagcagacaatggtaggaagaagagaaaagggagaggtctgggtgcttattccctggcttccttcctgcaagattccctcaggctggctgcattgccttgctgaaggtcacaagtcaactcaagaaagtcctcaatgcatcaatctttttatgtctccggaacagatccctctcctcctccctctggtaattggggtggatgggaatagccccacattactgaccctgggatactgcactagcccatttagttttcttttcatcatgaccacacttgtgtaaatagctcctgaatgaaatcttccttggattatcaaatgtgagtctgccattgattcccattgagaccctccctgatacaggagctctcaagaatttagggcaatttatccttctacagcattgggttctgatcttcacattgaagtgaagggttatgaggatggagggatccatctggagtgcaggtccactggctggtacccccaaccccaaataaagtggagcgacaccaagggagagaacatcccggctgtggaagcacctgtggttgcagatggagtgggcctgtatgcagtagcagcatctgtgatcatgagaggcagctctggtgggggtgtatcctgcatcatcagaaattccctcctcggcctggaaaagacagccagcatatccatcgcaggtcagtaccctgcttggcctcagctttactgagctgagctgtggcaggtgatgaagggggatgtgtgagtctctactgtgtgagtctctgcggtcaacctgggtctctacaatgcatgtaaggctcaaagcagggacctgaaggctactcactgctttaggggagcttccccacgccacaaagctgttcatgccacaaacatttactgatcacttcctgtctgacagaaacagaaagtgtgacaggcagtgggaattggggaaaaacattaagagaagctccttatgtaaagtcaaatgacaaaatgggaaaacatatatatatttacaaactcatagagaaagagctaatctttttgaaacagaagagtttgaaaactgagtaaaaaatattaacaaaggtcatgaattgttaattcacaggaaaagaaataacccacaaaagagtgctcattctcactcattagggaaacatatctgaaatcatttttcacttatgatattagcaaaaatcaaaaccccactgccttgcttgataccacatggctatggcaggagtgtaggaaggcagtgactctcagtcatttgctcgtgtcacttgtatttttggtgtgcattagcacaagctctattgggggatctatccaaactacatatttattgatccaaaattccagttctgggatatgcttgcatttgtatgagatgatccatgtaaaaggtttctgggggtttttttgtttgtttgtttgtatgttttttgagagggagtctcactctgttgcccaggatggagtgcaatggcgcaatctcggctcactgcaacctcctcctcctgggttcgagagagcctcctgtctcagcctccccagtagctgggattacaagcatgcaccaccacacctggataatttttatatttttactagagatgtggtttcaccatgttggccaggctggtttcaaactccagaccccaattgatccgcctgtctcagcctcccaaggtgctgggattacaagtgtgagtcaccagcccggcctataaaaagtttcttatagcattgattatgattgtataaggttagaagctatggagatgctcactgatggtgaacttccatacaagggaatactgcccaactgtgaaagaaaaaagagataattctctctacactaatatggaaagatctccaagacacactttacacagaagagtgagatgcagagtgatgtgtatagaatgttatttttagtttaaacaagaggaaaaataggaacatattttaatttactttttttagttcttgattctgttatttaacttacatttttaaaatttaacaagcaattttgtaatactcactgtacatcaagtactttatttacttatttagagacagagtctcactctgtcacctaggctggaatgctgtggcacaatcttggctcactgcaagccccgcttcctgggttgaagcaattctatagcctcagcctcccaagtagttgggattacagggacatgacactatgcccagctaatttttgtaattttagtaaacatgggttttcaccgtgtcggccaagctggtctcgacctcctgacctcaagtgatctgcctgcctcggcctcacaaagtgctgggattacaggcatgacccactgcagcccattaggcccttttaaagtattaatttaattcttctaacctcaggagataggcattatcattaccctcattttatagattaggccactacaaacagagaggttatgtaagtagtccaacatcacactgctagtcacataggggagccagcatttaaacccttgccctctgactccacagtttatgtccctaagcatcatattaagtggactaaggaaaagttaatagatggagggagggagtactaggtagatgggagagttgcataactttatgtacatgaagtttttgaaccatgtaaatgtgttactggttgaaaaaatatttagaaaaaaatgagtatgactctgctgaagttaatttccatacgagaggcagacctctcaagatagtaatagtagtagcttgtagtgagggtttaccaaagtcctctctacagtcctctgagactttagggacagaacgcttatttaacctcatgagatggattccatgcccccaacctgggctgagcagctaaagcttggggtgctgaggctggggaggctgagtgcactagctcccatgacccacagctctccccttcgcagaccccttcttcaggagcgcccagccctggatcgcggccctggcagggaccctgcctatctcgttgctgcttctcgcaggagccagttacttcttgtggagacaacagaaggaaaaaattgctctgtccagggagacagaaagagagcgagagatgaaagaaatgggatacgctgcaacagagcaagaaataagcctaagaggtatccaacgcaagcagagaatctaagcccctggcttgcatgccccagcctgaagatctcacccccattcccaccctgacactgcatcaagtttaaggtttattttcccaaaaccccccttacccataactgttctttttttcttttctttttttgcttattttccagagaagctccaggaggaactcagtaagttcccattccccaggagacccaggcatgtcttcttatccccactttgagcaccttgataacccttccctattcattccattgcagagtggaggaaaatccagtacatggctcgtgagtgactctgacattttctctgaatttgaatcttgaatctatgactctcttctgcttggaaattttccagcccataagtctttgcccagggttgaaaaatggtcctagatccctttactcaggaaaagaaaataagtttggctctttggagaaaccacccagaaggagtctctctctctcgtctatctctctctctaagaaaagaaaaagaggtcttcaatctctttgtactaggggccacagacctttatgccctaaaaagcactgaggaatatccaggggtacacttcaaaaggaagagagaaggatgaggtgcattttctgtggcaggaaacttacttgttgttttccataatctagaggatgttgaaaggaaaacaagaatggaagatttaagagataagaaaatcagaaaagagagagggagacaagtgtgtctaataaagaggaatagctacagtggctcagttggtacagatttatcataactgctttcaaaaactagtccctgaaattgctcattaaatttcccaaattctttttagagcaaggtaggaaatgatacagattgagaagggtggatcttgtactcctagacatacacatatagacatggtgacacctatgcccaggtacaggagtatagacagattcaaaatagattagctggactccactgggaaggaactctcacagtgactgccctgccactagcattcaaccaatgttcccagacttgatattaagaagaagaggtgaagagagaattgagcttgcagagtgagaccacagggaagagtggaatggtcaaaaagaaagtctagatggatgcgaaaggaagtggaaggggccaacagagcaaaggcagtgttcaggtgacacctctatctttctttcattgtaggtggagagaagtctttggcctatcatggtgagtgagcctgatgctctctgggtttgctgggtcatgtacaatgaacatttcaactttttctctgctgtgacccattgacgttctcagttggattaatcagatctaacccttagactcaattttgcatggtagggggttgacttctgcttttctggagcctctgagagactcctgaccctgcacatgcccaggcaaagcataaccatgcagcctgcaccccccatggcacagggagccgagcctgacattgtttagaaggtgccacctctgatctatcagagctgtagaggaaggaagctgaagcctggaagagactctgaagaaaaggagagaaaacgtgtagtgaaaggagaatggagtggagaaaagaacaaaaatactgacctttttcttatctgtgtctccttcctttcagaatggaaaatggccctcttcaaacctggtgagtaaatcactgtatgttccctggatcaacaacctgagggactatattcctttctcctcctccaactcttgtgatttagggaagaaaagttcccttgactaagaaagtttggggtagacaacattaaatcccaatctgaaaagtgggcccatctccaagacccttcccgctgagagcccagggaaccagggagaattgctctcttgggcttcctcagaccttcctgggaaggaagacacataaagggtggagctgaggggaaggagacacacactgagtgatactgcagggagagtgaggatgcaaatgccaaggagaggaggtgatgcctgcccaaagaactttgcacttcccaggcttctcatgccccctactgcctgtgtcacctcaaatgatttaatgcttccgagctttcgcctccacatttttaaatgaaaattgcaatctgtgttttgtgggggtgaggtgaagactgaagtaataataaatatccactggtcaaaaaccaagtaagaaagagatgacaagttcaaactggttggttgaaaaaggtttgcggaaaggagggataagggtaagcaataaggaaaagtgcagtgcccccatggttcccaacagtggggagctgtcttcactcctagcctgggaggtctaggaaggggaggcagttactggaacccagagaaaagtagctcaaaagagagggctccctgagaagagtcgtcaggccttgttagagtagcatcagctgctgctggcagggaggaagcaggagaataaacagtgtgtctctcctttctttctccttccaatcttctatcagggcctcccattggccaaacccaacagcaaaccagaagacaagggagcccagtggcactatccttagagtacagattcctaggacccagaagagggtggaaaaagctgaaggctggagagtgaatctggggcccctcatagagcccagcatagagacggccttgcagctattagaacatcaggagcttccttcatgccctgctgtgggctgagtaaataacatgattcccctatactacgctagagagtcatatttttatccccatttttcaggtgacaaaatgcttcagatgaggctccaccttgttaaataaattggatgtatggaaaaatagactgcagaaaaggggagctcatttagttcataagcggtcgagtgaagattgaaaattaacctctgagtataaggcattagggggcagagtcaatgtggggagggaaacaagaaaaatgtagcaagaggatccttattgcttcctgaggcagcatcagggtattgggttaggcagatactgaccttactttcatttcccctctggacacaagaccccttgagctttctcccatgacattgatgagagagtcatatttagagcaggctagggacgccaggttctggaaggacctccttagcatggtccaggccttgcatgctgaggctctgaaatccaggaaaaatggctgaccccatggacacctcctcaaactctctgcagcggatgtgattctggatccagacacggcaaacgccatcctccttgtttctgaggaccagaggagtgtgcagcgtgctgaagagccgcgggatctgccagacaaccctgagagatttgaatggcgttactgtgtccttggctgtgaaaacttcacatcagggagacattactgggaggtggaagtgggggacagaaaagagtggcatattggggtatgtagtaagaacgtggagaggaaaaaaggttgggtcaaaatgacaccggagaacggatactggactatgggcctgactgatgggaataagtatcgggctctcactgagcccagaaccaacctgaaacttcctgagcctcctaggaaagtggggatcttcctggactatgagactggagagatctcgttctataatgccacagatggatctcatatctacacctttccgcacgcctctttctctgagcctctatatcctgttttcagaattttgaccttggagcccactgccctgaccatttgcccaataccaaaagaagtagagagttcccccgatcctgacctagtgcctgatcattccctggagacaccactgaccccgggcttagctaatgaaagtggggagcctcaggctgaagtaacatctctgcttctccctgcccaccctggagctgaggtctccccttctgcaacaaccaatcagaaccataagctacaggcacgcactgaagcactttactgatattcattccattattccatatgacagttgttttgagtttcgtaccaccttattgtccccttatacagataaggaaactggggtgcagaaaggtgaattaactttacaaagtagacatgacaagtgaacagcagagctgggatctaaacagcaataactaacattaacagagaatttaaaatgttcttagtgctgtgttataagctttggtggatgtcactcctttaatcctcacaacaccctgtcgggtagtcatattttgcaagtatggaagctgaggcagggcaacatgaagtaacttacataactcatacagtaatttgtgcagttgggagatgttcagccttagtccctggctaattgcctgttcttttccagcctgattttttttcccacaggaagagcccacatgtagccctgaggtttccttcccaggacagctgcagggtagagatcattttaagtgcttgtggagttgacatccctattgactctttcccagctgatatcagagacttagacccagcactccttggattagctctgcagagtgtcttggttgagagaataacctcatagtaccaacatgacatgtgacttggaaagagactagaggccacacttgataaatcatggggcacagatatgttcccacccaacaaatgtgataagtgattgtgcagccagagccagccttccttcaatcaaggtttccaggcagagcaaataccctagagattctctgtgatataggaaatttggatcaaggaagctaaaagaattacagggatgtttttaatcccactatggactcagtctcctggaaataggtctgtccactcctggtcattggtggatgttaaacccatattcctttcaactgctgcctgctagggaaaactgctcctcattatcatcactattattgctcaccactgtatcccctctacttggcaagtggttgtcaagttctagttgttcaataaatgtgttaataatgctt

SEQ ID NO: 36664 - DNA, 5152 bp, Homo sapiens
agagcgcgttgtctaccctgtaccgaagacagaggctgtggggacagcctaggggcctggatctattgcctacttagagagaggccaactcagacacagccgtgtatgctcccagcagcaacggaggttcaggcaagatgcccgaaggagggaagggtgacaagggcagtggggagacttggagagtttgtgcagaggggaggaacacacctttctttctgtattgtattgtattgtattgtattttttgagacagagtctcgctctgtcacccaggctggagtgcagtggcacgatcttggctcactgcaacctctgcctcctgggttcaagtgattctcctgcctcagcctcctgagtagctgggattacaggtgcccaccacctcgcctggctaatttttgtatttttagtagagacggggtttcatcatgttggtcaggctggtctcgaactcttgacctcaggatccacccacctcggcctcccaaagtgctgggattacaggcgtgagccactgtgcccggccacatctttctttagaaagatcatgctggctcctgtggggaaggcaacttgaaggggaagaaattggaagagggaagacttgacactaaacatagagccatggtcagtaagtttttggagggacctttaccagagagggagaggaagcagtatccattatccactctttagtgacagagcccaaaggaacagctctgtaatggctgggggtgggggcaagggcagcaatgaacagaggaggcgagggctgctcctgttgttgagtgccttccaggacactaagtgctggtctggctgctccaacatgggaaactttcatgttgtctctcagatctaagggtctctctgcatttttaaaaaaattattttgaattttttaaacttctatcgtttttcaggtggttttggttgcatagataagttctttagtggtgatttctgaattttagtgcaccagtcaccggagcagtgtacactgtactcagtatatagtcttttattcctcaccccctcctcaccttgccccacccccagtctatatcattctcatctgcatttgttttttgagaggtagggtgaggtctgctgcattagcccagagacagctgaggaggctggaaaggaaaatggctttcagagaatagggaaggaaaaagtctgaggaagcaaaactacttaaaaaacactgctctttccatttccgtatcatttaaccaaacaccatcctgtgggttctgtcacttgatcctcatgctgatctgagaactcggcagagctgggtcactgccttccccaaggctaacctggtttctaagctggcacaagaccccaggtgatctatcatctaaccacagagcccttgctggacagagggtgaagacattatgtgtccctggctctgttcagggaagcagaggatagacctgaagaatttaattacttgtcatagataaagcctagagaaaaggtgagggcgcaaagtatctcctccaaattgggaagactcccccagggctcactcactaacgccagttctcctgagcctttaaagcctgggggtgagggagccctcctggtcaaccctctctaccctagcctcagggagcttcagggccccagcattgaaggaacagggtctgacctcatttgccaccgtagggttggggagactgaggcaggaggtgaatgggctcccagcttggagccctttcccctcaggacttggtttccctaccctagctccgcctgcagggacagaaagacatggtctggaaatggatgccacttctgctgcttctggtctgtgtagccaccatgtgcagtgcccaggacaggactgatctcctcaatgtctgtatggatgccaagcaccacaagacaaagccaggtcctgaggacaagctgcatgaccaagtacggctggagtgtgcctctgctaaggagggggcttgttctaacagggaggagaaagtcaggatggtgggagagggattgaggggtcagatacctccacatcctgaagttttcctgtgggagaagatgaaggtggagtaggaagagtggctgaggtgattttaggggggccctccccggaggtggataccatgttgacaatgatattgagtcgtcattcgatgggcacctgtcagttgtcatgtgttttttgtacaaaatttcatattcccaggggttcttggatgtaggtagatgatattctccacattacacaagtaagtgaaaatgaggctcacagaagcacatgggcccacacaggagctggacatgaatggcccctgtggaggggtaggaataggagtgggttaggctcctcctttggtgggtgacagactagggagtcgctggcttttcccaccctcactaagtgccatttccatggagtgccaagggagaagaggaggaggcccttctggctgtaatttgaggcacaggggctggacattcacacagtctatatacatgtatgccaggggattgcagccttattagactcaatgtctcccttttatgacagatttttttttagattctcttttctatcctgcaatgaaattcaaagaacctatttgtatgcataatttttgcaaatatcaacataatgctctgtaatataaaggagaaacacacagaaagtaacttgtaataaaataatatatatttcaatatgtcagttctctggtatgactacattagaaggcattaggaaatagcacatgcttgcttttgtcataaaatcattataagtggggagctacaaatgaagattgatacaggtatattctattggtgacttaaacactataagatactataatataagcaatgttgctgttgatgtcatacttttctaaaatagtgaataattctagtagaataaaccacatagtacagccttctatttcatggtatttgcagtcctggaaaacccagtctagattaaaatcttgtgaaaacatgatgtgcctatatgtaagatagagatacatttaaaaagtagggcttttgcttacttttttttttttttttgagaaggagtctcactctgttgcccaggctggagtgcaatggtgtgatctcagctcacggcaacctccgcctccggggttctggtgattctcctgcctcagcctcccaagtagctggggcacccgccaccatgcctggctaatttttttgtatttttaccagagacgaggtttcaccatgttggccagggtggtctcaaactcctgacctcaggtggtagacctgcctcggcctcccaaagtgctggggttacagctacgagccaccacgcccagcctggcttttgcttactttttccagcaaatattttcatgggcctactatgtgtctggcactggcctagccactggggacacagatcttactacatgccaagaagaataaatatattcaaactccattactccatggctcgctccctctcttcctttgctcaaaatgtcaccaatgtggcatttcctaacctatttaaaatttcagcaattccacattaccatttcctgctcatatcatttaacttttcccatatcatttatcatatcctgacataccatatatatatattttttaagtttcttactgtctgtctcctctgaccagaatgaaaattccatgaatacatatttctgtctgttttgttctcttctgtattcccagcatctataaccgtgactggcataaagtaggtgctcaataatttttaaatgagtaagtgaaaggactttttatgaagtgttacatacctcataaatgataactattattcccaagacagggtttcccctgggctcccacagtcccctgatcacacggttgtaattgtgtttcctccaagaaaggggttcctggaggcctaggagagagggaccatcatctgggaacctgagtgttctcaggacaacctgcctagggcagaggagtaagaaccaaatgggggagagacacgaggtggcaggaggaggagggtatggggaggcacttagtcctgtgtcttccccacccagtgcagtccctggaagaagaatgcctgctgcacagccagcaccagccaggagctgcacaaggacacctcccgcctgtacaactttaactgggaccactgcggcaagatggagcccgcctgcaagcgccacttcatccaggacacctgtctctatgagtgctcacccaacctggggccctggatccagcaggtagggtgtctccccccgacccaccccagcagactgccatccccctcagtcacttcaaggcgatggctgccagcatccctggctgagaggagccctgcctccccacctcccacccaggtgaatcagagctggcgcaaagaacgcttcctggatgtgcccttatgcaaagaggactgtcagcgctggtgggaggattgtcacacctcccacacgtgcaagagcaactggcacagaggatgggactggacctcaggtgagggtgattgagttggggttaggaaaaaggagattgaggtagggtttggaaaatcttcaaggatttggggtggggtgaagatttctgggggtggccagaaatgagctttgggcccaggggctgaaagtctgtgtccaccatgcctctccctgcaggagttaacaagtgcccagctggggctctctgccgcacctttgagtcctacttccccactccagctgccctttgtgaaggcctctggagtcactcatacaaggtcagcaactacagccgagggagcggccgctgcatccagatgtggtttgattcagcccagggcaaccccaacgaggaagtggcgaggttctatgctgcagccatgcatgtgaatgctggtgagatgcttcatgggactgggggtctcctgctcagtctggccctgatgctgcaactctggctccttggctgagttcagtcctcccagactacctgccctcagcttggataaccaggctgggctcagctcagctcccacaaatgacagccccttaagcatgcttctattagtcacctaaccctctgtcacccagtctgttgctgctccatggtggggccaagagtcacttctaataaacagactgttttctaataa

SEQ ID NO: 36665 - DNA, 3713 bp, Homo sapiens
cgcactccctgctggggtgagcagcactgtaaagatgaagctggctaactggtactggctgagctcagctgttcttgccacttacggttttttggttgtggcaaacaatgaaacagaggaaattaaagatgaaagagcaaaggatgtctgcccagtgagactagaaagcagagggaaatgcgaagaggcaggggagtgcccctaccaggtaagcctgccccccttgactattcagctcccgaagcaattcagcaggatcgaggaggtgttcaaagaagtccaaaacctcaaggaaatcgtaaatagtctaaagaaatcttgccaagactgcaagctgcaggctgatgacaacggagacccaggcagaaacggactgttgttacccagtacaggagccccgggagaggttggtgataacagagttagagaattagagagtgaggttaacaagctgtcctctgagctaaagaatgccaaagaggagatcaatgtacttcatggtcgcctggagaagctgaatcttgtaaatatgaacaacatagaaaattatgttgacagcaaagtggcaaatctaacatttgttgtcaatagtttggatggcaaatgttcaaagtgtcccagccaagaacaaatacagtcacgtccaggtatgtataataatgttttcttatcatatgttcataaatgttatacagctagagagtatctataaacattaacctgagtcagtaagttaaatagatgacagattaagtcttttatttatcaaggtgcacaggaaaaaataaatatcttctcaaatatgaccacataaatatgacctaattacaaaaatcatagttagttctgtatccactggaagtcactttcaattttaagatcttatttgttaatgccagacctacttgcaagcagaagtagagagaatttcttgatgttttagtgcatttaacttgtctcttcaatgaggtgtttgaaaacaataaagataaggcgatgttcacaattgtgccttgtttgttggaaatcagtttttcttgtgattgactgactgccgcttctcatggctaaagaggtctttgaaagattttagcaagtaatctagttcttaatcccaaatatctggagaaaatgggagagtttacagatggaataaaagcagtttcatatgtgtgcacaaatttttgctttgagacctagtggcacaaaaaatattttaaggggagagttttagcatgccactaagggaaggtattcatatttctttctcttttacctgaagttagaattcaagcagatagaagtagaacccatcctcaccatccaaattacttgaattaactttaataaatacatgtgaaattccacagacttaatcgcctactccacccacgaactaacagtggtattgactctccaaaccttggcttttcacctgagtcactgggaccactgttgctgactgtctcatactttggaaagccatctccgcatttggacctctacttaccatgaacgtgaggttgaaaggacagggcggagatcactttcatttagagacagtatctcaggcatgctccatccccagggcatctgccagtgaaggagggaagggtcatattttcaaggacctctattggtaatactcctggcagcctgcatctgaatgtacctggcacactgcgaatccaaggttcaccgcttaggtgacatcagtgggtatacattagattagatgctgcatggcaacttgtcatgatatgaagactattgtctatttttctcctaaacattttgggtgaaataactgaatattctgagctctaaatatacaggaatagatttttatgccttagggtatctcatattaaacttaccttatttgtcacacattttaataaaaactatctgggagtaaatatctgtctgattcatacagaactttgttaactgattattatgcttatcctcaatatagtcacctgttgtttctttctagaaacccaacatgtgaaatagtggctaaatactttcctagataataaatacagaataagaatattggtgtgtcattgaaaaagatacttctttttcacttgagcttctttatatagttgtcaagtgaaatgaatatgaatttatgatcaatcctatgcattaggattttaacacatcatttggaatatatgctataaaaccttctgacagtagaggctatcagcccctttaggtgaaagaaaatagaagcctgtgcttcctctgtatgcaaggaatacagttctaggagagttagaatcatctgatttttaggaccaagggatgcaatgattacgagaacaaagctttgctgccagccagatctgagttagtgtcctggctctgccacttaaagctcaggtgaaggtgggcaagccactgatctttatgcctaaatatcctcacatgcagactggcagtaacgcctacatcataaggtcaatgttcagattcagtgtgaaaatgttacccagtctggcagcatgcctagaacgtataggtaggcctcactacataatactaaattattaaaactgtacttttattattttcttattgtcgtttgctgttgatgctgtcattattactaccaaccaagagtatattagaggtcctttctgctttataacattaggttcttcttgtgaggccttaagcatttgctaaacaggttcaagtaagtttagtaaagtttcattactgccattgattcaattatcaaactgcttttgtacatataaagaattcttcagatgcatggtttctattaacaagatccaatgccttccttttatttccccttcagttcaacatctaatatataaagattgctctgactactacgcaataggcaaaagaagcagtgagacctacagagttacacctgatcccaaaaatagtagctttgaagtttactgtgacatggagaccatggggggaggctggacagtgctgcaggcacgtctcgatgggagcaccaacttcaccagaacatggcaagactacaaagcaggctttggaaacctcagaagggaattttggctggggaacgataaaattcatcttctgaccaagagtaaggaaatgattctgagaatagatcttgaagactttaatggtgtcgaactatatgccttgtatgatcagttttatgtggctaatgagtttctcaaatatcgtttacacgttggtaactataatggcacagctggagatgcattacgtttcaacaaacattacaaccacgatctgaagtttttcaccactccagataaagacaatgatcgatatccttctgggaactgtgggctgtactacagttcaggctggtggtttgatgcatgtctttctgcaaacttaaatggcaaatattatcaccaaaaatacagaggtgtccgtaatgggattttctggggtacctggcctggtgtaagtgaggcacaccctggtggctacaagtcctccttcaaagaggctaagatgatgatcagacccaagcactttaagccataaatcactctgttcattcctccaggtattcgttatctaatagggcaattaattccttcagcactttagaatatgccttgtttcatatttttcatagctaaaaaatgatgtctgacggctaggttcttatgctacacagcatttgaaataaagctgaaaaacaatgc

SEQ ID NO: 36666 - DNA, 14569 bp, Homo sapiens
aaaaggaggcgtgcagcgagcatgaaccggctgggctgctggcccgcaaggagcctgccaaggtcaggcaggggcagtgggcagaggagtcttggacttgggggccacccttcaggtcccaggcatccaggcaccccagcagcgaagaggacatgggagtcccctggtgtgagggccagagactgtccactgtctgtaagtcttctaagtagatgtcagggttctgggaggaggcctgcagggggctgagggcccaggggaagcccctcggactccctcccacaagtggactctgctatctgcttcctgctgggctggcctacactcaggccgtgggctgtggagagctgggccgtggcacaggcgtggagacgacctttttggcctggccccggccctttccttcacattgtgaggcatggattcttgcttcttctttttccccaccccgagtctgtgccacatctgctctgggaagatgtggtctgtgcttggccatgaattcccaaggcttgaagcagcaagggctttgagggagagggccttgagggagagggccttgagggagagggctgtggggcagaagcagagaaggagaaataagcctccggccaaggtcaggttgagcaggagagccttgggttctttgtgggacagcacagagctgggggtcaggcgagctgtgcccagcaagtaggcagcggctggatgtgacaaagacccagaggagaaacacagaagaggggagagggtctggaagctggggaaagcaggatggtcgggaaggcctggcccctcacccattcccagggaacggggccttgggccccagaagggcacaggcgggaggcagccgacccctggtggcagcggcagcaggcacaggagggcagaatgcagctggggtgtgcgtgggtggcagcaaggaggggcggagggaggaagctggcttcctggagccttctcagccctcaaagacagaccgacagacagacagacagctggcaagaggcagcctgggggccacagctgcttcagtaagtatctgaaggggggactgggagtcctgtggccccggggggtgcgaactccggggatataagagggcatctctaggagggagtgcgggagggcgagtggggcgccacagtgcctggctggggtatgggtgctcacagacctgatgtccccaagacgggggtgagcagggaagccacagggagctacaaggagagcagaggctgaagggaccttttctgctaccagagaccctcgctctaccactcacacctgtgccaggcccattctgtcccctcacctccgtccctgctgccttggtgattcaacacccccgccacctcgcccactgtgaccctggctctgggagatagggactgcccccaagaggagatggtcccaccacctccatgcctcctgtcttgcccccagctgtcgcctcaccatgcgctgtcgttcaagggcttggtgaggccatttcctgtgacggttacagaggcgggagacggggggatgggcaggaggaggaaggaaacacctccagcctacctccctggacagagaccccagaagccagaaacagacctgggagtggaacagcagcagttaggagaggaccctgctggggtccaggagcccgcctgcctggctgcccaaccagctccaacactgctggaggcctccattctctgttcaggggaaggcccactggttagctcagagatggcttctgcgtgctttctcccttccgtcctagagaacacatattttctgtttcctcccttgccttctcccacttggacctgctcagagccctgtgtactctggtgtgtggcctctctcccctctctcttttcctccttctggattctttcctatcttcatccacaatctctaccctttatcttgccgttactctaccccgagactgccttctgccctgggtcccaccaaatagatcctgtccttcccttagtgaaaatgaggccacctcttggggaacagaagacgccccagtgaaaacagagtgcaaacctggcctggcatgggagcctccttctggccaatcaggcaggccagagaacagcagcggagggccctgtctttcaggcagacctcatggctgagtgagcctcccctgggcccagcaccccacctcagcatggtccaagcccatggggggcgctccagagcacagccgttgaccttgtctttgggggcagccatgacccagcctccgcctgaaaaaacgccagccaagaagcatgtgcgactgcaggagaggtgagatcttccctgggggaggggtcttccgagccctgagcccccattccgctcctcccttccttccatctgcccctccagctctgacagcagggtccagagggccctcagttgttgactccaatttggaaaggaaaccagtagtgctcatttgcatgtcttttgcatgtctggagcacagagtttcatatcaaccatgagcctgctccctaaattccaggcaaggcccacagccttcttggtgctggatgcatgtcggagccacagggcctggctgggagtgggaagaggcaggcagctggaaggagcagttgagttcaaggctgccctgttctggctgacaaagggagagggctgagccaggcatggtagctcatgcccaaaatcccagcactttgggaggctgaggtgagaggatctcctgagtccaggaattagagaccggcctaggcaatatagtgagacctcctctctctcaaaaaaaaaaaaaaaaagagggcacacagcaggggcccaaaccctaaatttactgggctaccaggttaaaggaaagataaagagcggccccctcagaggtgccttataacagtaatacttgtaagaaaagcaaatatggtcaggcacagtggctcatgcctataatcccagcactttgggaagccaaggcagaaggatcacttgagcccaggagttcaaaaccagcctgagcaacagaacaagacactgtctctccaaaaaaaaaaaaaacttaaattagccaggtgtggtagcatgtacctgtggtcccagttactctggaggctgaggtgggaggattgcttcagcccaggagtttgaggctgctgtgagccataatagtgccatcacactccagacctgggcaacagagagagaccctatctctaaaagaaaagataaaaagaaaagaaaagcaaatatgattgggtgctcactaggcagtggtgggctatgcctgcaggcggggctccaatgtggctctgatgctggacgttcggtccctgggggccgtagaacccatctgctctgtgaacacaccccgggaggtcaccctacactttctgcgcactgctggacacccccttacccgctgggcccttcagcgccagccacccagccccaagcaactggaagaagaattcttggtaagaaattggggtcccctctgaatcgctctgccctctgtatcagaggcagccagctggaaccattctctcacgggcaccctgggcaagtctcccctttgggccccttaggaaagagaacttcagggctgagggaggggctgcccccaggcttccccttctgcccccaccccatctaggcctacatactattgtcaagaaggaatggccagagtccagctgttctagaaaaaggtagaaggagagaaaaggaggctaggagtcagctgctcacccatttcctccccctgccagaagatcccttcaaactttgtcagccccgaagacctggacatccctggccacgcctccaaggaccgatacaagaccatcttgccaagtaagaactgctgctgggatgaagggagtcgggtacagtccctggggctagagaacttcagaggacaaagtacacagtttcagccagggaagatcaaccttgcttggcacatcttctctcagcagagaaagggggaagaaggagcaagaatcacaacagcagcaataataatgtttgcagatatgtaccctgggccaggccctgttctcaatccttttttttttttttaagacggagttttcactctcgtcacccaggctggagtgcaatggcgcaatctgggctcactgcaacctccgcctcccgggttcaagcgattctcctgcctcagcctcccgagtagctgggattacaggcatgcgcctccatgcgtggctaattttgtatttttagcagaggtggggtttctccatgttggtcaggctggtctcgaactcccgacctcaggtgatccgcccacctcggcctcccaaagtgctgggattacaggcgtaagccaccgcgtccagcctcaatcctttatattcactcatttctcacaacaatcccatgaagttggtactgtgatgaccattttacaagtgaggaaactaaggcacagagaagttgaatatcttacctaagatattcaacttagctacttgcaccaagcccctttccctgtcttcctcttgcatgggaaatgcccagccaaggcttgcagtgaaggaagcaccaccaggagggctcccagagagatggctttgagaaagtcagatggagacagggcaacggccagcaagagagcagtggaggcggggagggaggacactgtgctaggagggggtgaccctgcaaactggcagacccggagcaagcaccttctatttttcggaggcaggcatgaggccccggagcctctccctccctcccctgctctccctacagggaagctactcccagcttgaggctttagctcagtgagcactcgggccctgtctcctgctaaccctcctggagtgtcctctgcctgcatgggcggatcaaggtgctattagcgctattccaggccagggggaggagtagcccttgttcttggcctaattctaatcagccctgcagccaccagaaaagggaaaaattcctttgcctgagattcccctggtccccagggtaccttctgtccatgaccaggctggcatgagcagagcgagagtctcttctcctttcctcacaagccagcttcttcatccatgtttgggtttcatttagagaaatccttcccccttagaggcagaggccaaatgcctcgtggctgagcggaatctgagtcctagtcccacttcacagctatgtgatatctggcaagttgctcatgtgaatcccatattcaccattagaaaacaaattcttcttcctctacatctctttttccatccctagtggcataatcttgttctaaacctgtactgatctcaaggatagaatactgtatctattagaatattatatctaatattgtatcttcccatttggtctctgctgttccgttccctttcttctctagtccatcctatacagcaccactcagttaatcttcccaaactattgttttgatcatgtcactctcctgctcaaaaacattatacagcttcctactgtctgcgtataaaatacttcaataggggccagacatggtggctcacacatgtaatctcagcactttgggaggttgaggtgggagaattgcttgaagtcagaaattcaagaccagcttgggcaacaaagtgaaacccaatctctacaaaaaacgtaaataaataaataaataagcaagccaggtgtggtggcatttgcctatagtcccagctatgtcaaaggctgagacaaaagtatcacttgagcccaagagttagaggttacagtgagctatgatcgcaccactgcactccagcctaggcaacagaatgagaccctgtctctaaaaacaacaacaaaaacaacaacttcagtgggtgtaaggccacctgctatacacaaggtgctatgactgtgatgagcacaggaactctcctctttctgaccctgcttgagtctgtgttagttggtcaccttctgacctctgacctctgctgatttttatttcctagatccccagagccgtgtctgtctaggccgggcacagagccaggaggacggagattacatcaatgccaactacatccgagtgagtggcctggctgcagtggtgggcggggaatgggggaattctcagacgtctgagaatatcttccagccatggctggtggatcaggtgcctgcatttcctaccctccctgctccagctcactgctgtcatagccctaccaagctgggctggtactgaacatgccccaaaacaccaacctaaaaaacggagcagatgttgaaaaatatctggagagaccaccaagtctccctaacctccactatcagtcctcccatgccaccctctaaacttagcaggaagttagcattgttgaacccaatctccagctgcttaagagctcacagctcccgagaactgcataggtgatgccagcactaatgggacctccccgccaacttaccttaactgcccctcagatagcccctcttatatgaagatggttgattgacgtcaagctataggaagctccaggccaggtgggtgttccacgccagcttctcgctgctgtgggccctaaggagatgtaaaagcagcgctctctagtgactcaatgtgggtaagacatcagtcaggggcgcagggaggcgaaaagctcttagctagggaagccatggggaaacatgatcttacatttgccggccaataccggatcaactgcagtctggatttcaccatcttgagaagcaggaagctgaggatcctgaaggtgagaaaatcaggttagggagagtgtgctacattttgctactactttcatagaaaagtagtaacctgtaaatgtgaaactgtcactgaacaaatattaaacactgtttaggtattttgtgctagaagaaagcagcaggggaggaagggaataaacatttatagagcacttgctatcggctagactctcaatatatcttactgaatttaatccactctacattcctacaagatagatattattatgcccaatttacagatgataccactgaggcttacggaggctaggtaactggcttatagtggtacagccaggaaacagcagaacagggatctgatcctcattccagaacccgtatcctttccatcatgtggcttctgagtgtgcgtgttcgtgcatgtgtacgtctacacgtgtggttcacagcttcaggctgaccccagcacctgaggcatctaggatctccccagagctctgctctcactgctccccaccccttcccctgtgcttccaccttccagggctatgacgggaaggagaaggtctacattgccacccagggccccatgcccaacactgtgtcggacttctgggagatggtgtggcaagaggaagtgtccctcattgtcatgctcactcagctccgagagggcaaggaggtaggaggcagagccacagttcatgatgaacccagaaagtgctatgcccaccccacccccaccccacacacagggcagctcagaaccagaggtttccctgggagccagccccagctcatacctctcagaaagttccctgagatatagccctgggaggctgtctatggccaaaatacgggatagggtgagcactctgcttgcaggtatcaagctcagaagagccaggctccctgttgctgacctcccatccagtaggggtggaggatggggaggagataccagcccctctctgctgccctgtcacctgctccagctgaccctcttctgactcccagctccctccctcctagaaatgtgtccactactggcccacagaagaggaaacctatggacccttccagatccgcatccaggacatgaaagagtgcccagaatacactgtgcggcagctcaccatccaggtaccacccccccggagccaggcccagtgggaagttgggccgcccacagcatctctgggactcaggctggctcttcactaggagccaagggtttgctcttctaaaccatcttaaacccacatctatagcagaaagagaaacttgagcactgtcctcagcctctagtctaatagggcagagccaataagccaaataggactaccgggaagtactcacccatctgtgtaaatggtcaggcggggacaggcaggatccaggagcagggccaagggaaggagaggaggttaaaggagatgtggaaggccaggtgtggcggctcatgcctgtaatcccaacactttgggaggctgaggggggcggatcacttgaggtcaggagttccagaccagcctggccaacatggtgaaaccttgtctgtactaaaaattacagctgtttggaaggctaagacaggagaatcacttgaacccaggaggcagaggttgcagtgagccaagattgtgctactgcactccagcctgggtgacggagtgagactgtctgtctcaaaaaaaaacaaacaaaataaaacaaaaaaagagaaagagatgtggaataacatgtacacaagggcttttaaaatgccttctattattttatggtgttttatatttttgaaagcattcctctatcaactcattctcctccaaatatcctggcaagtaaaccagtaagatatcactgttcccattttccaggtgaagaaaatgagatcaagggacttgcccaaagtcatgtgcttatgggaagcagagccagggcttgaatttgggtctctcccctctcccaggacaatgctccttcccgggattttgaagggggaagtggtggagaacaatgagcacgaaaattgcaacctagcttgctttgagtagatgacccccccacagggtaattccagcccttgccctcctcaggcaccagagaagaaggtagacagtgccctccaccctgaccttggttctcatgccttgtctccaatccagtaccaggaagagcgccggtcagtaaagcacatcctcttttcggcctggccagaccatcagacaccagaatcagctgggcccctgctgcgcctagtggcagaggtggaggagagcccggagacagccgcccaccccgggcctatcgtagtccactgcaggtgcgtggccctcccttcactgcagcctgtggactgtgctcccctcccctgccccctgggtctctcctggggaagggtctgagcagaaaagcatcaggcaagcctagtccttactcagacatgactcgcaaggccattcagcaagggctctgttctttttacctccttcacgcagaacccagacatctgggctggacacccaggccccatccatagaggggatggaatatcaggaagatcccagtcagctgcaggaggacataaacaggattccagctgttggggaactcatttacttattcaacaaatatgtattgaaaatcctattattggccgggcacggtggttcacacctataatcccagcactttgggacgccagggctggcagatcacctgaggtcaggagtttgagaccagcctggccaacatggtgaaaacctgtctctactaaaaaatacaaaaattagccaggcgtggtagcacacacttgtaatcccagctacttgggaggctgaggcaggagaattgctcaaactctggaggcagtgagccgagatcacaccactgcactccagcctgggtgacagagcgagactccatctcaaaaaaggaaaacctatttttgtcaggcacggtgttagctgctaaggagacagctatgaaccaagcagtttggtttcttcccagacagttttataggctggtgggaaagaaggcagattaggctgggtgcagtggctcatgcttataatctcagcactttgggaggctgaggcgggaggatcacctgaggtcgggagttcaagaccagcctgaccaacatggagaaaccctgtctctactaaaaatacaaaattagccacacatggtggcgcatgcctgtaatcccagttactcgggaggctgaggcaggagaattgcttgaacccaggaggtggaggttgtggtgagctgagatcgcaccatggcattccaggttgggcaacaagagcaaaactctgtctcaaaaaaaaattaaataccacgcaatgtgatgagagctgtgatggggatattatggggaccatagaaccaagtctcctaaaccagactttgaccagagaaagttttccaagagaaaggccatctaagccaagctaagacctgaaaggtgaattagccaagtgaagagagggaagggaacacgttccaggcaagtggaagagcacatgctaaggcccagagaagaaatgtgaaaatggatacactgctgggagcagggttacaggttaggcccagaggttgtgtgtggggtaatgatgagagatgggtttggaaggccagtgaaggtcagatgatgaggggacttggaggactggctaagacacttggatttgccattttaaaagaacactttggctatagagtgaaaaatggattgggccagagtgagggggtgtcgtaggggacaagactaaagaaagggaccatttgggagtgcatatcctaaataaaacagagcacagaggcaaaaggcatgacacaggggcctcccagcccacccacaggtagcactgggacatgtgcagggaggtcattaggggctcacgcaagaggaaggggaggcctagggggttttgaaataaagagagggcacgatagagaaagcagaacagagtggagagaagactgtgggagggcgccaaggtgggaaacagaggggccgggcgtgggctgcgtggaagatgagtctgagctgagaggaagtcaaggttagataaggagggctcgagggtcagcacacccacaagtgggaaactgtctgttggaaaccactgtagactcagcagaagggagatcgtcaaaatgtccacagggaccaaaaggtggcctgcaacaggcttacagtaaggctggtaagaaatgtaaactcctcccatgccaattaaaacctgcctccagcagggcccccaaggggactggaaagcagagtactgctacctgcctccatctccagagccctatccccaaaatatagcacctgcaggtcccatttctttctccatagtttggggcctggctctcatattccctggtctcccatgacctccctgtcccctccctggctatctccagtgcagggattggccggacgggctgcttcatcgccacgcgaattggctgtcaacagctgaaagcccgaggagaagtggacattctgggtattgtgtgccaactgcggctagacaggtgggtctgtgggtgtaaacaaggccaacaacgttaacggatggcatcagtgcctctgggccccagagttctgctaggcccatcaccatcaagcactcctgcaagaaaggaagaaaccctttctgcttagagctgtttattttacaactaacaaccaggaaaaaatatctatctggatggccgggtgcggtggctcacacctgtaatcccagcactttgggaggctgaggcgggtggatcacctgagcccaggagttcgagaccagcctggccaacatggtgtaaaccctgtctctactaaaaatacaaaaattagccaggcctggtgcgggcccctgtgatcccagctactcaggaggctgaggcaggacaattgcttgaacccaggaggtggagattgcagtgagccgagattgtgccatcgcactgcagcctgggtgacagagcaagactctgactcaaaaaaaaaaaaaaaaaaaaacaaaaaaaagaatatctgtctggaatgttggcttggatgcctggaattaaacatgatatgaggcagcaacaagtagtgcaaagaagatcactgggtggaggcagagccggtgttcagattctgacatctgtctcactgagatgtcactagatttctctgagcccccatttctttttttttctttcttctttttttaataatagagatgggggtctcactatgttgcccagactagtctcgaactcctgggctcaacaatgcccacttggctttgcaaagtgctgggattacaggcttaagccactgtgcccagcccccacttcttctttatctagacagagataatggctccttcccccagaaaactgttgtaagaaatgagttaacttatatgaaaatgttttggaaatggaaactactatacaaatgtatggaatcattatttttactttttaagattattagaaagaaggaaacttgaggctcaggagtattcctggcccgacccaaggcttcagagatctggttttgtcccaggagctgagtggatcaaggaagaccaagtgtcaacatggggcatcacccctcagcacgtgtaaggggcagaggacttctctcacagcagatctgaggggcagcaatgaggagtagaaagtagaaaagatgaatataggtggtggggcatggtggctcatgtctgcaatccaagcagtttgggaggccaagatgggccaatcacttgaggtcaggagttcaagaccaccctggcaacatggtgaaaccctgtttctactaaaaatacaaaaattagctgggcaaggtggcaggcacttgtagtcctagctactcaggagattgaggcaggagaatcacttgaacctgggaggcagaggttgcagtgagctgagatcataccactgctctccagcctggctatcagagtgagactctgtctcacaaaaaaaaaaaaaaaaaaaaaaaagtgaaaagatgaatataggcaaaggagttggcatgttctttgagaaagtcaggactttcccagtaggaccacagggatgtttgactggagccattcagccagcaccctgaccctccttcactcatggtctgtgtgtttctccttgcagaggggggatgatccagacggcagagcagtaccagttcctgcaccacactttggccctgtatgcaggccagctgcctgaggaacccagcccctgacccctgccaccctccggtggcccaggtgcctacctccctcaagcctgggaaggtgggtctggggaaagtgggccgagtgatctgggggtaccccttgggttggtgtggggaaggagtgcctccttagtggtgcttgcagtcacaggaagcagcagcagtaaggacaaggggccggattccaggtcttcaacactggccactcctctgcttcctctgttggccccagatggacagtaaggggaacctccaatgtctctctgaacttaaagacaggagctggcatttatgacagacaaagaaagaagcccaggtgtcctggtgttctctgagacactctttgtgagcttcagtttcctgttctataacatgaacataagtgcttagctgccatgagggaaaagtaatgagagaagtttctagaagccactccagccactccttcctggggctgacaaaagggtgattccaagatcatccttcacccgaggtcctgcccaagcacaggccagatgcaagaatggggaaaagtctggtcctgatctccaagtctcaacatcctatcagtgactctgctccctgaccacacatcggaagggctggatgaccccaatcaaaagaaagaacaaggactctggttacccttgcctccacccatgtgtcataagagtaggctacagaggtgaccaggcctggcagttgaaatctctggaagagggaacatgtggggactactcagaggcaaagaggagctgctcctgcctccatggttgctggccactcccaccaactactcttagggaggctaagcagtctctgttttgcttccatggctcaaataataccctgggtatgcaggacccactataccttgcatttgctgagtacacctagagagcttggctgtttccaaaaacaatcagggtcataaccatccatgcagacatggaggctcggctgaaccaggactcctcactgtctacctgagagaatgagcacccctcatccatctcagcatcaacacaatttccaggggacctcaggtctacctcaggactgaacgccacacctcaggattcctcctccttgaatctgagactggctgcccattctgagatggggatgaaggtaagatgccgcatcaccaggcacgccgcccctgacagctgccttgataccagctctctgtggaaacccccgaggagttggatctggagaacagctgggcctcctcactcaggacttctctcctgaagaacacgcagtgctaaaactgaggatgatttccctaatgcttctgcttggccttatggaggagctgctccttccttacagccttggggatggacttgcccacacctccacctcccctgagccctgtgagaggcacgactgtctatgccaatgaggctcggtggggggctctcaagtgcctgatcctgccctgggctcagagccagcccagagggaagcaactgcacagccccacaggccctccctggcactgtccccccaaccccatctcagagctcagagggtacaagctccagaacagtaaccaagtgggaaaataaagacttcttggatgactgactc

SEQ ID NO: 36667 - DNA, 53516 bp, Homo sapiens
attcggtgtgccgcacgcaggcttcccatcccccagctggcctccggtgctccttacctccccggtggtcgggcgcgaattactggaaattggcttttcccgttggggccgaaggtaccttccctgcggcggcgactcagcggggtgtcgttcggccggcgtgacgcagccggatcggcgccagacggaaacctagcggtgagtagtggggtgtcggggcagcctgcctcccttttctgcttagctcgcggcgtgtgaggtgcgtccaggtgcacccagccccgcgtcggagcttggcccctagcgtcccaagtcgcgcatctcaggactttccctcggcacttggggcatggtctttgcgcctcgctgccccccgcaggctgcccgggggctcgagaacccttactggtggagcgcagccaactggccagaggctggaggcgcaggccaaagtcctttaagacttgaggtgagaggctcactctgggaggacctttcgttagtctgccccgcagttataggccttttgtgcaagggacgcctgatactaacctacctgattcccagcttacgaagccctctggttggaaaaggagaactgtgaagatgtgtaacgacagtggtaaagtgccctgtgaggtatgaagaggaagagatcgcgtcccagaaccactgtagctagaacctttgatgtcatcccagcctggaggcaccaatgtgtcctgccagctaactgatcggtcaccttggagccatgcttggctgtaaaatgttgataagccaggctcttttggtagagctttttaattaaaaagatgttgagacgttacttttcattttacaattgaaatcctaatagaatcattacactttcccgcagttaaattgcaatctgaagaaaaatagcacggccctacaccgttatataagggcactgcacgttaaacggacatcatcacttattgagcagtttttctgttagatgttgaatgagttagagatgtacaagagatctgcatggttaagttgaagtttaaagtaaaaatatctcagtgcactgcagtaaggagctaaaaaagaaaaaggttaaagtaaaaataccgataattgggagcattcagtgatgctcttttatatatcaggcacatcatttcatttaatcgtcaggactttggacaaagtcacacagttataaagtatggagtggagattggaactcaggtttctccaatattaaaattggtgtttaaccactaatctatccaaccttctttttcaaaggattatgtttttaaaaattacagcaaatcttttatttgttttcaaaggagagtgtgttgctaccacttggtgcaatgctaacacttggtgctgcagaattgccttgaagtaactccttgaaaggggttggcctataagcaccaaggcagtgccttgaggggtcataatggtcactaaatattgcattttattgtgtgattgttaggtttttttgttcgtttgtttttcaggaactgttggaaagcaaagaaggaaacgtttctcatgaggtctttgtagacattttctttaatttggtgattttgtactatttaataagatgctccaaaattagaaaaggaaatgtttgtataaatgcacttggctacaaacaagtctcaggctgcctctctccaggcaattcttgtgtagaataccatagggaaattgcctaggacaatactcagttgcctagaatatttgtttttaaattttcctagaaaatcttgtccccacatccccaagaacaactaaacttttgccaataagaattacgtaaccgacctttacttgctttttgctttgattgccaggaagctcagagccaaaaattcattgtgtgattttattttctgctttcctttatattttttctgatgcagactccctattagcatttataaattataatttgttttattgcatttgctcattgtcactgcttcaaatcctttgtagtacacagcagtgtataattaagtaaaataatgtagattatgctgactctggccatgctctttgaagtatgcttgatagaactagtgatgtttcacccaatgaactggaaagttagagaaactttccagtttggacattctatagttacctgctatagaataccctaaccctaattgacatgtagagaaataattagacctattatgaatggttttcagaggtcaaaacaagcatttagcgtccagcacagtggttcacacctgcagtcccagcacttggggaggctgaggtgggcagattgcttgagctcaggccagcctgggcaacatggggaaaccccgtctctacaaaaaaatacaaaaattagcaaggcttggcattgcacgcctgtagtcccacctgttcaggaggctgaggtgagatgttgcagtgagctgagatcgcaccactgcactccagcctgggtgacagagctgaatgaccctgtttcaaaaaacaaaccccacaaaaacaaaaaacccaaaacaacaaaaaaaccaagcatttatgataacatttttatttgatggcaggagaggtatgtggtgtaatagagtggtcaggaagttaggaatctgccaggtgcagtggcttacacctgtaatcccaacactttgggaggctgaggtgggccaatcacgagttcaagagatcgacaccatcctggccgacatggtgaaaccccatctctactaaaaatgcaaaaattagctgggtgtggtggtgcacacctgtagtcccagctactcgggaggctgaggcaggaggatctcttgaacccaggaggcggaggttgcagtgagctgaaactgagcctctgcactccagcctgggacacagccagactccatcttagaaaaaaaaaagaagaagttaggatcagtccgaagtgaatttcaaccctaatagatttataattgtgtgtatttgcattaataattcaatgagttattaatatttaatgagttgacctcagtttactcatttgtaagttggggacattatatatataaagagagagatgcaaaatacctaagtcagagaatctgaggatttaatgagctggtgtacataaatgtgcctaatacagtgcctcacaaacagccccttaaaaaacctgttgctttattttatacaaatattacataaatgggttaaactttttctctaatacacccagtttccccataataggaaacagtattatgactagaaaaatggcccaagaggacatgttttacaagcaatggtcataagttatagatgaagtatttattatctttattttttatttttatttttaaaatttttccttcatatcacagccaagtccacaattttttgttgtcgttgttgtttaaaaaaatttttttgacctggtgtggtggctcactcctgtaatcccagcagtttgggaggtagaggtgggtagatcgcttgagcccaaaggtttgagacaagcctaggcaacatggtgaaacctcatttctacaaaaaatacaaaagttagctggacgtggtggcagaagctagtagtcccagctgtatgggaggctgaggtgggcagatcacctgagcccaggaggttggagctgtggtgagccaagatcataccactgctctaggtgacagagcccagaccctgtctcaaaaaaaaagaaaaaaaaattagagacagagtctcactctgttgcccaatccgagtagactataggcacatgccactacgcccagctaattttttttttttttggtagaggcaggccttactgttgccaggcttgtcttcaactcctggcctcaagggatccccctgcctcagcctcccaaagcactgagattataggcatgagccactgcacccagcccactatttattatctttatacacaaagtatgaacctcatagagttgtgcagattaaatgagaatacatatggagtactcaaaactgtctagcacaatgtaagtgctcaaattttgtcctcctctcttcccactccatccagatgttctcagtatctagggcttcctagccaaatcagtaatggtctttttgtcctttactataccattacaacagctttggctttgtaaggtctacatgtatctattcatcatgcttgttaaaacttgtggaacttgtttttgccccattgctttcatttttctgctagctgaccctgactgagttatttttccaattacaggtgactgtatctgaattttgcagctgcagaatgtgtagtaccttaaaaggtaaatgaaaactgaaagaagtcatttaagcatgttgcttgtcaaaataaaacttggtaacattgaattagttttcttcctgcagttaatgaactcagaagagataaatgactgtggtggtggcccatgcctgtaaatcccagaggtttgggagggtgaggtgggaaaattgcttaattccaggagctcagaaccagcctgggcaacatagtgaggctccatctctacaaaaaaaggaaaacctgccaagcatggtggcatgtgcctgtaatcccaactacttcagaggttgagatgggaggattgcttgagcccaggtggttgaggctgcagcaacacagtgagaccctgtctcaataaaaaaagaaagaaaagagagacacagtcaatagtttctcctgccaaaagaaaaggtgaaaacaagattgtaagaaagagagaagagaaaagaaatcaccaagaacactgaatcttagtttacattttttgggtaaactgattagctggcagcagttaaaatcatcattagttattttcaggccagtagcatagtaagttctgaaagttcattttgtgagactagccagagttgatcaaacttttgcttgccaaactctggaggtttgttcagtgaggaactgagtgtaaagtgttcgaaagatttgtgtttactgtttagttaccaagatatctagaaagccatattcatatttgtaaagttgtttggtaagcattccataaaagtaaagggaggtgcttgagggttttttgatccaggcttaggacacaagtgaagtttaacagactccccacaattgactgtagctttctagtgaacagataataaaatccattaaagcattattctttgtttggctgtcacttttctaaacactcatgtattaaccaccccctttctgttaatgtgcttatctggattggttagagctttcattaaaacttaaaattgtttttctgagaatattttattttatttttctgagtatattttagctaccttgattggatttagctcttctcaaatctcagaatctctttgcctccccaattttttagataaagaattgagttacctacagttgaatatgtagtaatacagtaatgcataatgtattttttatacttaaaaagactttaaaaatattagataaagacatgtattcattatgtgaatgtttaatttggtggttgatatgaattcttcatcacttttgagtaacttactgtttttgtttaggttggcaacaatgagtaaaccagaattaaaggaagacaagatgctggaggttcactttgtgggagatgatgatgttcttaatcacattctagatagagaaggaggtattaagtgattgtacaatttgaagagatgcttattataatgtttatggattatttcacttttaaaacttttaacattttcttttgaaaatatagcgcaaaggattgatctggttagtaaaactaaataaaaactgctttaatttttagtttaattctttcaaactttaattgaaaatgttcagtaaagcctaatataaaacaaaatgcccaggagtggtagtcactaataactacccattgtaatttaaaatatgtggttattttgaaccctaaaaatatatactttcaagattgtgtgtgtttttttttttaactatataaactgtggaagagtggtcagagtggtcagttttaatcaaagagaaagcttttttcccagcttttaagtaatgacaatataaatattataatttcttatttaaatgtaatgtttagaaagaatttatacctgtcatgctctatttctttggatgttcttataggagctaaattgaagaaggagcgagcgcagcttttggtcaaccccaaaaaaataataaagaagccagaatatgatttggaggaagatgaccaggaggtcttaaaagatcagaactatgtggaaattatgggaagagatgttcaaggtatttgagggggtgaaatatacactcgtttctgctagtagcagaaattgctttataggatacacaaaagtagtctggtaggttaaacagtggtgttctatatgatcatgtttctcatctaaaaagcatttgcttcaatttctccatagttcttttttttaacaaccagtcctgcacatagttttcagtaagaaggaatctatagaccaaccactctaaagttattttatttttaaaatttttccaggatacatgtgtacaatgtgcaggcttgttacataggtatacatgtgccatggtggtttgctgcacctttcaacccatcatctaggttttaagccccacatgcattagctgtctgtccttatgctctccctccctccacccacccgcaggctgtggcatatgttgttcccctccctgtgtccatgtgttctcatttttcaactcccacctatgagtgagaatatgcagtgtgtggttttctgttcctgtgttagtttgctgaggatgatgacttctagcttcatacatgtccctgcaaaggacatgatctcattccttttatggctgcatagtactcctaaagttattttcaagattatttatttatttatttatttattttagagacagggtcttgctcagtcacccagattgggatgccatggcacaatcatagctcattgtagcctccaacttctgggttcaggagatcctcccaacttagccacctgagtagctagtactatttttaaggtatttatttatggccagacatggtggctcacgcctgtgatcccagtacattgggagactgaggcaggaggactgcttgagcccaggagtttgtaaccatcctaggcaacatagtaagatcccgtttctacaaaaaaaaaaagtttttaattagctggaagctgggtgtgtgatggctcatgcctgtaatctcagcatattgggagaccaaagcagattgatcgcttgagtccaggagtttgagactagcctggcatggtggcacacacctgtggtcccagctatgagtgaggctgaggtgggaggatcacttgagcctgggaggttgaggcagcagtgagccgtgatcataccactacactccagcctgggcaacagagtgagaccctgtctcaaaaaaaaaataaaactagctgagcatggtggcgtgtgcctgtagtcctagttacttgggaggctaacgcagaggattgcttgagcccaggaggttgaggctacagtgagctgtgattgcatcactatactcagcctgggtgacaaagcgagaccctaggtcaaaacagaacaaaaaaaagatatttatatttttaacttatttaaaatacctttctaaagcaagttactttattcttaccttgatctttacagaactaggaggagcatttcaagaagtagtgttctaacccagggatgctggtattatgtgtgtggttttaatttttacatctaagccagattcctgcaagattattcttaacataaaacatttttttaggttcgaattatattttagttaggtttttcctgggtacaaggaacacagatccccacaacctagcttaaaaaaataatgacaaaggaaagaaatcaatattgttgggtactaggagagttggaactgggacagtgttaaaaactgaggaactgtgctttcatgagtctccaggtctccctgtgtcatctctgtgcatctgttctgatttctctatgccacatattttcttcatgtacatgtgttttattctcacatacttataaatgtccatcaagttcccagtgttaagtgatttggtttttcagttctcccattctagattctcaagagtcaatttagctcaattcatttttaaaatctggacatagaaatagcatataattggaatatccacagatgaatcacagttgagttatctgtgcctattacttattatattaatgaacataattacatagttcattaactatgggggtagagtcatatactccatgtatagagttatacaaaaaatgaccactgctcctcaatagatttagtgggctgggtagggtctcctatgtgtccacagctagacagttgacattttttgagcatattctaaataaaacttggtgttcttgactccctattatgccaggcctaagaagagattgataacagtattccacaaaggaaacttttatcataaaaattgtctcttaaaaaagtagtatgtttgttgtagaaattcagtgcttccaacctttctcacataacagcactcacagcaaatgatatttggaggcacaatggaataaatagaagaggatgctgcagaccaaggacaaataccccagggccctaaccctacccctgctactggccttgattggcatcctcaaaggcctgagagaatcagtactcagcacatatgaaacccataccatttatttatttatttatttatttatttatttattcattcattcattcattcattcctcacactggggaactttgccttattttttggcatcatgccctatgtttttcaacctttttaaaattattgacccctaattagcctttttagacattttctcctaatcactttttcccaccctaaaaatttcagtactacatatatgctgtatatctgtttatgtactgtgacgctttggagggccacagactattatattaataatgtcaaagtcttttttccacactccctcctgtgccaagatccagttttacccaattgggagatgtattgtacctgtcaagaatgcctgctttagagaacgtggaaccgttaacatttcagtgtgtatcttctgtctgttcatacatgcatgggcacacataagcttgcaccattacgtttataaatagactttttgcaattaataatgtatcatatatacattactctgtcattagacattcttctacaataagagttttgacatgtattgccaaatatcctcctaaagtttatacagattacactatttaatcatagttacattttcctaaagacttagttttggccaggtgcagtggctcatgcctgtaatctcagcactttgggaggccaaggcgggtggatcgcctgaggacgggaattcaagaccagcctggccaacatggcgaaaccgtgtctctactaaaaatacaaaaaattagctgggcgtggtggtgggtgcctgtaatctcagctactcgggaggctgaggcaggaaaatcgcttgaacccgggagatggaggttgcaatgagccaaggtcacaccattgcacttcagcctgggcaacaagagtgaaaatccatctcaaaaaaaaaaaaagaaaaagaaagaaagaaatcccaaatcccatctctacaaaaaacatacaaaaattagctgggcgtggtggcatgcacctgtagtcctagctgctcagaaggctgaagtgggaggatcactggagcccaggaggttgaggctgcagtgagccacaatcacaccattgcacactagcatgggtgacagagcaagaatttatctcatacacacacaaaaaagcttagcatctgaaccatttttaaagtgtatgggttcagtggcattaggtacattcacaccatttgtaaccaatctcccaaacttttctcattgtacaaaactgaaatttattcatctgtagatggacacttgggttgcttcaaccttttgggtattgcgaatgatgctgctatgaacatgggtgtacaaatacctctttgtgaccctgcattcaattctttggggtttatacccataagtggaaatgctggatcatgtgctaattctatttttaattttttaaggaaccaccatactttttgcacagtggctgcaccattttacatatcaacctacagtgtacaagggttccaatttctccacgttcttaccaacacctatttccttttttaaaaaaaaaaaaaaacagtagcccttttaatggatatgaggcggtggttttattttcttttaaatttaacatatcgttaaattctcagaggtcagtcttcggacaaaaagaactgtaatagctagtagtattgcattctaatatataaataatgtgtggttttctatattatacttttggattgtttgtaactttttattagtgtaactaatgcagtagtgattgattttgatgtaggacttgagtctttgaatgtaagtttgttggagatcagctggttgaacagtattgcctttttttttttttttttttttgagacagggtctcactctgtcacctaggctggagtgcagtggcacaatcaaggctcactgcaaccttagcctccctgggctcaggtgatcctcccacctaagcctcctgagtagctgcaactacaggtgcggaccaccatgcctggctagtttttgtatattttgtagaggtggagtctcaccatgttgaccaggctggtctcaaacccctaggctcaagtgatctgccagcctcagcctatccaaagtgctgagattagaggtgtaagcaattatgcccagcctgctttttttttttttaatttttaagctatcatatccataatgcatcaactggaattttccagtttcattttcttccaataaactgataacttaatgatacttttgatgctatctgagtgtagtaggctttcatgtttctcaaattttctcttaaatcttttacagtttctcattctcaccttatttaaaaccagttgttttagttaataactttttcaagtttatattttgtctatatttgacattcagacaaaaataaattatataggccgggcgcggtggctcatgcctgtaatcccagcactttgggaggccaaggtgggtggatcatgaggtcaggagatcgagaccatcctggctaacacagtgaaaccctgtccctactaaaaatacaaaaaaaattagccgggtgtggtggcgggcgactgtagtcccagctactcgggaggtggaggcaggagaatggcatgaacccaggaggcagagcttgcagtgagcctagatcgtgccactgcactccagcctgggcgacagagtgagactccgtctcaaaaaataaataaataaataaattatataaatatatagttatacattctatattctaattatatattctagttgtagttctatcattgcagtaacaagttctccataaatagatttgtgcatatatgaaaactagatatactgtagaagtagcattgcagatcactgggctagtgatgaactggtcagtaaatggtgatgggacaattgtatattcccattttaaaaaaaaggccctctacctccctttataaacagattaattaccttaattatttaaacatgaaaagcaaattgtaaatgcttttagacaaaaatataagagaatatggttttggtcttgattacagaaagttttcttagaaaatatgtaatcaaaagaaaagattgacaaattcaactaattaaaattcattgtttctcaagaaagtgagaagactacagactagaagaaaatgttgcagaagacatgtctgataaaggacttttaatccaaaatatacaaagagcttttaaaattcagcaataagaaaacaatttaattaaaaaataggcaaataggtatttgaacagataccatatgcttatttgccatctatttttattctttattaccaaggaaaataaacagatggccaataagcatatgaaaatatgctcaatatcatatcattagggaattgcaaattaaaacaaaatgagataccactatacacctattagaatagccaaaatccaaaacacgaataccaccaaatactgattaggatgtggagcagcaagaactcatttatctctagttaatgcaaaatggtgcagccccatgaaaaacagctgtgctgctgcttatgaaactcaacatactctaactatataatccagtagttatgtttcttagtatttacccaaatgagttgaatacttatgtccacacaaaaacctgcaggtggacctttatagcaatttcattcacaatggccaaaacttggaagcaacaaagaggtcgttcagtagatgaatggatgaacaaactggcacatcctgaccatggagtattcagcacttaaataaaaaagagctatcaagccatgaacaagatatgaaaggaccttaaaagtatgttactaagtgaaataagccaatctgaaaaggctacatactgtatgattccaactatatgacattctggaaaatgcaaaactgtggagacagtaaaaagactagtgtaaagtctattttataagaaaccagcactttccttcaaatgacaccataaaaagagtgtaaagacaagccacagcgtaaagaagatattttttctgagaagaaacctgtaaaaaaatgttcagtgtcattaatgattaaggaaatacaaatttaagacgcctctcttcagtttatacccattgtttgacaaagattaaggagtttggataaaaccaagcgttggtggaaatacagatcactaggaaagcttaataaggaggatgagcacacactttggaaagtttgacaccattttctaataaatccattaagtattgacaaaaattacatatatttaaatgaaaacaactttcaataacttaatgaggagggcattgttttctatttttaatgtctggcttcattgaaggcaactggattttcttcttcacgcattccattagtcaatatggtaacttgttatcacatcatgtcgtctctggcatacctcactgtacactcttgtttgagagtcaaaagttaattaatgtcttagtattattacgaagtaattttgacctcagggatcctagcaaccctcaggccacatgttggaaattgctgtgatagaaagtaggatactagaaatgaatgttcactgtgttgtaggtagcagttgatatttaaagaggagattgaagaatgtcagttaagtcaggatctgtgaagaaagcttttttttttgatactttatcactttatcaccgaggctggagtgcagtggcacaatctctgctcaccgcaacctctgcctcccaggttcaagcaattcttctgcctcagcctcctgagtagctggaactacaggcatgtgcccccatgcccggctaattttttgtattttcagtagagacgaggtttcactgtgttagccaggatgctctcaatctcctgacctcgtgatcacctggctcagcctcccaaagtgctgggattacaggtgtgagccactgcgcccggccaagaaagcttctaccataaaacagctgtttaaatctcaacctcaacaattgtacttttcatctttgcttcagaaaataaatataaccaaaaaactccctttagtcctcccttcccagggacaactgttactaggaattgaatgcatatccctctaatctggggttttgctatggttttgtatttttacatagatgtctgtgtatctttgaatagcatgttaaaacttatataaacagtttcatagcctgttttctttactatgtatttccaaatattttatatataaatatagttaaatctttatgcaaggctatgaggggtacaaatcttaagtttttttgttaaaatttttttctgttaattttgttcttttttcctaaatgtatattgcatttttttctttcagaatcattgaaaaatggctctgctacaggtggtggaaataaagtttattcttttcagaatagaaaacactctgaaaagatggctaaattaggtatgttgcttttctgatttctataactattactcatctttcctaaggtagatttaaccacattccccatgattattataccactacatttcctaaaagaatgaagagagattccctatggtttagggaataatgagacgttccctaaaagaaggatgttatattaagcacaattaagttcatttgtttttttcatgctcagatgtcttctgttttcagctagattataagcttcttgtagtatgtgcacagtctttgtttttctttagtcctctccaaaatatgtagcttagtttctttttttttttttttaaaggtggagtctcactctgttgcccaagctggagtgcagtggtgcaatctcggctcactgcaacctccacctcctgggttcaagcaattctcctgcctcagcctcctgagtagctgagactacaggtgtgctccaccacacccggctaatttttttgtatttttagtagagaaggggtttcaccatgttggccaggttggtctcaaactccaaacctcaagtgatccacccacctcggcttcccaaagtgctgggattacaggcatgagtcaccatgcccggccatagcttagtttcttcacaaatttttttgaagtaacaagtgagaatcacatagagatattctgaattgattaataaataagagttttgctgggcatggttgctcacggctgtaatcccagcactttgggaagctgaggcaggaggcaggcagatcccttgaggtcaagagtttgagaccagcctggctaacatggtaaaaccccgtctctactaaaaatacgaaaaatgagccaggcgtggtggcacgtgcctgtagtcctagctatccaggaggctgaggcaggagaatcacttgaacctgggaggcagaggttgcagtgagccgagattgtgccattgcactccagcctgggtgacagaacaagactccatctcaaaaaacaaacaaacaaaaaaacccagagttttaccctgtatatggaaaaatgttgtttatattacagaaaaatgcttatataaagttattagtaatggtcttctaacatttttcttacttgagttaccacctataccaattaacacttcagttgctgattttcagagaactaagctgtaataaattacatataaccttaaaattaaactgtcaattatttttcaaaattcaggccaggcatggtagctcatgcctgtaatctcagcactttgggtggccaagacaggaggatcgcttgaggccagtagttcagtaccagcctgggcaacatagcgaaaccctgtctctacagaaaatttaaaaattaggctgggtgcagtggctcacgcctgtaatcccagcactttgggaggccgaggcaggtggatcacaaggtcagaagatcgagaccatcctggctaacacagtgaaaccccgtctctactaaaaatacaaaaaaaaaaattagccaggcgtggtggcgggcgactgtagtcccagctactcgggaggttgaggcaggagaatggcgtgaacccgggaggcggagcttgcagtgagccgagatcgcgccactgcactccagcctgggcgacagagcgagactcagtctcaaaaaaaaaaagaaaattaaaaaattagccaggcatggtggtacatgcctatagtcccagctacttgggaggctgaagcaggaggatgacttgagcctaggggttcaaggttgcagtgagccatgatcacaccactacactccagcctgggtgacagagtgaaaccctgtctcaaaaaaacaaaaacaaaaaaatcagatggcactgtatttcgatcttgtggtatgagggggtcatcatttttgaaagcagtaaggaagggaaataatatatgtgaaagcactttgaaaattataaaggtatataaatacaaagtttggaaataccaaaaagtcaggaacaaaagtataataattatccacctggtaaatgtaatagttgaaaaagagggcttataacgtataattataaaacacctatggatatttcttcagtggtttgtttttattcaatcactgtagccaatgacacatgtaaacattcaaggtcaagtaaaaataaaatatgttaaatgttgacactgatgaggaatatatgagaagtaattataaaacctgtatttctgaatataagttaatcagttgccaaaatcagtttagtttttctaaaatgtgtaacattaaatacattactgattttgaacataacatggtacatacaataatttacattaattgatgtgtttcttagtatttattatctacatcaagaaattaagtttttttggttggtcgcggtggctcgctcctgtaatcccagcactttgggaggccgaggtaggtggatcacttgaggtcaggagttcaagaccagcctggccaacatggtgaaacccagctctactaaaaatacaaaaattagctgggtgtggtggcacacacctgtaattctggctacctgggaggctgaggcaggagaatcacttgaacccagaacgtggaggttgcagtgagccaagattgcaccactgcactccagcctgggtgacagaaagagactccatctgaaaaaacaagaaattaagtttttaaatctataaaaatgactgaatcctgtataggagcactgagaaaccagagaagaaatgctgatgtaataattagaaagataaagtagacagcaagaccaaaatgaaaccctaggacaatggtgcaggacaaagaaataccactggagaaagaggagaattattattgtaaagtgaaatagaactcacaggagtaatcaagtagtagttctccatttggagaattagcatgctcataacttaaagatgataatgtgttgtatttgtaagcactgcataaaactggaatattatcctcattctgcgcatttctgtcatcatatctgaaagaaatacacattttaaagtcatgagaagatagttttatagatatttcgtctttattattatgaccatgaaatttcaggaacgcagtttaacagactgatcagactttctataatctttgtttagttatgatgctctttaatgaatttcattgactcattaagtattgttgctaattgtgtttacatctaaatatatcagtaaaatagaatgccttaatatttaataaataacatgatctgccagaaaatcatatgttattctgagtataaatgatgattttgtccaggcatggtagctcacacctataatcccaacactttgagaggaaaaggtaagaggatcacttaagcccaggagtttgagaccagcccgtgcaacctagtgagaccttgtctctataaaaaaaaattaaaaaaaaaaatagattttcatataattgggctaaccaagatatagggctagaaatagactataagttagataggaaggctttgtaaaatacagagaatgtatctagagtaagaaaataaatgtaaacaaaagagcaaaagtagaagtaccaggtagagaagaaagtgaggagttcagtcaggctggagaaataaatgggtaaattaaaaatagattgagatccagcaatcccactactagatatatacccaaagggtatgaaatgagtatgtcgaagagatatctgcactcccgtgttcattgcagtattattttgcaatatccaggatatggaatcaagctaaatgttcatcaacagaggagcagataaatataaatgaggtaaaagaaaataagtatctttttaaaaaaattagaaaatagattggttagataggaccagataatagactaatctaaagctatcattagacagagaccagtttattgtgtaaaatacaatacagatgaattaatagaataatgaatataaagatacaaaatttatgccctatttttttttgcaagcccacaaataatatcataattttttttaagggtctcactgtattgccccggctggaacgtgtggtgtaatcttggcttgctgcaacttccatgtcctaggctcaagcaattttcctgcctcagcttcctttcctcagtgtccctttagctcgggctaaagtcacacgccaccacacctggctaatttttctattcttttgtagagacagggtttcttcatgttgcccagtctggtctcgaactcctagactcaagtgatccacccacctcggtctcccaaagtgctgggattataggcttgagccaccatgtccaggtctaattttctattaatagagtcaacagccatgccattacatttcatttaatatcatcaaaaacaaatatgacataggagcaagaaaagaataaaaactgtacacatgcattgaaagtgtgcatgtagatgattaatacagagcaaaggtcagccagctttttctgtaaagggccagacagtaaatattttcagctctgtgagctagacagtctctgttgtgactactgaacttggctgttgtagctgaaaagcagccacagacaatacgtatggatggtgtggctacataaagctgtacttaaaacaagtggaaaggctgggtttggccccatagacttatagcttgctgacccctgacataaagaaacactgtaactttttgccattcatagtcataactaaacacaaagttatgtgttaaatagtgattcaccgctgggcgtggtgactcatgcttgtaatcttagcactttgagaggccgaggcgggaggagaacttgaggccaggagtttgaaaccagcctgagcaacataggaagacccagtctctacaaaaatttaaaaattagctaggcatagtggcgcacgcctgtggtctcagctatttgggagtttgaggtgggaggattgcttgggcccaggaggtcaaggctgcagtgagccatgatcacgccagtgtactcctgggcgacaggtacttgtactaggcattgtgcctggtgcttattagacatgttgagtcatccaagaggtgttggaatgtctgcctatctctgtgtgctcacaaaaatgactatcttagccgggcgcggtggctcacacctgtaatcccagcactttgggaggccaaggcaggcagatcacgaggtcaggagtttgagactagcctggccagcatggtgaaacccccgctctactaaaaatacaaaaaattaggtgggcatgatggcacacatgtgtaatcccagctactcaggaggctgaggctggataactgcttgaacctgggaggcagagggtgcagtgagctgagatcgcaccactgcactccagcctgggcgacagagcaagactctatctcaaaaaaaaagagactatcttgttcttaatcctcttcaattcttcctttttattcttttctccctggctcctttgtagtttaatagttatttaaaatcaggtggagcatttttatgtttcagtataacaccaaaatgatctcagctaagttgcttttgttgcttcttttcatatgaagttttttccctatcctgtgaatcagcctttaatccaaaaatgacataaagagaagagcaaggactgagccttaagtatgcctagaatgttgaggaggctgaggacagtgaagaagagatgaaataaccacaaccagtagcttgggaaccaggataatgtcataagactcaaatggaggaattaatatcaagggaagattaaaaaaaaaaaaaaaacttagtgaatcatatagaagaccgaagggattaaggaagaagaagcagccaattcatttgtagagattgttatgagtattttgggtcagtttcaagactggaggataaaaatgggggcaggttagaaaggtttaggagccagtaaaatggctttcacttgtacaaatttaactacaccttctccatttagagaaaaaaagcaaaaaagcagttaatttggtatgtgccctttttctcagtgaacagtgtcccagtgtgagagttaacttggaaaaggtaaatctgtttcttcatttgggttcattttccacatgcctctcatggtgtgagtgtgagagcatcattaaagataacacttatatttttttatttaaaatggcctctattataagtgatttggtctttggtctttagaaaaaaaaagcgagagaaagaaaattgttaaagtaaaaataaaatggcccctaaacaaaagaccactattccatttattctcggttgaagaaatggccatctgttcaacactctattttatgtattatttatatgtattatagactttttggcacaaaataaactgttcacactttatggaagatttaaaagattttaaagtataattttaactctgcacagttttcacttgattttagatctcactttctggcccttctttctcaccccccatcaaagatgtgcctcaactatatatggtaagaaatgaaaggaacataagtggttgatggagaggagagtatggtaattagagaaagcagcaaggtcaaagttagttatttgtattttcttttaaagaaatctgtgggtaatatgaaggaaaatttgaagattctgggaagacagctaataaaggtgaaagcagtattactcctaatatgggtaggattatttttctgataaaagtaacagaggtttttaaagaatttttgtaagcgtaataaggttatttccctctttatctactgttgtcctttaaaaggtttttatatatttctttgtttacagcttcagaactagcaaaaacaccacaaaaaagtgtttcattcagtttgaagaatgatcctgagattacgataaacgttcctcaaagtagcaagggtaagacattacattagttctttgaaaagaattttcatagttgcttcaagatagagcatgttacttttttccttgtttgtgaatttttatatatattttcttcttttctgaaaattcattcaacaaaatgcaattaatatttcaactcatgtaccttagtatacccgtgtttagcagtcagtaagagggaaaaatatctgtgctaactgaagttgtgcaaattgacagggttaaccagaaatagtctttaagtcctgttgtcatgtgcttgagttagccaattatttatagaagatttggctttgggaaatactatatgaaataaggcgtttggagtttggaagtcttacagattgtggagcagctgtttttgaatgatccattctaactagattaaaaagtgtacatttcgttgctctttatttatatttttgtttttgtttttgaacaccaatgtcacttgccgacatttctgtttttttcattttttagagacagggtctcgctatgttgcccaggctgaagtgcattggctattcacaggcacaattacagcacactattaaagccttgaattcctgggctcaagtgatcctctagcctcagcctctcgtgtaacagggcctataagcacaccgcattgtgtctggctccattgtacttttttttttttctttttttttgagaaggagtctcgcttttcacccaggctggagtgctggagtgctggagtgcagtggtgtgatcttggctcattgcaacctctgccttctgggttcaagcaattctcctgcctcagactcctgaataactgggattacaggtacctgccaacatgcccagctaatttttgcatttttagtagaaatggggtttcaccctgttggtcaggctgttttctaactcctgacctcaagcgatcctcctgccttggcctcccaaagtgctgggattacgggcgtgagccaccgctcctggacagttgtacttttcaataatcaaaatttaaaagggctccgtttttcttgttagaatgctacagaaatgcaggaagtagctgttaaaaatgtgagtaatcatgaaactaatagtgataatcctccggtggagatggaattaatttataattcagtaataatgtggtggcttctatgtagaagctgcaactttgctttttttttttttttttaatttttaattttttgaatagacacaggatcacgctatgatgctcaggttggtcttgaactcctggcctcaagcaatcttcctgccttgcctcccaaagtgctgggattacagatgtgagccaccatgcctggcaaactttacttttaatgaaactagaccacaatgaaaagtgaagtgtccgtagtaagtcatggctttttgtttcattctttaggccattctgcttcagacaaggttcaaccgaaggtaagcaattgactaaaaagcaaaagccttagtgttacaaagtaagacatgatgaaaaattgccagaaattcaatgaaaaaattgatctcttaatttatatagtgctttgtaatttacagatatttggcagttaaatacctaacttataggtggagaatttgaggttcagagaggtaaagtgacttgtgtgagttcacttgactaggaaggagaacagctagaaaatgaagccaggcctcccagacccaactgttgtgctttttctgctgtgtgtagctggcctgaaaatgtttggggttttgcttttatgtatcatgttctgtttcttttgcagggggaagagggcagtgttgtgcagtttgatcccaagatgcattagatccattactctatatttttatctcctcctttgtggggttttttctttgtttgtttgtttgtttttgagacggagtcttactctgtcgcccaggctggagtgcagtggcgtggtctcggctcactgcaacctccaccttccaggttcaagtgattcttacacctcagcctcctgagtagctgggattacaggtgtgcaccaccacgcctggctaatttttgtatttttagtagaggcaaggcttcaccatgttggccaggccggtcttgaactcctgacctcaagtgatccatccacctgggcctctcaaagtactgggatttcaggtgtgagccaccacgcctggcctcctttgtgtttttgtggtataattttctcattatgccttttcaagtggtgagtgttccatgaaagggccatatatgcaaagcatcccccaaatgccaaaggagccaagaaaccaaaggacaaggcagacaagtttagtttgtctgtaaagggtattttattagagacagaagcatggtcttgggcagccacaagacaggtagctctctgcagtgttactccccagacccacggcttacctaccataaggaaagggtatacatgttccagcaagataattaaaggcaaccctctttaattgtcaagagggcaagaatgctatatgcattgtagccagtaatttgtgtgataatatcaaggttgacatgttctttcacagaaggcagtacataaagtaggaatcaggaggcattcatgagactggggctaatcagaagttaacgtgatggattagcatccaagatggagtaacttttgtctccacagtcagtatagacatttaaggccatggttatggcctgtgcaggaatgtcctatttagacaagtctaggtatgggattagacatgccagactttcatttgtctttaataatgcttttttcttatgtcttgtgtgttctatcactataaaaggaaaaaaactcattgccataatctaatcaagaatttagattattctttctcaagttatagattataacccattagaagatattgtcaactctcccaaaaaaccagaaaaacctgttgatgaaacaaagctacctatcacaataagagacaacatcgttgtgacagaatcttagtgtactgtcttagaaaagcaagttcaagagaaaatatgtatcgggcttggggatcctgggctcaagtggcttaaagcaggtttttcaaaatggtaaactgattgggattgggcaaagttagggacatgatattttaggattggtagacacagtgaagatcgtgtcttaaagtgtatcttgataactaaactgttgataagataagctgtttgccctaggagtaatctgttgtcctgatagggagaacagtttgcccaaatgagcaaactgtcaagagagattagtttgcagaaatgttctatagcaagtaggaaaaaattatttattagtcttgtctttttgagcaggaattttctgcagtggttattttgacacaggtgttgtgaattctcagacttaagctgtgtagatatatataagttatctcaatactcaatcttgaaatcagtttaataggacataaactgcatttttaacaaatgaagtagaacagaattttaaatttctgttttataattttttttagttatatatacacgtgtactgggtcaagatgacaaaatgtaaaaatttttgaggatcttgatcaaaaaatttgagacatactgtaattccattggtaagggattagctcagttattagagtactattctttttttttttttttccccctgaggaagagtttcattgtgttgtccaggctggagtccaataacgtgatctcggctcaccgcaacctccacctcccaggttcaagcagttgtcctgcctcaacctctcgagtagctgggattacaggcatgcaccagcacgcccggctaattttgtatttttagtagagacgggatttctccatgttggtcaggctggtctcaaactcccgacctcaggtgatctgcccgccttggcctcccaaaatgctgggattacacaggcatgagccactgtgcccggcctagagtactattcttaaaatcaaatcagattttaatgacaccagcaatctatcacaagacaataaacttaaatttttttgtcatattgtcatgttgacaaaatcacagggtactttaacttttttatcagtactattagaaatttacaggtatataacagtggatgttttaatgtgctaacaatttatggtattaaagtattctataaaaaaacagactttgtactcctacaaaaagttacaattttttaaatacagaaagtaagaaagtgtaaatctctccttctctcctcaaagaatgtaatactttaacaccagtaaatttctagcacattaaaaggcccattgccatatacataggggtgcccgttccctttcatacttatgattgctacataatactatcttttaaaaaaatactccattgggccgggcgctgtggctcacacccataatcccagtactttgggaggttaaggtgggcggttcacttgaggtcaggagttttgagaccagcctggccaacatggtgagaccctgtctctgctaaaaatacaaaaattagctgggtgtggtggcacgtgcctataatcacagctacttgggagtctgaggcaggagaatggtttgaacccatttgtcataatcttctagttctaggaactaagctcatctagttctaatgcagtctattgaaagcaaaatatttttctttttttctagcctctttcactcagatcagtcattaatttccatgttattatttaatgctttttctatttctaaacagaacaatgacaaaagtgaatttctgtcaacagcacctcgtagtctaagaaaaagattaataggtacgtatttgtttttacatgactttttataaaaagtagcatctaaacaagaggcaataatagttaagtatataggttctagacttagactgcttggtgttttgaatctttggcttttagttgcaacacttagcaccatgtctttcacattgtagtcagtgtatattgaagtcagctaaaaggtctttccaatgaaataacatgccttttaattgttttgagacagtttggaaattattctattgatttatttggaaattttataatgaaataatattaaatattcatagttgtactgaatgctaaacaaagtcaagtaaacagacatggcttctgccttctaggaaattaaaaatcgtttcagatttttgaatattgaactttgaggcaaatgactggacctttatatatcaggaagatgtcaacacctttcataatgttgacccttgacaataatagtattagtcaacattgttaaattcagcctaacatcagggcttcatacttcatagccctttcttttcaaggtatggatttcatagagttgttaaaactgtatttttaatcaccataaaattggtaatgctaaatgatttggtatattaaagcagtaaaagatctgtatagttgtgattgttatttcatgtcaactatatcccatgtcttatgttttctcctcatcccaaatatgggttgttttttagagagaaggtgaacttccctcttccttcttaatcaccacaaaacatatatacctacatggaggaagcatacatgtaaagaaggtagagatactttctggtacctgccaccacttctaactgtgcatgtaccacgagcagcagtcaatgcacacctgaatctgctgagctatatatgcccacaaaatcaagcctttttttttctttttttttttaatatctacatttgttacatgctgacttgggataatcctctgcagtatatctgttgttcagaataaatatgctgatttgtttaagttttttcactcatattttggaagttagcttttaaaaacagttttatgcctgtttagtgtgaaactggctttattcttatttgataaatgtaaaactagctatattatttctggggagttgtagggatgaggttgtggtttgtttaaaaagacaattcttgaatcaactctgggatggtgtatgtgtatgtattagtaataattataatcataagtaccatttattgagtgctatattagttagtatgacgttttcagtaggcagcaacagaaaattctataatggtagtttaagccatagacatttaagtatctcacatcaaaacaagtatggagatgcaagttccatggttgatgtgacttaacagtatcattaaggacccagattcttcctatcttttactctgccaccagcatttttcatctttaggtttgatacttcatattgcaaaatggctttcatagctttaaacgatgggtataaataggggcttttcttccgtaattgaggaaaatccttctcagaagctgccagctattttccctcaattcactggtcaaggggtcacatagtcaaccatagttggagcagaggctgggaaagcaggtaccttgaagaggaaaaaggcagttaccatgattcatcccctaggatggggcatattgccatattttgcaaaattggagttctgttagcaaggaagagggaaggagaacggtgttaggtatgattaacaatttctatcacagttcctgtgtgtcaggaattattagtggctttatatacatttcaatgtaatcttcctaatggtttattaaactatgtactattaatttgataaataaactggtgctgagagaatttgttaattagctctggtgaaatcatgagcaggtaatgacaaaaccagaattcagactcttactacagagcccccactctttgctttaccccacaatgcctctcttgtcaaaccatgaaattgtccaaattgctatttttccccccacagttccaaggtctcattctgacagtgaaagcgaatattctgcttccaactcagaggatgatgaaggggttgcacaggaacatgaagaggacactaatgcagtcatattcagccaaaagattcaagctcagaatagagtagtttcagctcctgttggcaaagaaacaccttctaagagaatgaaaagagataaaacagtaagtgaagagagagactttaaccttaaagaaaaattgtgtaatatttcaaagataggctaccctaagagatccacatctctcaaaataatattttttcttcacttttctatattttctcagccttccacataaattcccacatatatttgtttctacttctgggctttcttttctggcctgtctacatattcatgaattaataccatagtatatgctaaatagtatatgctaaaagtgacatctcaattccactgtataaaaatgaactttttaggctgggcacagtggctcatgcctgtaatcccagcactttgggaggccaaggcgggtggatcacctgaggtcaggagttcgagaccagcctggccaacatggtgaaaccctgtctctactaaaaacacaaaaattagccaggtgtggtgatgtgtgcctgtaatcccagctacgcgggaggctgaagcaggagaattgctggaacccaggaggcagaggctgtagtgagccgagatcatgccattgtactagcctgggcaataagaacgaaactccgtctcaaaaataaataaataaatttttaaataagctatgggattagaataaaaaataacaaaaataaaaaatgaacttttaagtaaatattgattggacaattggaggcatgagttctcagtgtatcttgtttttgtaccattgtcaatgtattcaagtcagtgtaatgaatgatgtggctagggacccatgttgagtcatttggaagaacattgcaggcaccttggttttagaaaaggctaattatcctggtgctctgtctaaaggttcagagcaattgaggagcctactgcttaaatagctttctgtcccttccttaccaccctagagtttagtcctgcccaaaatcagaagaacaaatagtgtgagaagaaaattccgcttgactggaatagtaggccagtttttttatttgtttgtgggtttcttttttttcttttgttaccttgcagttgatttcctcattttcacagtacttcagctatactaatattaaaggatttgctaagactatttgaagccaggcatggtggctcatgcctgttatcccaacactttgggagggcaaggtgggaggattgcttgaggccaggagtttgaaaccagcctggataacataataagaccctgtctctgcaaaaaaaaaaaaaaaacaatttaaaaaattagtcaggtgtagtggtgcatgcctgtagtcccagctacttggaaggctgaggtaggaggatcccttgtgcccaggaggttgggggtacagtgagctgtatttgcaccactacactgcagcctgggtgacagagtgagacccttcctcaataaagaaaggaaaaaaaaaagacttacttgaggagaaacaaagatcttgatatataaaaccatctctctttttttagtctaaatggaaattacatattgtaacttaggaatcatttttaggaacagactactacttcacctagtcatttctttaacttatatgatcctagtaattactcagttttattactgaaattaaatatgcttggtccttaactggtactgttgctttaaaaagaaaatactaccaagtaaagaatttcacgtgtcctattttacattaatattactgtctaattttgatatgagacagatatttgaagctactaaggactgactactctgttcactttcagagtgacttagtagaagaatattttgaagctcacagcagttcaaaagttttaacctctgatagaacactgcagaagctaaagagagctaaactggatcaggtatgttacaaggaatgttacttctaaattttttttactctgtcctgaaaaatatgctacgtaagcaacagatttgaaaagtatacacaagtagaattattgtcctgatcaaatgaaacacaagttaatgtgattattacttcttttattatataaatagtaaataggccgggcacacctggctcatacctgtaatctcagcaccttgggaggccaagggaggaggattatgtgaacacaggagtttgagaccagcctgggcaatatagggagacctcgttgttactaaaaatttaaataaataaataaataatttactggattagacagactgtaattatgcatttttcccctcttactcgtttattatttcttcaggatctatgataatcatcagggtcatagttccttgatatccatttaccatttatctctgttattcatttaacctatatgtattcactaaatctcacactggtcataaaacagcaactgcaacctgactttctctcagttaaaaactttgcacaaagtagaggatattctgcttgaggatattatggaaaacctgcccagtgtggtaaggtaacaagattactatgtaccatggttccagtagctcattttacaaaaaaaaaaaaaaaaaaaataccatacagttatacttgctggggttttacatctctgtgagaggagacagaaccatctgagtgagaaaatctttgtcagtaataattgcaattgataatctaagtcctggctcattggtattgagactcggatcagagaatataagcaatatgggagaaggacacatgagtctagactcacaataggacttcatcagacttagaggcaaaaagatctctaggaggatgaaagaaacacctgtcagtgagggagacgaaagcctttcattgggcgtaaacatagcatagctaaccaatacaatcttcagtagcatgtgacaataagcatttttcatgtctgcaagtcagtcagaagttggctgatctaggatttgctccatgtttcttttcctcgttggaccagcaggctagctgaggcatgttatcctcatgacagtggcagaggcataagaggaaaagtgggaaaacacacaatctcttacagcccaggctcaaaactagattgccagttctgcttcattctagtacagctggatattggggtcgaaagtgcagttttccatgaatattaattaaagtttgaaatgaggctgggcatggaggctcacacctgtaataccagcactttgggaggccaaggcgggaggatcacgaggtcaggagtttgagagcggcctgcccaacatggtgaaaccccatctctactaaaactacaaaaattagccaggcgtggtggcacgcgcctgtactcccagctactcaggaggctgaggcaggagaatcgcttgaacctgggaggtggagtttgcagtgagctgagattgtgccaccacactccaggctgggtgacagagcaagactctgtctcaaaaaaaaaaaaaaaaaaaaaaagtttgaaatgaaagtacatacatgagataacattctagtgttcacactcaagtgtgaatatgctcagataatctagtgtaaatgactgctggaaaagatattagtgctttctctgctttttcagggctctgaactcagaagagataagagttgtttttttttaactacctacttaacaattttacttaaaggtagttctgtttgctttaactgtgactaaataaacacagtacaagccagagtacctggaatatttatcgcaactctaatcttcagtatttaaataatattttacttgaaaggtggtggaatcatgaaaacatggtagtgccaaagtgaagacccatgtgtagctttttgctagagttttcatttcaaaaaatgatctctgattcatcagcatgaatttccaagtttggggtacagggcaatgcactttcctcagtttatttatattattgtttttaaaaatttgcaatacttaccaaagataaaggatttgttagaaacagcttttggaagaggagcagtgatataggtttattttactaatgataatagtaagtaaattataaagaacctttaatgttttctgagaaagtaaagcctattcttggagtttataatcatttaagtggttctggacaaaacttaccaaattctttactgttattactaaaaagaatgttaacaattttaagaaaacaaaaaaattattttttaagaattttgtttatcggttgatatactcattgccaaaccagattaaagtaatattccaattggattggcttcttctaagctctacttctaaggaaattgtttggattgatttgctgtctgtgctttgagaatgacttttttcccctcctccttttttttaaagcaaactttgcgtaacttattgagcaaggtttccccttccttttctgccgaacttaaacaactaaatcaacagtatgaaaaattatttcataaatggatgctgcaattacagtaagtattatcattacaaacccttgtaaaataaagaataatatttacatgaatctttatgttaaagtaagttaacatttttctttttacagtgagtttcagatatttagtcatatataaaaataaatgtaaaaatagacattatgactcagatatagaaatgtcactttattgtatgactcttcccagaaattctacagtttttaagaaatttgtgtttatcagacttgacagccattgataagataaatagcatttcttagaattatgttattggtttaaaaaacttgaatatttcctttgtcaagattaataaatataacaattagaaaaaaaaattataaagttttccacagcatagttctttaaatgaaaggataatatttactttaatcttatgtatgtgtactacagactttcagaattttatgaacagatttgttctataagcattattttactattttaacattatttcctagaatattttttcactgttattattttcacacacctcagattaaattttaaatttccattaaaacacctagaagaatgattgaaatcaaaacataatactttctttttatgataattacttttatccttgcagttaaaaagacttgaacataaggaagtgcttaaaatgtacactaatgtgaatatacatgcacactcacagttacattgtcactgaggtaaataagaaggtagagccatggaccaggcacttggcctcccataatcccagtgctttgggaggccaaggcaggaggattgcttgagcccaggggtttgagagactctgtcttaaaaaaaaaaaaaaaaaaaagttatgctaggaagggaatgattaacttgcctgcaagaacctcagcttctctcaataactatttatggatctatgcattataaatttgtaagctcttcattctaatcccatccccagcccatcatttttttctcccagcgtgtcaacttagataacttaatttgctttgcttctcagattagaccttatagtcagcaagtttgttggaattgctagctctctgaattccttgcctctttatttctgctgctttgaccttggtaatctctacctttggaggttacctcttttctgttcttccatttctaggttatcctgcattgccagagagcatcacataaatactgtttctgcttgacctttgtaaacaatcacggagttggactttagcttgacctctagtgcttggtgttctgggtggtctcattcacccttctggcttcagttgttttctgtatatgaatgactcatgtaactgttaacctccaacccatacctcactctcagtagcagacctggatatctgaatgtatattagaagtttatacttgggtgtcctgtaaataattcaacatacataaaattaaactcatctgaaatccactgttcccacctgcccctgctatccagcagagtgaatgactgaatgttagtcactccatttgtgtagttgcctatggcagaaaactgagtcattcttttttttttttcttttctttttaagagacagtctcactctgtcacccagaatggtgtgaatacagctcaaggagccccaacctcctgggttcaagcaatcctcccacctcagcttcccaaatagctgggtccatagatgtgtgccaccatgcctgggctaattttttttattttttattgtgtagagatgaggtctcaccatcttgcctaggctggtctcaaacccctgggcacaagcaattctctgccttggcttccaaaactgctgggattacaggtgtgagccacagcgcccagccctgagtcattcttaagtattcttttcctcactctccacatctaatcagtctccaactcttactggtttgactttctataaagttcttgacattttaacatttttctccatgacagctaagttaatcttccacagttttgttccttcctgtccattccccaaatataatcaatgtgatctttctgaaaagaacatgttactttcctacttaaaacctttctgttaacccctcattagttacttttaaatgctcattcttggctgggcacggtggctcacgtctgtaattccagcactttgggaggccaaggtgggtggatcacctgaggtcaggagttccagaccagcctgaccaacatagtgaaatcctgtctctactaaaaatacaaagttagccgggcttagtggtgcatgcctgtaatcccagctacttgggagggtgaggcaggagaattgcttgaacgcgggaggcagtgagccaaaatcgcaccactgcactccagcctgggtgacagagcaggactccatctcaaaataaataaataaatgctcattctccttggaatgagtgaattaatggtttagtatgacttaacaaggcctttgttacttgacctcttttcaatttgtatcagtttcaactctgcttcagcctataaaagtttttaggactttttttttgttgtttttttttttgagacagagtcttgctctgttgcccaggctgaagtgcagtggtgcaatctcggctcactgcaagctctgcctcccgtgttcacgccattctcctgcctcagcctcctgagtagctgggactacaggtgcctgccaccacgcccagctaatttttttgtatttttagtagagacaggatttcaccgtgttagccaagatggtctcgatctcctgacctcgtgatccgcccgcctcggcctcccaaagtgctgggattacaggcgtgagccactgcgcctggcctttttagggcttttattggcaatggtctcccttgcctccagtcatctgtcatctgaaaagtaatagaagctacagtgaagctactgaacaaattagaactagaagcttggtatacagataataaaattgtgcctttaccttgtatgggtttggaataaatatttatttatttatttaagatggaatcttactctgttgcccaggctggaatgtagtgatgtgatctcagctctctgcaacctccacctcccaggttcaagcaattctcctgcctcagcctcccaagtagctgggattacaggcacctgccaccatgcccagccaatttttgtatttttagtagagacaggatttcaccatgttggccaggctggtctcgaattcctggcctcatgtgatccacctgcctcgacctcccaaagtgctgggattacaggcgtgagccatcatgcccggccaataataatttttaaaaagaatactttttttttttaggaaggaagaggaagaactgggatggctgaatcactaaacattgattcctggccttgcacggtggctcatgcctgtaatcccagcactttgagaggctaaggcaggcacatcacctgaggtcaagagttcaagaccaacatggtgaaaccccgtctctactaaaaatataaaaattagctgggcatggtggcgggcgcctgtaatccagctgctcaggaggctgaggcaggagaatcgcttgaacccgggaggcggaggttgcagtgagctatgatggtgccactacactccagcctgggcgacagagcgaaaaaaaaaattattattaattagttaatttttttttacagacactgtcttgctctgttgccctggttggagtgcagtggcgggatctcggctcactgcaagctccgccttccgtgttcacgccattctcctgcctcagcctcccaagtagctgggactacaggcacccgccactgcacccagctaattttttttttttttgtatttttagtagagatggggtttcactgtggtctcgatctcctgacctcgtgatccgcccacctcggcctcccaaagtgctgggattacaggcgtgagccaccgcacctgacctaattttttttttaaataaaaatatttttggctagacatggtggctcacacctgtagtcccagcaattttgggggccaaggtgggtggattacttgagcccagttgttcaagaccagcctgggcaacatggcaaaagctcatctctagtaaaaatataaaaattagccaggtatggtggtgcacagctgtagccccagcttcttgggagactgacgctgaagagttgcttgaacctgggaggctgaggttgcagtgagccaagagtgccactggactccagtctgggtgacagagtgactctgtctcaaaaaaaaaaagatacatatatatacatacatgaaaaacttttttgcgtttgccttcccaaaattcggggattacaggcttgagccagtgcgcctacccctttcctgtattttttataaactgaatttaaggaaactggttgataataaaattggcaataagaggtattgaagtttaatttcatgaatactgtctttcctaacagccttgggttcaacattgtgctttatggtttgggttctaagagagatttactagaaaggtttcgaaccactatgctgcaagattccattcacgttgtcatcaatggcttctttcctggaatcagtgtgaaatcagtaagtttcaaaaatgttaaagggaaaaacattatatcctctgccaattcaagcccccacataaatgaggatggagtattaaagaatttttgttttagccttcacggtagtaggattgtatagtgcttaataccatgtgtttggactcaagaatctagctttgaaaccatcttcgaatgtcctacattgtaactgacatgtattaaaacttaggaaaatgttagctttgtttactatactgagtatcagtggtacttctgaaggagggaattatggggtcttcagttttgttataaactatgaaaatgctttattaggcaaaaactacatgctgtgaaaatgctttaaaatgcaacaggatgtgatgtgaagactgtagtttaacaatacatttatcatagatcatttttatttcaaatgcttaatatctcttcatcatttgaacatgaaatcttttgggtgctggatattgagccatatagtattccttttttaaagtgtctgtagtgtttgtgtcctgtttcctttgatagaactgtagttttctaatgtttctcatgttcttgggagctttttcatttgtttttgctgccctcttatattacctattacctgtacatctttgctattcttttctgttttcttttagccacaacttaggcaaaaaacaatgaattagatatactcaagtaccagtagaatttttaaaagttattttttaaacttttgggaaatccaaattcatttttaatttataaaaaaaggtttgattttctagttgtatatgacaataaattgtaattaatgtggtacctcttccacattcatgatataggtcctgaattctataacagaagaagtcctcgatcatatgggtactttccgcagtatactggatcagctagactggatagtaaacaaatttaaagaaggtaacatgaagtagatgctcggtagttttagagtaaagttaagcatatacttctacttattcatgtatttatatacatacaatattattattattatttttgagacagtctctctgttgcccagcctggagtgcagtggtgcgatcatggctcactgcagccttgaccttctgggctcaagcaattctcccacttcagcctcccaggtagctcagatcacaggcgtgtgccattatgcctggctaattttttattatttgtagagatgaggtctcgctatgttgcccaggatagtcttgaacttctgggctcaagcagtcctcctgccttggcctcccaaagggctgagattataggtgtgagccaccacacctggcccaaaaagattattttaataatggcatttatcttggtgctctaaaaaagtttgtcctttttctatgaactttttccgtgaacttaacaggaaagaaaaatgttagtcccactttcttaagtttgtatatccaaaagcctgtttctgtttataaaacactccaaaagtgcagtggcacgattttggctcactgcaacctccgcctcccgggttcaagcaattctcctgcctcagcctctcaagtagctgggattacaggcgtgcaccaccaagcccagcgaatttatttcagaataattttcaggttttgttttgcttgtgtaaagtgcctccacttgagtggtacaagtttgtctgatatttttatattgtttaatgtttttataaaacattatttcttggctgggcgcagtggctgacgcctgtaatcccagcactttgggaggccgagctcagtgggtcacctgaggtcaggagttcgagaccagcctggccaatatggtgaaaccccatctctacaaaaatacaaaaaaattagccaggcgtggtggcacatgcctgtagtcccagctacttgggagggtgaggcaggagaattgcttgagcccgggaggcagagattgcagtgagccaagatcataccactgcactccaccctgggtgatagagtgagactctatctaaaaataaataaataaataaaacattatttctttattctgtgtacatatcattacattgagataattttatatactaagatctcttgattcttttggtgtgaatgttttggttatgtgagtatgtcagaaaattggaaatagtattatatagtctctaacagttaattgccatttagtaatgactaaattaagaattaagagaagtaattgagaatgcctaactgctttgatggataatttttttgataatgacaataatcttagctctgttccgtagtacttttatcttgtcaatattctagcatgttctttagttttgtcttcattttgtttccaacctgaaaagctttctgtcccaaatttcctttcacactcctacacccattttatccacagttctttatagaaatggaccgtatactttttttttttaacacagtcttgctctctcacccaggctggagtccagtggcacaaacacagctcactacatcctaaatctcctgggcccaagtgatccacccaactcagcctccccattagctgggactacaggcacatatcacctgcctggctattgttaaaattttttgtagagatggagtctcactgtgttgcccaggctggtctcaaactcctaggcctcaagggatactcctgcctgggccttccaaagtgctgggattacaggcatgagcccagccagacaatatacatttttataccaactctacacatttgaaaacaggtagagttgattctcattattcacaaattctataatagcaaatttacctgcttgctaacatttatttataatcccaaaatcaatattcttggtacttttgcaaagtgaaacatggcacagagtggcaaaaagtttgcattgcccaatgtacatattctaagccgaggtcaaacaaggcaatgctttgccttcttgtttcaactctcatactataaacaagcatcgttttcacagtctgttcagtgctacgtttttcacatttttctgcttttttgttggtgatttggctgtttaaaatggcccgcaagcatagtgttaaaatgctatctagtgttcccaagcacaagaaggctgtgatgtgccttggggaaaaaatacctgtgtatataaacttccttcagttatgagttacagtgttcttgactgtgagttccgtgttaatagaccaacagtgtatattaaaaataaagttgcccttaagccggatgcggtggctcacacctgcaatcccttcactttgggaggccgaggcaggtggatcacttgaggttaggagtttgagaccagcctgggcaacatggtgaaaccctgtctcgacaaaaaatacaaaaaactagccggtcctggtggtgcgcacctgtaatcccagctagtcgggaggctgagacaggagaatcgcttgaacctgggagttggaggttgcagtgagccaagatcacatcactgcactccagcctgggcaacagagcgagactccgtctccaaaaagagtaaataaataaaaataaaattgcctttaaacagaaacacacataaaacaaagttatatattgaacctaaccctgtatttcctctgggaacagtggttcagtattcaataattcaggatttgcagcagcatagaacttaatgtaatgagagtcaagtatatatttcccagaaccctaaaactactgcatatgtgaacatatcttattcattgattatgtgggcatatagtgaattactagcaggttattgtaagagaaacaaatctgtttggtttgttttcagttctttcaaccttattatttaattaaaaatcaattgctgcaatatttattcctataataattttgccttgtttttctgaattgtctttagttttcaacataagttctcctacttaaagaataacagaagcattgctttttattcccttaccacagatccttgtaagagcccagtattgttcgtatgctcattaaaatagatgcctaagtcactttatatttgtgtgcgtctgtgtgtatacatacgtttggttttgggtgtttttggttttgatactgttaaatatgatgacgtctagatttcagggaacctgggattttcacaatgtgtcatctcagaatctttgtcactgtattgtctctcttacccatctacccccgagtagaagagaaattaactcactctctgaaagacttatactctatcacgtatgccaagtctccagagagacttatcaatacctgtggcttttaaatatacattaaaaataaaagttacctgattctgctgccctttcacactattttatttttctgtttcatacggtttcagtattttggaagacatgtcctgccttcaattttttttttttttttttttacctatttcattctaatgtctttcctctgtgctatcagaactgtatgcttgatcacctgtaactttcttcttaccaagcccagtgaccttggctcatcctttatcttgatctctgctgtatttgatagtgtcaacagctccatcctctaaattcctccttcactgacttttataatttatctgaacttcctgatgccttgagcagtatcctaacccccaccccccacccactccttttttggtctcctttggcttttgtgataatccgggttttctatataatctctgagagcattatatataatgctttctgagaaatcctttggtttttttggtatccctccactcccacagtgtaataaaacatgcacagattcacctccaatctattgtatacatcttgcctatttcccatgccttattaaagctgctttctttaggctgagcacggcggctcacacatgtaatcccaccactttgggaggccgaggcgggcagatcacttgagctcacgagttctagaccagcctgggcaacatggtgaaaccccatctctacaaaaaatataaaaatcagctaggtgtggtggtacacgcctatagtcccagctactcgggaggctgaagtggaaggatggcttgagccctggatgtcagggttgcagtgagctgagatcaccccactgcactctagcctggacaacagagccagaacttgtcttaaaaaacaaaacaaaacaaaaagctgctttctgtagggcctgacttcagtgctaatcatgtctattttatgagtaaatgacatatcttctcaaataaattacatacccctaagcaatcattattttatcctatactactttattttttaatacctaggcattgtgtatggtagaggaaataatcactgaaatatcactaaaaataataattgcagctggacatggtggttcacgtctgtgatcctagcactttgggaggccaagttgagtccaggagttcaagaccaacctgggcaacttagtgagaccccgtctctaccaaaaaaacaattagccaggcatggtggtgtgcgcctagttccaggtaatcgagaggctgaggtgggaggattgcttgagtccaggagttggaggctgcagtgagctatgattgtaccactgcactctagcctaggcaacagagtgagaccctctaaaaataataataataataattggatttcttttctttttagattcttctttagaactcttccttctcatccacaatttggatagccagatgttgagaggagagaagagccagcaaatcattggtcagttgtcatctttgcataacatttaccttatagcatccattgaccacctcaatgctcctctcagtaagttaattgttactatttttccttctagagatatcagtcttacaagacaaattctattaatataaatcagaaaatttttactgtttttagtacgctttttccccttttacatgtttaaaaacacaggttgccaaaaagatgttctcaatctaatttagaacataatttttggaaataaaaattcagatactaaatgaggatgttttagtctaaagttaaatggagggaaaagacccaactattattttggtctctttctcttcttgtaatatcgcaacatttattttatgaacttaatttatagactttctgataatcctgtagaagaaaatgttaaaacattactaattttttaaaaagaatgcattggtagtgctaagattttaatttatgcttaattgaaaataaaggttcagatgttggttgaaaatgaaattagattgtgagttactgatttagatatggaagtggcaaaaatgaaaaacttggggattcatttttatttaatcctttctcattcttttgtaaagtggaatctagtaacatgacaatataaaaataatttgtaattcttgttttctttgatcatgtgctagtgtgggatcatgcaaagcagagtctttttaactggctctggtatgaaactactacatacagtccttatactgaagaaacctcctatgagaactctcttctggtaaagcagtctggatccctgccacttagctcccttactcatgtcttacgaagccttacccctaatgcaaggtaaggatgaaaaccatatttcttttttaaaaactatacattttaagatatgtactactaggttttaatggggatactgaagtccctagttagttgaaggattaagtgaaattatagtaataatagttaccagtactggattatggagtaggcagacaagtcaacagtagtctatcaaattgcccagtaataaagcgagaataccaactttttatttctttgatatttctgaatatgagcacctgactggtcataatggagaaaaagcagacttttcatgacttttacttaaattttatggttatttttcattacatattgaacattctgatccaaacagtgagtactttatatgcattacttcatttgatcctaactaaggtggatagtcagtggcacaaagactttgatccagatatgccagctccaaaactcatgctcttaaacatcactgtataatgtctccagtcaagcccttacagcagcctaacctagaggcatatctgaattaataaatgcaagctggttatagcataagccagcaaaaaataaattgcataattagccggacgcagtggcctacacctgtaataccagcactttgggaggccaaggcaggtgggtcacttgaggtcaggagttcgagaccagcctggccgacatggggaaaccccatctctaccaaaaatacaaaaattagccaggtgtggtggcacgcacctgtagtctcagctactcaagaggctgaggccggagaattgcttgaacccaggaggcagaggttgcagtgagctgagattgcaccactgcactccagcctgcgtgacagagcaatctctgtctcaaaaaaataataaagaaattgcataattagcctgttgaaagaagcttttagtaacaaactttaccccctgacaaaagcataaaattatagaattatatttaacaagatgaagtgttgaaaaataacaaaccttgctgagaatagataattaagagctggatagatgaaaagaaatattgtgttcttgggtgggtagattaaatattataagagtagcaattctttccaagttagaaatgtgttagacttgccaggcacagtggctcaagcctgtaatcccaacactatgcgaagctaaggcaggaggattgctccagctgggaccttgagaccagcctgggcaacatagggagactacatctctacaaaaaattttaaaaattaattgagtgtggtggtgtacacccatagtctcagctgaggaggctgaagggagccgagattgcgccactgcactccagcctgggtgatagagcaagaccctgtctccagaaaaacaggtattagatctataaattagtcaaaatgtaaatgaatttttttgttttaaatttgaaagaaaatttagtttcctaaagaataaacagtcagctgggtgtggtagctcacacctgtaatcccagcactttgggaggccgaagcgggtggatcacttgaagtcaggagttcgagactatcctggtcaacatgctgaaaccctgtctctactaaaaacacaaaaattagccggacttggtggcacacacctgtaatcccagctacttgggaggctgaagtgggagaatcgcttgaacccaggaggcggaggttgcagtaagccaagatcacgccactgcactccagcctgggtgacagagtgagcctctgtctcaaaaaaaaaaaaagaaagaagaaaaaagaaaaaaagagggaacaagcaagtctagcagagacaatttcttttttgtttttaaagagcaatgaagggacacttgtggtcaagatggcataatacttctcactctttcctttcatcccctcttgttccaaacacacagcataatagacagaatttaaaaataaataccctggctcaaaatacaaacatctcaatacaacagaatgataaatcagtgagcagagttgaagccacagcacagctgcattcttggtttagaagcagcattggcagccaggatattgacttatatgggatgatagtagtgtgacgatatatattgtccaaaccagatattttcgtttaggacaaatgctgaactgaacagatgtttgttgtagaaataaaaccatataaaatatatagcattcaaatgtatatatcagtatgaataaaagtttaaaatgtgcatggaattaggtctttttaggtactaaaaataataaaaaaaaattaggtaccaaccctggagaagaataaaggggaatagatagaggagagtgtacacagggactttggggatatcttttttttttttaaccccccctagcaatttattttccatttatttttcttttacctgtgtgtttgtggtggagggattaactttttgttgtgagatgattatagattcagaagaagctacaaaaatacatgcagggaagtctcatgtaccctcctcccaaagcaccaacttccaccaaccaccaccatctcatataaacacagtacagtatcagaaccaagaaattgacattgttataatcccatccatatttggatttcactattatacatgctgcactcgtgtgtgtaagttctgtgcagttttgtcacttgtagccttgtatgactgccacctccatgtatacactcagctgtaccatcaccacaagactcaaatgttaaccctcaaatgctaattttaatgaatgttgttactctgtaaagctgatttgaacactgaagatgagattagcattcaactcggccaggcatagtggctcacccctataattctactactttgggagcctgaggagggaagattgcatgaggccaggagtttgagacgaacctgggcaacgtagaccccatctctacaaaaagtaaaaataaagccttgcattaatattggaatatgcaggctgggcgcggtggctcatgcttgtaatctcagcactttgagaggctgaagcaggcagatcgtttgaggtcaggagttcgagaccagcctggccaacatggtgaaaccgcatctctactaaaaattaaaaaatcagctgggcatggtggtgcatgcctgtaatcccaactacttgggaggctgaggagggagaatcgcttgaacccaggaggtaaaggttgcattgagctaagatcacaccactgcactccagcctgtgcaacagagtgagactctgtctcaaaaaaaaaaaaaaaaaaaggtggggcacagtggctcacacctgtaatcccagcactttgtgaggccaaggcgggcagatcacgaggtcaggagatcaagaccatcctggctaacatggtgaaatcccatctctactaaaaaattagccgggcgtggtggcgggcacctgaggtcccagctgctcaggaggcagaggcaggagaatggcgtgaacccaggaggcggagcttgcagtgagccgagatcgcaccactgcactccagcctgggcgacagagcgagactccgtctcaaataaaataaaataaaataaaaaaattgaaataggcattaaatggttatctaatgaaattttttgatggaattggggacaaagtcttcattctgttttgttattactaataataaaagtccttaactgctgaaggactgttggaagttgctgtgtgtaaagttgagggtccatgcagtgtgagaactcaaaacgttaaatatggcactggctacgctgatgcaagttttttttttgagatggagactcatggtgtcgccaaggctggagtgcagtggcaagatctcggctcactgcaacctccctctctggggtttaaggaattttcatgcctcagcatcccacaagtagcggggactagaggcatgcaccaccacacctggctaatttttgtatttttagtagagatggagtttcaccatgttgggcaggctggtcttgaactcttgacctcaagtgatccacccaccttgacctcccaaagtgctgggattacaggcatgagccaccatgcccagtctaatgcaagtattttttagtttggcatgcctaaatgtctgtgtgctagcctcagcattttcttatttaaactattttgaaattttgcttgattctgcaaactccagtatcatttagactttacttggtatgtgattgaataaaaattttaaccaaaattcagctctggagttagtagtagtacctagttaaaaagtagtcattgagggccggatgcggtggctcactcctataatcctagcactttgggaggctgaagtgggcggatcacttgacgccaggagttcaggaccagcctggccaacatggtaaaacgttgtgtctactaaaaatataaaaaattagctgggcgtggtggtgtccacctgtaatcgcaactactcaggagtctgaggcatgaaaatcgcttgaacctgggaggccaaggttgcagtgagccaagatcgcaccactgcactccaacctgggcaacagcgagattctgtctcaaaaaaaaaaaagtgttcattgagatgatccaaaatatgattatagtaattgttttctggacctgcataacaatgaaaattcatataagttttgaatttttggcatacccaaggactgatgggagtcttagtttgtgtaatactgcttctaaccccataattctacttggttcactcttccatggaataattcaaaatacaaagaaatacgtacagttttatttagtgctgagttattttttctgtatccagtcatccattaagagttatttttaatctaaacttagaaataatgtaaacatccaaaccaatagggaaatggtaagtttatggtacatggtagataagcagttgttaaaacttccttaagttcttcttacatgtggcaaaaaaaaagaaaagaaaaacttgtttaggagaagttttaaagacatgggaaaaatcaggccgaggcgggtggatcacctgaggtcgggagttcaagaccagcctgaccaacatggcgaaaccccgtctctactaaaaatacaaaattagctggggtggtggcacatgcctataatcccagctactcggaggctgaggcaggagaatcgcttgaacccgggagacagaggttgcggtgagccaagatcgcgccattgcactccagcctgggcaacaagagcgaaactctgtctcaaaaaaaaaaaaaaaaaaaaaaaaaaaaagacgtgggaagaatcaaaaagtgaagaagcaaggtataaagtggtatatgcagtatataaatgtgtgaatttctgttatttccacccgcctcattgcacaaagatttgagataacagcatacccagtatgatctcaacaccaagtgttaatggatatgggattgatatttttctctttagatgttattctgtattccagcttttctaccaacactaacctaaaaagtaagaaaaaaatactttcatattttatttttttgagacagggtgtctgtcactcaagtacagcctcaagctcccaggctcaagtgatctttgcacctcagcctcccgagtagctgagaccataggcgcataccagtatgcctggctaattttttaattttttatagagacagagtctcactatattgcccagggtggtctcaaactcctgggctcaagcagtcctcccacctcagtctcccaaaggggtgagattataggtgtgaggcaccacactcagcctatatttttctttagaagaaataaaaaagcgggccgggtacagtggctcacgcctgtaatcccagcactttgggaggccgaggcgggcggatcacgagatcaggagatcgagaccatcctggctaacacggtgaaaccccatctctactaaaaatacaaaaaatttagccaggcatggtggtgggcacctgtagtcccagctacttgggaggctgaggcaggagaatggcgtgaacccgggaggcagagcttgcagtgagccaagatcatgccactgcattccagcctgggcaacagagcaagactccgtctcaaaaaaaaaaaaaaaaaagaaattagaaagctttctgtttaagtaggcaaggatatgatattccttggaggaacagaagataatgcggataggccaactacttgacattttctttgtgtattttactattagttgttaccttttgatgttaacatttttggatttaaattcctgtttttttttttttttaggggaattttcaggctactaataaaataccagctggacaaccaggataacccttcttacattggtatccaatatttatgacattcaattgtgtaatttttgttttaccctgtacatttcctgtctctggaatttaatgacagcagtgcagtttttcacagcagtgagtaagtggtcactcatgatgggtatgtctgccacatagcaaattttcaagcagctctacagatccactgctgagcaaggtgtttgccaacacaaattgaaagacaaacccagcttacttttaaaattttctgtgctaactatggatgtgtatctgccaagtacatatttttcatattctaggcatcttaggagattttcttcccctttggcaaaaatgatttcaacaaacattttaataattgttctgctctcatgacttacttgttccttctttaaaagtcctatcaatacttgttcactgctctgggataacatgcaaatagcacttttattctgttcttttgtatgggtgtttgtatattgggtcatgtcttaagtgctgacttatgttcatatccttttgaacttgccaggcctttcttttcaagatttttaccagcagtgtcgggaggcattcctcgtcaatagtgatctgacactccgggcccagttaactgaatttagggaccacaagcttataagaacaaagaaggtaagactccactattgtagcattgtatgccaggaatagtccgtatcatttacttaaggacacatatatgtttgacttagacctgattttgaaactgatgttccctgttgagtcacagagattcatttaggggatgtgccatttgagtttgtagaaagagccatggtagaagtaccctgcttcagagcagagcagaaaactcacatgttctagtccagagtaataggcaattagaaacatggtgagtcaaataattctgttcttttgttttttccctcttgctcattcattaatttggtctgtatttattgagtactaactacatagatattgcactaagtattaggatacagtagtaagcaaaaatctgattgcttttcttatggagcttaaagtctaatgggggagatggacattagtcaagtaatcgcacacataacattttaactgtaaggaagtcctatgattagaaggtacatagttctgaaagagtttatttaaataggtggatttgacctaattatggatagatatcagaagagaccactgagctgagatctaaaggaagactaggaggccaggcgtggtggctcacgcctgtgatcccagcactttgggaggccgaggtgggtagatcatttgagcccaggagttcgagaccagcctggcaacacaggagaccctgtctatgaaagaaaaaaaaaaaagagctggttgtggtggcacgcagctgtacctgtagtcccagctgcccaggaggctgaggtgggaggatcacttgagcctgggaggtgaaggctgcagtaagccatgatcgtgccaccacactccagcctgggcaacagagtgaaaccctatttcaaaaagaacaaaacacacacactgaaagagtgacattttagggagacagatgatgagttcatgatcttaatcagtttagacaactctgtttgaggttcctttgagatttccaaatggaaatgtcaactatgcagttggatacctaggacaagaaaccagaggaaagatatgggttggagagagaagattatgattcttatatatttagattataactgaaaccaggcattggggtactacctaaagggaggacgtttagtgagaatagagagctaggagataaggccagaaatgtgacatttaacaaaagtaaaggataagcctgcagaggtgagagaaacagccagagaactaggaagaaaaccaggatgtgatgtcacagaagccaagagaagcatgttttaatgcagagaaaatagtcagcagtgtcagatgctgctgagaggccaaaaagattaagactgaaaatatctgtgagatttaggaatataaaattcctgatggtctaagcaaacgatgtgataatgggaacagtagctcagttaaactgtgctgaatgagaagtgtggaaatggagactgccatcatagccaacttgcttggagaagtgcagagataatgtgatagatggagaggaatgaaggtgtgtagtgagggttactgaaaaattggacacacttgaatgtattaaatatttaaaagccaacagggaaggttcttgttgaaaggaggaagaaaggacacagacatcaatagtgttagattctaaacagggcaggaaggtgaagaatgatctaaagcacaatgaaaaaaataaatacccacctacccaccctctagttagttgtcttttccactataaggatgtttaactataactccatatatttaagtatatatgactgtgtgcccttttgcctttttatacttatatatttaaaaattacatccaagaaataaattcattttttctttagcctctacaatagaagagttcatatacctcttatgaatgactaacgtacaggtattcttaaatctttcagggaactgatggagtagagtatttattaattcctgttgataatggaacattgactgatttcttggaaaaggaagaagaggaggcttgaagctttcctttattcttgaatctcccatggaagggttgtaccccagctgccactcctctagttgaaagtgttgtgtttacatctgacattaaattatttttccagcatacaagatttaaatttgggaagggggggatgtcctcaattagaactttttgatcagcctggctggtaccgtctagtactatgcagcggtcctcaagttggagaaaatgtgcctttcattcattacctctctggagacttcttgctggaatgaacagtgtgctcagggactatttggaactggatgtttttgaattattttatacttagagatattctgaattttttgagggccttttaacactccccgagctgattgtttgcaagtgtgtttgttccagagtgtggaagtataaagacatgggcatcacgtaaattggttttgtttgctattctgtgtgtcagaaccaacgagtgtaatggagagggcaggtcatctcttattgtttctaaaacaacttaaaaggtgtagattgggaagaggtgagtgatccagctttctccttttggattgaggctatgtacttggtgggggcaggggagggaatatattataatactattcagttgggataatgggaaaaacagagtatatagggtatctacccagcctagaaagcacaggaacaatacgtcatatatttggaacagttattgtctgtgccatgaccttcatgataccagtgagaagccaggctagagaaataaaatcctgaattacattttagtaattgttttcaagacaacaaaaaataaaacatttcattattcttgtatattgacatatttttcttttcttgaacaacatgcaggtgagtagcatattaatggctggctgtaaattaattttgattcctctgtcaagtagacctaaaactcactgtaagatatttcagttttttccttaaagtgatgatttcaaacctcctgaatatttgcgcgagacttttttcttaggaaagaaaaaaggctcaccttggctactgttgtcagcttacagtcatcacataccccctgaaatatttgacacttggaaatgaagttcttcctgaaaatatcactgcaataaaatacgtactacgtc

SEQ ID NO: 36668 - DNA, 15349 bp, Homo sapiens
atcaccttctaccagacactgtgggcccggccccggagggctcggcaggcccggagagtggggggtggtggggggaccaaagcgggtgggccaggggccttgggtacccggccagcttttgaggtaccagccattgtggtggaggatgcccgagggaagcggcggtcctcgctggatggctcggagtctgccaagacatccctgcaggtcaccaacttggtcagcgccatcgtctttctctatgactcactcacaggggtgcccatcttggtgagatcggggtcctccccacctgttctccccaatatccaggccccagcatcatcacctgacctccaacttcatcagccatacagcagctccgtcatctctcctccagttccatcatccatcttcctctcctctgtccatcccccactccatttgtggcccccatcttgatcatctgtcttttagttcccactaccctgtttaccccagctccagcatctgcttcagttcccactcctcagctccatcaccgtccttcagttccacgacctgtcctccagctccgtcatccatcctgcagctccacggttcagccgcagacctctcatccagccgctgggctccactctccattccctccttccctcgggctgccacatggtctctgagcactcttggctggaaatcccacagggctcaccccaccaccccatctagtcactgttcctgggttcctgtctgtctctacggttcctggtccacctctgttcctctccctcctgaccgcagggctttgtctccagcactctccccgaccttcctctgagtcagtcccttccctctgttcactccatctccacctccgcttcgcctctgttggagcacagggatcaggcattacttctgacgtcttgcccaccagctgcactaggatatggggttcaggtgggctcctcagctctggccctgacccagcccgctcccacccttccccaggtggtgagcttcttctccctcaagtcggactcggcgcccccctggatggtgctggctgtgctgtggtgctccatggcacagacgctgctgctgccctccttcatctggtcctgcgagcgctaccgcgccgacgtgcgcacagtgtgggagcaatgcgtggccatcatgtctgaggaggatggagatgacggtcagaggaggggctgggctttggctttcctggacatctgtctattcccttttctgccgctccttctcagccagaggatgggctgccctggagtgccccctactggacagaatctgcaccaccctgggctcccctttccctaagcaggcaccctgctgtccactcactgcttcccgcagcactcagggctcccttcactgggcctaggctcccctccagaaacccacactgcccagctctggcactatggggaacctgagcttcccgagagaggccccccagctatagggacggctcttgggggagtgcaggcaattgtttcaataacttcatctatatgtatgaagcactccactcaggatttagcactgaacgcagcaaatgctagccactctcactgtcctcttggaacatacatgctaatgggaactaaaggggtctctgggagcttataaaggcagtggtgggaggccgcggtaggcattccctacctgtaaccactctgcccattttctctcctagatgggggctgtgacgactatgcagagggccgagtttgcaaagttcgctttgatgctaacggagccacaggaccagggagccgggaccccgcccaggtgaagctgctgcctggaaggcacatgctcttccctcctcttgagagagtccactacttacaggtatggaactgggggatacatctcctacccttggtgccgctcatcacttttctccagtgtctgttaggcaccccaatcccctcttccctagccctggctttcagggcaccatagagctgggtgaaagaaagctatagcaagagaggcatcccttcagacctcgtggggccaggtttgcccaccggagcaaacgttttgaaggttaagaaggtggcaccatcttccggagtccccacttggttcctgcctctgcctctgtccctgcagcaccttcaggtcttacccgctcctcttcccaggtccccctatcccggcgtctgtcccatgatgagacaaacatcttctctacccctcgggaaccaggctccttcctgcacaagtggtcatcctctgatgacatccgggtcctcccagcccagagccgggccctcgggggtcctcctgagtacctgggacaaagacacaggttggaggacgaggaggacgaggaagaggctgaaggtggggggctggccagccttcgccaattcttggagagtggggttctggggtcaggtgggggacccccacggggtcctggcttcttccgggaggagatcaccaccttcatcgatgagacacctctgccttctccgactgcctcaccagggcactctcctcgtcggccccggccactgggcctctcaccccgccgactctcccttgggtcccctgagagcagagccgttggacttcctttgggactaagcgcagggagacgctgctccctgacggggggtgaagaaagtgcaagggcttggggaggatcctggggcccaggcaaccccatctttccccagctgaccctgtgagcccaagcaggcctgctgaactcagaggagaaagcctgagtgagtaacacctcattctggccgagagtagggcagctgcctccagactctggggagacgggcgctagatttggggctcagaaggccctgctctctcccatccaagtgaccagatgccctactcagcttccatcacccctagcaatatgtattaaagtctgaagtgttgccatggaaacctcagtgtccagtgtactgcggtggaaaggggcttggagggtggagtggctcacaggggacacgacagagcaggggcagcagacagaggcacagaaggacacatggagaaatgatcacatgctccaccaggcagcctcgcacagggaaggctgggaggagcatatcctgctgggggcggggcttgaggacacacatcttcgttggttggggtatgaaggatctctgttcagatttgttgaggtggttttagagcgtggctccagccccagtgcccaactctccttctaacctcaaatccatgcaggggctcactttatgggcaggaaaggttttggggctgatgcagtgtcccgggcctggacacctcctccttgctgcattttaaagctctttctccaaaggagtgcaggggtggatgagtgtgtgtgtgggcgggggtgggagtgcaggggtggatgagtgtgtgtgtgggggagtgcaggggtggatgagtgtgtggggggggtgggagtgcaggggtggatgagtgtgggggggtgggagtgcaggggtggatgagtgtgggggggtgggggggggcgagggggggatcggcgtccacactcctttttctggacccagaagcgtgtgtgtggagggaacacagccccagtagttacccccagacctcaggggctgaagtcaccgctggggctgaagtcatccttcatggatgcccaggcctgctccagttcccgccttttgccctcctcctcccagtttctccctcttattccacactagaccagctttgtccactcagcactcttctctctccatcttttcacatgggcctctcccaccatcgggtctcagccccatcttctctctctctctctctctcggcctccctcattatttctccctctccctccgcctctccatctctccttcctccccctccctccccttcccccctttcctctccctccctctcggctcccgcatttcccctcggctgccggcggctccgacatcatgctccggctcctccggccgctgctgctactgctgctgctgcctcccccggggtcccctgagccccccggcctgacccagctgtccccgggggcgcccccgcaggcccccgacttgctctacgctgacgggctgcgcgcctacgcggccggggcttgggcgccggccgtggcgctgctgcgggaggcgctgcggagccaggcggcgctgggccgggtgcggctggattgcggggcgagctgcgcggccgatccgggcgccgcgctccccgccgtgcttctcggggccccggagcccgactccgggccgggacccacgcaggggtcctgggagcgacagcttctccgtgcagcgctccgccgcgcagactgcctgacccagtgcgcagcacggaggctgggccccgggggcgcggcgcgcttcgcgtggggagcgcgctccgggacgccttccgccgtcgggagccctacaactacctgcagagggcctattaccaggtggggagcgggccgggcagctccgagggtcccagccctcaccacgacgctgtcctactttgcgttgcccaggagtaggcggaatgctgttgcccgggccccgcacggggctggggagcgtaccgcgggcctctgcgtaggagctggctaagcgaccgcgaggacctcttgagatcgcagaggagcagccgagggggagtgcgagcagaatgggaatggggcggggaggtcgtgaggtgggacgggagcagatcgaagatggagggacagggccgcctcttcctaggaatgaagcggaggcggtgggggcgaaaccggctctcggacgggaagtgtgcgtgggtgtgtgtgtgtgtcgggggtggtggtgagtgtgaaccttcgcttggggcaggaggtagcttcggaaaggaaggagcagacggaggcaaggttggggtcctccgaggccagacctctgcgggcggggaggggacagcacgccgcagccgccggtaccgcagcagttgcctacgtggctggggaagcggggcgccggttgtactcacctcagctcagggtcctagagacctgcgggttttgctggtcgctgaggtctcccccacttccccacctcacttaagccatcacttccacctggtctcccaaattgaggtcctgaagtcctgagacccatgtcccacccaactccgacgtctttagatcccctttccctcggtgccagccttctgagagtcccaacgttctggcctctaggggatctgcagttcgggcggtgggcggttctgattggccagtcttccatgaggctctggggcacccagagtgtgtgtctggggtagggtggggaggctggccagggggcagaggtctgccccccgtcccagggctctgatgccctcctcccttcgcctcctcagttgaagaagctggatctggcagctgcggcagcacacaccttctttgtagcaaaccccatgcacctgcagatgcgggaggacatggctaagtacagacgaatgtcgggagttcggccccagagcttccgggacctggagacgcccccacactgggtgagaatcccagcaccacccctgtcttgccaccagccttttcctggctggatacacaggcctcactaaactgtgcgttgtgctgcttgagcatacagatggggtaatgatcctcagcgaccctggctgggagtccttctctaggacttcgtttccttcctggatgatcactgaaatctgatgttctaacattatgattctgaggcccacccttattcttctccacggtgaagagggacatggagtccttgccccaaatgagaccaacacccctctcctctctacctcccagtttggcaacccctggatcttaggtgactgactgctcccttccccaacaggcagcctatgacactggcctggagctactggggcgccaggaggcaggactggcactgcccaggctagaggaggctcttcaggggagcctggcccagatggagagctgccgtgctgactgtgaggggcctgaggagcagcagggggctgaagaagaggaggatggggctgcgagccaggggggcctctatgaggccattgcaggtaagggtcccgtgtgtgagggggtgggtcggtgcccagggaggggcatgaacaagctgaatggcttatgggtttcctctgcaggacactggattcaggtcctgcagtgccggcaacgctgtgtgggggaaacagccacacgccctggtcgcagcttccctgtcccagacttccttcccaaccagctgaggcggctacatgaggcccatgctcagggtcagttggggaagggtggaaacggggagtgaagatttgcctctgctgctatcctgagctccatctctctatccctcccatctgtctctggatttgtagtttcactgtcagggctgcatgggaaccatcacttcacaaggactctaatttgccctcctttggcgcctgtgacaagctcaggagatgggcttccttctgccttgctgcttctcaccttcctttattttcccccctcttgctcttctttgaactctccagctaaggtatgtttgcaccagtgtttgaaagaaccggcagctgaacttgtctgccagtgggaagggggctcttggagttagctgtctggcctctggagaccaccttctccagcactgcctctgccccaaggatcaatgtgctctaagtattcatcccccaacccctgaccttgtcgctccctctccagtgggcaatctgtcccaggctatagaaaatgtcctgagtgtcctgctcttctacccggaggatgaggctgccaagagggctctgaaccagtaccaggcccagctgggagagccgagacctggcctcggacccagagaggtaatcccctctccacgctcacctgggaggtagccccaaatcaaacaaatagacctgagaagtaacctggacccccaccccccgctggcctcttacccgagcactctagtcacccaaaggactccaagtccagcatctgacttccgtctccactccctgctccccacggcagcctggagttccgattccagccctcagccccgtctctcttgcctttacttcactcctgcctgccaccagcccccaaactcatgcatacacacacccacacactcacacacactcccaccccctacaccctttccagtttaagtccagatgctctgaagctgctgagggggaacgttgaacagaggaaccggggggcatggtgccaggttcaaggagcatggagcacccaggcagtgccctagagccggcgcttccctgccttcctccagctacccctcactgctcatcatctcaccctcaggacatccagcgcttcatcctccgatccctgggggagaagaggcagctctactatgccatggagcacctggggaccagcttcaaggatcctgtgagtcactccacttctgcccatctcacccctccgcactcccaggagggatggcactttggtttgcaacagagttttccatttttccaccatgaggcttggagaagagtctgccatcccagttttacagggacggagacagtgtgcctgtagttagggcggctttggggtcacgcaggcctaaatgtcagtcctcctctgccccaaacatctctgaacttcaacttgcctctgcctcaatttccttacctgtaagttggaataatcacatctgtttcacagggctgttgaaaccacatcatttgataacaaaatatagaaagctctgttactgctgcttttatttctcttcttgtagttatgagaggaaactgcggggcggaggttatctatggctaggactagggcatcaagcaggcgttctcagtcttcctggcgctactgatattttggatctgacattttggataattctttgttggggcagagggcagggcctgtcctatgccttggagggtgttcagcagcttccctggtctctacccagtagagatcaatagcacattgacagcccctgagtcatggcaatcaatgtttccacactttgcctaatgacccctgggggcagaagtgtcctgcttgagaacgactggctaaatgtgtgaactctgaagctagttttttttatttttatttttatttttggagacagagtctcactctgtcacccaggctggagggcaatggtgcgatcttggctcactgcaacctccacctcccaggttcaagcgattcttctgcctcagcctcctgagtagctgggattacaggtgcccgccatcttgcctggctaatttttgtatttttagtagagatggggtttcaccatgttggccaggctggtcttgaactcctgacttcaggtgatccacccgcctcggacccccaaagatgctgggattacaggcgtgagccaccggaacccggcctgcagctagtttaaaacctaacgctgctttgggaggccgaggcaggtggatcaccagatcaggagttcaagaccagcctggccaacatagtgaaaccctgtctctactaaaaatacaaaaaattagctgggcgtggtggcgggcgcctataatcccagctacctgggatgctgaggcaggagaatcgcttgaacccaggaggcggaggttgcagtgagctgagatcgcgccatagcactccagcctgggcgacagtgtgagactccgtctcaaaaaaacaaaaaacaaaaaacaacaacaaaaaacaactaaccctgtcatttgtagctgtgtgatcttgagcatgttactttacttctctgtgtctcagggctctcaattacaaaatgagcactttaatattctgtttcatgagactgttgtgaactttaaaggataaattccatttccatgaataaagctcttagaatagcccctagcagatagtaagtgctatatgagttatagttgtacttgttgttacagtttgatccactgcccagggctcctgacattgagtcccgggcttttcctacctccgtcttcctctctggaaacagaagaaacttaatgagatatttcagctctaatgtcagggattccaggggctgaccttggtgggtgatgatgcttttctggactgtcgcaggacccctggacccctgcagctctcatccctgaggcacttagagaaaagctcaggtaggatatgccccatggtgggaggggcttggcccgagctgggaggctgggtctggactgtcctgggcacccactgagcgcatctctcacccctgagagaggatcaagagaagaggccttgggaccatgagcccgtgaagccaaagcccttgacctactggaagggtgagttcctgggagggagaaggcaggagcctggagggtctgggggctgccagctactgctctgcctgcccttaggggatgctcagccccctctgctctgtcttttccctggcagatgtccttctcctggagggtgtgaccttgacccaggattccaggcagctgaatgggtcggagcgggcggtgttggatgggctgctcaccccagccgagtgtggggtgctgctgcagctggctaaggtaggaagacctgcaagctcatcagctcgttcaagactcttggatacaatcacctgttcccttgctcttggcctgcccccttcattctgcctgtcctgattatccaaccgggactgtgcttaccactgcctctcagctgtggataagttccgtctcgtcttaatttagctgacataggtggatgttctttacaaatgaattttgctagaaattgataggaagaacaaaacaaaaaacatgaaggcataaaaatggatgagtgtgcaggtaaggattgcttggttagccaagagtttagttactggcttggctgatggctcagcagacacgcaggcctttctttccctcctagtttaggttgaatgactcatactcaccaggttgaggctaccattttatgaagcttcaacccttatcttaggttagtgctcattcagtaatatactcactgagtagctgctatacactagaaactgctaggttctagggagaggaagatgattatagactctgccctttgggagctcaagtgtagaggtggaaacagacaaggaaatacataatataagcaggtggtaagtttggtaaaagaagtatgtttttgggctgggtatggtggctcatgcctgtaatcccagcaatttgggaggccgaggtgggtggatcacctgaggctgggagttcgagaccagcctgaccaacatggagaaaccctgtctctaataaaaatacaaaaaagttagccaggcgtggtggcacatgcctgtaatcccaggtactcgggaggctgaggcaggagaagcgcctgaacccgggaggcggaggttgtggtgagctgatctcgtgccattgcactccagcgtgggcaacaagagcgaaactccatctcaaaaaaaaaaaaaaaaagtatgtcaaatagaagcactgaaatgcagttatagaaggcttgctggagaggtggtatttgagctcagtcttaaggatgagttagtcaggcgattgggggtggaatcagtctaagagggagaagagcatggtgcattctgggaactgcagtcaagcacaggggtgagagcagggccagctccatagtcattacctgtgtgatcttgggcaatttattttaacatctctgagcctaatttgctcatctataaaatgaggataataatagtgtttttgtcatagtgtcgttgtgaggattaaatgagttagcacatgataaagctcttagaacacagaatcatcactggctgggtgtggtggctcatgcctgtaatcccagcactttaggaggtcaaggcaggtggatcacttgaggtcaggagttcaagaccagcctggccaacatggtgaaacccggtctttactaaaaatacaaaaaaattagtgggcattgtggcaggtgccagtaatcccaactactggggaggctgaggcaggagaatcgcttggacccaggaggcggaggtcgcagtgagccgagatcgcaccattgcagtccagcctgggcaacaagatcaaaactccgcctcgaaaaataaatttttttaaataattaattaattaattaattaattaaaaaagaacatagaatcatcagggtgtatgttaccaagagacagtatagggaaagagggagagagcccacacatgaaggccgagggacagtgagtgtcttctgtggcctcccaaggagtttgggctttatctgtgtatggtagacagctgttgcaggattttaggacggttgacttttgcattcctgtagtacctggaatcaggtgcagggtctggagtcacctgtaggagtggtagagccctctagtggcagtctgtagaatgcagtgggagaaagacccggaaaaggggagtaattgacgaatgccaccgttggctggcgaggtggctcacacctgtaatcccagcactttgggaggctgaggcaggcgaatggcttgagcccaggagttccaggccagcctgagcaacgtggtaaaaccccgtctctacaaaaatacaaaaaattagctgggcctatgcgcctatatgttcccacctacttgggaggctgaggtgggaggacctctggagcctgggaggtggagattgcagtgagctatgatggcgccactgcactccagcctgggcgatagagcaagaccccgtctcaaaaacaaaaaatgaaaaaaaaaaaaaaccccaggttagacggcttgggtgactaggtgtctctcagaagtgagatttgtatgcaggcgtaactagatagtggtgcttaaacaaattcaaaaagtagacaaaaaacgggtgtcagaaaagcgaataattccagtgtagacatccagatattaggagacccccaggtagtgagagtggtcgcggaggtggctgggtagttgtgactcagtatcaaggagtgggggagccacggagtccacagtttctccgagagcatgtcaggtgggaagaggtcagagagggatagcccgctgatgctgtctccctaccgccagtctggcctaactgtggaacttcctcttagggtcctgtttccagagggactcctctattcttggctcatcggggattaatgatcaagcccttcctgcctagttcccagctctgccccacttttccagctgtccctaccctctcagaggcccccttactgctgtaggaagctctcccgagttctctccacagtccccttagtaagcgggattccagcccgtaccagagagggacaatcggacagccgtggcggtgggcactctctgggaaagagcagcagctcaggaagacgagccacaacagaactgtgggagcatctagcttcttctggagagcgggagggccggagggagggtcttgcagccctgcagacagtgaggggctgggggagtgactccacggtaaactccttcctatttaggatgcagctggggctggagccaggtctggctatcgtggtcgccgctcccctcacaccccccatgaacgcttcgaggggctcacggtgcttaaggctgcgcaggtgagcacaggaggcacccgggcccgtctgatgcccagacctggaggagaggctgtgcaggaagccgggccccagggcctgggcttttgtgaaggagctttcttgggaccgagactacctgataggacccagcgtggagaaaagggatgttctgagagctggggccggggttgttgtcatggagagagaaggagcagtttgggctgatggacagagctggatgctgacagactccaaacccatgggtggagagcggcagagttgggcaggggctagggccgagaccaccctccccttgccttcctccttttctgccctgcctttcactgcctgcagctggcccgggctgggacagtgggcagtcagggtgctaagctgcttctggaggtgagcgagcgggtgcggaccttgacccaggcctacttctccccggaacggcccctgcatctgtccttcacccacctggtgtgccgcagcgccatagaaggtacgacagggaccccccactgctcttctccaacctcaggccctgcccccaggacactgcccccaagagccccggggtggacgtgcacggcctgagcccacagggtggcagatgggcacaggggcacagaggtacccccagacccctttgtgtcctaggagagcaagagcagcgcatggacctgagtcacccagtgcacgcagacaactgcgtcctggaccctgacacgggagagtgctggcgggagcccccagcctacacctatcgggactacaggtgggcagcccctctagtggtcaggcaggtgggcagacaaaggtcatcccactgccggcctgggcctgggttggggtctcactgcctcttgcttttttccctccccagcggactcctctacctcaacgatgacttccagggtggggacctgttcttcacggagcccaacgccctcactgtcacggtgcgtggagtggggggtgtgacggtgtgacaaagggcccagctgtggggtcaggattcaaaacagaaggctccagaggcaaatgcagggaaatggccagggcttttaaccctttcacttccccgcctccgcagccctcccgctgcttcctccgtagcaaggtctctaagtggccgaatcaaccctaccatcagtatttgtctcgcctcctaaagaagggtgaatgaagcacagcttgcaggtgcctccaggactccatggccctattctagggatttggggaacttgaaatagtccttcctctttgcagcgaggtgagcacagtggctggcgcacagataccagggccgccttgactggggctcggattctgaacctttctgaggtttagtttcctagactggggtgataataatagtacgtattttaaagggtcattgtaggaagtaatttaggtaatgtacctaaaagaatgaggcagcgcctggtaatgataagcaattaatgaatgttaggtgggaaatttccggacaccaggggctaggattgggtaggaggagaggggcagtgattgttcatctgggtgtggggtgtgaaaatggttccaatatctgtatccccttctgcatagagtctggtactgcatgcacagccccagattgcttcaagccctggattcaaagggctgagtgggaaaaatcagggtaccaggggtcaggaaccaacaggagaccatccgtggagacccctttttcctttggttcccaactcctcttgcatttttgctctgcaagttgaagctgatttctcatttgccccaagctagtccctgaattaaggagtaggaagtggtagcgagagagctgatcctctctgtgcccctgtccccatcctgctctagggagtgagggccaagttctctgagagagccaatccctggagctgaacctgccctcatccctccaggctcgggtgcgtcctcgctgtgggcgccttgtggccttcagctccggtgtcgagaatccccatggggtgtgggccgtgactcggggacggcgctgtgccctggcactgtggcacacgtgggcacctgagcacagggagcaggtaaggagcggggtaggaagggatgtggttctcctggtgcgtgaagggtgggcaaggagcccccgagaaggctcacagtcggtgagggtcaggggctgagctgacccagggaaggtgggtgcagggaatgggccacactctcctccccaaccccaggagtggatagaagccaaagaactgctgcaggagtcacaggaggaggaggaagaggaagaggaagaaatgcccagcaaagacccttccccagagccccctagccgcaggcaccagagggtccaagacaagactggaagggcacctcgggttcgggaggagctgtgagtggctgagccagctccttgaggatgtggccacttgacttgtggaaggccatcttgatgccaggacacacaggaagcccctgtgtgacatcaggagcagaacagcaagctctctgtccctgcacccccaccatcttggggacctacaagggcctggactcagaggacagtgcacaggctagcctggagctcaccaggcctggggagctgggacggggccccgctgccggacctgcagccctggacagatggggaacactgtgcctccctgaacagaaatggcaggggaggaggctgatgctttaaatgaagaggatggtggggttgggaggtataaccctgctcctctctcccagtctgtgcaataaaggtcgtgaagatctctc

SEQ ID NO: 36669 - DNA, 1389 bp, Homo sapiens
aggagacttggcctccgcagctgccctccggccccccacggctgccgggttccggggtgcaagtgaagcagcctccccgcggaggccgcagcgccccgaccaggcctctttaagcgcaggccccgccccgggcgccaccgccccgccccgcggatcccgctcccgcaccgccatcatgatctgcctggtgctgaccatcttcgctaacctcttccccgcgggtgagccgcgcggcgcgggccgggggcgggtggccggtgctgggccggcctgacggcccgtccccgcctgccccgcagcctgcaccggcgcacacgaacgcaccttcctggccgtgaagccggacggcgtgcagcggcggctggtgggcgagattgtgcggcgcttcgagaggaagggcttcaagttggtggcgctgaagctggtgcaggtgggggcgcggtgagcgagcgggggcgcggtgtggggggaaggggagcggggacctggggacgcctaggtgccgggtgcgggcgcaggcggcctgacccttccgcaggcctccgaggagctgctgcgtgagcactacgccgagctgcgtgaacgcccgttctacggccgccttgtcaagtatatggcctccgggccggtggtggccatggtgagtatccgggaagcgggcgggcggctccgggacccccacccccgcgtgataccgcgcccgttcctccgcacaggtatggcaggggctggacgtggtgcgcacctcgcgggcgctcatcggagccacgaacccggccgacgccccgcccggcaccatccgcggggatttctgcatcgaggttggcaagtaaggcccgccccggggacggtcccagccccgtccggcctccccctgttcagcctgcgtggtacccgtgccggaggtctctttcccacgctcacacgcgcctcttccgcgcaggaacctgattcacggcagcgactcggtggagagtgcccgccgcgagatcgctctctggttccgcgcagacgagctcctctgctgggaggacagcgctgggcactggctgtatgagtagcccggcagatgcgcgtcacagaggctctcacactccagcctcctccagggcccaggtgggcgggcttctggccccaccccacagcgcttggagcatccctttggacgggctgctgaacatccacctgtctggacgttgcatggagggtggcgcaggcctctccaatccctggcgtacagggtttcctgcccgaggagctgctccaggagcctgcgcggctcgcctggaaacgtgccaggacactgtcctggtgcccagcccaacgtggtccaacgtttttttataataaagtcctcgttttcgtttcgatttgggcccaggaacaggc

SEQ ID NO: 36670 - DNA, 154781 bp, Homo sapiens
acagagcgtgttgttagagctgtgctgagcgggtgtttgggttgttggctgctttcttccccctttctcacacacttgtatattattttgaggtggtgttcgcagagtttgaaaggagagagaattaaaaaaaaaagccgcaagcgtttcactcttttatttttataatccccttcaatttggggttaaaaaaaagacaagaaaacaggaaggaagagaaataaggaaatgagatgtggtaaaagaagctaaaaggtgccttttaaaagatcgttgctgtgaagtgaaaaaaatctccagagaaaccaaaaagcaccgccgagacctcttccgaaccaaaggagtttgtgtttgcttttagggaagaagaaagatcattcattcggaggaataacaaccaattaaaagacaaataaaaaaagtttggagtgggacgcagagcgagcgagaggagctgccggcgggcggtggggcgcggagcccgcactttcccggccgggtgagcggcggccgcggcgccgggctcggcgggtgcgcctcggcggagcgaacgtcggagcgttgccttgggagacgcgcgccggacaatgcccgcggcgggccagtgacgcccgcggggaatgcggagcggcccggcagccggcacccagccgccgccgcgcgttcctgccgcccgtgtcacgcgagacccggcgggggccgggaccgcccgagccgcccctcagaccgagccggccgcctccgctgccgcggccgcctcctcttcggggtcattaaagccaatgagccgcgcgcctctgccgagcgcagccaactaaatcggcttggatgattcgcgacctgagcaagatgtacccgcagaccagacacccagtgagtgcgggcggcggggcgcgggctcgccgggtgctgggggattccccgcgtcgccccctgcgcaccgagttgtgtcttttggccggaggggcgtggagagccgcccgaaatcggcgccccgcgccgggagcagcccgcccgccatcacccccaccccccggcgcggtggccctcggagggggtgcggagaggcaattgagttgtagccattttcttattgttgtctttgaagcccctggaagccgcgccgagccgtttgcggtccccgcgccgcgactcctcgagggggggtggcgagcgatgaaggaggcgcgactccgcgcccgggcggggagggcgccctcggcagcggcgctgctgggctggctgcggtttggaagtgcggggcgccggcccctcgcgccgcgggccgccggggcgagcgggcgaacgaacgagccgagagggtggcggccgcctccctcctcccccggcctgaccgcagcccgacgccatggcgcgggtccccccgacgggccagtttcgattccgggtgaggagggagtgggcgcggcgcgcgggtccctgggtgcctgtctttggccggggaggggagacgggactcgaaccctcggggtccggggcgcgggggcctgcgggcgggagtatgcggggccccaggaccacctcgaaaccagcctctgcctgggctgttgggcgcgaggagggttgcgggaggagagttttaatctctctttgcttgcgtgcgcgatgaccctcaccccccgctaacgccgcatagtaggttttctccgtctccctgcttcgcctgtgatgtgggctaattaaatattttattgttgttcttcaggcaccgcatcagcctgctcaaccctttaaatttacaatttccgaatcctgtgatcggattaaggaagagtttcagtttttacaggctcaataccacaggtaacgatattgactttagctgatccttctgtttgcttagctcttgtctccccgacaaatacacacaaacacttaccctcctccttttttgtgggggcgtcacaaaggtattatttttttttctcggtgggcagaaagggcaaatcaaggcctccttccttaggcaggtgtaaataaattaaacatttcttctaccgtaaataaaaagaaggcagaacaatcgaaactggggagacttggaaaacgctgaggccaaactttcgatattgatttattggggccgggagaatgaaaggttgggaagattctggggccttttgacatccttggttctttattactccggacttgattccttctcacttttttctgccattccactgaagagctgagagcccagggaagtcggagtgagcgatttcattacttttatgctaaaaaaaaaaaaaatgttttcatcttatagacgatttttagacttagggtgcctttgagacatttttctttagctggctttttaatgatgcctaattcttatttcataaatgcaagaaccaaaacaaaccactgaacccgattgacactttgcccctgggtggtggtattcaacttgtctgtgtgttttggagggaaaaaaacaagatatcattcataagacatgcttgattcatattttcattaatctctttgtagaacattaaagaaattcccttgtgacgttttggaggacttatttgtgcttgtatgtgcagtcattattgaagtttattttcgtgtttgttttattaagtgaatattcaattctggaggaagttcctgaattaaactgattagaggatttgtttccttaaaacttaattaaaaaaaaaatcctaaaaacaaaaaaccacatatatgatccttattgaaggggcaagtccagactggttccaatcacccctttccccttccctttccataatgatgggggtatttatttaagattgttgatttagttgtttgtaggtgagatttagaatatgcgtttaagagttgaaggatgtaagttaagatcattgtacttagagtatcttatgtcttgaacagtctgaagctggaatgtgagaaactcgccagtgagaagacagagatgcagcggcattatgtcatggtaagaaaaccatgtcacagattcaaagtgcctattagtttggaataccaaaaacaagaatatgtttaaattgctgggggctgcaagatagatcacagtcaccctgccagtgcagttgaagttgtgggaatatgtctattagcaacctgtaattctaggctgttataacttgcctttgacaactggctttgattggaattttcagaaagttcagccacatggggtataattttctgtgctttgtttttacagatcgaaaaaaaataaaaacaaaaccttgtttgttttgtcacaagcaaaaatgtttttgtgttagtggctttctttgttgttttattgctcttgctccaaacaatttttgccagtttttctgtatgctgttaacattgtaaatgtcttattattaaagacattattaaaaaataatgttttatttctttgaaaaggagtgatggataaggaaagacagcagaccatttttcaaatttttttctctttatgttactattacattaatatttgtatgttttcaatttctgtagtgttatattggtttgaggaatgttgtagtctcctgtataactgatgtgttctgccagaatttctatgccagttatactacacgttcaaaaaaccagatctgcttttacagaagtattatgaagcatatttttatgattgtccaagaaagctccagaataacccactcatttatttttctatctagcttttttgctttgaatgtgtgaatatgagcagtacactaacaaatcagaaatcaaactctaagtagcatcaccttttccaaccttcctttcaaaacatcagcgtttgtataaggcattctttgctgttaacttgcctgctgtgcttaggaattaagagtccgtaggataccaaattttcatcagacttttttgatgcatctgcttgggatgtataaagaaactggagatgttaagaatgctgtgtttgaatttaatttttcttagttttgtgtgttttctcttagaatttgtgtcttaaggtggttaaagatagtgatgggctcttgatttattggcataggttatatgaagatactggtttaggtgaggcttttatgtttgtttcagatttacttggggcattttgaacaaactagggagattgtttgatgaaagtcatgcatttaattgcttttccttctttgacagtattatgaaatgtcctatgggttgaatatagaaatgcacaagcaggtaagttatttctttataaccattttaaatgacagtaatactgggacactatgaaaagaaaattgtatgttttgcagttttattctgcaagccgttgtggctacctgtatttaaaagtctgggtagtgaagaaaatgctgttttttcatgtgtggctccccatctttctttcatattatcctaatttttataatttaaaaatgttattttaaaaagtctgaatacatattaaactctgtacactttcaaaagcaggatgctaaattttaaaatcctcttgttattcttctgaaagagttgctttatgtattttgggcattgcaaacttgtcttgtgaaagagcttttcttggaaaatattaaacagtaaaattaaattgtgtggcgccttcgttggcttgatgtgaaagaatggatagagggtgagctgggaggatgaaaatgaaatctgtggagctacaaaagaaattgatgtaaaatccttgtactggtcccctgaggctacttagttgggtcttaccaagaactataaccgttacttccaaaatttgtacagagtaaatgagcctgataggaggatgtgataaggttcaacattgggtcttgaaatctagcaattagttcagtagcaaaaaaaaaaaaaaatgattagtcagaaagcactgagagatacgactcaaacagtcttctttttgtgcaggagactgaataaaatggtttggcttaaatttcctagacagaagaataatagcgggtatatctatctatatatatatatacacacacacaaatatatatacatacatatatatatataaatattgtttggcgatagtaattcctctaggaagcatttatttttagtgatctcctagtggaagcacttcaggtctcatcagccatttcagaataggtgtgtatgtgtttgtctgctgggaaaaagacaagggaaaacttactgcttttcatttcctatttatggtcaaggtggatgtcattactttctaagttgagaaaatatgaaatgagcacatactattaggccttcactatttatggattcctttttgggtatagttattttctacatgctcagaacatcccagatagtagatctttaagagatggctgttagacaataaggcaatctgatgaatagtattggaaaacaaaaagttggaaaaaaatgagacgttgcttacattgaggacttttaatttcagatactgttttactttgtatgctatttggttatgtcaatattagcattatagtatagtttgaatggcctgttgaaattaaattcttattttggcatctttgtcatttctgtttagattagtaatgtaaatatcttctgcttaaacaaaatctgttcaatcttgtggatggacttctcttagttctaccttacaggaataaattacatgagagatattgtttgttaattatcccattacatttcctttgaggtctggatcttgtgtatgtctctttttttgtctgcaccccactccccaaaattaattagtgtctttttaaagattggaccagatgattaatttagtccctttatttctccttctgtatcttgtttaccctaaccacttagtttccaggtctccttgtaccatctacatttctaagaggcacatagcttgtatttggctgtatgtatttctttttcgagggggtatgtgaaatcccttaattttacacattttatactgctataattctgtcatcttcttgtccagctagcctcaaatgccatccatttaaaattgagaacagtacattttccctttttttcgtttccttttaaattcaatcatatcaagaatcctgagggcagtttatcacattatgaaatacagacagccctgcaaaccacctacttattatattttctttctttctcccccttaagcatagaggcatatctgtctttatttgttttcctaggcagacagccttagttcctcttagcctctcttccagatgtactcgctggatacccttgtaatggaaagcagcaataatgcagggaagttgccctgcggcataattgggcctagttctcaagatcgggttaggtttattcacttattagatttgtgtctcgaagggttcaacagtaggagtcccgggagcccttggaagtaccctagtaattggtggccctgatatttgaaacctttgtgtattttttggttaacgttcctgttcttcttggctgctgctagccacagaatatttatttttagagaaatttttcattggaacagaaaatggtggttgtgatgcagtcatggctctgtgacttagcaaactgataaaaagataaaagtatgaagcaaagacaaacagggtggaggtcggtgttctccctcctaccctttctatgtggtgctcatcatcagtccccctgtgttgattctgatagagaactataaaatgaaacctatggggaatttgtcattctgaaatgaaagctaatgtaattagtaccaattaaagtacatttagtaaattggatttaatcttaattaagcctgcataatgttgccaatttttaacaattatgtttgagaacataattaatttaaattttggtaactgagtaaatagcattagtctggtagaattagtggattttttttttttttaaaggggaacttggtgatatgacgtggaattggaacataaaatatgaatctaaatttctggtaatctttaggattgatagagctaagcagatgaagcaaaaaaaaaaaaaaggatgaagtattctaggctataatgggaattaatgctgtgccattgtctcaagttctagcataaaagtgaagatgacaaataggacatggttagaaatggcacatgttttagtgtgacgtcttcaaaatggaatttttaaaaatgaaagaacataggcccttattccctaaggatttccctaagtgtatggtttttgttttttgttttgtatgagacagctgacccagggtttagttgttaagtttttttgctgattgttcttctttgtaaatacagtgtggcttctaaatgggttggtggcttctaaatggcacagtggggtgatgcatggagttgatagcattactaaatgctgcttcttcccatctttcacctgtaatgctgtcattaaagaagtcctcactgatggactctgacagcagtggttaccattctaaaaagtgagtattggatatagattaggaacagtaggtatgtgaattcaacctataggaactatatggagatgaacataccatcttttgaaaaggggagcatgagaacatctatgacttccttatagttagtattctacaatgtgaaagcttcttcatttgaattttagtaatcatcaggaaattttagaaatctaaaacgcatagaatctgaaagtaagtactgcacatttatgtatgttttatgtgtgtatttttatatgtgtgtgtatttgtgtgtgtgtgtgtgtatatatatatgtatatttaatcaaagcaagaaaactcctgtttcacttaaagccatgtaaattttattacgagacttgggccacaaccatttgagtgctgctaaaatattaattgaatagaaatgaaagggccttgccaactgataggatatcataatcatagcctctttggtcgatggtaaatgatgataaatgacattaggaaccttttagcaaactgtaataactacaaggagggaagcagtatggatttgcattgtatctgataccctctagtaccaagtggattgccaatactgcttgtttagcattttctaagggcaataagatattgatttctgacttacaaggaacagctctattttcaccattgaaaagtattgcaggttgttaagaagaaattgacttgaagaggccgactgctgcccatcatggagcaaataaagcaaaactgccgaagcatggtggagcagcgagacgggccctcagcaatttgttgctattaatttaccatgctcgacagcaaatcaatcggcatctacttcatctgctggagaaaatgctgtccagggcagataaaaggctcggcatggtacagagaatagactggattggccaaaagcaggctgcagttaatgtgtaaataagtgaaatcaaggccactgttgcagaggaagctgttgttaattaggttggtgttttttagtgaactattttagaaagcagctaggatttggagagtaagaagagatttattgagattgaagtaatacatgactggcatgacattctagccttgagtgtacttgaatctagggtgcagtaaatttatttggggacactgcttgctatgaagtttgttgaaagttcattttagaccacatttcccttatgataactttttttttcaaccttgccagttttttgcacatcttctgtcttattgtgtactcttagatttagaagagtagatggaggagtaggtgttttagtatggaggcacaaatgtgtctgttatattcttacccagtgcctttttttttttcagagataggtataattgaactcttgtataataatgagagtgaactatcatggaagatggggtgttctagctgaaagtaactaataaatgaagattttgctgacagaactttatcttgcttcagaaatattaggaaataacaatctagagggcctgaatagtgggtagatactactagattataaaatcttaaagatgacaagtgaaattttgatgtctgcataaacttcagatacaattataagactatgtgtgtgggggtgggaagggttcttgtgtttttggttttcattaaggtttaaagccaccttttctaatttaagattatttacacgctgataatattccacaattaatgttaacggagtgaagggtattggtggtgttttttcccctttacctctcatttgggcattttaaaataggaggccaacttcatttactcctgtttagtaaatctaaatgagtgtaggttttaaattagattttttcccaaaacccttcagaaggtctagtattagggcagttgataagtaagtggaagcaccttgggcaggacccagtgacctgtccttttacttattacagcacctgcacgggaagcagatctggaggatgaaatttaacctgttacagtgtgtgtatgttttagggtgtgtgttttccgaatactgtggggagttccctttttccttctcccatgatggattcttttgtctttctagagataccataggaggatatctggatttttcacctaaggcagtgattcttgagtgaaattggaatttcctttcaatagaagtaaacatttattatatatctggcttgcgcttaccactggtctgggcacactgccaaaattcttatcgttagttctcataatgatcctaagacagggattatatccaatcaaaagttgattaaacagggtcagctctgcacaaggtgatacagctaatagttggtggattcaggacttcaaataaatttatgtgggaggatatctcctgggagatgggtttgctatgggttagagattcaggccccagttcattcctgaaatagagagtccctgaactttaggctcatacgcagaacctcttgagttgggggattctctgcaactgcctagagtccatggatggctcagcctgccctctgcttgcagactgctttcagtgggtgagagggtgaggttgctttcactcggaatctcccacatgtgggctagggaagctgcttgcttatcaagatggaatttgcttcctccctaggcaacctatttctcatttgtttacaaacttgttcttctctttaacttttatcttttcctgtggcttatgagagtgcctacagacaaggggctgtttgttaatcaccatcttgtgggcttttgaagggggaagctgggaggggaaaatgtgatgttttgtagcctctttgtagtttagaaagaggttcgtcgatgcaggaaatcacacaactcagttttaaatgaaggcagatgttttgcttttactgttaaaagaatttctttgcagcattcaaacaaaaggatagttccttttcactgccccttaatccctgctggatattatttatttgtatttattattttgatgggcaaagttctttgtatctaggtatatatcactttgatctgtgtaggaatgatggaccggactaatgagctacatctctaggtgctgttgcagcactggtgaaggagacaatacaagcaccagcccattgttcttcacattcttcatttaatctttgctttcctagaatacatcttttttatttcttcttttttttcttgtgttataagataggtagaggaaaccagttgggaattaaatgtttaaaaaatgcatttataagttatttgtgtttgtttttaatgtggctttttttttttttttttgcctttgatgtgattcgatggtttggtttaccacttctggacagcaataatgtatttggtggctagagaaaagagggacagggatgtgagttctagaaggcactttcttgatccctctacacaccctcttaaaatgactccagcgttccagcaatggtggtaggttcagtggtcctatactagctaagttattaccagttttgtaagctgggctgttggagagaagcaggggggcagcacatttacgcatgggcaatggagtatttacactgataatgacagtttgcaaggcttaggacttgttcaaagtaagtatactgcgaacagtttatgaaattattactctaaagaggaagggcctcagaagttttagtcagaagcaagagttagagctgttttgtctttgccttagtaatagctctcagtggtagttgttttctatctatggagagggatttagctggcattcatcaccacaaatctatataccctctctcttttcattggaacttacccagcatttatgccaggctgttgctatttctatatcattgacccaaaacttatccctggagagctgcacgtgtaacccttattccatccaggggtgacacatgggcagggtgtggattttcttagctggttcatcaaataagcagaagagaagtactctgggataccccttaggtactctgtcctctggtgagtggatcgcactgtcatctcttttgaggatttgcccacacacatttcaagaattgtatggtggaggcagcttctgcgtttcacggaatgaaaggataacttctctcccggtgcgagacaatactctatccccaacctgggctggctgtggtgtgcttgggacctctgcagggccctgttgcttgcagcaacctaggcaaagtgagaggttggggaaggaggaggggggatattggctttttcatttcttagcaggcttatttaactcattattattattattattattgtaatttgggttctgtccttattttcgaactatgtattctgtttctgaaggtctgtggatgattttggttattgaatttgaaactgcaagaaaatataactggaaagaatagtcatagtagaaattataagcactagtactctgtaacaccctttctttacagagagcttaaggcattttatatgttctctttaatgttccttatgttctgtgaagcaggtagcaagcttggatccatgtatttatttaaatagcttctgtcagtggagtacccaacagtttgccaagcagtgtcattctactggcctcctttaatagataacactgaggcttaagggcttaagagactagcccagtgtcacagtcagggaggatcagcacgggggtggagataccagagttcacgcaggtcagcgaatgcgcctgaggttgcatagtgagagtcactggcagaagaggaaatagtaggtttcttgacttcccttccagggctcccttcgctgaccatgctgtttccaaacagcaaataacatgcttgtttctatgatgtgtttggctttctgcaacatgaggagcatggtgatgctactggcagtccaagagtgttacaccgtcatctctagtgagagatctgatctgtgtttgtgtttgaggacagctcctccctcccctcccttctaccctctcattgcctctgccctgcccaaagggagtctaggatcagcaatattgaaatataaagccaaggtccacttttagaaaagtgcttgataaaactggctatctggcattcctgaactgtaccatgcaaacacactgtgttagatacttacctgtttatttcctgtctctctctcgtgctagattgtaagctccatgaaaacaggagcttttattgtttactgctgtgtacccggtgttgagccctgtgcctatcgcatagtagatgctggtgcgcaataaaatatttggtgaatgagagaatagcagttagagctagccaagaatatgtgtgatttaatatttttaagggtatattaggttgcaagatagataacaaatactgaatctcaggcatacttaggtctgtgttgtctactagtttgtggaaaagtgacacttggaaagaggaagcaaaagcaaccgaacttgctgtgcctttgaggaacaagttagtatagctaaagtagaatgtatgtattttagtatgttgagtctgcctttttaaagatgaaaacatgaatcattccaaacagaatttaaaattcagtttgaacgtcactgtatcactagtcagtgtttatctgaataattcttttactattaataggtctgtgtacctgtggtttgaatgaatgtggagcaatatcgatcttgactatattgtgtgtttagctaacttccctgcaaatcagtaaaaaatgcaaggttttagttcttttcaagggacaaggaattttgaaaatgtcttaattttttttattagtagagatagtataacgttgttgaaagaatagtaatcataacagtaagcaattttagattgcttatagtgtcgataatatttcacttattcttacaacaatcttatgagattatagtagtagtattatttccattttacgtatgttggggctgagacacagagagcttaaatagcttgcttgaaatcagctagccggtaaaatagatcttgggtttgactcaaggtcagaacgctggtatgacagatatttctgccttattccagttgatatgtttggaatactccaccatcagcatacttactaccttcccccaaatgcttgactgattccggagcctcagattctagttctggccttgctagtcaccagctttgtgatattgctgagtaccgtacctttaagggccatgcttttctcatctttaacttagggcgtaagtgaacgcccagatctcttttagctcttttggttaaaatgaccatttcagtttggtttgttgctgtgatccagtgaacagaaattgaatttttttttttcagtcttagaaagtctcttttagcacttattttcagaatttttaaaatccaaagttacccaatgtgcctaggagtagaaatgtatatttatatactattaatactttattttttataaggtactttctcatccttttttttcatgtaaaccccaataataaagcattccccccgtcctgtggatgaacacagtgagacgcagatgttagatgacaaagttcttcacttaattagtaggtggtttacaattcactgattctcttatggccagcgttcaggctaaagtaatgttgacacagaagtagagcaattttcataaaacatgtaatataaaagtatatataacataaaatatatcagtatgtctttaaagtgattagtttttgtacttttcctttggcatatattagaaaacttaggctgggcacgtggcttacgcctgtaatcccagcactttgggaggctgaggtgggtggatcatgaggtcaggagatcgagactgtcctggccaatgtggtgaaacgctgtctctactaaaaattaactgggcgtggtggcgcatgactgtaatcccagctactcggggggctgaggcaggagaatcacttgaaccagggagtcagaagttgcggtgagccaagatcgcgccactgcactccagcctgacgtcagagcaagactctgtcacaaaaaaaaaaaaagaaaagaaaattgtgtgacttctgaaattgtatgaattataaagtgatccaataattttcttccaaagatgtgcaaagggactatgtagcagtttattacctgttgtgtaattagctccgggggttactcttctagaatctaaggtaggtgtcagtttctctagcttgaggtaaagcgtgtctgtaaactgtggcttacagtgagcttgacatctcaagtcctcaggactttcttgctttgtcccatcaaggaccctttccttagggaagataaattcattgtaaataaatgacttaatcataagtagaagaagggagaaatgtttaatcttggccttttggagtttataaatcaaagacacagtagagatcaagttccttcattaaagtgtagttccaaaaaggaagaatgtggttttggttttaaaaaatttttttatttttaatttttaagagtacatagtaggtgtatgtatttatggggtaaatgaactattttgataccggcatatagcatataataatcacattcgggtaaatggactacccatcaactcaagcatttccctttttttgtgtgggttagaaactttctagttatactcttttagttacttttaaatgtacaataaattattgttgactgtagtcactctgttatgctatcaaacactataccttattcattctgactatatttttgtttacagaagaatatgttttgttcactgctggtaccactagcacctaaaacaatgcctggaatatagtagaagaaatgaatgaatgaatgatggaacagctaaaggagtggtttaattttttcattttattgcatttcatgtagcatcacatattctgagtatcagccacctttatataagctgtcttcgtttctgagtgcttagggagggcctggctttatgctgagcaaaaaaggcctagataggcaatcagagagtgggagttcttatctcagtctgctacaggtccttgagctgctgattggcatttttaaaatttagaattggattcatactttgccagatgatttatttctaagatatctttcaactcttaacatcatatgatgtttaaatgaccagcttaaaaataaaattcatccctacttccattgctcggtactataggcatgccattttagtaagttaagttttaagataatttttataagaggaaatacagccaggtttttttttgtttttgtgtttgtatttttgtagaatctcactttgagcaatgttaggctattgtgtggacagctaaaacaatcctaatattgccagtgtttcacaacctagaaccatctgctgtgttgctttttttgcagttgtagctgcatcttcctggtccttctataggctaagagcacatcagtaagtacatatagttaacagatttttcatatgtatatcttgggcaagtgttagtgataataagagcagttaaaatttatcgagtgcccactggataccaggtaaagcactaaatgcttcagatgtattaatttgtttaatttgtaatcttttgaggaagggatctgattatccttattgtgtatgaggaaactaaggtaaagagaagctgagaaatttgcccagggttatatatagctggtaggttacagagtaggggtgtcaaggccaggcattctggcttgagaacctacattctggttttgaaccactggcaataaatgtctcataagtgactatggtaaacttctttgtttatccttgcgtgtgtgtgtgtgtgtgtgtgtgtgtgttttgagatagagtctcgccctgttgccaggctggagtgcggtggcgtgatctcggctcattgtgatctccgcctcctgggttcaagtgattctcctgcctgagcctcctgagtagctgggattacaggcccacaccaccactcgcagctaacttttttgtatttttagtagagacggggtttcaccatgttggccaggatgggcttgatctcttggcctcgtgatcccacccacctcggcctcccaaaatgctgggattacaggtgtgagccaccgcgcccggcctatccttgttttctaaatgaaaaaacaaatcgtctgcttctgtgttctgtacacagtgagcttaaatgttaaaaataatagctggtatcatttgggtattttgttttgcaaattaacacactagattagtggactcattcattggttcatcttttatcacagattctactgtttgtccgtggctggataaccacaggcctctagatatttttgtacctctgactgtgagatttctaaaacaggcatggcaccttcttttataaccacgtgtcacatgggaatgttcagggaactgtaaacttttgagtgcctgcctggggtggaggagagatggaggttcttggctgggtttgaaaggttctatatagttctggaatttatatgcataattgtgtaccttttttgtgggggcagaatccatagcccttactggttcaatgaggaaactggaacccaaacaaaagaattagggaggtactgtgctagagcagtggttgcaaactggagcagttcctttcctcagaggatgtctggcaatgtgatgatatttggggttgtcacaacttggagttgctactggcatgtagtgggtagagtctgggatgctgctgaacatctgcatgtacaggacagccctctacaacaaagacttagctggcctagaatttcagtagtgccaacactcagaaactctgctccagagagaagaaaatactattaaattctgttgcctttttatggcccggagagttataggtttggggcataatgacctctttgagtagagaaaggccaagtatgagcattgtctggcttctctagttaagtcaatttgagagaatcctttaaacgtacttaaccttttcaggttttttcctccctttcccatgatgataagcagagtggggttggtggtagttaagttctgaatagagatattacatgatcctttgtaatcttccttttcctaaagaagggaccgtgataaaccttctcggtgggagggacttttcacacttaagttcagcttctcactggaaatcagcttgatttccactgaaaacatccagatctttgtggtgctactactgcgcaaggcagaagacattttcagtggaggtattggattggcagaaatttctttatgtgagacccattagtcctgtcccccatcgaagtcactagaattagtcttactccttgtctaggtttttcagaagtgttgccctttattagccttcctttgtccatgctgggcattctcagtcattttaaccattctcctgagacaccagtctggttggtaccaagatgtatatgatagaccgggctgcctgagaattcaacgtgacgtttctggcctgattctacccaactgaggcattagggcagatcttattgcaaagtagcccttctgctctttctctttagggcaaagtacattatatttgtctttgtcatgtcctgatcacactgtaatacacaaaatggaaccttgagttttgtaagtaacctgagtccacaatatgggttcgtttttatttttgaatgtgtgggcgctgatcagtgaacctgttttacttggacttcttttcccccaacaaatttcactatgctgcgctatgaatgtgggtggctgttttaaaggcttttgattttgcgggggacagagaactgtttggaaatgtggttttacctctggctagcttggttaacccccccaaaatatagtcaacctaaagtggctagtgaaaaaacaatagcagttctgtagctgcttgtttgcttgaacattttttgggtgagctaggggaagacaaaacacttgtttgggcttcttaatgaagaaattgtgtccccaaaattccaatgtgtgcttcttaagcttccactcttctctaggttctgggcatggggaggtaaactttggcacccctacttgcttgtaagttttctctttacatttcagaggtgtcagatttaggagaggctgcttgtaagttttctccttatatttcagaggtgtcagatttaggagaggctgcggcaggcaaagtacattatgtacaaaaaccttccttttgtaatatgggagctcatttccaaaggctccatatggctagcctaggaggctcatagtaaagacctgctttagttgtaagcagagctgataggagggtttttttataatctaagcaataatttttaggttattttgcatcagtttaggatgcacacttgtgaggtggtatttatgccttcttcccagattagatttacaaatcccactttcttaagatacttgattttacattttgaatcatgcttttttgccactttctttctgtttgaggctcaccgtgcaaattaactttctaaactgaaatatttagcttctcaaatggaaatacctggaactggatttattataaaggttaagaagattataacctaaatacttaaacatgaaaaaagtaacttaatcttcatgagattgttttattctttcattgggagggttacttggttaagagccagtagtcctggtcacctcagagggaatgcaaaggctcttattctttcatccagctaatgttaattaacctcatactatgtgcaggttgctttgagggctagcagttaggaaaggtaggaggcttgcctccatggagaatctagtctttttacttcatttggaccactgtaaaaaatataaagcagtgcagtggatacacagttgtgacataggtggaagagaagggggtctttctggctccttgagtgattaaggatgctgttacggaggaggtgggcacagtttagtgagacctcagaggatggggagcacttaggcaggttgaaaggaaagggtaggattccaagtggaagccacagagactggaaactgctgtgcatattcaggctgtgtttagtgtttccagctttattgagtggtagaggagagaataattgggaatataggtttgggatgcattatagaaggccttgaatgctggtggtagtgcttgggctataaaaagaaagcaaaggggagattaatcagtagttggtcaagggaccatatctgttttgctaatttgttcagcagctagcatgaggcctgagaacaaatgtcagtgaatgttgttgaaacgatttgagtggagaggggcgtgactggagagggacagggtggaggaagtgaagtctgaactagggaagtagaactggaaaggaggaatccctatgacttgacatttcattgggtgaggagtatggaaatgcataggaggaaaggccctaagacattgatgtctgcagagggacagagtcatggtaccattcattgatagaaaaagatactttagaaggggagaacttggtgttgataatgctgccaggtgtggtacctaggaaggagggagtgaaagaaggaagaggaggagggaatgaatgagtttgttgcttcttttgctttcgttcatcaccttactttcatctctcctgccaaatttataatccttccaagaacctcaaggattctttccacatcttctgtataccacagtggactttgccaggcagccttttgtgggcatgtgttttaggaactatttgacgtttgtaggagtgtggaagagagtttcttcttcttcttcttctttcttctttcttctttcttcttctttcttctttcttctttcttcttcttcttcttcttcctcttcctcttcctcttcttcttcttcttcttcttcttcttcttcctcttcttcttcttcttcttccttctgcttcttcttctttcttctttcttcttcttcttctttttttttttttttttggaggcagggtctcactctgatgcccaggctggagtgcagtggcgtgatcatggctcactgcagcctcagcctcctgggctcgagtgatcctcccacctcagcctcctgaatagctgggactaaaggtgcttatcaccacacccggcaatttttgtattttttggtacagactgtgtttcgccttgttgcccaggctaatctcaaacttctgagctcaagccacacgcccacctcatccttccaaagtgcaaagtgctgggatcacaggggtgagccactgtgcccagccagagatagtttctgtcattttgctcggttactgccattacctttatatagacatagtggaatttgtaaattcaattgatttttaactttttcgtctgtaaaggatttttaacattagaagtaggtacagaatactcaaaattattcttctatcattgaaactctttgttgcagtcattcttttcttccattttttatttcttgtatgacttggccaacaactctggatatcagtgattgtgtatcctttttaagttgagaaatttcatgtagacataaggctgagtcaataattgtcttgggcaactactgtgtttcaaaagaaataattattcccattgttcattatgtccctgatgagctaaacactgaaattacaatagatgctttagtcaatgtgaattatttgtgtgtggttaattttcttctttttttctccctaatgtgaggcatattctgtattttcaacctttaccccttttagacacttgtcttaagctgccttggttgaatgagaacagcagtgatagtaaggaaagttaagatgaaattaaaaaggccatagagtacatttttggtaaaccaaaatattgcttggtggcataaagccacagatccattccaaaaaaaaacgaaaaccgaaatgtggttttgctgtctgtcatgcagtctgtttcaactgtcagaaacatacgttgctttatgggatgtttttttcaagtctgaccgcagcttttaatttccttcattccacccacacctcctaccacacacccatgtatctagtactaatttataggcaatttgaatctaatgacataatcatcagcaagcaaaagggtcagcacttgtggcaaaagtttctttcttggtgtgctaattatcagttctacactcttggaaactctaaacagtcagaacacagtgattgtccttgttcatggacttttcagtctaagttagattgaggcctttaaaagatgggtttgaagtgctttgtatttttgctaaaaacataatattaaagaaaattaaacaatattcagtgaattttagaaagcaaaagaaagaaactcactcatgttcctacagttgtgccttaactgctgaccaggcagaggcatccctgtgtctccatcatatatgctgtgtctgatggagatcatgtcacccaaatgaaaaaatacttttctagtctaggttcaaagggtgatacataaaatacataccacaaaaaattaatgatacaatgaaacctcagatctttaaaattattattgacttattggtaactttacagtttcttcaactccttataggcaatacgatcctaaatatttttaaaaatctagtcctaattcagccagtaacttcctgtgacattggtaaattatttaacttttctgagtctcagttcctcatccataaaacaagggtctaggactggatttttactttttataacatgttggttcccaggcccctgatctgggccttaggcatcagtatttttctaaaagctacagaggtgattttgatgtacagcaaggttgaggaccagcgaactagagcagtgctgctcaaaattcaatgtgcatacaaatcactgaaatcagattctgtttctgtaggtctgggttggtgcatgatactctccatttctaacaaaaagatcaggtgatactgatactgctggtccactgaccacattttgagtagcaaggagccaaaacatctccaaaatgtcttccatttctacattgtatctccatggtatagtttatatagttcatgaagtctgtgtgctgcttgaatgagatctcacatttagtatgttaagattgatagtgtattatcttattatctgcacaacctctctttgcttaagctccatccagactcatgcatctttatttttgtttttgttttgtatttttttttttgggagattcatgcatctttgaaacaattcctcatattgaagtcattttaatagtaccttgctttagacagcctgacagctctagctggtggctggtgggttgttatatttgctgtagagaagagggttttcatttctttcttcttcgttcactccactccgacagatacttaggcttttgtattgtcacctttcctctcttcaacaggtaccctccccatattgacctcttgtattttggggtaaatgggcaaaaagaatcatgaagtgcattttgttttaattttgttctcatgcatgtacattctctgcagaaaatttattaagcgtaagtttaagggagcaaaactccaacttaaagctcaaacatacttaagctgtaacattttttaactctgtactttaaccatatcacttggcaattgtttttagaaataagaaaatactatttatagtttgtggttctttatttttgtttgctgcagctcaatctcacattggcaggcatcatgacccagtagaaagacccctgaatggtagtgtctggagagctgatattctaagccttcacccacccttaagtagtttttgcaactgtagacacttgggttctgtaagtaaaccagggaagagattaaggaatgctccatttcttagggctgtgttggagaatttggttaccttggaagaacatacctatcacctaaagtctaaggcaataagaaattatagtttgcgattggggaatgttgcttcggagcagtgacactcagagagtggtccatggactggtgcaggtctgtgaactatttcttaaagatgggtgaatgagataaggtacttgttacttgtgcaaaaattaactcactgttttcttcatagagaatgtctttatttttaaaaaacaaaacaaaaaactccattgaactaaacgtagttaaccgttatctttttgctgatcggtaacaatgtgggaactagctactttctgctttagaatacttaatcggtcaaaagttgtatcaggttattttataatttaagaatagaccaaagtagaagttcataaaatgtagcctaaaaaataaaaaagtaaatttaaaggcaagttaggttaaagataagaatcaaattcaaggtggtctggacgtatgtagcatagttaagtccaaggcagttaacacaggttcacaagtagtagcttcttacagaagctgtaagaagcactgcagtttgtgctttggttaatgcaaaacttgtttaaattcttctgagtgcttctaaattatctgagagaatttttgtttttcattttttgccatctactttttttttttttttttgagacggagtcttgctgtcacccaggctggagtgcagtggcacgatctcagctcactgcaggctctgcctcccgggttcacaccattctcctgcttcagcctcccaagtagctgggactacaggcgcccaccaccacgccatgctatttttttgtatttttagtagagacagggtttcaccgtgttagccaggatggtctcgatctcctgacctcgtgatccgcccgccctggcctcccaaagtgctgggattacaggcgtgaggaaccgcgcccggccgtttagtatctacttaatcgaagagaacatacctctgtaagtcacaaagaatttttattctgtagtcttaaatttcaggaccatgttattgtctgagaagctttaaaattaagcctgcctcgcctcctcctgcctgatgatattctttatactttactactatatataaaattcactgcatctagggcaagtatctgttcaccaagaaaagaggaagggagatccttcaccagtagcaaaacataaatactgagaatgtcttttctgggtaaaagtgcaagaaaagtagaaaaacagcaaattttctggggctaggcctgtgagctcactccttccaatcagtgaggaggcacttgtcttctgccactgtaccagtgagtctggcatccccatcccactttagatctgttccctagccacctcatggtccttgcagcccttcccctgtgtagtataaattagtaagggatgctttcttaattgagagacagaaagagccctaagcttgaatcgatacctaacaatacagccactcaatttgtagcactatctaatctcagttctgtcttaaaacagaactacttaccttaagggattttattcgtaagcctaccctcataaatatttctgtcagccagatatggggcagccattcttcccatttcatgattatagaaatggagtccagaatcattttggagtttgcttattaaagtcatggtttagctagtctagaaattagagtcacactaggatttgggactgcacagctgtatagttcgtaatatttggtgttcttttcagaatgttttgtcacttgattctgaattcttcccatgcctttccataattgtcccctaaccaaatcttgacacgagcctgtgatttccctattttaatgaatggtaggaagcaccatatcatccaggttttacacactggaatcattgattccgtactcccctggttgtctaatctagtgaagccacatagtctgctagttctccatgtgcagcctgcctcctttccttgctctcaccacggtcaccatcactgaccatcagaccttgttgtcatactagaggctatggtggtctccaggctttttgtctgcagcctttgccttctctgttctcttatctgggcttgctggacctcccggtctacttttatatctaccttttggtgttgggtcattttttagggtcccttctctgaccttggaaaatcctaccagtatttccaatatggctctgtcctcttctctgcttactttgcccttttatttaggtaattttattcactctgagtagatgaatctcagggttttttttctactagcccagacccttcctctgagaccattgtatgtcctcatttgccttgaatgtctcatagatacttaaactcaacaggtcccaaaatgacatagtccccccacaagcctgcttagtgattcctatctgaggaaatgccaccaccatccacccaatttctcaagccagaaacccatagaggcagctgattattgtccttccctcttattcattagccacacccagtcaaacatgaggtcttctggtatcaactcccagttactcttgcatttgtttacttttctccagctatatgatcatggtaaattaaccactgtatgattctttggctttatctgtaaaatggggacgagagtaatcctcttaaaattgttctgaacattaagtgaaatatctggcacagagcaagcgttccatgaatgttaggatggtgaacacccttggccaccatatttaaaaggactcactggcctggcgtggtggctcacgcctgtaatcccagcattttgggaggctgaggcaggcggatcacgaggtcaggagatcgagactatcctggctaacacggtgaaaccctgtctctactgaaaaagaaaaaaaaaaaaaaaaaaaaaaacttacccaggcgtggtggcatgtgcctgtaatctcagctgctcgggaggctgaggcaagagaattgcttgaacccagggggcggaggttgctgtgagctgagatcgtgccactgcactccagcctgggtgacagagcaagactccgtctcaaaaaaaaaaaaaagaaaaaaaaaaaagactcactacgagtaatgcaatagcctcctaactggtatgtcctggatagtgataattctggtccactaggttcttttggatctacttctccaccttcaccttgtgctgatactaccctttcacttttttatttgaacgtcagtgtcccatgctggtatggcaggctttgctgggaatggtcttacccttttctctgcccctttctcctttgtgtgtcagactcattttaccctcagttactcagggaaatagtcctctaaaaagcatttaaaaataccctgcattctgtatttgtttcaatgtctgtctcatttgctagattatggactctgtaagtcctatcttgttcctgtactgtttttttcagactataatgcagtatatggcagagtagcagacaataatcgaaagttatgaaattaatatggctcacattactctctccccaaagccagaagggttttcttcccctcctcactcttagatttccagggctcctctgtgtagtagctagggcacttaacacatggcgtttgttattgtgtttatttatatttgatcttccccccccagattataaacacctcgagttcagatcagttttgcattcagaactgctgtttctaccagagcttctagtttagagtaggagccagtaactgaaaacatcttgttgaatttcctaagtctgaggtgctttggaaattcattttgttcctattctgaaattatctttcatcctccatctttcctcttgtggtatgttttgtggttataaatctcttctttccgtccacaacattaaatataatcagtgccaagaggaggatggaggacagaaatgcactgtggtgtcttgacctgtctggtacttatcataactttcctaggaattgaccttgatgggcccttactgccttctaaataaagttcaaaccccttagtgtggcattcaagaccttccatagtctgaccccagtgaacctcttctgtccttattttccactctattttttattgcatgcatcctgtgctctagcttaatggttttcaatcctgcctgcacattagattcacctggggagctttaaaaactgaagccagggtcctgtctttggagattgtgagttaattcgtctggagtgaggcctgggtgtgggtgtttgtgaaaggtccactagtaatgctgatgtaaggccagggctagaaactactgacaagctcagtgtttcccacggaatatcatctcctctccgaattttgacgagaaagggtcccaaagtcaaagaagcttgagtagtaattgcttttaatgtgctcctttccaaagatgtacaacgaacactatcaaatgaaaggctctaagatacccaacagtaaagaaaactgtttaactttcttcatagtgtgtgaggtcgtctgataagagacacttttatgtatataatacttgttaataacatctgcaacatgtggtatagaaaatgtttttagccacttctcaacttttgagtcacttctttttttgtccttccctgatcatgtcatccaaatcagacccacctcctgccccagggctctctcttacacccccaattttgtcttcatagcacttctcagtatctgaaattcctctttatatacttgtatgtttgcttctgtctccctccacctatgatgtgagctccatgaccgcagggatttacttgtcttgttcacccctctgtcttcattcagcatctacaatagtcctgacaaatagtaagtagatatttaataagtatttgttgaatgggcaaaaatacacgggcagtaatgcattcgtggtttaggctttttctaaggtgcatttgtttaaatattttaaattgcctacagaatttaatttaaaagcaacctgaagtacattttaaaagtaactaggaatataggaacacaatagtttgctttacctttaattttctcaacctgcctagtcaagtattaaaaaagaagaaaacaaacaaaagtggatgtgagcctgattatagggaaaatgctgttatttttctgattatagagagttttcagtttgtggttggggacttgttttttctgatttctcagcctgtctcgggtggcttcccccagccattgaaggaacttgagtgaggaatcagtgaatggtagtggactttgtgtgcagtacaccaccccaacaacaaaaacacacaaaaacagacaaggaattaatttcagtaaaaacttcctaataattaaaaccctcctacagtgtgagagtattcagacaggtttgtcagggacagtggggaggcagtttgtgtatcagaatccgtatgtggaatcccaagttcggttgcctgctgctcaacacgtgatgctgcagcaactcttggaccttgttcagaagggatttgaatagcctgttctctctaggggtcctcatgctgcagctgtgcccatggctccccaagcctggctctaactgtgttgttttgagcagggttaataagcacgaactcgtctacacattgtagtgtgtataattcctgagctccaccaccacaccttgaattatcaggaactgaccttttacttcctgtggacctagtgatgccgtcgcatgagtaggccctttccttgggctattaaaatcatcaagttggttcactcgagataacattatagagatttctcatgaacgctgtatacaaggtgctctcctagggtgcttctaacaaatccatcagtccagtgggtcaggtgatcagcaatctggtataaataatctcaagaaggaggttgagctgcatttcctttattatattttaaaataatctttaaaacacatattttgccaaggtttcagataggaagctttaatcatttattcacccatcaggaattgtccagaatgaatttgcatttccttttgttgcacactatgataatttattattcttttgaatagcatggtatcctaaatgccagaaaagatgtgtgatgggaaactaaataaaccatatcagaatttaagcaagttttctggatagatattcctttatggttgatatattaatgtgctttagctacaggcataccttgttttactgggtcttgctttattgtgcttcacagagactgtttttcacaaattgaaggctgtagcaaccctgaatggagctgttcttccaatagcctgtgctcacttcgtgtctctgtgtcacattttggtaactctcacaatgtttcaaactttcttattattactttatctgttacatgatttgtggttagtgatctttgatgttactattgtaatagttttagagtgccgtgaactgtgcccccatcagacagcaaacttaattaatgtgtgtgttctgactgcttcatgctattcccccttctttccctctcctcaggcttccccattctctgagacaacagtattgaaattaggccaattaataaccctacacgggagggcctctaagtgtacaaatgagaggaagagtctcacatctctcactttaaatcaaaatctagaaatgattaaccttagagtggaaggcatgtcgaaagccaatgagccaaaagctaggtgcgttgtgcccaacagccaagttataaatgcaagtaaaaagaagttaaaggaaattaaaagtgctactccagtggtaagaaaatgaaacagccttattgctgaaatagggatagttttagtggtctggatagaagctcaaaccagccataatattcccttaagccaaagcctaatccagagcaaaacccctcactctcttcaattctatgaaggctgagagagatgagaaagctgcagaagaaaggtttgaagctagcagaggttggttcattaagtttaatgaaagaaaccatctccataatgtgaaagtacaaagtgaagcggcaagtactgatgtggaatctgcagcaagttatctagaagatctagctaagatcattgatgaaggtggctacaccaaacaacagatttgcagtgtggataagacagccttctattggaagaagatgccatctaggactttcatagctagagaagagatgtcagtgactggcctcaaatcttcaaaggacagacagactcccttgttatgtgactaatgcagctggtgactttaacttgaagccaatgctcatttatcattccaaaaatcctagcgcctctaagaattatgctaaatctaccctgcctgtgttctataaatggaactacaaagcctgggtgacagcacagctgtttatagcatggtttactgaatattttaatcccattgttgagacctactgctcagaaaaaaagatttctttcaaaatattactgcctattaatggtgtacctagtcacccaagagctctgatggagatgtacaaggagataatgttttcatgcctgctaataattctgtagcccgtggatcaaggagtaatttcaacttttaagatttactatttaagaaatacattttgtaaggctgtagctgccatagataatgattcttctggtgaatctgagcaaggtaaattgaaaaccttctggaaaggattagccattctagatgccgttaagaacatttgtggttcatgggaggaggtcaaaataccaacattaataagaatttggaagaagttgattccaaccctcatggatgcctttggaggggttcaagaccctgaggatgttctttgggggtggaccttgaagatgtgactgaattgctgcaatctcatgataaaacttgaatggatgaggagttgctgcttatggatgagcaaagaaagtagtttcttgagatggaatatacttctggtgaagatgctgtgaacactgttgaaatgaccacaaagaatttgaatattacatcaacttagttgataaagcagtggcagagtttgagaggattgactcctctgaaatttcaaagaaattctgtgagtaaaatgctgtcaaacagcatcacatactacagagaagttctttgggaaggaaaagacccccagtgctaacaagcttaattattgtctgtttttgagaaaatgtcatagccctccaactttcagcaaccaccaccctgattagccatcagtattgagccaaaaccctctgtcagcaaaaagatcatggctcactgaaagctcagataatggttaacattttctagcaataaagtatttttaaattatggtgtattgtgtgtgtgttttttttaagacataatgctacttcacacttaaactatagtacaaacataacttttatgtttgtactatactgtagtacacacatgtactgggaaaccaaaaaatttgtgtgactcgctttattgtagcattcactttattgttgtggtctggaactgaacccacagtatctcttgtgtatgcctgtattcccaaacaattgtagcgtgcctgcaaaagaattcatgagattctaaccacctaaactgtagtttcttctatttattcaacaaaagcgtattgagtgtctttgacataccagccactggggctataagacaaagctatctgccatggagcctacattctctagaaccttactactaggggtctggtctgtggaccagcattttcagcatcaccttaaaatttgttggaagtatagactctgaggcccttttccaatttggattttaacatttccaggtgattagtatgtgcattacagtttgagaagcactagtctagtccatgtaaacaaaaatatatatgagataatttcagatgattacagatgctgtcacgagaagacaaaactataatggccagagagtgggaggaggacgagtaattgaggatggtaagtgaaagcatcagagggagtgtcctgtgggctgagacttaaatgatgggtggagatgagccatgggaagatctggggaaggtggttccaggtagagggaacagcaagtgcaaatgctaggaagagggactgtctccttgttccttgctatgccctctgctctagccaggccagggcccatttattcacttgctgactgtgcctgcacctgaaagtgtggtggaagtgtaatggcagagtggtatctcagtaaacaggaaaaggccaaaacttgggttttgataagagcagctactcatagtgagaaaacaatcaaagggattgtaaggatgttttggtaatgacagcttcaaagaattggaattttatataattgggaggagggagaagaaaccactagaggccatatgctggaattggaagaagaggaaagaaaatactgagaaatgcaggatagatggagatttcctgaaaaacagagaaaagaagtaaacagacaaggaagctttagcctcgcctgagaggaaagaccaaaaaatagagcatggctctctgtataaaaggtggcttgtttccctgaaggtaggcatccttgatgagaactgagtaaggacgattagtctgttttgttttgttttattcctgtatccaaaattcctttgtctttaggtatttctcacatcattttgatcatacatatatgttgggaaaaatcaagatgaataatctccgtttactctgggaacaaggagtatcttcttccctctactgtggctaagtatggaaaagcttaattgtaaatcagcattcaaagacaaccaaacatttatttatgtcagtaggaaagaggaaggtgtgtgagagagagaaggaggaggaggaagaagaggaggggagggagagagaagagaaataaaatgtaaagcaggcagctggcaaggcttgctctgacacactggctgaggaaagagctattggtagaacttggatgtcttagtaatcagagtaatcaggttctctgaccggttccaccttgttctgtgcaggctgaaagtaagctctctagagaaagtaattttctttctctgctccttctgacatcccacttttccctcccatccttcctttctattttccctgcctctcccctctggtagaactgagtataaccgtggtaacattggttacagtgttttctagacttgagaactgaaatgatttgaccttgtacaagtaactggatgtctggcacaatgatcgtcattctcaaccttgataatttatctctctcgatcactgttaacattggagcagtatttaaacacaataactagagcccagaatatgcatgtaggcgaataggcacctatctaggatttctcttaaagatatacctctagagagctcacatggtaggaggaaaaagagggtgctcttttttttctttaaccattgtaaaaatgcttcagtaaaatatagcttgagctctggggatagactggaatagtaccatgaaatgtgggtataccgtgattctcttcaagaaggactttgttctgcttattcccacatgagcaccacaaacagtagccccatgtatcttgttaggacaaataaatgggacacttgagaatatccagttaactgagccgcacattgggtactttaaagcacacttaacatgcagtaaaatagcataaatatgagttcaaaacacaaaccaagttgacattgcttgtggtatcatcattagtagaatcattgctttggttaaactccctgggggaagcagtggaagggaggtatgggggttgtgaaaagagattcaatattgacactttcacattgtttaagatgatacaaattaactactctgttatagacagtatccttttctcactggagtaagtaggatgggcagagcttttaaaaacagcaagtcttagttttaatcagtcctttaggaacctgatagatggcctactaattcgattcttataatgttatcaactttgttttattgctttattaagcagtagtagttgttttttttttttttttttttttttttttttttttttttaacaagcacttgaactgaaataaagcttaggcatgtggtttaccaacttgctagctatactgacgatacctttggtctaaatctttaagctttattccagtcaggcttttttttttttttaagaatacctaagattagtgtgtgtgtgttttttttttttttttaaatactttttaagttctagggtgcatgtgcacaacgtgcaggtttgttacataggtatatatgtgccatgtggtttgctgcagccatcaactcgtcatttacattaggtatttctcctaatgctatccctcccccagtcccccactccccaacaggccctgatgtgtaatgttccctgccctgtgtccatgtgttctcattgttcagttcccacctatgagtgagaacatgtggtgtctggttttctgtccttgtgatagtttgcttagaatgatgatttccagcttcaaccatgtctctgcaaaggacatgaactcgtctttttttatggctgcatagtattccatggtgtatatgtaccacattttcttaatccagtctatcattgatggacatttggattggtcccaagtctttgctactgtgaatagtgctgcagtaaacatatgtgtgcatgtgtctttatagtagcatgatttataatcctttgggtatatacccagtaatgggatcactgggtcaagtggtatttccagctctagatccttgaggactcgccacactgtcctccacaatggttgaactaatttacactcccacacagtgtaaaagccttcctatttctccacatcatctccagcacctgttgtttcctgactttttaatgatccccactctaactggtgtgagatggtatctcattgtggttttgatttgcatttctctgatgaccagtgatgagcattttttcatatgtctgttgactgcataaatgtcttcttttgcgaagtgtctgttcatatcctttgcccactttttgatggggttgtttgtttttttcttgtaaatttgtttaagttctttgtagattctggatattagccttttgtcaggtgggtagattgcaaaaattttctcccattctgtaggttgcctgttcactctgatggtagtttcttttgccgtgtagaagctctttagtttaattagatcccatttgtcaattttggcttctgttgccattgcttttggtgttttagtcatgaagtctttgcccatgccagtgttctgaatggtattgcctaggttttcttctgaggtttttatggtgttaggtcttacacttaagtctttcatccatcttgagttaatttttatgtaaggtgtaaggaagggatccagtttcagctttctacatatggctatccagttttcccagcaccatttattaaatggggaatcctttccccattgcttgtttttgtcaggtttgtcaaaggtcagatggttggttataggtgtgtggtgttatttctgaggcctctgtgctgttccattggtctatatctctgttttggtaccagtaccatgctgttttggtaccagtaccatgctgttttggttactgtagccttgtagtatagtttgaaatcaggtagcatggtgcctccagctttgttctttttgcttaggattgtcttggcaatgcgggctttttttttggttccatatgaactttaaagtagttttttccaattctgagactttgctgaagttgcttatcagcttatggagattttgggctgagacgatggggttttctaaatatacaatcatgtcatctgcaaacagagacaatttgactttacctaattgaacaccctttatttctttctcttgcctgtttgccctggccagaacttccaacactatgttgaataggagttaatagctaagattagttttatgtgttacatgttattaacacttttgtaaaattgatttttgataaggtaaaaatggagttgtcagtttagagaaatagtactacttgaaaatttttccttatatttagtctggattttaagttagaatttctcattagtcctctgactttttaatctagggtcaggcaagatcagtttcagaagttgtacagtttctttagaaaatttggaacaaatcaagatattttctgattgaaattttaaagaattgcagtctttgttctctagtggtgaagtgaagtgataaggttgcaagatttatttgtgtttattccaaaaagtatttcaggcagggtaagtaggacttctttgtcacctttttaaaaaatgttgatattaaagtggatgaatgtatgttcttgataaacattcaataaaataaatagattcatctttaaaaaaattttggcaagaaactgctgtacagaaaacgaatggtaaaaagttattcttcaggaatgtttcctaaaactgtaattgctttaagttagctgctgaaatggtttcctaataacgctttgttattctgttttatttcaacaatacatatgtagtaatgttgttcctattttgatgagagacaaacccatcaaacagtttttaaaatcaacaattgcttttgatatatccgtttgattactaaaataaagctattggtactttcacccaagtttattatgtttttaaaataaaatttatgtctttttaaggaaatcatataggctgaaatgatctaaataaaaatcagatttttattgtatcaggtctatttcagggaatgtagttaaattcaggtatagggttaactaagtttttgtcttttaaatgattagtaaaatttgttatgtgataaaggaaatatgtatttggtattgtgtgcgttagtatttgttactttttaacctagtgattgagttacagctttcttttcaacacatgacatcactttcccatgatgtaagatagatgataaattttccaatgattcttgagttttggagtatgaagaaataaaggataaaagattcttttctgtgttttcctgtttcgttactacctggtcatgctcctaggccactgtccatcagtactgtagagttagcctgttgacagtcacatgtcatgtgttgagtgcgtagccaagggattttcgtagaatgccttttttgtctttacatttttctgagatattttatccaaaccaaggttttctttagcagggatggtgatcatttttattttatttatttttttgttggagaatggtgtaaaggtgggtaattttgagagagaggaaatagaatggtagtgagttgagggtaggaaaatacatctgcaacttttattgttttttaaatgagcatcttgatagggaagatagaatggaattgtcaaaaattgttaatgtgtttgacaaagtgtggctgtcagtatgatctttttgttacattttgacatgaacaattgtccttttattggggctgttaatgctattttagaatatcatgagcatctgaaggcaatagtttagcagtgtccataaagcatcaaataccattataatatctagtaaccctaacagcaatatttcagaatccctgcctgtttaaatgggctatctgtgaatgtacttgctcagggatgcatgacccacatcacctataaatttgattggaagctaacagtactggcgtagcctgatggatagcagattagagccctgattaaccatgtgattcaaagactgggaatatattgtctaagcaagattcatcagatgcaatcagaatttcaagtggtcagatgaaattcaaatgtgtgttgtggcttttcctcccctattgcttttcctcctaggttgcctttttttccttctttccccaaagctgaaaaatacttctttgatgaatctgctccttaccctaaagctgtctgtctgttattcatcagaaagcaggtcgcagttcagtgagcagaagaaaagattttaatagaagctgtgccaagggctgtaatgcatcattttagggccctaattacattacaatgacaaatatcaatggtgacaacagcaataacctacatcctttaatggctgtgctggaaaaggagtttgggccccacgccattatattagactcagtttcaaaacataggccattagaagtgtgtgtccacagtgttattggctgatcgctaaagcccagtggaaaggcctgtaaataaatgatgcctccctaaagctgggtcctgtgggacaaaagaggcgaaattagatgaccatgggagcagcagtgtttccgaggcaactttagatttcaaagtgaagaatgacctgcttaattttatgaaatcacacacacaccccacccccccactgccaattagcctgaccatgaaaatccattggcatgacaacttaaagaaattaagaagtcttttaaacaaaaggagatctttaacggaagtttggaaggtttctgccctcccgtttctgttgtgtgtgtgttaacctatgtgattgaataaaaaggctcttctcctttttacatttatttttaagaaaatgtagaatttttttaaaaaatagttgctcagacttaatacagcctaggtccaaaattttatttcaccagatgaataagtttccttagagtcgtttttattgcctagattatgtaggcgaactaaagaactcagttttcttatgtgcccacacatttttcagccctcctagcaagggactattttatttatgtaaacaacataatgacgaaaatatgcttggcagatggttctaagcattagaatcatcagtttggtctgccccaaagtgtctcattatcttttattctctccccctccacctctccctgcaaaaagcttaacaaccaaatgcatttgagatgctgtactttcagcctggtgaatgctactctatttttattgctcaccctggaatttcaccccataaccactgtggtatgttcgtccaggtggagagtggtttggtgattcccattgcagctcttcatggtggcttaagcattcttaaaggatggctaaatgctccatggggccagtgcagtaaattaaatcaggtcagcacagttgggtccttattcactgcagcttattggtgctgggtttttgtccatactgttaggaatgcaggctggaatggaaagcttggatttgaaacttcatggtgaatttgtgttttcttttggctggtaaagtttttaaggtgctggcatttaaaagattgcatagctacacagttagaagggttgctgatgaaagaaggaagcctagattgcacaagtagagtgtcactgtcattctggtaatgacttggcaagaaaaggcattttgggcctcacataaaatgaggaactgaccctggatggaatttaagaatgtcttagggatagtaattgctttacattttctgcctttcaattcttcttagctctctttcctccattccatcattaaaatataaactattttgtatgtacgtgtattaaaaaaaactgtgtatttatacatcacaaaatatacaaggcaccatctgaaaaatacaaattaagataaacattggtaaaactgtgagtaactttttaaagaaaacatgtagtggtggtttttcttttaacttactgtagcatcttattggtttaaaatgtctgtacttataaaaattattagagaatagactgttctttgacattgttgggacttttgcatatccacagtaaaaaaaaaaaaaaaaaaaaaaagttcccaaggatagtttccagatacatacagattgcttcctgctaagtgtaataagattttagcatatctcaacctctgcacactgaaaaccttggtaggacacatttggaaatttttatggttgaagaaaacattttgttctccaagaatttgtaagaatccgaattagccaacttttttgggttgtttgggtgctgctgtttcagaagtttagggtcttgagtttaaaatcacagcaccaatgtttttaaagcaaaggccacaaatatagaaatccaatgatttgctaattgatggagttgagatgtaggaaagaatgtatctttacttatctaaattcttaagacttagaagactgcaggttttatggaaaacattagtatgagcaagggtcctggtgaaggctgttgaaaactgatttccagtcatggaaattaaattccattttatattgccctgatgcttgaaggttaactttttaagatgaatgctggttaataaattgtgctgttaatgtggcactgttgtcactgcttccttttaatgggcttactgatgagatagttttcctcttccttaggaaatatgccagccaaattataaagtatgttttaatatcatcctgttaatatttggggaatctgtaaccagctgactgttctctttattgctttcctttcccttattttttgcaggcagagattgtcaagaggctgaatgctatctgtgcacaagtcattcctttcctgtcccaagaggtaaggtagttgattttaggcactggactagaagttgccattttagtggttttgcagaaaagggattgtagaactgactctctggccttgccagtctcttggtgtttgtattttattttcatttctaagaaacagtgttctcactccaacttgtataccttagtaactttctgtgggatataatttatatgtgtttacataatggaatattttctagttgggctaagcaaaattcagtcgttaaaatattttgctatctttgtcgtgttgctcagaattatgcttgtttgtcataatggtacctaatagggtagactgaaaaattgccaggaaaacaggagcttactctgtactattgtcattgggcattaagaattggcagaagacatatcaaatggaaagactttttgtagtaaacaaactaatgaagcttttggctagctacttttaaacatttacttcttgtttcctgattaagtctttatattattgtgcttttgggaaaagacctgcaagatgaactcattgaactcgtttctctgagtgccacttttctcaaaattaggctttggtgatggtaggcttagcacattgctaaggcctggcatgcggctcactagttctcttgctcacctacaggggaagtgcatgccatcagcaaacaggcacaggttggaataaagcgatgcatttctagtgcttgttggcttccttgtggtttttttttctctccctgcttacttttggtagttacaaagttgaagtgagaatactggaaaaagataattttttgcttctggattactgaatgccttcatttgctcaggtaagatccactctaagaaggaaggagctaatgaaatatctgcatgtcttgtagccgcaatactttgtgctgtgggctgagaaggcacagaggcacttttcttcctaccctttcagttgttctataagtgtgttgtgtcactgcttttcaggagagaggttcattcacctgcttgccagcgggcatgtgccaatgttatgtggccaatatttgagcctgcatgtgtattatagatatgcagattgctgtatatgatttttttctttggtctggactgggttagacttgagtaactatgggtacccttcataggtatatactggggagggggcactcatattcacaaatcttgttgacactctgaattcacatgctcttttgggtcttgataaacaaagggtatgttgtcttttctcctcctttagctgtgaccacaaaacctaccaccagtcatgtccccatttgcctgtttttacttaggatttgcttatggctagattagatggcttggtgaatgagagtcaaggggtgtatctgcatttcttttggaaacctgactgccccctgcctgatccagactagtgtgtattttttactttaagcagctctgctttatggagatggagaatgggaagaatgtgtgacctacagagctgtaaccaggctggggtgtcatgttctaaggtgacagggaaaagttcgaattatccctggggtggtattagactttgggcctctgtaggcacagacccctgtatatgatcgctggtatggctttggtctcatcacatttctgcaggatctgtgggttgtgttcagaagtagaaggttgtcttggggatgttgatgaagctgatttgccaatgagttgttttcccacatgaattatgttgtttgtgtgagcaggcccagtgggaacagaatgtataatggtagtggtgctgagcaagactggactgaaattaattgtctaaggaagttgtacctgtaggtgaaagccatggggagatactgacaactcatttgctctagtctgggaagaaaggtgtcatacttaactgttgtcataccacttaactatttatttcccaaatactttgacatttcttggttgaaatccttgactcacgtataatgatttatgccaagcttgtgcaaccccagggcctgtgggccacatgtggcccaggatagctttgaaagtggcccaacacaaattttaaactttcttaaaacagtatgagatttttctttgcaattttttttaagctcatcagttatcgttagtgtattttatgtgtagcccacataaaatgggatgtgtgtgtgatttcttcttccagtgtggcccagggaagccaaaagattggacacccgtgatctatgccatggttttctaaatgctagttctgtgtatatattttcttttgcttactttagatttaatttactcatctttttctagtttcctaaggtatgtgtgtatcttttattgtgtgagacacaaacatgtttgtttccttcaaatcagggcatctctgatgttttttatctgaacatcgtccaccttgtttcttcttctgtgcattctgtgagcattggactccttgcttctgccctgaagccagatggaccataatctggagggaggggaggagcaggttagtagaggaagatgaattctgtttcctgtctcttcagaggcatggaaaatcactcttgcatggctgtgagcatcactgtgccaggactgaaggctcttaatctgatcttttaacaccggctctctgtgtgacagtctcgctaccaaaacggcagctgctgcattagaatttattttaaaatgtttttatttaaaaattaaatgatcgtatttaggaaaaagcaaaacaattcctgaagagtagtgcataagctaacagaacattggctggagcgattgtgagcatctgaagtcaggctttttggagtttgacaggaacaaggggtatatttacatactgttagatgaagtctctttttaatttagcccccatgtgttgattaatatacctgcttaatattgcttgcgtctggtttaccgcatttttttaaacttaaaaaaactatatagtactgaatgataactattaaatttagctttaacttcaagactttttctttttagaaatgagttgtataattgtgttcagaagtacttgaagtgtgtctgtatatgaaaatcacagaaaaatattttcctattagagtttactaaaacatttaaaaatattaaagccaatatatactttaataatgtgctgttgcactcacgtacaactgcttccagcgttacaggcatttgacaaagatattgccaactcttgtcattaaaagtgagtactcatcacttggagttcatagaatttcacaggattctcaatatcagaatttagaaaaaccttgtgaaccctcatctgtcccaagctgttcttttctctcacttcactttttagcttttaggaatggataagactcaaatttattcttcaaaaagccatctcaaggtggtaaacgggaagctcttttctttccctatttcggtctcatttgcaggggaagaactataaatatcaactctgagttggcagttccataaacaagagatgccaggatgatgacagttggatctgggtcctggcctccctattacaaatcgtgtggtttactctaactgggctaagctgggtgacctttagcaagtgatgtgcctctctaagcctcagtttcctcatctgtatgatgaagttaatcatagcgtgaaacacatccaatgtctgtgaagattacttgggattatacccaggtagcttagcacacaataagcacctactgccgttgactagtgggattaactacagtagcagcagtggagctctgtctcctcttgggaggagctagaaccagccctccctcccttttctaatcattgcatttgggaagaatgtgaattgattatcttcctctctaatgtccttatagaagaaaaaatgaaaattaaaagtgaacccagggccttgaactagctaaaaatctatgtttttgtttccattggcaattttgggatatggcttatagacccttagacctcagtgggtccttagtaaaactgaggattgccaataaatattgtattgcttccagtatcccagtaacaactcctcctccatcccccaattccaggaacatatctatgtagagagtctaaggtggacctaaaactctacatcactgttacaccctggcagtaagggacagcatttctgctaatttagaattgggctagctctccctcttcactagctttgcattgcaaagttgatctctctaagccttagtattcctgtagaataaggagagtaagcccacctttacaatgtgtattatatgtatcaaaatgtaacagacttggcatagggagtgccgtttccccacctgctcttttcctattttacttccagggaaatagattctatttcaggttatttggggtcctaagacatttggaaaggaatgacttagtaaaaactgggaagagttcaaggtaatatttcaaacgagctggctggcagtcttcctgcagagttagctaggccttgcagctccagtagctgcttccaacgatggacatttagctccacacaggttatctttcaggaggaagggaatttttttttttttaagtaaaccagtaggtatttttcttaacctgttagattaagcaggaaatattgtgcacttagttgaggacctgttggaggatagttgtgttttttgtactcttgtttccctataaggatcacttttaagatagggtatgtttcacagtgatccacaaggtgttcctaagatctttgagaacctcaaactcttgaaaagcagtaggtcagtaggtgaaaagtttattacgttatagttgaaaattattctccagggtacagttgtatttttcagaaacttgtcgcttcagtaacaaggagcacattcattggaagaggcacattaggcaagaggcaatgtaataaaagctggaggtcagccagacccaggactaaatcttggctcagccacttgctttctttaaaatgtggagcaaaatacttaacttttctgggctgcagtttgcttatcggtataatgggatacctgtactgtaggatttttatatgaggattcgtgacagtgtaaaaggacctcactgaatgtttggctgctttaacagagatcaaaggaacagtggttttttcaaggaaaaaaaaaaaaaagcttgtttctctctcatgtaatagtaacagttgacagcgaagccatctatagctaatttggtgactccatgatgttgtgaattcggttccttttatatcgacgttcatcatccttgcaccattgtgtcttgccccagcgtcagctggcaggaaagagaaaggaatgggcaagttatttccttttaaggttgccctctttgcagtggccagcacttagttacctgcccacagatagttgtaagggagatacagaaatgtagtcttagctgagtgaccattatgcccccctaaaacttacaccagtgtaagagaagggatactgggggacaactgccacttgcttccagacataatgctatgcacaaaataaaaattatggctattgttactgctaatggtttatctttacataacaaactctagctttgactatgtaattagcacatctcatgtttttcagttacataagatataaaataatgcatagttcttgttatagaagtctcttccttaccattcgaatgttggagaagagtcacccatcaggtattatttatcattcatacattcataggggatggaaaagaacctacatgaacagtatggcctctgtgggctgtctatatttgtgtttcttatgaccagtggcttcctaattctcatttattaaactcatggtcattgttacctttagagaaatggcattcatttttaaccttgttattagcagacttgtttctagtcactgggtgccaaggaggatggacattttcctccttctacactcctgtaattccatgactgttttttttggtggtggtggttgttttttgagtcgaaacagaagccgagctgctcagaggctgatggaggagccctgcaggctagtcctcacagcaatgatgaggagcacacctgggggcctgcacttgcacatgaacggagctgtttttcccttgcatcagttattttaagaaaatattggtttaacaaatgaaataaagaagacgttattctttttacaatatttaacaatagttctctgatcattagaatattgagaatataaaagggaaattaggacctaaaaatggaaaccttccatttttatacttattttacctggggaaaagggaacttccataccaacctgaatgctttctggtgcaaatttaattttaacttaaaacttggtttgtattgccctgttagcttttctaacacgtagtaccaagtagtgtttgggcactctccattgcatttatttggtagaaaataatagtcaattacataatagtgataatatgagtttatttgaattataaatccaacaggctagaaaagctagtcacatcaaacgatacataaactcctgttttggacatgccataaatttggtccatgtaatttgatggaaaacaaaccccttctactacattgtgatatatgagtatatctcagatgctgtttacttgggcatctcggttaatatggtactgaattacttggagccacattttgcatgtatagaataattgtgaaatgaaagttgaaaaatgtgatcagtcactttcatattgtgccttcgggaggaaatgaagaaaatacagtggttatatgcactggtggaagtgttatcgccttacagtcgtgccaggttaacttgtcttattgcttgttaactttgcgaggaatcaatggcttgtgataacaggtttgatataggagagcatggttaaaattgcagagatcccctggcaagtatgcagtgacatccctaagaccatcttcagaaagtgcttgtgttaagtgccagcagcctgcacagggcacgtctgcttcccagttggagccattttgtcagtcttggtaatatgttatgacagtgccatatatcggaagaatgtcctaaaatgaataatagacatggattggggcttctggggatttggcccagttttctgattttcacattaggttgtgggcatgggtaacttttcatttaaaaaatatatattttctcataatactgaatgagccatcagagagcgtaattctgtcccatattccgtggttgactgattggcttgctgtacctgaccatgtattttggtgacagttggctgcttggtgagattcatctggtggcatcatggcctgtttgacctcaagaagtgaaagatgattctcaggaggtagaacttttttcctgtggtttaaatgtgggtctctatccaaaggcagcaatgccaacctttatctgtatgtctcaacaaattaatgagtgtttgagaactgactcatttatttgacttttagttaggtagtgattagattattattagtggagctaagtttgaaggtaccttgagtagagctgcattgtccaatacagtagtagctatgtaaagttgaataaaattaaaagttcagtttcttagttactctagctacatttcaagtgctcagtatccactcatatgtggctagtggctgtcatattattagcacagatacagaacatttccaacattgcccaaagttctgttggacagcagtgaatttgtagagcttacctatccgtgaagaatgccctgtccccatgtaagtgagagtggagaaggcaaggccaggtaggcagtcagtaatgtgctcctaagagctttaatcccatgttccacagctaaaattgtttgggaagccaggtatacttatttactctctctaagctttgtggtgctgagataacctgcagtttaccgggtatttgccaaattaaacctgtgtttgtgtacgtgtatgtatgtgtctaagtaatatctaaagtaatatctaatttcttgggtgactgtgttgggctgttcttgcattgctataaagaaatacctgagactgggtaatttataaagaaaaggctttattggctcatggttctgtaggctgcacaagcatggcaccaacattacttggcttctggggaggactcagggagctttttttactcatgatggaaggcgaagtggtgaaagcagaaaaggagagagagattgagggggaggtgtcatacactttttaagggccagatattgtgagaactcactctctgttgcgaagacaacatcaggccatgaaggattcacccccatgacccagacacctcccaccaggccccacctccagcattgggaattacaattcaatgtgagattggagttgggacaaatatgcaaactgtatcagattaatgtttctttgaatactgtataggaaaggctgatttggggagattgggttaaatttaagttgatttgtactagcaaatttaatagagttgctgaaaaaggcttttagtgggattttttatcctgacttagcagacatggagcgacactttcacttgaatttgatctgcttggccatacctggagtaatgtgcactacaaggagactagccagaaggatggatgagtgggctagagcccatgacacagagaaattgttgagtgaccttaggatggttaacctagaagagataaaattgagaacatgcattatgcattgtcatatacttggagtgtcagtcaatggaggagaatttaaagacaaaactgggtccagtggggaagaattaatggcagggtagatttcaacttagtattagggctcattatcccaaaatggaaaaagcttgtccatgaggtagtgaattgcctttcacaggaggtgatcaaggagagactggttagggtgtgacagaggagattgattcattggatagagtagtggcctttgggctgtggttggtactgtagttccgccatcccaatctgctcagccccggcagtgtttagaaatttgcgtgcttttggtgatagggagagtcttttgttgattggttggttggttgattgttaatagtgcctggggtactctggcatctgggtctcatggtctctaaaggccttttccagttctgaatttctatgagtggcttcttaagtacatgtggctaatggcttctattagccaaaagggcatttggtccaagttcgggcctaagtatctttcaccctagaatattgcagccctctaactgtttacccttcaatctggtttacctctctgccatccaccttctttacttttcccagatccatcttactcaaatgcagaactgatagcacatagctgcttaaaattttttaataacatctcatttcctaccaggataaagtccaacttttttgcatgtcatgcaaagccctttgctgtttggcctcctcctgtcttgccagaattcatttcccactaatacttggttctttaaagcatttccatgctacactcatgtcttcatccattttcctttatttttctttgtgtgcacaccctttccactttaaagtgttcttgcttatgtgtcttatcatacccaagaaggccctatgaaattctactctgcttgtctgcagctgtgtcccctacctgctctccctcttccagccacacagacattcttgctcttcctataaggcccctacccagttctcttccctttgcctggaattcttttatcctcattcttcatctacagaattcctggaaatccttcaggtctcagttgtcaggtcagcttcctaagggaatcttcccctagccccaatattagattaagatatttccctgataaatgattgggtagcatcctgtaatttttcttatggaaattatcctccagttgtaattatagagccttttgagcattaattcactgactgttttccttgatagagtttaaattctatgagatcaaagactatggttcttgttccttactctaaccttagtatctccctaccacagtgcctggtgccatagtaggtgcttaataaatatttgaatgaatggatgaaaaaaacaaagccttcccagatgccgcgggaagtgcgctggccatttcctcctaaaacttctttctgttttatatcctgtattcctctaagatgtgctctgtgtatgagttcatcacgtgagaagcagggccattggtcttactttcacctctccacatgttggagactttaattaatattgttcattatgagaatcctagtttattttgtttcattttatatctatctctacccttatactcttttactaccccagtcaatatggggagtactttttaaatgtttttttaaaattttaatttataaaattttgaagcatactttagagagagaatatactgaacctacaggtacccatactaaacatcggcagtaatcagcattttgtctttttgtctcatttattccttaggggagttcttttgtttttgttttattattatttttttttaattctgaggtgtactatagctttttattacggttttttattagaagtactgcatctgttgctgtgccctaaaacattggcatgacaggtattctcatcataataccttctgagaaatatatattaaacacctactatacacatattactggtttgttaaggtctgctttttagcaggcttttttggacttatgagctggtattattttagtttcttatagaaaaaatatattagtactttgtctgaacaaatgccagaaataattttatgatgatggaagtaaggcaagtgatttaatgtacagaatttcattttactggccctttcccctgcaaccatgtttgtattgcttaaatcacttttttaaaaaaattatttttactgaggtataatttacacaccataaaattccctagttttaagtgtatggttcaatacttttcagtaactttacagagtcgtataaccatcaccacaatctaagggttttttttttttttttttagaatttttttaaaattgtaaagtacagcattttaaagaataaataattgggcatttgttttgtctcttcaaaatcccagttagaggtcccctctcttacccttggcttactaatatattcttagtggcatttcatttggtggtactggtggcgcattcaaacaggacacttgtatctgagtgagcagctggagcagtaagaatgacaacacttggtctctgcagattggctggacccaccactctggtgctagtgctggcttggtggctgagggaacaagcaggaagtagaagaggaaatgagatgtgggtggagtgggaagagaggacagattggggaggggagggaaagtggaagacaaggcagacataatgggaaagccctcatagttctaagaagatgtgaaaaacttgctgtttttttctgagtgagagcttacttgttaaaacccgaaaatggaaaaaaaaaaaaaaaaagcctcctgggtcagtttatgggagtactttgggcttccttgcatgttcatttttctcttttgtgtgtaatcttttgacccttcttcctgtttgggttttaattttctcaccttccctggtgggtgcttcctcaggctgtggcgtaatgttacatggtgtggctgagtgagctaatatattagggtgtttctggtgctttcagagcacacaggggaggaggcattgtttgccttagggagcttctattcaaaaggtccttaaacagtgaatgattcatgggttgtaagcagaaatagggaagtagaattctgaactgcaggtaaagttcagatatcagcccacagccattgccatcaaaaagaagaagctgaatcatgacttccattgtcattttagctttatagcaggagtttctttaggctgtcagagttatggctcactggtgtgcgtttccggttttctgaaaaaatgcacttgattttaatgccagtgcggaaagatatcccctgctgcctaaggcatctttgcccattttagcaattggaatctagttcatgaagtaagtgttgaacagtcttcatgctagaatggcactaagtagatgtattttccatatctccgtctcatggaaactattctttgaatacttgcagataatatttcaacaatagggagaattggtagagtaagagctttaaaacttttgttgaatgaatgaatgcgtgagtagaatgaatgatacctgtgttggatgtgacttaagtgtggtcctttgtttcagttccgaagttttaagtttcttttaaatctatttcttttctttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcgccgttttagccgggatggtctcgatctcctgacctcgtgatccgcccgcctcggcctcccaaagtgctgggattacaggcgtgagccaccgcgcccggccttaaatctatttcttttaagatttaaaagaaatacctgaagttcttaaacttgagttctatgtttttgatcgcttttaaatatgcagcccttcatgataggagttaaaacacgaacaatttgcacatttccagaagaaacatgtttgttgtattctgtatgtccttccggtgtctacactaactgatatcattgttgagtataggaaagtaaaaggtggaaaatcccataaacatttctatcctacttttttttttgttttccaagtactgccatttctcaccatctagagaatcaaattgtcttcaatgtgaacatgagctctgtgtttggcacatagtaagtgctcaacatacatacatggtcaggttggctttaggggaacctgaaatgacaattgctggccattttattgactgtgcccttctattccttctaatattttcaaaatcccttaagacttttacttgcttcagagaaagaaatttttttcttccatgttagcaaatattataaggaataaaagaatggaatggacatatctataaatagacttttatatttatataaaataaataaatatatatttatatatattttgggattgcttcttaagctcctgctttgaaaatggaatgcatacaatttaaaaacattaaaaagtatatagtttaataatcagagtctattaaaagcttaagattctatggtctattatttgacatttttcttcccattagtcatagacacaaaatacacatttctattaggaaaccaagagtgaaaacatcacattgtaaataattaaagtcgtttccttttccacctggcctccccactccccttacacagctcagaggtggaaataatggtcaccctagttaatctcagtaactatatttgaggattttggaatgggggccaggtggttcacggagaattccacattgaactgatagctctttgtattattaagcagtgtggtagttgagcttcatactcatctcaaataagtgaagaaagttagctaaatttctcaactgagattaaccaaaataagactcttcagatgtacagaggagtacttgtttcacggcgcagttcctttggttcttcattcactaaaccaagttgaaagaaacccagtaagactgattttaaaccaaaattgactgtagatactagagtggtcaaatgttttaatgggaaataatatttagataatatttggagggggtaattcttgtaagcacttctgtgtctagatatatatgagtgcccctatacagagacttccatgctactttttctgtacaaaaattactaacatcagttcttacttattctcactggaactgagttgtggatggagggattttcctgtactgtccgtcctagtttttctaagaaaaaaaattatcgtacacttttgtgggctttagtttttctgttggatttaaaagaaatacctgaagttcttaaacttgagttctatgtttttgatctctttttaatccctatctcatgataggggttaaaacaccaacaatttgcacatttccagaagaaatatgtatgttgcattatgtatgtccttccggtgtcttcgctaaccgttatcgggagaaaatttaaaaataattacttccaggaaacaatttttaaaaattttaatgtagatagcaaagagaaaaggtagtgagtacaaagaaagcaagtgggatgggttctgttttgtttgttagtactaatagcagatgggtggtccaagtgtaccataacttttaagtgaaatttaagctgttgtaaaggagcattcttcatggggtcacagagatggtacctgcagttggatgcccagtgactcctcaactttgtggacccagatgtaccctagacatctagtcatccatcacctcaggcttgtattggaaacctggagatcccccaaatgctgttttgcatgtaactgaagttagaggacatgttaggaaaagctgttcttgactgagtagaaaacaaataattgtattctgtttctgatcttcatttatagcaccagcaacaagtggtgcaggctgtggaacgggccaagcaggtgaccatggcagaactgaacgccatcattggggtacgtggcctttccattttagctctgatcttagtgtttgtcatcagctctctcgctctctctttttacattttgttccgccaaaggggcaaaaagcaatagatgactacaaaatgaaattaagcactttgccttcaatctcctgtgaaatttgatggctgccttagaaactttggatcacattctcaccaatttaagtggatgtgttcatgaaaactctcctctaaggagactggatagctctttttcatatttctttgctttgcaatcagcttgtgttgctaacctaggccaaaaaaaaaaagagatatagattgccctgacgttaaaatgacctggtttcttttttctttccttgaataatcatgtagagtatcttactatcatttttaatgaggtgtacattttcacatctcccgttctacttattcttccttcccctgtcatgagtggctcttatgggttagtgtccatttgaaatagaaataatagatgaactacactttatttttaaaaaaatcagtggcccatttagaaaatccttcctggcaatagtggcattaatgttgcatagaaattgtgctggaattcatggatttgggcagtcacttcaactctgcttatatatgtatgttttttttttctcagattaatgtaacaggcaataaaataatgtgctgaaacttagaaataacaataaaggcaagaaatcacagctgtaaagagcataatattcacctctctatttatgcagattgtacaagcagttccttgggttattctaatgaagacactacaactgcactttcctctttctgtcccctcccaaatactttcttttgtgtatagattatacacaaaagtcttttttttttctgtcagtgtatcaaacacactttgaaatgctaattatttcgtttactttcattaaaattcaaattgctgagtgaagatgtggataagggtcgcctgataatcaatctgaagtgaagatattgcttcaattattcctctgtcttttaacaaggaaatcagaactctgggatcactgctgatgttgagggcgccatagtctgattgtagcttgttttttaatggggtatttggagctctattttatgtccctctgaccaaaaaaaaaaccaaaaaaacaaaaaaaacctggtaggaaattagcagatgtaatgaatggaaaagagtgacctttatttcctccagagtgccccttggaaacaagaggctgaatcagaagaagccatgtagaatcatgaataatgtttgtcatacattttgtgtgatgggcaggggaagggacggatagtagagacgaatacatttcgcaattggttttcgtttccaaaaactccaggaaacagcagtatattaaatttttaaaagttgagaaaggtttaattttaaagttaagtgtgtgtgtgtgtgtgtgtgtgtgtgtgtgtgtgtatatgtataaaccagctgtgctccattgacgtgtgtgcacaagtgcaggtgttgtattcactgtggatatttttgttaccaaatcttccaggggtcagaagggatagaacctacatttctctactgtctctactgtttaccatggagagaatgtgcagagtgatccctgataggagaggttgctgggtcatttttagcttagcgtttactgtttgtatgaatggctgaaatacagatagccctcctgccttatgtgtgattggcagccttttctaggaaaacagaatggattattattatttttttttcctttttttgagtcttttaatgactgtacagtggagagattaagctaaataaaaaacactttgtttatgtgttggatgttgcttaatatgagggaagatataaaatcagaacaagttcccttcacttcacatcaagaatatttttaatattgttttatatttattcatttttatatactttatttggaatggaatggccgattgccttttcttggggaaatgaggatttattagactgcagccaagttactgacatattgtgtttatatgtatttaattattaaaataaagctaacttaattttgtgacctaaaaacttaaagaactaactcagcagtacattctgtcaaagcagcgttacgtgctatcaacgcggcatatacttggatatagttggatatagttggatctgatgagtcttccaaactcttggtatctgagcagaaaatggagtcggaaatcacattatctgactattctggaaaatagattgcagaaataggaaaacaaacccaacagttttagagaaccacaaaccaagtgagaaggaaagagctcagttacaaactcacttgacaaatttttgctgctgaggttctctttgtctttttagccatggtagtgcttgcatccagtagtttttgcagttgtaacattgtagtattttaaaggcacttgctgttctctgtcccttgagcgtagatggctggctgagttggtggtattttgacacgctaccaaaaacaactaggggtcagtttttagatttttgttacttggtttttagaatgtagtcagcagtgattttctgcactgaaggaatgacagttttcctttgagaggcaaagacccatctaagcccctgcagaccctcatttatttatcactacatatgtgtctattttatatgtatgcacaccatccagacaagagcaaatgttcccagatttaatgaaatctgatgaagcacctttttaactctgcaatattattctaccttcattggtaaatgagccaaacgagtgatccatgcagtttaaatgcaaaatgctgaagtgatcccgtaatctggagaggcggctgttctcttgacaataagctggttgtgtttaatggaatgaaacacagttataatgatttctttcacaggtcatgttcagtttaaaactgttgatagattgaaataagttaaatatcatttatcttttatttataaggaagaaaaccaggaaaattcctgtgttggtttcccatcgttgatattttgtgttttgttttgaattggtgatattacacatttccttcaggccttccccaagttccctcagttgggctaggggaacgttatggatctagtttgattttgtcatgtgtcctgctagccactgtgtttttaaattagaatctctgcgagatcacactgttggaacaacacacaaattgtagttttaaatcagtaatatgatctaattagaaatgatgttttcatttcctgtattattaaattgagtcacctgactatcttaaaatgctttttaaatctattacactatataatcagtacatgctgtgtgaatgtggttatgcttaataaaggaggctgacttggaacctcataagaatttcaccaaagaaactaccattaagaaaaaaagtttagtcagtgtgaatagtggaaaagaaaatgtttggcttataaaaatagacgatgtgggttcctttggaaaccccctaacccactttttaaacctaattctgaggaaaaaaaaatgatagaaatgtatgcgtttggaaaaaagctcacccccatccccaataaacccttaggaaacaggtatgccatggtgttgtaggaattgcagtttagcacaagaaatgctgaacctcaatttttagcagtgacattttaatgataggaagtctgcaaaattatttgccatcaattgtgaaggcaataacaagccttggtggtttttcacactctctgtgttaagtgctttcagaatgacagcgtaaactgtgttagagaactccaaggaagtaaaactgattaaaatgttcatgcttgaatggtgctgatggaatagttcatttggactttctctacctcctgcagctcaagctgaaatattaaaattcagtggatttaaatctctttcctctcagctcaggaaaaaaacattacattttaataggttttaaacccataattcattggattggagcagcactattaaatctatttaaatattacttgtattactaaggaaatgatttaaatgactttgcctttaccatcctatgtgtttgagttagtttaaaaaaagaaagacaatacctttgcggtcccccccttagtattttgttttcttgtccttgtcatatgattgaaccttaaatgtgtgtgtgtgtgtgtgtgtgtgtgtgtgtgtgtgtgtgtgtgtgttttctacattgacaacgtggtaagagggtcttgcagtatgactgtttaaaaatgtatgtctcttcttttccgttatagatttcaaaactgccattttaactttcaaaggcatttggatgagccaccgtggtcattttccttgtattctttttaaacagtttagccattaggcagaaagggaaagatataaatatgtgggtatatataaaaatgtgtgtgtgtgtgtttccctcccttacattgcaagtgtaggaaatatacccctgtggatacatggcctccagtaacacacaacttgaaattaaatttaaaaatttacgtttttttacaaaagtattcttcctgggcccaccgtgtacccctcagttcctttctctctagcccttgccactacaacatgtgtcccacagcctgacagcacctccagtcagccatagcgcgaagtgcttgctttcccccagtgctttgtgggaaacctttgtggggaatccacccttcacttacacaagcacagcctggaaagtgcaggaattacagctgcattgggtaaccctgaatcccacagggaaacagagttagtggaatgctccccgcattctctgggggagacacctgtaagatgccttctatgctactccacaaaaggttccagtaggatggagcttcagttgcccacagtagtgataggctagataatacatgtttattttgagttttcccccttccgtggttcactattcataggcccgtactcctgttctgtgatcatttcaaaattacctgcagccaagccctctccctccactttcccggcagacacttaggatttgatttcataggcctcaagctacttaagggggctttacagtgtaggtaggtaattgtagtcatgtactagagtcagggcttgttttctgatgtgagttctgtgcgtaaaacatatttaacagctcaactgtacaactcagcttttgtgttattttttaaataaatatttttcagtaaacttacaggtgagcttctctatcttgttctgcttcttgcagctgattactattggtattttctagatgtatgtaatacagaatgaaattaaaaatgagctataaaatagatttatcagagattgttatttcagctttgttactgtctttactgaatagtgtgcctggagcttaaaggctttataaaacatgctggccactgtctgtgtcgtgtacacacacagcttgcacaatgggggaaggggctggcttgaagatgcactcacttggagggctttactcacctgcattcatcaaacacatggcaggaacaccaaagcagttttacatcacattctttcttctttatcttctgtgggtgtgcctgcccctcactctttttcttttcttaactggttcatttgccatggagcaggggactacattattgaatgatgtattcataatctaatctttctgctacggtttgatgaggctctaagaggcagtaatttcccttctctcataacaaagactctcatatatttaagtaatttaaaaactctgcctgcacttcagagacgcccaaaaaccactaggtaaggaataggatttctgatttgtgcttgtgatgtgctctccgttattttctatgacaaagcttctctggaagaaatttctagaagccagtctatcaatcctctcacctccaaaactgggactagccagcaatgctacaatttttctttctgtttggagctgagccatcctttcctttcccccagtgaatgcacttccatcgctgtagagttgagttcaaagtgttataagagttgcagaatgtgtctgggtagatgtatctgaggaagggatatgggcattggcttccactgagaagaaagtagttctcccagatccacagagctcggcaggctgagcttatgcagaggtctgaggaatggttatatagaaaaacaggctaaaacagagaataaggcaacctgcaagcttgcagttccagagtgttaccccattttataggttgttttgttttggttttgtgtcacttttgtaattctctgatgatttcctgccagcagtgtttccacaagcagcatcaccaacttccgtatagtcagagacctttttccttgtggtgtcagactgctttgtacccctcgaagctgagagggagggaagaagcatgggctataagagacagtctcacaccaaacaggcaactaaagggttattgacagtggttaactgtcaagcacttaggtgaggtttttaaggacttttgttgcctgttctcaaagctccctaagaaaccagtttgggaatccttctaccccaaaatgcatgtgtggtcttaagtgttgtccttaagacctttgtgaaaaggttagaactctttagtgaatagcaagagttatttaatgattatgtccattcattcattcagtaaatatttgagtactttcaccaatatcctattaaaggggcatattttattttcattttgagtgatattttaaattgtcttctgaaatatattctgaaatgatcctcaagttacatttaaatcattctattaaaattttggtagctgtcagcttgctggtattacattgtacttacaaataatcaacttttaattaacgcattttaatttcaataaagctagtttccatggataacagagtaaagagaaatagttaataaaaaacataagaatgaagcagcatacatttacggatttgtatttttttatatttgcagatacattttcagatatttggattaggaatttagaaattcattattgatattctctattacatcagatttaatgagacgtaatctgcaaaaagtaaaatttaccctttccagtgtgtaggtctttgagttttgacaaccgaatacagttgtgtaactgccaccacaatcaagatacaggatagttccctccaccccaatcccttgttactctttgtagtcagtcatttttttctatcccagcccccgccaaccattgaaaatgtgtcttcttccaaagtgagcctttttgacaatgtcatgtaaatggaattatatatcatgtagccttccgaggtttcttcttttacttagcataaggcatttgtgatttgtccatgtggttgctcatatcagtagttagtgcctgtgtattgcagactgatattctattgtatggatataccagtttatctgttcactccttaaaggacagttggttgaataaagccacgagaaacattcttatttggatattttaagtaagtgaatgtaagttatatcttttgggtgattacctagaagtgggattgctgagttacatggtaaatgcacgttaaactttccaagtaattgacatactgtttctcagagtgattctactattttgcagtttcactaatatattacatgtaagaaaacctttcctctacatctttgtctgcacttggaattacaggttttggggaggttattttagccatcctaataggtgcataatagtacttactgtgttttttatgcattttcataacaattaatgatgttaagtgtcttttttgctgtctctgtatcttttctgatatctgttcaaatctttgcctctttttttttcatcagtcagttttattattgagttttaagagttctttaattttctggatttttttgtgtattttgtaattctcccaatctatagtttaacattgtcaaagttaaacttaggctttttttttcctttatggacttttggtgttgtctgtaagtaatctttgcctaaccgaagaccgcaaacatgttattctggggtttcttgtagaagttttacatttaggtctataattcagttcaatttttgtttatggtaagatatatgcattaagttgaggtttttttttttttttcccacaaggacatggattcagtttttctagcactatttgttgaaaaggctatcctttctccattgatttgtctttgcaccattgttgaaaatcaattaaccttatatgtatgagtgtatttctgactgctccaatcaactgttgccgtctcttttgctagtgctatactgtgttgatgactatagctttcattattgatgttctccattccgttttgcacttgttcttcctgttcttccttgccctttgcagtactcctcagcacttcaggtctttatcatcagtatactaaagactgactgatggatgaagggaaagggtctaagctcagtataaacactttctctcatcagaaatggtgtctgctccacctcctaacatttctctcaaggttgagcgcatttttccatctcctcctggtccaagtaatgcctttagctagactcttccagcctcttcctgataggctaccatgtttccgcatttgtctttctttcattctacacacagcagccagagtgaccttcttataaaatagaaataggatctattggtcctctgcttaaagccacagtgagtgtggtggtgtcgtctatatatatgagactatatatagtagctgagacgctactcgggaggctactggatcacttgagcgcaagagttcaagaccagcctgggcaacagcaggatttcatttctaaaaaatttaaaaaacaagcaaatgaaaaacccaggaaaacctgatggctgccccttttatttagaaaaaggtctgaatttctaaccttggcctacaagattcttcatgagctgacccctctttcactggcctttctgctgtcacataccacttatgttcttcattcagctgtccttaagccactttggcccctttcttctgtccctgggtcactccaagtgtgttctcgactgagggtttgtgcaccagcttctctgtcctctggatagcccatcctctggatcctagagtggtcttccttatgcctcttttcagagtgtcagctcagatgttatttcctgaggaaggactttcttggctggcactctttttactctttgcttctaattcattctctgtcccattaacctgttttattgtcgtcattgcacttaccattgatttgttatgcatcactttcccttgactagctagtgaaatctcattcacttttgtagccatgaagcctagagcgataggtatctcataattttcaatacgtatttgtatgataaatattcagtaactatttgttcaataaatttgcagtaatttgttcataataattttccatagatgtttgttaaatactatgctctgggatattttctcatttggatattctccgtacaattttgagccaagatagaaaaggaagcgcatggactggtagaaaatatacagttctgggtttcacttatagtatgatattaggaatttcatttaggttttttcatctgtagaatgcaaggctggagctggcctatttattttgacgttaatggaatttttattttaaaacttggggtccttttgtgtcatagttatttttctaggtttatcacctccctaggcttgtattcttttcctgaaaaaggtaactaaatatagtagatgttattgaatattcgctctgtgttaagcatttacatgcattactttgtttaatcttcacatcaacctcatgtggaaggaaatactgttccagctttacaaataatgaaaccaagggctttgaagaggtaagtcattttctgaaggccacacaaaagaggagtggcaggactgggatccaaactccagctgacttcagaactcacacatttaaccattatgctacacttgtctcttatttgttctcttgactctgttctttctttcacactgtcatcaataatctctttatcttgagatccactgataggattgtccagccagagctcagtgttggaaggaaaatggaaactgggtatgctgggtccacatactaagtggttagtctaaattgtctgaattatattagttccacaggtcagttggatactcttgactcatacgttgttgcttcctgtctgttgtatcttactcttatgaacaagaactgaaagttgttataaacacagctgttaaggcaggtgttttaacccagtgtccttggatcttctggaatttcatgcttgggcattgggctgtcaattaaatgcctgaattgcttgcagaattgcctgtgtgtgtgtgtgtgtgtttggggttggtaggagaggagtatgtatagtttttggaggagagtgttcacaaagggtcctgtgacacaaacaagtttgaatccatgccttagtagaataggattgtgcaaaatcctgatatgaaatagcaaaatatcatgtggggtgcatgtagacaaaaaatatttgcccgtagcagcgtggggacacattctaggatggttgttcagaaacttggaaatcaggagtttacttttgtaggagggtttcttgattaagaactattgttggtactctagttgcaggcagcagtaggtgaggcaggggacatgactggtggtgaagaccataaaggggcccccaccaggccagtggctagtcaggagatataaacaagttagaacttacagggattgccattatgttgtggggagttctatctttgaaattacttcattgctttgtgataagctctatacttctctgcttctatttctctatcttgagaaaaccttgtatgcctgacttgtgaataacaattatttcatgagatagagtaatattgcaaacttaaaaaaatggttttgactaaatagttagagctaactgtgcctttgaccccaacctcttaagaaaaactcagaatggtacattcttgaatcctttttaaggcagctctatagctagtctgacccttgtgattctcatgcttttttttttttcttggtagattcataaaaatggtgagagtttatctttgctcagattgttttctgtgaccatcaagggcagtgccactatggtcccgaagcaaagtggcagtaatgttgctttttttctttatttccctagagtgtttctgggttgactcaaagcaatttgtagacacagctctgcacaaattaatatctgggagaagaaacagttgagaggaaaaaacagtttaagttgagatctacttggattgaaagctcagaggttgttcttgggtttctttcagctaatagcttcagaatggcctctgagcaaagatagatgtcgaggcaggctttgttgtttgttggttctcccttgcaggcagaggctaccctctgctatcaaggctaaagcattccaggagctctttgcaggcttccttacagaagaactgtgggcaagtgaccctatccaggtcagcgagatataaaaagatgtggttttcttcttaacagaaacccatggagagagaattatcctcccttctgcattttaatatggttatgtgaaggcatgaggtaatgtgtggagctgtggcagccatcttgtgatgggaggggatgggatttgagggatgccacatgaatcagggacccagagccctgataatgttaggtcatctatccatccctggacttgtagtgtgagaaataaaaattcctttaaaaaaaattcaggccatttttgggtattctataccttgcagaggaactatcttaactcaaatatatagttacatgccatataataatgtttcagtcaaggacagaccacatatatgacaatggtcccataagattataatggagctgaaaatattttattgcctagtgacattgtagctgtcgtaacaccacagcaaattactttttaaataatttttttgtagcagtgtagagtaattataaagtctgtagtggtgttcattaatgtcctaggccttcacatttactcaccactgactcattcagagcaaattccagtcttgccagtttcatttatgataagtgctttatataggtgtaccattttttatcttttatactgtatttttactatacctcttctgtgtttagatacacaaataccattttgacacaattgcctacaatattcagtgcagtaacatgctgttcaggtttgtagcctaggattaataggccatattgcatagcttatgtgtgtagtaggttataccatctagataaatatactctataattgcacagtaataaaattgcctaaagactcatttctcagaatatccctatagttaagtggtgtatgactatagatagatacatatatatttctatgttaatgtcatgacttatgtatatcaaaatactgggaacaacctgaacacccaacactggggaactacttaagtgaactcaggtatggcagtacaggttgcaaagaacagaaggagttgagtgttactttgaagacagaactagaaagacctggttatggaagacggcagagtgagactaagtggaggaattcaggacaccctggaaatttggaacataagtaactaggtagatagttgtaccatttactcagatggggcagaagagagaaggaatggccatatgaatacaatggcataccatgtagctgttagaaatgatgtagtcaaggtgtattaaggatgtggaaaaatgttcttaatacatggtaaacaggaaacgaagaaacaggttaaaccacaagatagtttgagttacttttgttaaaaatgctaacatgaattcaaaaaatactggataggcccaccatgatattactagttttctttggctggtaggattatgtgtggcttttaattttttttttcactccgcctatcttcatttaacatataagtttctaatctgaaaaaagctataagacaaaattctattcatatggccattccttctctcttctgccccatctgagtaaatggtacaactatctacctagttacttatgttccaaatttccagggtgtcctgaattcctccacttagtctcactctgccgtcttccataaccaggtctttctagttctgtcttcaaagtaacactcagctccttctgttctttgcaacctgtactgccacaaccctaactgaagttatcattcattattttcttgtttgaaccccctgcattacctactagccggtctcctgcccttcattcttgccactctcagattcagaaaattattattttttaatattctagcttaaaatacttactagtctttataaaggccagtttaagctggtttacacactcaagcttaaaatacttggtggtcttctttatataggccagtgaaatagaataaaatactaagaaatagattcacttgtatatgtcagaatggacaagcagatcagtggggagaaagatggaagctagtaaatattactgtggggctacctggttattcttgtggaaaagaattggatacatacatgtcaccatatgcagaagtcaatcctagaatcataaaaagaactttaaaacttaaaaaaaaaaaacaggaagaatcttttttttttttcttggagtaggatttcttaaaagggtcacagaaagcccaacccatgagaaaagattgatagtatttaatactcacttggaatgaaaaacatctgttcatcaaaagatgctttaaagaaaatgagaagacaagccagaaaccaggagaagttatttgcaacacatgtaaccaaaaagtgattatgatccagatttataccagttaaagagcaactaaaagttcagcttaaaaaacaaaaccaaaccccaaaacccaccgtagcctagagctctaattattcttaaataaaagtcaaaaacccttagtgtgcacagcctgattcccagaatatacttgtattctacccgacttccccattgctcactggattctcactaggcttccttttacttcactggtcacagcaagcgtctctcttgttctgggtcctctcaactgcttttctcttgcttctgattctcccagctgtctgcagtgtgctgtcatttgcatcctgcaggtctcagttcaaaggttatttccccagaggagctgcctccatttatttttatgaatgaatgattgcttaccccttccaccctagttgagaaagggtcctaattgggcagcaggtacatcactggactaaatggtaggggcttgtgctccatttcttgatgctaataccatctcccactgactctctcacctaggagatcacacatgtgagtgttggcctggtttagcgttcttcaaattgcagctcaagagactcatgagtgtacagtgaagtctatttagtgggcatagtggactttttttttttttaattaaaaaagggtatagaagactatagaaaatattagcgtatgttgcacatagtagtgtttggtaaactttgttaatttacacgtatattctatgtagacacacacacatatgcacatagacacacacacagaaattgtggtcaaaattttggaaagcaagtctcctagatgacatctgaggttcattccacctctgacgttctaagatcaaatgcaggattactgaacaacctaaagcagataggctttttaaatgctgctttacttaaaaaaaaaagaaaaaaaagaagaagaaattagagatggtgtctgactgtgttgcccagattggaatatagtggctattcataggtataatcatagggcaccacagcctcaaatgcctgggctcaagtgatcctcctgcctcagcctcccgagtagctgggactacaggcacatatatgccactctgcttggctcagctttacttttttttaaagtactctgaagtaactaaagaaagcttttctgagtacattcccttagcttggtgactttaaagactaaaacttacaaaatagaaccattggtatcagtaagatgttaaagactaaaaatttttcttaagtagcttaaacaagcttctgggaaattgtatttccattattaatttgcttagaagtacaattactaataaacttttggccaattcataaaatacgctaacgggatcactaatgggaaagttaataaatcagggtttttgtagttttctccttcttttcttgccattattacttcatgagttaaactacaagttaggacaatggagccgctggcaaagatctcatgatttgcttgctttggttgttacttgccatccccttaagaccagtccagagatttggaggactacagagatctgtggtttgtttagcttgagaagcttatcctttcagtgataatcttacttggattgctctaaatgcatgtcttctccctatagtaaatctcatgttgtaagtcatcaggaatgagttacagataagcttagtttgaaaagtttcttcctttgttctctttattcttgcttctttccatatattcacttaacctttagctttttctagagatatttgttaaagtaaggtaagaagggcacatcttattttcccagcctctacaactacagagaaattgaatgaatagtagagcaaacactgtatactcgtcacctagatttaccggttaacgtatcgtcacttttgttttctgtctctgtttatatactcatacaaatacatgtgcactttttggaatgtgctgaactaattgaaagtaaaaggcaatcatgctgtttcaccccctaatatttcagtgtgcttcttctatgaacaaggacatcttcctgtataagcataataccattaacacattcctataccagtgtgacagctcataatcatatttctccaattgtccacaaaatgtccttaatagcacttttttattcaatccaggattcaattcaaaaattgtctttgctgtcatgtctttttactcttctttaaatcacagtgtccgaaagcattttgctttttaagatattggcattttgaagattccaggccagttttctggaatcttccacagtctacatttgtctgtttgtttctgattgttttctcaagtttagatttcggttaagtgtttttagtaggaatactaactaggtgatgtgtatttccagttgtatcatattactggtgaagctaggtgatccatggggtgatacctgggcactatgaataacctgtttccctgcaactttttacccagtggttgtaatatcgatggttgagtctgtcttgcattagttaatacatttgacatggtaaaacagtaaattttaagttatttctttcctttcaaattaatattctgtaaagaagagcttttcctgttttctcctctcctcgctccctcactctctgtgcatatgaaaatgtgggcttctggtacctttccttaatactagcagtcaccatttattgagtgtttattatttgccaaacactgtgtgatatggtttggctgtgtccccacccaaatctcatcttgaattatagttcctacaatccccatatgtggtgggagggatctcgtgggaggtaatttaatcaggggcaattttccccatgctattcttgtgatactaagttctcacaagatctgatggttttatgaggggcttcccccttcactcggctctcatgcttctgcttcctgctgccacgtgaagaagggcatgtttgcttccccttccaccatgattttaagcttcctgaggcctccccagccgtgcttaactgtgagtcaatcaaacctctttcctttataaattacccagtcttgggtatgtctatattagcagcatgagaacggactaatacgctgtgctaagggttttatatggatcatgtcatacaattcttccagcaaccttgggaggtagattttgtaactaactgttctcgctttttacatgaagaaacagagcatcagaaatgttaaatgacttgttcaaacaggtaataaggattccagtgactctgaggccacttcattgtgatgcttcccaaatgtcagccagactgtgctttctcacacctagcccgacttacagacaggagcgaggccagcagaacaactgtccatagtaaatagtgtcttcacaagccaaggagtatggctaccagcccagtcctgggcccttccctgtgcttgctgctctatttcagagtctgttgcctcttcctttttggctcctttcaaggtctgctgagtcttcccttacttctctcctagaatggaacagtgtctcctggttggattgaggcacacgtgctcagagcgagcagctcacagcttggctagctcctggtggatgagtagtatggttgtgggcttgggagacagccagccttgaacttaggagctggcactggcctgagagtcattatctgtctctagtccttggccccagagtgccctacatcttcacctattttcttggggtaccaaaaactccattcctgaaaatgttttttgaaaatgtgttataacctataaagtcattattcttaatgatgctgagattgtctcaagttttgccagtggggatcccttcaatttggctcattgtccttttgacacaatatccgttagtctagatagctttcttgatttctggcacaagatatagcaggttcaccttgcacttgcactttttttagaaaccaaaatatgagcacaaagtgtgctcattgctactgagatgttgttgtttctaaggaaggtgcgtgttttttgagaattattctgctgttgatagcgtagtagagttggagtgggggtgaacaaggaaactgctgcctggccttcaattggaaatgcccaaaattcctagggatgtcagtgactgcagctctgtccttgctggctcctgcttggtcaatgacttgtcagtcccttgtcatcaagcagttggggacctttgattacaaagaactcctctttttgctgacagaaagacaacatttcaaaagacatttcttgtgaattctattctccagtggtccttttctgccctttgtgccaaacttgaaactgcagggaaatctttgttacagagaatccagaaaagacctattaacagcattgaggctgtgtctgccacttcatggctgtgtattttcagacatcattgctatttttcagaattaaattaattatcttaatggagtacttacttgcttaagtttaaagttcactccattttaatgtttattttcttgagtggcccatcaaggaaataggaagaagtagtttattttgtattgtggtttgagataagagaggtttttatttattattaattttaagtaaggcacccaaagataataaaggcctaggaaggatagtgagaagaattttgccatgatacatattttcctcaataggtcttcctcagtggtggttatgtatgtacgtttattttaatactctagtctatgccctctttaattctttggcttgatctttgttttgtttttcttctaaagcctatatatatatatattttttttaacctgctagtttataatgtatcttaaattacatccgtaacaaatctgtgttatactgtgtactcttaatgtacatttcccttccttttggtctttaaaaagcaaggggttttatgtttcttagtgggactgtaagataaagtagaatatctttgcaggttaattgctctgtaattaacccagatggggcagagggcagaggacagttttgacttaaccctgttgggaaacatcagcaagctttcactttactgtagagcaatccattagattatggtactctcagctacttgactaatatccagagaaaccttactccttttccagggaatcctgagttcctctgttgataagatgacttaatagaaatatatttttaatgaattcttgacatttgataaattaaggccatttattttagcagagaaaaaggtgaagttctacttagccattggtgacttactacttttatttaaagaagatgttttctaatatgttttattgactaacccttatcagttataaaatacctgctactctagttctaggctagttcctaaggtgaaaatttgcaaagaagcttaaaaatgaccactaagtacagaaaggggtctcatttattaatgtatacattttaaagcctactgtaatattttaatatctctgtcatatgccttttggtgacttaatttcattttatcttatagtttaatatttttaaaacacttgataaaaattgctcccttctacaggatgcctgagtataatttttctgttttgatattttgtatatgtataaaacggtgactgataaacatgaatttatggtagctgcctctcatttattcttctttaagatcaaggcatatactattaagcagtatgcctgtaggttggttgttaccattcataaaatctttgaaaggactttataattttggtataataacaaatgaaaaagcttctctaaatgcaacgttgtatgctggtttggattctgggacagaaaaatgacattagtggaacaactacagaaatctgcataaagtctctagtttggtgaatagcaatgaactgatgttaatttcttagttttgataaattttatggttatataaaatgttaacattagtgaaaggtaggtaaagaatatatgggaactctatatgtagtagaagcttaactcattaaaagctttgaatatatagagacatatgaccatagtttgagttcattaattagttcagggaaagtttagtggtagttatatttaagcccatttataattcataattaggaatttaaaaattaaaagaccgacaataaaaataaatgcacttttcatatgagggcaccaagttctgtatgttcgatcactaaaaatatcagttttactcattttagattattgctgcttaagatgtccagaataggcttatagtacaagcagcttttttatttcttctagtttaattttaaattcaaaagcttgaaacatctggaagaaaatagagtcagaattcatcagtgtataaaatcatgctgatattagttggtaatctgtttgcatacctactaagtgtgagaaatatctaggcactatgggaaatattttttaaatagctctaattaagaggtatggcatacacagacttgtgcacacacacacgtagcacatatatatgtatttaaaaagtctttttttgtcttggattgttaagtatcttaatggtattgagcttaagtggtgtcagaattgagagacagtggtggagattactttgagccggggtgatgagggatgtctccaccgagaaagtaggcaggagtttagcttggaaggatgggtagaatttatacatatagagacagatgagagagtactctgtgggtgtgtgttgattagtagtaaagctgagccctaggagtttagatgtctccctaaacagactagtgttgcgggcagagagttccctggatggtgttgcacagtagggtggagttaggctgatgctagtttatggaaagtcttgaatgctaagaaattggaacttttgtttttaaataaaagggatctgttgcttttggaaccagagagtaactatcaaaggagtattttattttcagtagtatcagagttttgtattgagttctcgctatgtttagggaactgagctaggtgccaggggtactaagaggcctgagactggtctcttctctccaaagtctcacagtctctggcaagtcagggtcttcttatctgtaaaaagatgaataacaatgcctttatgaggcagtatatgccagtgaataatacagggagccctataagatgatggacacttagattgcttggagaaggctgtagggaacaggtgaaacataagctgagctgagataggtgagtacaacttagataagtaatgtggaggttgttctaaaaggtgcagaaggatatgaatttagggaaaaaaaccacaggtggagaaagcagtaagggttcattgtaactaaaataagctgatggagacttaaaataatcagcatgtgaggtgatgagtctggtgagtatcgtgacaagtagaaacaagggattatttgagaatcttcaggacttggcaattatcaatataggatagcacagaaggataacaaattgttgatgaccagtaacttgagccagtagaggttgggttttgtgtcacacattttcatttccaggtaatgctggacttccaagtacaattgtctgacaaaaagttagaatgggggtgtcaaagtttggaagacaattgtgggtcaaaggtggataaagatgggtgaggccagagaggagcaaaggagctaaaggagaaaaaatcaagaaggatatacaactgctgcattcagagagccaaagaaaggctggccatcgtgatgatttcagtgttcttgaagcaggtggaggatatactgtctatgactgcagatacatcagaaaaagaaaactgagaaatgctcagtcacgtgtgagtggtcctcggttttataagaatggtgggcctgcagtccagatgatcaggtctaaggagtaagtgtgtgtgtgtagaggaggggcttgttgaagtggaggcagcagatttacctcagtgtttgaagaagtttgggtgtgcgaagacagggacggacatacatacatacacacacacacacacacacacacacacacaacaaggcagtagttgaagagggcaaaagaagggtattgtagttaaatttaacaaacatcaagtgccagttttgtgcaagacactgtgtagggggcagtggaggacacaaaaagtgattaaaatatagtgggatttctgttcccctgaaaagtactgcctcaagttcttttgactttagatgggcagttcatcttaaacaaaatgttggacaaaatcagtgatgaaacaactgaggatgaaggagagttggagagttgaaggagcagtgaaaaagaatggaagaaaacatgatgtgcaggtggagaggctggcctttgaaaggaaaaggacccttctctaagattagcatacaagaggaagagaagaagctcattttagaactgttctgagatagaataaaaccaaacaaggacctcaggaagccttactgtgaatgtcatgtataactatgatttctgcctttgaaaagttctggtccaatggaacgatgagtcggtgcttattttttatcctgtaggagaaaaagaataaaagtgacacacctggatcattaaaggtattgggctttggctgagggctttttgttgttgttgttgttgtttttttgttttttgttttttgttttttttttgagacagggtttcactctgtcacacaggctgggatgcagtagcacaatcatggctcactgcagccatgacctccctggctcaggtgattctcccacctcagcctcctgagtagctgggactacagatgtgcgccaccatgcctagctaatttttgtgtttttagtagacacaggattttgccatgttgcccaggctggtctcaaactcctgggctcaagtgatctgaccgcctcaacttcccaaagtgttgggattacaggcgtgagccactgcgccaggcttgggtttttttttggtctaatgtaatagatacatttttaaaactatcaagataatgtgtgaatatttcagggtctgcagttagctaggatttgtgagatgtagactcatagagcttagattctaagaagggaggtaagaaagatgagcatgcaggatcttaataaatgcctgctcattgacctctgatctgaggtagaaagtggctgtgtgtccaaaacatacacaaggagtattaggggaatttagaggagaaagaattggagctatttctgtttttgaaacaaatttgccatatatttacttcaagtccctattttgttttcttcatagacgttattttctgcactgttaggaaatataattttgtgtgcatactttttgatccccactgaataacagtatgtaaagaattatgaacatgattttggccacttaaatgaagagaatcaccttatctcaaaactacccagttaagaaaaccttcagcaggacttggagcgtgggtggggcttggttggtggagtatctggatgtggctcccattttccattttctgcttgtaaacttgcttttcaaagtgttcatactttattctattgactatattttaagtgcatgtagccagaacataggtacaagtcagtaagagaaaagaactaattaatactgtacttggacttttgtagtcaaacataggaagacatgtgggagtggaagaaaataaacctaatttggagaggagaaaaaaaggtccactttttttctctgaggtattaataaaagcattttgagatttttcttggtggaatgatcgatctctctctctctctctctctctctctctctctctctgtccctgtccctatctctagatattttgtgaaattttgcttggaaagaaaattatagaagggactatttggctatcacaggttaggcctggaatgtgatttctttaaaggcaaaaactaaaattcagtcactacaaaatttaacctgagaattactcaatacttgttgtcatacaatattgctaagcagggtttgagttgaagggattcctattgagtaatacatttaatgtccttccttcaccaccaactcctcctctcccccacttcccactcagaagaggcagcaaggcttgcccaccgcggttcctgtagcagagtttgacgcagcctcagctgaggtcaagcacacccattccagcctcttgagggctttctctatgtgttgccagtgtgctggtaaaaatgactttaaactcttgtcagcgcagttactggtgcatgcatcacagtcccactcaaataaacctgtcacaacacagagtcggccgctagagaagagtacaagggcaggcctctagcttttcattcgagcatcactaaacgtgcacagagtgcccaattatttcagcattattgagcaagcctacaggaggacccaagccttgctacattagattttctttagtaatttgctcaagtaccgctgaggacacttaaagggcttaaaacggtggctgcaaccagtttccttttctgggttgttaattcaggttttctctttcaaattaactctccctgcatgctgtgcagtggttctgggagaattgtttaacactaattttctcaattttcagctttttttgttcaacataactgctttaacagttactcacgtatatgttttgattagaaatgtatgatagcgaggccttattttattttttgagataaaaaaagccttttatgaggtttgttaaagaaatatgtttgcatatcaactattgaaagttacttatatactttcaccacttaaaaattaaattatttatattgcatgtgcaaaacctccaagtataagaaaggtagcatttattgactacacagctcatttgctccttcccccttttaaaaatatatatatgttaatagtaaatcttacgtaggtgttggcttttttctttttcttttttttttgagatggagtcttgctctgtcgcccaggctggagtgcagtggcacgaactcggctcactgcaagctccacctcccgggttcacgccattctcctgcctcagcctccccagtagctgggactacaggcaccagccaccacacccggctaatgtttttgtatttttagtagagacgggatttcaccgtgttagccagggtggtctcaatctcctgacctcgtgatccgcctgcctcggcctcccaaagtgctgggattacaggcgtgagccaccgtgcccagccggtgttggcttttttactgccgatttatgcctcctttctgtttctcttggggcaggggttggatatgggggcaaattcaatatctgtgtttaatttttcacagcagcaacaactccaggcccagcatttatcacatggacatggtctccccgtacctctgactccacacccttcagggctccagccccctgccattccacccatcggtagcagtgccgggcttctggccctctccagtgctctaggaggtcagtcccatcttccaattaaagatgagaagaagcaccatgacaatgatcaccaaagaggtgagtaactctcttggaatgccaatctgagatgacctacttgctgctgagggtaggttctggatgctattgtttattctctctgaatttagttttaccagtgactaaacaaaggatttccactggaaggtaaattaattactgcaagtagtcaattgccaaatgatattctagtggttggcaagagctaacatactccctagaggcagaggggcctatttctggttattgcctttgatttcttgctaccttctatgttccccaggtctaaatcagtaatgaaatcccatgatgctctgtttgaagtagcatgttgcattaatagttaactttgactgaatttattttggggaatgtcttgctgataaatgctcacttgatatttgaccaaatcaattattatttataaacaaatgagcctatatagagcagtaaaaatctcacaggtaagaaaacaatttcagtagtcttagtaattaagaaggtacagaccaaattaatgaaatctgttggtttaactctctctctcacccagtctgtttagaagcatgaaattaactaatttcttcctagaagaccaacataattgtttatgcaattaattgatttaaaggccagttgtgctccttctaggttgatttccttcctccactaaggtagatgatggtgcagaaacattttgatgtgactgttgtttttctttggtgcttactgataatttttattagttgatgacagaaatgcagatgaaaaagtctctcccagcattcctttttgggaatttacttagcacaagggtggttcattggcttgaagggtgtgtttcataattaaaagctcatacccctgtttcagcatccttactgtgaattataatattaagtcagtgatttttatcacatatgcataaatatccatctctgatattaaaaacactgtaatttgtcatccagttatcttaatgctatggtacagagttgatgcatgattgtaaatactttgaaaaagtctataaggagcacagataataagaatgtccagctttggttcttctgaaattgtgtcaaaggtagattggtactttatgaatttggttgtgcagtattaataattaattttacagcacagttgacatctgtgtaatttattatttagcagagatcaagtttgataaatcagtatgattttatgtaaactaactagtacttttcttttcttcttcccaccactttatctgcttgtgttgctgctgttttgcatatagacagagactccatcaaggtaggactcaaaatttacagactaaggaatggcttaaaagggctgtaaatgatttgaatgaatctagtaaagaattctttgagatttagagaatgatttcattggttagtagtggttaactgcatttttaaaattactttcaggtgtgtggttgattttttttttttttttttaaaggtcccatttctctatcagaatcagatttgttgacccaggttgaattgcaagatctggcttgcattgctcattttattatttgccatgtgaaaaaaaaataactgcttttcttcacttaggctttggctgtaagataacaatgaaatgaattaaataaattggtttgtaaagagatacatattagtttcatatttgaggaaacagctccaacctacaaaaatatttgtttaagtgaatggtgcatttttttttttttttaccactagaaataattttctcttttaaatttaagtgaatttttttcaccaacttttctttcaaattaacattttggtatctggtataacaagttaattctctttaggttttgcatctgtcttatctgccttttgtatctctttatagacaagttgtagggaaagaggaaaagtatttaaggtctaatgatttgggtatgcttctatacctccagaatgggatgtgctaaggatacctgaagttatttagtaagcaaacaagaaaaataggctgccatggcaggaaatgagtaaggcatgaaaattaatgtgatcacttatgaaccagacacaatataaatacaccattgtaggccgggcttggtggttcatgcctgtaatcccagcatattgggaggccgaggtgggcggatcgtgaggtcaagagatcgagaccatcctggccaacatggcgaaaccccgtctctattaaaaatacaaacattagctgggcatagtggcttgcgcctgtagccccagctactcaggagtctgaggcaggagaatcgcttgaatctgggaggcagaggttgcagtgagccgagatcatgccactgcactccaccctggcgacagagtgagactctgtctcaaaaatacatacatacatacatacatacatacatatgtacaccattgtattatgcgtaattgtattacatatgccattgtgttacttattggttagaaggaaaggacagttctcaaccattggccgaggtacaaatgctgtctatttctttatatcttacaacagttgaatgttttggagtataggtagttatatcttgcagtttttaatggagctatgtatatgaatgctaaaattttctcccagaaccactgtgctagcactttgaatgcctttttactccttgtcgttttacaattaaaggaatttttttttcagagcccttaagtaatggaaaataaaacttgagcctatctgttttacccttcaagaatctttgtaatttgaaagggcatctgcactcccatgtaaatgtcaacatttacaattagaactgaacacattgaattatttaattatgcatttgcagttgtgtattttgttgtatcatatgcatatcagtacttagactaaaaaagcattcttaaagtatattaagtgtttttcacacatgtgtacttaggaagtagtaagtaaatgcagtggctaggattaactgataccagcctttgaaagcctgtccagttattctgaggtcataatataaacattccctgccttcttattataaatatatacctttaggcagtccagtgaactaaacaaaagcctccactcccagaagactgtgaaaatatttatacttcagtgtacacttttgtgtcaattacattttcttattccctcatgcaagagtaagggtgtgttttgaaatcatcaataatcattcagggtgagcctggaaatgagtatctgtatagctagaagccagggaaaaacaagaaaggctgatgattttgccttgatttattatgggatggcatctataaatagatgttttggttgggtaccattctcaaatttgaagttgtattacgtcaggtctgggactgtcctatagttctacaaggtgagatagtttgcttatttttctgaatgtgttctgtgatgctcagagaagcagttgtagttgcttgttccatcgatcgtcctcccataagtggttcctggttaagaggggctttttatgattgtctgctgtgtgactctagatggtttttatcagccagagcgtgccagttgcctgcagctggagtcgagcttgtatgaaataatttatttatgcaagataatgctccttaacatttaacaggtaatgaacgtgacataaatttccttcttgcttttaatttttccctttcctcttctaatgtgcaaacaggcagctctggtactctaaataataagtaatttttggccatctgtcaaaaggaaatttcaatacaaatttaaattaatggtgcctgaaattttttatagctcctctaaaagcctctaatgtgcagaaaattcggaatctgctggtagtaattagtgttgcatgtaatgaggatgtgggcaatcttatacagccccagtggaacattttgatatggtagcaaaattttgatttatacaaggttgtagatgggtttgattgtgagagatactttaaaatgttttcttgacgttacagattgttaaacagggcagatttcagaatagcttataaactataaatttaaacttactgtaaagatttaagtaatttaggtactttacctttagatgccaagtaaaattcacttgttaacatgttgggccttttttttcctttgtctttctcttctgggaagttctgtggccaccaaattgcacgctgttggctttattgatctctttttctatagctcctgtagccaagttcattcctaagcctgttatttgcagacctgtatctgaagtttttcaacaaaggtggagaatgtaaatatggatctaaaggagaaaacactgtaggagcccaagaatcagtttccttgatgatgagaaactagaccagtgtgtgttgtagggctgttgaagtcaggagccatggcacctgcagccttccttgcttgtcacttggctgtccagtgactccatgtgcccaacagtaagtcccacatttgaggcctgaaaatgacaagaaacacagactgtgatccactctcacccttaatggtagggcagaaagcccaaatttatctctccaaaaagaatccaacgtaggctaagggggagtgttctcaccatcttatgtagtatcaagaaccatttctctcatccctagaaaagtcgtaagtgacaccaaggaaatgttttctgaggtgatggaatcttccattgcccaccccctctcattgagggctgaggggtaaaagtgatgggctctaaaatggtgtcagaggggacattcccttgtgctgccaggagcttcccacttgatggaggttccagttcattaagaggagtcagctgcccagactgaaccagtgctattaggttcctcatagcactctccagttcttttctgagtgactgaaatgagggtaatgattcagagctgtgaaggccaaaattgcctgaaacttggtaagaatctgaggttcagaaatcgtcttatttcccactccgtcccaaatgtgtgcataattccaatatcaggtagcaaaaaataggcaccaaaatcaagaccagcttaaatataagtcgcaaaattcactatcaccaaatgctcattagctccgtggcctcaaccaagttgctattattgtgcattctttattactttgtaagtccttttcatgtatctgcctggttctcctgtgttttatcctgagtgcaatagccttctcaagtcacatctatgagggatttgccttttttatctgtaaaatatagcacgagtactttttctcctctgtgcctatgcttacccagtacaaacattttttccatctgagtggtggtgtttttatttttgttatttcattggaatgtcttcaagcccagagtgctggatgcatcatcaaagagtatgatcatttttagtgacttgtgcagtgccaaattgatctcctaaaaccctgtactaatttaaaatgccaaatgcaatgtttgaatatgtttccacacaatccgccaatatggaactttatagtttttgtaatttttgttggcataatgagtatggatggtgcactttatttttttaatttacgtataattattttttagctaaatgcttttctctgggtatatacactgtttttttcctgtgcaaattccttgattttgtttaaaggtttttataatgattcattcattatttgtgtttaaggcaatgcatttttattctgccgcatctgtattttggggcatagatgactaaaacatcatacattgcttttttctatcccccatttattatgttgacaataaaggtttatcagcggaaaattagaataaggttgtttttatgttcaaattgaagggcatgattcaggccaagaaagcacttttgcctcattaattgggtgttaaccggtgaatgtgggtttttagtctgaattaacagaatgattacttcatacacccctttaagtaggagttttaccgtttgggagataacttgctgggataaatttgtattactccagactttagaagtacatattgtaaaaaggcaaaggcataaaataatagaaaggtagattaaaaaggggaaatcattgaaatccacagaacactaaagagtgtttaagcaaacaaaacagtcatggacttttggtatcttctgttttcccctcagtaatcagcaatctgagaagagaagttgtctaattaagggctgtaacacttcagcatatccactgtaacctagggaaaaataaggtgggtccacagtgtccactcagtcctactgatctcctctgagcagcccccactgcatgtatagctcataggttagattttgctggtgaaggtaggtgttatgcttacccttatttcatacatgaggaaaggtttagaagtgtgaagacctgtcaaaggtcacacagccagcgccgccctcaaaggaaagctctttgggtaacccagtttcattctcagttattaaaaatctgaaacatactacaaagtacaaagaacgcctcatacacccagcaactaggtacaagagctatcaatatgtagccatatttctatctatactttttctttgccgaagtatttgtatgctcattttgctcctgtgtacttcaatatgcaaaatgaacacattatctaaatagtgggcccttttttttttagataaccataatgcctttaatcacttagtaaaataattctttgatatcttctaatacccagcttataatcaaacttctttgattatttcaaataattggtttacttgaaatgagattcgaataggattcattttattttgttgtgatctctgttaggtctctataaatctttcttattaaaaaaatttttgttttttgccactccctaactcataatttccttctcaaactaatcttcgatttgtcctcttatacaattccacaaagcagattaagactcttcccctcaagaagctaaaaatttaggggaagagaactttacttagttagggcatggggaatcagggataccacctaataaggaaatagaagtacttaatatatttttaaaatcatattttaaaatatgtttttaaaagcctatcttgagcaatacttatttggacagtggatttgtatttcaaatacatcatagcctgtgtttcaaggttaaagaatagaaatagaactctacctttttacggtcagcatacatttctagatatcttactcccttgattattggtaaaatccatttcattgttcatcaccaatgtatacagacaaacctagatttcattctgtcccattctcccatcataaggaaaaggcttttcctggtgtaattcaccatgaagtattcttgacaccacaaggaagcacactgaaacatttagaatatgagccattctgtaggaaggctatgccaggttctgcaacaatcctctctaccactgggtaagctgaatatcaatagacaagtcacttaacctccatggatctcaaggctgtaactcaaggcattcttccaagtatttggaatgtagctattttcttatgtgttatttagtcctgtcctagaaacaaattttgaaataaaaatcttataccataggttatgtttcagcaataaagttggccataccattagccaagtaaacacagtggttagaagtgaggaaatcatttgaggggttcggtggtagggtgataaagtatgcctttcaagcatttaacgttataactctttcaatttcccaaaataacaaaataagatggtaatttgaaattaagtgttttagcattgctattgctttttaattatttgtttacaagacttttaggtatttatttctaccatgtattttactatttacagttatcaaggaacagttaagaagttttgttctatgaatctatgatgcagtaatttgttcagtattaattgatacctgcctctaggcatgtaaactgtgtgaaacgtaacaggtgtcctaattctagaaaaatgtgtggtaattgtttgtttgtcaaacagatgaataaatatctttagggcatagctggtcctcaggtggtgagcataaatggattaatgatgtgagtgactcggggagacacgcttgttttgcagcaccctcctccgccgatcgctgaagcagaacaaatactaattaacaggggcggcctggttggcaggttggctttctccagctgatttggcaaaatggtttattcctttccctccataaaccatccctcttagttattagacattttcatactgatgtttagttaatttctaattttcttaattaggatgcatttcatctcttgcaaaaatattataacgtttatagttaacatttttaaaaatttagaggggcctaagatttaagttttaatagttgacgcttgaatttcaaaaacatttgtttctcaaaatgtagataattcttccaatggaattattccaaagaatcgttcaccatcttttttttgtattcttacagtaacactaaccccactctggaaaaattataaaatcactcatggggtagtttaatactcttgttcttctttcttgaattatttctgcaacactttcctctgtccaacttatgtattttgttctgtggtgatttgaagtagctcagctatcttctgggttaaaagactttctacgcgtaggacccaccactttaataagggctgtaattttggacttagagagtcatatctgattactgccatggcaactgccttgtgaaagggttgaagagaattcaggcttcatgagagagtaatagaaaggaagtttgctgaggagctgagtagtactttctgaaagagtttttgatgcttttaaataaggttgctgttaaatgaagataatacagttatttcaaaactcagtaatgctgcttagacttggcaaatcaaaacttgaaatgttagcattgaatacttagttgtttttctttgaatctaaatattgaataaaataagtcacattgctttaactttatcagattattcattatttagaaccaatccaattatttttgtatgtaataaattttactgcttaaaaacagtgtaagctgagagttctagtattgtaatgtaacataagaaattcccgctcatttgtgatagttggaattggtggttaagtaccctcctcctcccaacccctgggttcagttttgcctctagttttccttcactagaaactggagaacaacacacacatacatgtaatccgctcacgtgcggtccacctttcttccttcacactgtttaatattccatcccctctgcatccactaaatgttcgtgaaaagcttacactttccctccccttttacagaaatgcaggcagtgaggtggaagttaaaatgtcttaagtattcttgttgtaagtgaactttctaagatatggtgataagggtgagcatgaggaattctttttcatggaaatggactcattatttaattgtatcatatcctgaaggattcttgaatcttcttttttaaattgctacttttcaagttgctgacttcaaatttgagaatagaagagggctgggagaggggaggtaaataagttagtgatgccacccagtgagagaagccagtaggcttatataataagatctccttgttatttattgctccttatggtcattttaattattctagagaattttgagaattctattcacttatctttttttaaacttctgtttttgtgagcgacatttggccttttgaacaacaaaataaaattggaaatgctaatgttttgagccaactaaaggaggaaaataaaaatgtcaccatggtaacaaagctgctttctagatggtttcctaagatatgcctgaactagaagcagatgtctgatttgagaatcttgcctccttcgatgtaaacaaataacttctgggcaggtgttggaaataatatggaaatcctattaaggggccccgggttcctgtcagtcaggaaacccgtgccacaaaagggctggttgtcgcataaaggagcagagtaaattctcattaggcttgagcttttcccaggaaatgattgtctccgtgtgttctttctcctgtgaatctgaatgtaagctgttgcttctattgatctattcactggctttatttttctcctcttcattccagatcctccctcgcccccacaagcctgtgttctccccctcacccaccccttccctttagattaacacttgatctgtgctactgctctgagagtcgtgacatttgtgattttaacctcccaacctgggtgggggtgggggtgggggtgggggtggagaaggaggggaaagttagtcttgttccctcagcctttttcacaaagactctggctgattgggactcgcacagctagcggcaacggcaatcatgaagaccattctgtgtacatttacttgaagttatatttttatgaattaagcagaaactaaaagcttgaagagacagctttttaggaacttttaaaaacatagatagttgtctggtaagcctctgaggctgccctgtccaatatggtgtagccactagtcacatgaagctatttaaagttaaaatgaaatagaattttcaaacccattttcccagttatattagccacatatcgagtccttagtagccacacgtggctgtagaaactgccaaaacggcagagatacagaaccttcccactgctgcagagagttctattggatgatgctgcgtctctgacagactctgatgaggcttgctggttctgacattccttctggctaaaactgactcctgatactcaaaagcaaggttcccctggtttcatagaaaacaaggcatgtgtgtattcgggtttgggtggttgatgtggttagctgcactaatatagtagtgatctttaaatggttgtagattttttttttttggtcacggaactggttgagcaatataaacatgggtcttcccaaaatggacccctaagagatgcaatttaatgtttctagatagaaagttgtggcagttttggggggaagggaggagtgcttgaaagctatgcataagggtgctctttataatactcagaaggttaaatgtggataaacacaaaacaaggcttcagaaaagccacactattattatgcagcgtttctcggactatagtccccgagacgcacttcataaagccaataaagcgcgcactggtggtctcccgttgccctagcaacgggccacggggcacagtgtatgtgaaatgcatgaacatctgtgaattaatcttttttagtttgttcttttcttggcactgattggaccactcgggcttgtgcctgtgacactgcgtgcagaggggtaatctggagcagtccccagggccttgccctaaagtggatagtggaatggaaagtgaagggagatttatcccggcagtgcattcagcagtgcagggatttagcctgacagcactctcagcgggatgttattagcttactttctggtgcatggggaaatgaataaaaatttttctagtaaatctgggcattattgggtttattgggttgccctgaaaaaataatctgcagagaaaattgaaataatcacttgtgtttgtaccacagttatcaggacttgaaagctgagttattccacatccttggcccagcccccgcctcagggattataaccaaaccatattggactgtcactgctctgaatgagactcctgaattggatgcgtaggctggaatctgatttgatgataaaatctgttagtaacctagtctgaccttatttagggaaattttaaactaagctggtgacatttttgcctttgggagaatagagcaaataatgactaaatacgtaagcgtccaggaacagtacttttgttagttagtcccccacccctgacctcttctgttctttccctcctcctgcctcccgctgccacttcttccctccctcttttcaaattgccatcctccttctagacttcagcatgactgtacagactgtgttcagttcctcctgtcaataccagatgttcacttgtaaactgttttgctcacccttgtcattttcaattcccttctcttttcttccttttttctctttgtgcctccctttttttttctctctccattcttccttatgggtcaaccctctttcctggggagaaatgaaagaagaatattacatatgaaatgtttcacgatggatgtagtctatttggttaattgttagggtgaaaatttcctttataacaaatgtattaaaacagaagttcgattgcattagtactgaaaggtatttaggtgggaagaactccttgtcaattctgtatatgttttcctttgattattaaaaaggcacagctatacctctgtatgtagctgagagatttttctgatttgttttttgttagacaactgactaaaaattatattaatggttcctgactttgaaacctgttggtattgacagatgaacttgcagtccaaataaaatatttaaatcagtaggtattgattcagcagctggagggcaaacaggcctgtactgcattgggggtgcacagtaaagattagatacaatcccttccttcaaatcatgttcctgttaaaatatggaattgcgatatgctgccttctgagtagaataaaatatattaatggatcgttcctcttcatttctcagagcttctggtgagtcctgaattctttaaaatgtgcatataaaaccagtttatgatgatgggaggactagctctgaaggcagtcttcccaggaagctgcccgggctgatgtgcaaatgcatgcaaacatgaacctttagcaaacactgacagtaatgccagtggcaacgttctgtcgactcccaatcgggatatgggccttttactcgaattcagaaagtgttttgtaggaatcggcaaaacaattgaactacagagctaaaatatttatcatctgattttttggcacttgaataccctcacttgcttttcaggtggtttctctgttttcaaaattagtaaataattttatttgtttttttgctgctcccatttagctctgatgatattttcttctttcaagagtatttttaaaaattgccagctttctagttgttacttgaagccagcttcagaagtagaacagttaacacggattattagagacctttagaaggaagtaaaattctcaaattttatttctatgtcttggactgttatttggtttttgaaagcacaattttttatgccaagaactaaaaatctgtagacactggtggtaaaaagtagaaattccacaattacaagtggcagtgagtaaactggctagagtgagaagcaggaatgaggtggaatgagtatgaatctctgctgtttccttcatctgtgtgtgtgtgtgtgtgtgtgtgtgtgtgtgtgggtggggttttttttttttgttttttttttttttttttttttgagaaggagtctccctatgtcacccaagctgctgctggagtgcagtgtcatgatctcggctcactgcaatctctgtctcctgggttcaaacgattctcctgcctcagcctcccaagtaactgggattataggcacgtgccaccacacacctggataattttttgtttttggtattttttagtaaagatgtggtttcaccatgttggccaggctggtttcgaacttctgacctcaggcgatccacccacctcagcctcccaaagtgttgggattacaggcgtgagccatcacgccccaccccttcatctatttttaacagtttcttaaaatctctgtcatgttcctatgtactaggctggtaaatagccataattcttgaattttatttttaacttttctactcttactgtgttttaaaagcagtaatagaaataaaatcagcactttaattagtgttgtagatatgtgtatctataaaagtgaaaatgtttaggggaaaaaaatgctgcttgttttcttagacacacaacattacatggaaacatttggtgattgcagtggcttcagcattttaagactgggctaccaaaaactgtacctgatacttaacctgttgggcctacccagggacagtgaaagagtccaaatggaggccctcataccatacactgaagtatttaaaagttataaatccaataaataaatacaccttagtgataacctgaaagaccaggttggaatttaaaattctcaggcactttggagttcattgctttaaccacgtgggtcctcacgtattttcttgtacacaccctagttcttacttcaaagcttcatcgaacccctacagctgcgcccagatctagacacactcaaaccagcagcttgatctaaccctgggaggcttcaggaagaggactgagactgagtaaaccctggaagtgggcctggggtgttagggcagggaatttcagggtcctgggtacccagctcatggtgtagaggccacggacaaaggctgtgtgtgggcatgcccccttggtcttacagggtgttgctcagccaactgagggccagggcccacgtcaggggcccttctccttctcgccaggctgcttggtttgtacatgatttcataagctatacacttaagaggaaagaaagggaacttagaactgttttatcttaaaataattctttgttaaataaatgtcaatagttttaatcaaaattcatccagggaattctaaaatataacatacatatacacatatatatatgtatataaaacattaaagataatctctaggaacagctgctttgacactgtgttttatagtctgtttacggatgtgtatgtttttaaaatactccattaaaaatccgaaatgcgtatcctgcctattggaagtgcttgtgaaaggaaggtggggagttggggtaccatttaaagctgagcaaggtaaagatagtgtggagcttcgaagtcaggattttctacacgaccccaccctcaatctggtccacatagtaaagattggatgctagtgaaaatgccaggcaagggttaggcctaaaaggattagtcatgaagattcgagattcttaaactaaagattatcactgggaactaactcgggtcatgatttctcttttcatctgcctttgttccttttatgcacttccacagttggacagctggaagtgccacagaaatatttgaagagccctatttagtagtttacgtgaaaagtcgttgaataattcacataacaaatgattagacaagcacttgtccatctgactgaattattctacatgtttgcccaagcaacaaaggagaacagcgtttcctcctacagagggtatacagtggtggtattgacccatctagttactgggtgggtttcagtcttttgttgacattgttgttaatgaaagcagcccagacgagctgtgagcagctgggctggataattgtgaaggattcatgcttgttgctgttacccccagtgtttgcagtgggttgtttgctttgacttttgttgaactgttgacaaaagcattagatacaaatgggaacaaataaagtggtgagatgccaggagggcttggcaggagtagtggttttctttctgactgaagtggaggatgtcggaacgtatctagatgggaagtggaaggtgtattcggtgtgtgtgtttagcagtttacccttccgataccaaactggaaaattttgttgcttatgtaccttggctcacagaggtgagagaatcaaggaggtcaccgtatcttgtaaccctcaaaaagccacgctctttaccatgccagtcaggtggcttgcaggccaagaatgttacaacagaaatagtttccagattccccctcctcaacttaaaacaaaattttaataatagaagtattttggactggggagatgacaggcatgacgttgaggtggggaggattaagaagaacagtatatgctaaaatagtatagctagcaaatggaagtcatctactggaacgcttttaatttgctttaaacaaaatactcttttgtatattcaaatggagagtagctcagctgttgtgaagccagaaaattaatggtatttttagtgaaatagcaaaagcatgtcaacaatgtagctgcagatgataatgctggcattttattcatgaggaattatcaatgcaggttactggacaacatagtgtgactgaaaatgattgagtgtcggagaagcccgccatccttctgctcgattatttcattttgcatttaggcttccccaggcttcatttgtgcatgtattttccctatcacaaaccaaaatataaagtctccctggcttaggattgtatgcatattttttcttcctttaaaatgtctccaaatgaaagttccccttgagtattgactcagaagctgaggagttcattttcagtgcacacatggtcagtggaggtggttaggcttcagagataggtccctctgaacagtttatctaaataggtctatggcagttgtttaaaagccagcaaaactcaccaccgtttgatagatggaaattgtcacagaatatgccttctctgacaagtagaagatttggaataagtagtgaggccagaaaaatgtttaaaaaacatgggcaagaataggcagaaactgtatttaggcaattaaaatgtcttttggaagagtgcgtttcagtgatagttgaagagttactaaaaatatatttgaatagtcaggaaaattaagctatgtctttttttttggcctgcagttttggtctgaggcgctctgggcaccatcactcacattgttttgttggtattatttcacctagtgtctgagcaaggaagaggctaaggcttcctttcaacattctgttctccaacctcatttattggattcccctctgctactggtgacaaaaagaatggattatacctttgtgtaattgtgcttgttccagtacttcatgtgaccaaatctaggaaagaataggaatttactgagtttgttaaaagtgggaatggcccaattgttttagtctttgcagcatcttaatcctagagagcagtgaccagtgagaagaggtcaggattttctcagaaatgggggcatgcgttacatggctgtgctccactcaaaaaagttacatgaatgctccccacgtttcagctctcagaagatattttgcttgtttcagtactagatggtcaaatggtaaaggcctagatctgaagttcatgaggaagaaacccctgaaatgacagacactgaatggggataaatgcatctatgtgattaagtagttggtagttcttccagggtttattactcaagagaggaggtagggaaatcgtgcaagtagaaaacttgaaaagactcaccttagaggggatagctaaagagtaaaatgagtaacagttaaataagaaaaaaaaaagaaagaaaaaaaaacttgagaagacaataaggcaagaagtttatcaccattaacaagccagaagaaagaaagagactacaccgacttgactcagcatgactccaaaattatgagaccctgggcaaaagcacaacaaaaggctcacaaatgaaaagaatgagttcaagagaaatttacttaggccacgtcaaaaagattggtacactgcaccctcaggcagtgaccagagatgcaagggtaagcatatttttgtaaaagacctgttttacagacagatatgcctcagtctttcctccccctcctttcccactgctcaagcaggtattcatgtttgctgtgcttttaaagctaaaatatcacccttgttaacggtgactcaaggtgactctacatactctgttcaaactgcatttcttaaggttgggaagctggtgtgtgttgggacctgtctacttctgtgcatgtggcatgctatgaactctagacagccagtaggcaggaaacagtgtagcaataccagctagacactcatcctctggaaccaggtggtctgggttcaaatcatgccttatgctatttaccatccttgtgatttttggcagtcttcttctctatctgtgtaacatgggagtggtaaagttgcccaatatagtaggtccttattggttttttttttgtttgtttttttagtgtacagtatgagtaatttgaaaatgacctggttgtgtttattctttggagggttaatatttaaattaacttgcattccacaaacaaacacaaaactaacagcagaaaggagcaaactagaagtgtgccaggccacagggaaattattgagattaaattttgcctaaaaaaaaatctacaaaatggatcttgtacatgcagatggttgagaattaactttagctgatcctagcacatatttaattccattggggattttgtgtttagggatagttcaaccttggctgagaatgtgacttttatgtattttacagcaaaactacttgctgctcataatggatgaaattggagaccaaagaggaagaaccttctgggttcctgtcagtctaaatcctgattttaaaagacattcacctgccatgctagtgttgtgtgcttctactggtaggaaaagctaataactaccctgacgagctcaacgagtggcccgaggactgtgatctcacagtttaccgtttttgcagagagcctcttttattttcgtgtcagattatctgtaaaatggacttctccctccagtgttgtaaaccataacaattctggcattcctctaattgtgtggggagagggagtatacccaacagatgcttgtcgagcaggagagactcttgctgcttttcattattttactactcatacacctaatccctgtcaataaggttggctgtttggggaaagaacacacatccctgcactataatactgatttatttgcagcttcttttcttcagaccgagttaactgaggagtctcacaaggcagtgagtcagccttgctatggactttgacagaagtatatctgaagggaagggagtgattgcagtattcagggtgctggggaacagcagacctggttcagcaaggggaggttaaggactatactcccacccctactcaagacatgaatgcctctcatagtgtgatccctggttgctttgttttcagtgaagattagcctcagtttctccgttaaaaaaaaaaaaaagtcagtctggaagattttatacggcctatgctttttaggccattgaaacaaaacactttttttttttttttttttttttttttttgcagaggtggtggtgggggaggggggatgccctttcagtgattagtgccctgctacatagttgtcttccagagctacaatgtcaaggagccctcctgtcctggggagagagggtgcgcagaatggaaattcagcttgctcaaagagtcataccaacagggctctagcagatttcatattttcttaataagaatgacaaaggggccagagtcctggaaagtaagatacacactgggcataagatggtgtttgccctcatgggaagagtgtggttttcccacaggagaatccagaataaccaaccaacatggccaagtttcccactgtgggcgggcagtgaggggcccctgagcagacaggatttcaacttcccacatgagccagggtgggtctggcaaaggtttaggagatgtctttcaagtgaatctgtttttctacatgttttctacctctggatgtatagagtcagcttcctgcatgacctgtttttgtgagacagaggacctgggaaacatgaggccatatttgaggcggttcattcttaccaaccgccagacctttgtttttagagaagtggaatcttcaccaaaggcccaagaagcctttgtggggtcagctgtgcttgagaattcttgaatctttgttactctttatcacctacctgagatgccacttttgcttgcttagctcaggtttggaatttgatttaagagggattcacatttctctgtttatcagaacttagcatcaattgtgtttctttgtagagatgtatgttacttaaaagataagggaaaggagcatgtgtttctgtagctcagaaaaccctaagaggaaggaccagataaagtggaaactttctacagcgacaattagagttatgttaaagaaacaagtgcaagtgagggcaggtggagcatagaaaactctcagcacagggactcaattaaaaatgcttttaaaatgtaattccaatcaatgtggatagtcttagaacattgcaagatgtgtgaaaacatgctttaaatgccagcaaccagtgaaaagggcacggttttagaaaccctgctataaattatgtgcctttggctttcaggaacgtggaggatacatcgctgaaatattcagaataaatatcagagagaattgtacagtcttttcattctgcaaggaatgaaatttttaaagagctagttgtgtttggcgtaagatcctgaaatttttttatagtgtcacaacatttgttttgggagatgtacaaatcaaatctgattataacaaatattataacaaaaatatccctctaaccaaacaatttctagaccccaaccagtggtccacttatttaaaacaatattgaatgtaacccaattccattaaggcaaaataatgtgagttagtcttggagtttttctttcatgagttccttaccttttggaattcatataggcaattggcagtgattccaaaaatgtttatttacctttggaactatatgattttaaaagtgtagtttatctttcaaattattttctgcatagttccattttacagtatctgtttttgtgggaagagactactccaaatgaaattctggtttctgattggtttcctccttgcctattttagtttcttatacttttatacctaaaaagtttttcttgcatttaacagagtaatttccccctaaaaactattgaagtagtagcataatttacatgttacttcttgtcaaccaccaaaaccacagggtacaacctgatcaaatacactaaatatgaaacaaaacacaggctcaaaatagagtagatggccattgctgcatgtgagtagtttttgccccgacccctggtcagttgattccagtcacgcctctccatgccttcctggggggtgattttgtagggccgttctgcttaatgtttcctgactcaacctgtccctgggttcagaacccagggatcttcttcctcctaattacccttgccctctttagtcctcccaggcttcaggcttccctccaagtggggatcccttcccagataaaagagttgagaagtggtttattgcttttctcaatgtttaaggaaaaccactagaaggctgcttagtatagagtgaaaaccatgtgctttgtagccgttgccatgggctctggagacagctctgcccctgctagctttatgaccttggacatgaataataattagcactgtgggtgcatatactctgtgctgtcatcagaacagcccattaaggtggagtttgctattatctccgtgttgcagatgaggaaagtgagacacagtgagactaagtaagttgcctctggttcacccagaacataagtgatgagctgactaggattcagttagtcttcagagcccatgctcattatctctattctagggtcagttttaaaccctcatctggatgtaccttacttgatgtaggcaaaatgcaaagattagagataggaggagccccagcaaggggcctgccacgtaggaaaatacttaagattataggagcttcctccttttcctgtcagatcagcaaaaatccaaagtatcgattttgtatatgtgtatttgtagtagtgctgttgtgatgtgttcttttcatgtgacttgtctgtcatatgtccttagagtgtaaacttgtcacgtggggcgggatgttttaatacttcacaatttttaggaccttcaaagtggcggttcaagaccatttcactttggagcattttggaatgtcatcacacagtcccgtgcgtgtttttgtgttaaatttctcatatccaacagatgtatcctcctcttctaccagttcagaatctgctatctgattaattaaaatgtatgcagatgaaaaatctgacaaagattttaacttgtagcctcatcagtttgctggaggttaataggaatattcttgcagtaacagaatcccccaatttggattttctagcttgatgtcatttttatttcatgaagaaaaaagggtagtttttgtttggttggttttttttataaccactaaccagatgtagtgataatactttataacttaagtgtctataatttttaaatctctttgtcctttctgcccttccctaattgatgaacaagcacttacacttgcaatgttttggctcttgtttcctatcagctgacttttggagatttacagcatggattaagtagggaccacttgcttatcctacttttctttgttttcctttccagtattccattccctttttccctgccatctcctcctgaccctccagaaaaggacatcttagtaccttagttgggtggcagtcacagaagaaaacttgattccagtgctatatcaaattgttggggcagcctaaggaattaagttgagggctgcatatcatagtgatttatactttaagaataccaaattggggcccatggctttacaaaggcattttcttatattaatttgtgaatctacatgaaaacaattaagacatggaaattaaatttcatttattcttcatttaaccaaccactttaaaacaaacataaaatcctgaaatcagtatatccttaaaatccagaatgtgtaggcattaactatttgtgactggtggcttaatcattttcaaggttcttctttgattcactaagcactgtcactgccactgtggttggtcattttgcttctcttttaaacacagtcctcagctttacattagggagctaaagtgaggtgagagataatgtcttagaatcttataccagttaagtatcccttatccgaaatgcttgggactagaagtgttttggattttggtttttttcagatttgggaatatttgcattatactcactggttgagcatccaaaatctgaaaaatctgaaattttaaatgcgcaatgaacatttcccttgagcgtcaggttggtgctccaaaagttttggactttggatttcagattttcaggtgtgggctgctcaacctgtactggccactttgaactgattagataacaggcatcacacaagatgcttgaagctagattgccctggtagagtgacaataagggataatgactttacactcgttttatactactgccatatttgatgatctgttaattgccagtcatgtttgtttagatattgtttagtcactgtgcctccccaaggcctttctggcaaagggcacaacaaatagagtaaataaattattgcttttgttactactgaaactattttggctcaatactctaaattaattgttttcatgtagattcacaaattaatataagaaaatgcctttatgaagccatgggccccaatttggtattcttaaagtataaatcactatgatatgcagccctcaacttaattccttaggctgccccaacaatttgatataacactggaatcaagttttcttctgtgactgccacccaactaaggtactaagatgtccttttctggagggtcaggaggagatggcagggaaaaagggaatggaatactggaaaggaaaacaaagaaaagtaggatatgcaagtggtattgtattttgttttttaaataaaatatgtggaaagagagaaaagccaaccagaaatatggtagaaagagcactggactagattcaggggaggcgtggccatcgtctagccttatctatgacgtctgttctctctgagcctcagtttcctctactgcataaccacttaggttcttctgatgtatgatggaccctatgatttattttacttgatatttaatagcagagctttattattttaaaaaatcctcaaattattagtttgagctaaatgttattctatatagatattctcagtgaaatgttggagctgcctcagacatgtaaatcaaagatgtgttcagtattttaatttctttcatgtgtttgaagatgcatttcccatgcatccatggttttagccatgaataaaacatagtattatggaaggtataatggtataaaatccagaaggatagatctgggctcaaatcgcagactagagatagatgacttagcaagttactcagttttccccaactagattctttttaatagtaacagtagcagcaataatatctatcttattgggttattaaaagattaaatgagacagtgtgtgtaattgcagagtgcctggcattttactcaattctcagtaaatgtatcatgtattcaaagtagtaattttggctaattcaaaaactatttgcatgctaaaagttgtagtgcctagtattaatttagttcgtggcctctgtatgattttctgtccttttgaagatgtatccatgacagaagtaataataagcagactgctagagcatcctgagcatgtgtcatgggccaggcattgggctgtgtgccttatgtatgttgtctcattctaagatttccttctctttttcttcaaaatgttaactctacttagttgaaagtattggactatgataacagcagagacaagatgccgtggtagaaacttttttaatttttttgaattggtaatcatgggtcctgataacttgttatagttgtttcttcattttttttttttttttgtaaaacaattctgcgttttgaattgtgtataatctgagatggattcaattttttttcttttgtggaaacaaacttaattgagcttatactattccagaagttttaagatgtggcatcttcacaactatcctgtttgtgaattttgtaggcttgtcattgttttcacatctataaaaatgtggtcaatttgtggatgctcttttacttatagaatcagaagtgggtggtgtaagagattctacacatttatcaaactatggaactttagaaggaagagtactgaaaggttagccttaccaggtacttctggcgtaatttctctcttctattttgaatgcttctttatgtataaagatgaatatcaaattcagtagcttgttaacaaagcaactagtgagtgatgtcattgctaaacaaattcagtacgctgttttatacgtatgcagtctctgtctcagttaaagaaattagtagatatgtgaactataaatatattaaatgaggcagaaaaaaatcatgcatagcctcatcaagcatctagatgcataggtccacagataatgatcttcatcaagttatgtacgtgaatctgcctgttcaataattagtaccattcttttgtcataatcctgactttataatgaacctaatgcagtaaggccaaaaaactttgtagatgttaatctatgtacattgtatttgagtaaatgtccttgtttatcagcagactttcattgcaagcttgaattggaaaccacatacagacctttccctaatcctaacttcatctttttttttaaatcagagaaaaataatgaatttattctatcaataattcttaaaatagcttggtaataactatcatttataaagattaccactgtatctgagaaaaaacaatacacagtcagtaattctcatcaaaatcacctgaacgttgctttaggtttcagtggcactctagtttaaggaagtactttattattgtttttcttttttttttattattattatactttaagttttagggtacatgtgcacaatgtgcaggtttgttacatatgtatacatgtgcctgttggtgtactgcatccattaactcgtcatttatcattaggtatatgtcctaatgctatccctcccccctgcccccaccctacaacagtccccggagtatgatgttccccttcctgtgtccatgtgttctcgttgttcaattcccatccatgagtgagaacatgcggtgtttggttttttctccttgtgatagtttgctgagaatgatgatttccagtttcatccatgtccctacaaaggacaggaactcatcattttttatggctgcatagtattccatgatgtatatgtgccacattttcttaatccagtctatcattgttggacatttgggttggttccaagtctttgctattgtgaatagtgccgcagtaaacatacgtgtgcatgtgtctttatagcagcatgatgtatagtcctttgggtatatacccagtaatgggatggctgggtcaaatggtatttctagttctagatccctgaggaatcgccacactgacttccacaatggttgaactagtttacagtcccaccaatagtgtaaaagtgttcctatttctccacctcctctccaacacctgttgtttcctgactttaatgatcgccattctaactggtgtgagatggtatctcattgtggttttgatttgcatttctctgatggccagtgatgatgagcattttttcatgtgttttttggctgcataaatgtcttcttttgagaagagtctgttcatatccttcgcccacttgttgatggggttgtttttttcttgtaaatttctttgagttcattgtagattctggatattagccctttgtcagatgagtaggttgagaaaattttctcccattttataggttgcctgttcactctgatggtagtttcttttgctgtgcagaagctctttagtttaattagatcccatttgtcaattttggcttctcttgccattgcttttggtgttttagacatgaaatccttgcccatgcctatgtcctgaatggtattgcctaggttttcttctagggtttttatggttttaggtctaacatgtaagtctttaatccatcttgaattaatttttgtgtaaggtgtaaggaagggatccagtttcagctttctacatatggctagccagttttcccagcaccatttattaaatagggaatcctttccccattgcttgtttttctcaggtttgtcaaagatcagatagatgtagatatgcggcattatttctgagggctctgttctgttccattgatctatatctctgttttggtaccagtaccatgctgttttggttactgtagccttgtagtatagtttgaagtcaggtagcgtgatgcctccggctttgttcttttggcttaggattgacttcgtgatgcaggctcttttttggttccatatgaactttaaagtagttttttccaattctttgaagaaagtcattggtagcttgatggggatggcattgaatctataaattaccttgggcagtatggccattttcatgatattgattcttcctacccatgagcatggaatgttcttccatttgtttgtatcctcttttatttcattgagcagtggtttgtagttctccttgaagaggtccttcacatcccttgtaagttggattcctaggtattttattccctttgaagcaattgtaatttgaagcaatgggagttcactcatgatttggctctctgtttgtctgttattggtgtataagaatgcttgtgatttttgcacattgattttgtatcctgagactttgctgaagttgcttatcagcttaaggagattttgggctgagacaatggagttttctagatatacaatcatgtcatctgcaaacagggaggatttgacttcctcttttcctaattgaaaaccctttatttccttctcctgcctgattgccatggccagaacttccaacactatgttgactaggagtggtgagagagggcatccctgtcttgtgccagttttcaaagggaatgcttccagtttttgtccattcagtatgatattggctgtgggtttgtcatagatagcttttattattttgagatacatcccatcaatacctaatttgttgagagtttttagcatgaagcgttgttgaattttgtcaaaggccttttctgcatctattgagataatcatgtggtttttgtctgtggttttgtttatatgctggattacatttattgatttgcgtttgttgaaccagccttgcatcccagggatgaagcccacttgatcatggtggataagctttttgatgtgctgctggattcgttttgccagtattttattgaggatttttgcatcaatgttcatcaaggatattggtctaaaattctctgtttcggttgtgtctcttactagctgcaggacctcagacaagtcccttcacttgtatttttattaatacttagtatttaacaccaaaatatttggactaggagttctctaagtctgtgaatacatccaaaaattaagatttactctgggggaaattatgtactgatgaagtagaatgagtcttggatatacttaatctgctgtggttaaaggaagtcactatcagccaactcagtaacgttattttgttttttatgtttagatgtacaaataaaaatagctgttatatatttgttagattttgatgaagagcttgcttcatatggtaaagagctcttcacatacattgttgtagcagaagcgaaggttcattggatataggctctttccttatagagtgacagcatacatgcctggtaaagttgaaagatctctagctttcatgttactgggtgttaggacatttctctcaggaattgaagatcgaatgtccacattaaggacattctagacattctaagtccttattctaaggatacactgacttttctggctacatggatacagatctgttcagtgattctgtggataactttttaagaaaaatatgctacatattttccaaggattccttaactacttcctggaggcagggagggaaggagggagagaaagagagggagggaggagggaggaagagagggagagagggagacagagagagagagagagagagtgtgtgcatgtgtgtgtgtgtgtgtgtgtgtgtgtgtgtatgtgtgtgtgtgtgtaatttggtatataatatagttatatataatttgatatttttttaatgactcttggatagcataagaaaatgttaccaaaagagtgaaatcttgattagtttgaacttacctcactggtgtctcatgtaacctgttattgttaagatgtggtgccataaagagggccactcagattcagcacattggcagttggttggagtttggatctggaagcatcctattttgtggttttcttaagttaaaactttattttaaaagagaaaataaatatacaggctctttttaagatcaggcaggcccacagtcttttatccactattctgaaatccagaaagctctgaaaactgaaaggttttttttgcatctcattcataacaaaactgaacctggcttgaagtgatgtaaaagtgtattaatgtttgattatagactgttattccagcccctgttagagtatatgcatcatattgcctttaggaaattccccagatactgaattctaaagcacatctggccctcaaggatttcctgacatgccttttccaagtccagccttggaacttgtgtgcttaccttatctctaactctcattgaaaagaggcaaagcggtcaaaaaccttgtccttttcagctttgagccttcctgcattcctgtgaggggcctgcgttgtagtagtcgtttgtcataaatcagtgaagggagggaggaatgttcaggcaggtgttccaaaccagtcagccagcaatttcctgtccagtgtcctaggcttaaattaagccatgaaactcagttgcctgatgaaactgaagttatcaagtaacaatttaggacctttccccggcatttaaaatcatgagaatgaaaatgctcaagcatctcagggtggtaaaatgactcttggttggggttgcagatcacactatgcccacagccattatctcacctcctggatcctattgagagcatcctaagaagagaatgccagaaacttgttatgatcgttgtggtgacagtcttcaggttataaaaaaatgtaggaatacactacattctcctgctcttacatagacaaagggatgagtaaactatggcccacaggccaaatctacttcccagtttgtttttctgtggcctgtaagggaaaaatagtttttacatctttgacagggcataaacaagtaaacaaagaaaaaaatgtacaagaccttatgtgggttgcagagcctaaaatgattgttgtcaagctgtcaaacactttacacaaaaagatttgccgacctttgatgtagaccatcagtttaactcccagccttactgctcctatttttaagattgattctttccttctccattcctattctcctttgtcttcaagagttggctgactctgtggtcattcagggctcatagttacttttttgcatgaaatgagaaccctaaaagatggtttatgtcccctttttgaaatgtacacaggaagaaactcttaggtagaattaaattgagcgtaaacatgaagtttaaacttattttgatattcaggtgtggagagaaccagttaaagagtttacatggtacctatgccaattttacaaaggcaccattactctggtcccttaatcaacaatgatccatgtctaaattatgtaattctggaatatcagtataatttaggaatcatactgtgagccattctatttttttctaaattatgtaagttacatcaacatacaactttttatatcttgccttttaatccatgaactgataaggtgtggttaatctcactgatcttgaaatattctccgtattttgtattaggagattagtaaaaatcagttgagacctagagtcagaaatattacattctaatactagcttgactcctctagctttgtgaccttaagcagtcacctaatctcacaggagttctgtttgctcattaacatggcagtaataatactatccaaataaagttttgtggagggcatgtacaatgatgaaacgtgcagaaatggtattggtgaagctgtaatgaacttatgacgacagtttatcatttatacatatactgactcatttcttaagatatcacaaaccataattccatagaaagcctgagaaccaaaaggaatgaggttgctttttaatttacattattttcatctatttctaatatggatgtcttaaaaatgagaaggagtatttattcctataatgcatatcctcaattaaatggttatattagttaacaattactacctaagaacttcctctaaaccatactggtatgaaatcgaaagcatttgctacatctgattggtctctgtgttggctgcggtggaagcttttctctctaggctgggcttgaatttgcttatatgtctgcagtcagctgggtggtctagaacagggatccccaaaccccaggccatagaccggtactgacctgtgtcctgttagaacccaggctgcacagcaggaggtgagtggcggctgagtgagcattaccacctgagctccacctcctgtcacatcagcagtggcattagattctcataggcatgcatactctattgtgaactgtgcaatgcagggatctattgtgaactgtgcaatgcagggatctaggttgtacacttcttatgagaatcttaactattgcctgatgatctgaagtggaacagtttcatcccaaaaccaaaccactaccgccaccccacctccgtccatggaaaaattgtcttccatgaagccattccttggtgccaaaaagattggggactgctggtctagaacgtcttcagctcaactgaccaggctctccctcatgtatctatggtatccctctagcaggctagccaaggcttgttcttttggcactagtccagagtctaggagagcctctctttgcatcatgtgtgctactgtgccattggccaaagcaagtcatatggctgagtctagcatcagtgacagagccctaccaaatgtggatacagggaggtgtgaaaaattgcagccaatattgcagtcagtctaacacagtagttttagaggtaaaggaaagtctgcccaagtggtgactggcttgtagcctggcacatgcgtcatggttgggcccgtgtgcatgcgaacggcttggtaatttcagtgcttcccttctcatttctcatagctgcactagaaccgtggcagccttaccatctgactgcttcatgagaaatagcccacgcccaaatacacacctcttgtgtttgaaataacacaaagagtattgtttccaagacgactttgatgaaatgtcagctttccctgggttctaaacccatataagaagcattgttaccctcattcctgctgggtaatttgtatactgcaatagtttgtttgaaaacatgcccgttgttctttaaaatatgcttaatgctagattagaacagatttttttttctgtttatgcaagctcatttctaaagcatttaaaataaagagcttgggcatgtgtggtatttaaaaacccctcacatgatgtttttaaaacagatcaatttcagcattaaaatgttaggaattcagccaaggaaaattcagcttggattgtatagctgtaatgataatgtattataaccatcttctttgaaagtgattgtagtaacagaattgaacctggtgaattatataatttaacagtgttcaccagaatactactctagggggattattcaagcctttcctaaagcaaaacaaaacatggattttattatcacaagatagtcatcacaaaatatctaaagataactcatttggattgaacagaaggtcatatgtctgaacatcacttatcccacttaactacttggcaggatattagtatgtaagagtgcatgatttttgttttttagctactttgtcttgtattaaaaatgtcttgagtttgcttattacttacccagaaggtattttcacgtcagaagtaacttcataattgagacattagtgattcacaaattgactcccaagtacagatggccctctatattcctgggttccacatcctcagcttcaactaaccacagattgaaagtatttggaaaaaaaatacaataaaaagttcaaataaaaatacagcatgtacattatattataaataatagagatgatttagttataaagaggtataagtaatactataaataggcattataaactagagatgatttaaaatatacaggaggatgtgtctaggttatatgcagatactatatcattttatatcagggacttgtgtgccctctgattttggtatctgcaggggagagggaggagtgtcctggaaccaaacgcccatggatacctaaggatgactgtaatttagaaagtttatatatcagtcatattatttaggcatattaatctttttaaaacttttttaaaagctttgaaccaacaaccagtttctaaacattatcaaaacatctgtaatgttggtttctcttcggggttgaattgtgtctcaaaaagatgtaataaaattctgatccccggtacctgtgactgtgactttatttagaaatagggtcttggcagatgtcatcgagttaagatgaggtcatccgggaatcaagttggccctgcatccagtgactcatgtccttataaggagagagaggtttgacgatacagaggaggcacagaaaggaaggccatgagaaagcaaagaggaaagactggagttgtgctgccacaaaccgaagaatgccaaggattgccagcaaccaccagaagctggaagaggcaaagaagcattcttccctggagcctttggagggagcatggtcctgccaatgccttgttttcagacttgcagactccagaaccgcaagaaataaatgtctgttgctttaagccacctagtttgtggtggtttgttgtggcagccccaggaaactaataatggctcccaagagcgaagtttatctgtcagttgtgtttcatcatcagtgaagtacttgctgtatgatgctaaatccagtgagcatctacgtttaataagccccagaactgtacatgttaaaagcttttaaaattttgtcatttggtatcatctggtcaggtgcagacactgcacttaggctctggggatactgtggtgaaaaccctgaataaatttctgcccacatgcagctcacatttcactgggaagacacacagtaattatagattagcaataatgacagtattgcctcagtttgcgtttatgtagcctacattcttcttctcccccgaatcgtaattgcccttggatccagccgtgggtgatgcaacgagctcaccatgctcctcacttgctcatgggcttgggttagtgttgccatggccacgtacaagttatacagaagcgcaattcacatgaatctacgatgttctggtgtttcctggagttgtagcatctacatcctgtgtggtcatatgtggtggccccatgggtgccagattttcttccttgtctctcccttcaaaaatatctctcaagtggagacctcagagcttttccttctctaatcttttcagaaaacaaaacaaaataaaattttgtaacattcttttttcctcgtctttcatttttatagaacttaagtagtttttacttcttacatgtttgatagagttctcagcctacatcaaatatatttgaatccagaattgtcaaccctaatgaagcaagtcccttgtcattccttggcctcttccttgcccttccttggcctcttccttgccctcttttcttgatgttgccttactgctctttgtacaggctggtttcttttcacaatacacaagtgtaatttgctgagcctcctataagaggcagtccttaaaatcagaggcctgtcttcaactatcagccctttgtgaccttgcatgagttacttcgtcccctaggattcaagtttcctcctgttcaaagtgaagaggttgaggtagacaagtgcttctcaaacttttaatgagcgttaaaagcacacgattcagtaggtctggcagtgagactgggattctgcatttctaacaagccctcaggagatgctgttggacagtggaccacacttttttgagtagcaagaggctagatgatttctctggtccctcccacctaaagatgagaacttccttcccttgttccacgttgagaaggcccaccttgctggtcttcacattttaatagtctcaccatctctgcacactgtctaccaaaggaaaggtcacagtatacttcgtgctgtcctatagtgcttataaggacctgccatctgcagttcttattttatagcttggccttctccccttcaacccccgaaagactgaaaacccactatctaatgcctaattagaattagccttcaggttacatagtttttgtgactgtttcccttggttatctgccattccttcatttcacagtaatggtagatttataacagtcctcataactgattaaatgtctcaattcttttgctttatgtggcgttcttgggcacttaattatactacattaaatggtgtcttgttgctgtcagtgcagttggattgcagtatagatagcatctttggatattttttaatatgttcctatcatacactttaagcttgtaaatagaagtgctgagcatgcataaatgtgttttaagaaattatttctttattactgtttagctgaactgatggtgacactaaacactgaggctttgatgtttatacgatattcttccccactaattaactgcactaatgaagttaattgtggggaagaatgccgtataaaacatcaaagcctcgatgtttaatcacaacttaaaaagaagttttatactcttcaattgccaaatacattccaattagctgaaggaaggtcaaaaattctgttttcttccatctcatcttcagagcttttctggttgaccattggttacttgagctgcctgagtgttaatctagacaagctgacagtggcatgtggaggacaacatatcttcccccaagctataagccagcataactgagagactcagtttctgcaaaaggcagtgatgacctcttctgtaatgtgttgatgaaaaatgaatgaactcacagagtaatgcatttctctaccctctaattttattattagcttgacccactactccattttcctatatgtttccatatgttgctcttataagccacttctctaatttctgataggcatatttccttgatgaattcagactgcaaaaccaaggaaatgtgtatgtgtgtgtgtgggtatgtttaaaggcatagggcgtatgtaagtggaggctttgcaaagttgataagaattcttaaatgaccagtagtagaacaagaactccttctcaggtcaatttccctgtggtgtgtgttacatcaatttttattgttgttttttttttttcttaatcaggcagggtttacaatagcaataatgtaattcaaataagcaattattgtaattgaccttggcgatgagtatccttggcttttaccacagtttgcttaatacctgaggatgggcaattatctcataatgcccactttattgagattattgttttaattatggcactcaaaatacatcactttgtcagcattgtagagtcaagcatggaagcactgcattcagtattcagaagtgcgtaaagagcatcttgcctcatcttatgacatggttatgattgcgttttttctctctcccaactgtggttttgaaatgtagttcatcctgacgtgactggcttatagggagagaaagtctgggatttgttgctgagctaattgtgctctcagaaaggatgaaggtgacttgtgctgataggtaagcaggtctagttgattaggagtggtaattgatagcaatcacagtggcttgttgattatctgaatatgccttaggtcagaggttgtcaactttagaatcacctgggagcttttaagattgcctgtatccaggccacttacttaagcctaccctctctggacagcgtctgatttaattgttctggggtgggttccagatggggctttttgaaagctccacaggtgattcttatcccctgacagaccttagaaccactgcccggtcctttgaattatttactccttgctgatttgtctcattccaaccatgaccccatcccagattttaagactccttttgggggtccttgttgctctataccttactcttcctctctttctttccagacttagcctaagcctagccacctcacatgcacatgcttgaaatagcctcagtgcagatttgggtcctagtaatgctaattcttcccaagcagttccaggtctacccctcccataggaagtgtcagtgggtaaatttcacctcttcataaacgtgaagtgtcatttcttactaatgcctcattatgctcttacaattcagttttctcttggtcacataaatatggcttaacctttatctaagttttttgagtaaggatcagaatttattctttaacatctgtcttaagtactgggtaccactttgtggaaatttaattctggttgattagatcagtagttatgaagttcctagttgtttctcaccttctttgataaacctggaggatactgttcacacgcatcttgcagtcccttgattccctaaggataggaatattcttttaggttacctaagactcctgcttctttttttttttcttttttcaaatttttagacgggatctcactctcactcaggctggagtgcagtggcaccatctctgctcactgcagcctcccaggctcgagatcttcccactttaaccttcccacaaggtagttgggactataggaatgtgccaccactcctggcttttttttttttttttttttttttttttgtattttctgtagagacagggtttcgccatgctgcccagtctggtctcgaactcttggactcaagcagtctgcctgcctcagcctcccgaagcaatgagattacaggcatgagccaccatgcctggtgattcctgccatttttacactaagaacctgtatcttattgcaaatgcatgaagatggcatcattatattgacaaacttgattccattctaattttgtattcacataggaacacacatttgtgtgaagtgagtcactcatttatatcctaatgtctcagattcatcctcttcccccttccccagtagccctccagtctaaaccaccagcatttccctctggaccacagcaacagctccttactggccccccatttctcctccaaggctctgttacctgccagatccactttagcccacaccaacagcatgagtaaagtaggggcaccaaaagtggtaaaaactcagctttgatgatctgattcagaattttgaaaccagaattctactatttaatgttagcatacacagaaggtttatattgtacacttagtgttgtttttaattgcaaaggatggaggtaggcagtgtaatcttttctgttcttatgggctttaaaaattcttactgtgattcgagcctcctctctgaatgatttttaggatatgtgtgtcatctcaacagtccccttcagtggcccttagaataaaacacacacctcaccgtgtgctgggcctgcacactgtggaccccctttctcccagcatcacccctctgtgctctcccacctgctccctccacgtcagcacccagtcctcctgtgtgctccagtgccattgccagctttccgcttcttcagagctatgcatgtgttattccctctttctagaacagtcttctggctgtcaggaggtttggctccagcttttgcttcaggtgtcagccagaatgtcatctttttgcagaagcgtttcctgaccacctggctgctagttattctcagtctcagcatcttatgttctttgtaacacattgccattcgcatttattttattttttattaatgttattagcagcttgttttacttgatttttaatgtcccttaactagaaccagtgctctgtgagaacaaggtccccattcgccctcttaattgtatttctagtgccttagggcccagcagaatgcctggcaaatagtggggactcaatataataaccctcctgctttgttattgataagggattatgtgtctgcatgcccccctcccccatgttagttttgaggccccactcactttagagcactttagaattatttgtcaaattccagtgaagttgaggatgcaaacctagtcttcacttagcattgtaactcaaggttgccctagaaggcacatttgacatgaattctgcaagttggaggaagagcgcgacttctgaagagaacaccaatccaggagggcaggaagatacccagactttggaatgtgctgtctgaaattttgactgtggagaagtggagtggcttttccccagggtcctgaggcttgaaaaagtgtccattaccctctttcaaaggcttagaggagacattcacagcagctctccaggcctcctgctacccagattggtttgctggcagagacttggccattgccttttaggacagatcccagaaacaatcatgaaaggaagggcggtatgcctccacttcatgtagttatctcgtttaattgtcatgactatcttagtttgttcggggtgctatgataaactaccataaactgggtagcttaagtagaaatttatttctcacagttctgggggctgggaagtctaaaaacaaggtgcctctattagatgcttgatgagtgcctgattcatagatgatgccttcttgctgtccttacatggtgaaaggggcagaggagcttctctaggcctattttataagggtgctaatcttatttctgaggctctaccctcctgacccaatcacttcttaaaggcacagcctccaaataccatcacctcaggggttaggtttcaccatatgacttttgatgggacacagacattcagactatagcagtgacaatcctgtaggcgaaatatccttatctccgttttataggtatgacaaagccccaaggggttaacttgctaggagtcacacagttgataaatgttggagctgaggattgaaacctcatgagtgcatgtgtattcccttcccttccctttagactctactctctaatctcagtgctggctataaagctggtgcctttttcactgttgtgtttccagtgtctaaaacattaccaacacagaatagctattcaacttatgtcacgggattcttctggtattacaacgtgaatctctgcttgtgaagtcgttgttattcttcagatagaggaataaagactcatttttccatctgcctgctagcattgaaaacccttaggcagaatctcccccacccaacctctgtggtctagctggccctgtcaagcctgctaataacctctccagtctactctctattctcagtggaggaaggtcagtgggtatctgttttagaaatgttgtcagtggctcaaatgtctgtgacatgccatttgtttaatcccatgctcctggatacttgcttgtacgcattaggttgtgggatcttctgcgtttcaattactataccctggaagtttataaaccataagacttaccagatagcagactgttggctgtgttagcagagagctgtcctgcggtgggacatgcatgcacacatgccacacgtgtgcatgcatggaaagagagagacaaactcaaccacaaaagttgtacctctgctttgagttattttaatcttccttcatttgttcagcaaacacttatgaattgtccttgcattaaaaagtgcatcatgtccttcgaaccatatttagtattaaatagcaaaagcgcatcactgagctagcattctttttaataaaatagtgattgatcaaatggcattcacctcatttctctgtgtggtgagtgagagtattttcttgcagtccattttcagcatgctgctattactgcaccacttagcttgatgccaaattgcagttggctccattcatttctgtttactgagtagcgctgtagtgattaaatgtcactgggtacaccaagtatacaaaagtaattaacctaaaaggacatgttagaataagggtcaacaacctctttagcccacagtgccaccagcaagacagagtattgacagaggtattgctggcagggcaagggcggaggggggagtgtggagaacggaaaagagagaagcgaatggaaggagaaagagggagagggaaaggtcagagaaacaggagcgatagaccaggactcacaattgtctgaaatggcaagtagaatggagctaagatatttttcatcagtcctttataatttagttctctgacctgtgatcttttgctgggggagggtgagagattagatcataactggacttacctttcaacattttagcactggttagtggagtgctcttgtctggttagaccagagtaattttggcacatgcttggtgaatcaacctgttcttccagtgttttttgtttcctcaaagtctcctgcatcttagatcttgttgtcatgtgaaagctcgaaatcgtttctgtagaatgaactgaaattgtatctcttaagtatctatgtctcatttattttcattcctcagcatactgaagttactatcagtcacaactgatactaataatgctttatgttgctttacataataaaaatttacgtaaagcaccaggtagtcatctatgacttaaatatcaaccaatgtaaacatcttccttaaaaaacaagtattatatctgtctgccttatatttggctttttctttcatcatctgtgtgtggtgacttactaaccagaaaaaaaaaaaagcaggggggaggactaaggatgtttttccttttaccacatacctccttgggggataaacatttcaaggagctccccagggtcactattctctaaatgagcagcacagaaaaactgctgatgcgtgcattcttccctgggtctgtcaggcaggattcctttaaatcctgtcttttcagtggtcagacttaagtaagatttgtttccctgtggtcacagacagctgaggagtgtgtgatgagagacaaggaaagggataacctgttgaaaactttccctcttataggaaagattaatttctattacaatttttaaaaaggtggccttcatacatttatccaacaatgaatattcattgcatgcccacccagtggccaggactgggcactgaccttgggggaggggcctgcatccttgattggtgaggagagcagcagtgaaaaggcaccagctttaactgtcttttcaacatagttctgaaaattatcttgtcaccctattactttcaaaattactatttttgaaggctgcctccctcctttggtgtgcctacaaatgcatatctcacacacacacacacacacacacaccactgttcttgtattacaggcattatattaagcactgaggatgcaaagaaataagacacaatagtgcatgacctttaggaatgcataatctcctatcttaatataatgaacataatatggtaacatgaagcatacatgagcagaaccaagttttgtgcccattcatttgttcagcagctgtcaattaaaacaccgaagtactggattttcgtggtgatccaaacgggcgtggtccttgccttcatggagcttctagtcaagtagatgagataaataatcaaaagagtagccacagccacagtgctgggaaggaagcacacaagggagtgtgttagagatcggctggagggagctccttggatagcattacagataagacctttctgaagatgtgacatttaagctgaaacataaaagatgaaaagatgctagccactcaggctgggaaagagagttcttggcagaagtctgcacagaggctctgaaggatgaaaacgtttgggttgtctgatgctctgagaaggaaattttcagatcagattggagaaggtgggcaggagctagatgacacctgctacttatatcaagtgtgagatgtttgtcttattgggtgttgatttctgttgtgactctgagaacttttagacctgtgttgtctgacatggtaaccacaagccacatgtggcttttcagcagcagcaatgtggccagtccaaattgaggtgtactgttgtcagtataaaatgcacatcagattttgaacagttagtactaaaaaaaatgtaaaatgtcacataattttcatattaatatgtgtattgacatggtattttttgaagtattggattaaatagatgaccacagttaattttactgttatacatttaaaaaaatctgactatccgaaaagtgtaaaatacataggtggttcacattatatttctgtctgtcagcgccattctaaagaataactttaatattttaatgaaggcccttaagaccaatcagttaagcgataattgaaaactgtttagcccttttgtggtgatatgaagaagaccagagttcctgattagcgaccttaaaacttattaggcagccttcctttaaattgatatattgtcatttctttctttgttcctgttgtattaccctcagacattgtatagagtatatttgcatacagaatacataagaatatatatgagaatctgtggagttaacactctttggaaaaaaaagtttagcctttcaaatagattaaagcagtttactggaaaaaaaaaatagcaacatgaaaagactttcttttctaataaatgttaatagttactaaaatgaagattctggtccattaagatacagcttgccaagtcctaaagcttagtaacttatttctctgagctgttaccctacttcagctttgtcaaagcagctgttatgcttgtgttgatattttcattcaaaaacagagcacagtgcagggataggtataaagccagtgcaccttccgtgaacatccaggaaagagatttttgccaaccctctccacttttgtttttagggcagtcaaactcatgtaccacatgagatttgccagtgagacttagtaacattggttataaagcagtaggtgaatgagtggtttatgatatgttttacaggtcatatactgaaaaaaataattccagaagaaagtggccagtgcatgtaactgtaatttacagagttagcatacaagatttatagaatttgtattaaggagagcgagaattcttgctggagaacaaatggacacagaaatgttagactttgcaaactttgaggaggtccattggattgaaaagtgcgaaatgactttggggtgataggtagtttaaacgatgaacacaatacaaagttgtatgcagttggcaatttttattacaatttctgttagactgttaataccatgccatctctaatgatcaggagagggattacttgattaattcagcttgtactttggattcttctctccatcagtggtgaggggttgtacttgttccaactcattcatctactttcttccttgtgtggcccaacacttgcaccacatgcagactagctttcaagagagggcaactaagctccctacataagaatcaaccctgtgtctttggcatcaaagcatcatgtcccagcagctcagtttgtcagctaaagtaactgtgttcaatgaaatttctggggtggagccaatagctttattccaggaagaggaagcaacagtgaagaaacccccgagaggacattaagataatgttctaatttaaaatcaattttattgatatcttataaattattagagcgttttatactgaccaagcaatacataatgctgaggccatgaaaacagaacatgaatgaattaatattgaagtgctgtattttctactacacatgaagaaaaaaatatgtaatacttttgtatcctaagtattttgactcaaggagccctactgaaaaacaaggtgtatatttcattcttcaaggtgtgtattaatattttattcaagacatttcatgtgtttctgtacttagtgggttaaatacttgttgaatgagtccataagcagacaaaaaatatgcggttgtttccacatttgccaaaagggaatagctgtctatgggggcttactagtactagatgctaggttgaattcttctttatccttatggcaacttacaaggaagtgctgctaacaccctcgtcttacctactggagaaatggaagcttaaagaggttcatgaattttcccaaggtcacatagcaagtgttacagcctggtcttgaacccaaggctgtctgacttttatacctgtagcataaccattgtagacactgcctctcttctgttattcttctgactgttggttcctctggtttgataatattttgattacctgcaaaagaaatttaccttgatccaggtttctcttaccagtagagaagcagagacaaaaacaatagaacattttaaagaatatattgttcatgaaatgttacagaaggtgaaacatttgttaagaatagattcattactttatatggagattatattaaatcttcttttaacaagggcagggctttagaaagtcccagtcatttttgaaggtgagttttgatttatgttaatttgaaaaaagcaagttctgtgagagttttatacagattgtgcttttaatgacttccttaatcaagcaggttataaaaaagaaaaacctcttactgtgatgagcagtaaactgacaccagtgactggctcagtcagagctctactatattcaagttttttaccaccagcatgctataaattttaagttcatttacataaatttacatgtgttatgtgttagtatgtgagacttgtgcattttgaccaagtaattttcattttaaaggttttatatttacttttttccaattgaggattatttcttatatatatatacatatatatatatatatgtatatcctggtggtttccctgtaaatgagataataatatgttaaaatgttttatcagttataaagagctcaatgaatgggaaaataaacattttgtgtaattctgtacaataaaatccaagcagaactagctgggttatggtacaacagtagtttgatgtacgtaggtttattcaggatattactttccaaacttactcaaagtagttccaaaaaaacagaaatacagtgctttgtggtctggtgaacatgatcaactctttggatgattcatgactatagagtcaccagtgttcatttttatttttgacatgggtcttttgcttttctaaggggttgcagaggaaaatatgattgaggactttggttatggcatcagtaaaggatctacaggggccttcttcagctttctgtcttctgtgcctccacccctgtccccatcaccaaaaacaaactcaacttgaatcgtccctgactctgattaatgtttgagaattcctatagtgactgaactatagttaagagtaactataatttatcgtctaaacttggccatttttgagagtgaagggaagtctggacaacaggtgtagaaagggcaaaccaggacttgcaattacccttgacatattttagtggtaccttctgactcctcattatcccatttatctgtttgaaaactgatttacccttttgtaccgtgtggatacgatttttgaaggccatagctgatgagcaaacaagccataacgaatgagttttaggctgcttgatcatggtttccatgcgacctttagcatgttctttctggttgttatcgtctatgggcagggaagtctaagcactgcacctgtgtgaatggaaagcaaaattggcatggtgtgcatttgaaatcaaattagaaagtccattgtggagatggtatttgcagtcttgcctctgtgcagtattgaaccaaaaccttatcgtgattgttgaaaggagaaaagttttggtgaatagtagcatattaaaaccctataattatggggcatcagaatatctatgctgggggaagtcctacacaaatgtctagaaaagacctaacataaggtttaaaatagaagatccacactaggtcaccatcccaatctctaaagtaagtagaatcaactggagtccagtatacagtgataggactaagttgcactgttgaggggctaggctatgtgcctgggactgcgcgttgtactttatgtggattatttttcttggtcttcaaagcagcccgtggggctgagaatggtgtgttgttaccccagactaaagagaggctgagactaagcaacatcccttacggctattaagtgaagactctagactcacaccaggcagtctgactccagagagatgctcttgcctgctattaaaatctgtgctccctgttattaaaattagctaattataacaacagcatcttcttttggagggggaagttactttatagaagtctttctcatacattgtcatctttgatcttgaggtggcagaggagtaaaggtggaggggtggggccttccctttcaagttgctggaggtgtcagttttccatctgacttggtcaacagccctagtaaagtctgggatggtctttaatctaggaactagaatcttctcatagtgaaattagaacctgattatagctttttaaagcttaccttttgctaccaaagcaattggggtttccatgtaataagtcttttaatcctttagtatttttttcttggtttctccttgttttcctgctctttttcttaaacagatctaccctgttctttttaaatatcccagcataagtgtttacttttaaaatccagagctttactaaacattcacattcagggtattttgctttctctggatcagccattgcttgtgaccgtgactctccaatcataacagatttgctgagatacacacacacatacacacacacacgcacactcaaactgtagtgagaaagacttgtgtttaatccttctaaatttgtagatttatagggtcacaatgcagcttcagtaagtttcttatgtagtaaacttgagaaatatctaaattgagcttttaaaataataatagagaaataaaaaataataaaataaaaagcttttctagtaaaagcatgactttatcggtatttatttaattcctcttattcacatgcctagcaaagatccaagtggcattcctgtggcagaatggtggacttacaagattcatgatgagagtctgtgccaagtccaatttgattccagagtaattatgttattagaacattgctgattgccccagtgcccactgtgcagcttaacctttaaatgctagtgataattaactactttatcattctaccaagaaactccaacatgtaactctgttctacagtcaacttcaaaaatacaacgctgcctgcaaaaccggaaacagctagcttaagaaaaatataaagtatttggttgtacatatgagccaataaatgaacataaaatctaaatctaaataggcattaccttttagtatttttaagaaattgttttgtttagaaatttttcctcttaaacaatgtggaaataactttcaatagaatatagcagaatcagagaattgttaataaaagatatatatactccatttttcttctttttgtaaaatatgaaattagccagatttagtgcatctaaaggtaagtaaaggagcaaaggtgaggaaggggctgaattgccatattaccgattccaagggcaccacaacacaaatcttactctagtgaatggtctcccatggaattgttcatcctagtgatgctcagaaaaggaatgtatcataagagatttggagtgagattgaggcgtgcagaggggatgttcagccatttgtgttgagaaatatttctgggcagttcccttctgctcatgatgctaggtgccccaccctcagggaacccacagcctaaagtgggaagtggccttgtaaacacagcaataaatttgttgtgagtgctttactcattggaggaacaaaatgttaagggaacaaagaggaatgaatgattaattctgcctgacagcatctgaggaagctttgaaaggtgacattagagctgattcttaaggatagtgggggatttcaaaagatagatcttgagaaaatagtcattgccataagccaggaaaaaaggctacaggtgcaacgaaaatacacagagcccaggggaacactggcttatagtgctgatgtaggatacaaggccaggactctggattggggtgtggagtgaggactttggaaaacagccatactcagaaatttggaatttttttccccctgtgaacagtaggaaactgtccttttaaaagaggagttaaaacaggctgaacctctctttgggaagtatgaattccagaagtgaggtggatagactggagaggggaaaactagaaacgggattgaggcatgaagtatggtagatagtaacccacagatgatgattgcatgcatggtttcagtggtcatgaaaacctactgagtgcattgggttgtgtgaaagcaaagcagaagtgttgacccaagtctcatggcttgggagtgaggtttggaactcagcagagatacacaaaagtcaagaagtagtccactttaaaaaatcgtttggctcgtaatgttttgtgtcaatcttcagccttactgaataatgcctgcagtcttttctgccactaagtttaaggctgaacgtttgataggtctagggctagagtattcatataaaacctcaagaggggctggcacagcagggacggatttagaggtccccagcccgcccagtgggcacccactcactggtcccatctctctcccccaccaaactcccacctgcacatctttggagcttgtaataaagagttgccatcaccacaggtatgaagaaagaccatcaatcttcttaacaatgtgctttggaagttcagaaatgccacaaaagagattgtgacattaaggctcagtggaaataaaatggaacatagacccaaaagttctgggtaacacactttctctcatagttaattaaaagggcctcgtaaatgttgtatgtttttataaacatcagttattaccaacagactaagataaagcaaaaaaaaaaacccgttcaaagagttagtcttatatgaaataaatttataaatgaggaagagctttcctgaccagttttctgaattgatttgcatgccagacagagacgttccagtggtgattgttcttcctataactttttttccatagagattttcagatattctttctactactctccaagatcagccctttgttaccctgggttagggtcattcacacttgggagccctgccctggtgccctgccaagggactgtgttactcaggtttttgccattcaccactcagcagcatagcgcagccctcagtccagctcccgctctcccacctcacctgcatttagatcttttctttggtctgtctgaagcttagtcactaggcagttgttaagattgttccagttttcattggcacttttttcacttcttcatccatgattttaagctctcatattatctaaatgtgcccaataaccacctgaccttcatggcagatagagtcattctctgcttcaggtcttgtcacccacgtctcttgtgtgtataggagacttctccagttgagagctccttgaaagcagaggtgaagcatacaggctgagcctaagtgtggtcccaagaggcatggagcatctttctccattccctggccccagtggcattcctaggtttccagacattgaaaggtgtgggttcatgaaaactataggagtgagaaaggaataatacgcatttctgcaggtggtgtttttcctgccactctgtatcttccaggccctaacatatggcgctgagcaaaacttcataaatatgacctatatgtcacatgactgccatctttggttgctcaaatcccccaaaattactttcccccctttttttttcattgacttactaattacctcttaaaagctctactttatagtttttctatagaagcttgaaatgctggcttcccattagccagcaaactttaaaaacaaaacaaaacaaacaaacaaaaaaacctggctttttctccttcccttttttctcatatatgcttcctttcccaactttctttcttttttttgagacagagtttcactctgtcgcccaggctggaatgcagtggcgccatcttggctcactgcagcatctgcctcccgggttcaagcagttctcctgcctcagcctcctgagtagctgggactgcaggcacgccaccatgcccagctaatttgttttgtctttttagtggagatggggtttcaccatgttggccaggatggtctcgacctcctgaccttgtgatctgcccgccttggcttcccaaagtactgggattacaggtgtgaatcaccatgcccagcccctttcccaagtttctaaaggcacttcaacagtacaatatatccgtaaaaccaaacccattctgttttgagtttacactaattcctgccaccctttttatttcctctcctccctctgtcccatctctctgcctcttctcgttttttctttctttcccattatctttcccccttgtcttttgctacttgtctttccctttatatccctgttttcttcctttcgtctcctccgctttctcctatctcctcttaacagctttgcaagtatatgctaaagaataaaaagaaaagaaagtctcaagtgacttaaaaatcactcggctaaatagatgataatttctcaaccatgcttcctctccttctaattccagagctcttcagtatccccatcagccagtttccgaggtgctgagaagcacagaaactccgcagactactcctcagagagcaaaaagcagaaaactgaagaaaaggaaattgcagctcgttatgtaagttcattcacctttgtgttaggggaggccagcttgcctttttatctgcagccattttaccctttgactattaccagccaacacaggaacacaggataacatcctttaggagacaaaaaacatttattgtatttatagctctgtagccattggctagctgaagtcctgtgtgtgtacagatgcatgtgaggatagaatgcttcattgggcagctaacagaagacctggatgatccatattattgtttctataggtgtatttgcttccccattcatttcagagtggttggattttctgtggttagctggaattgttaagcagaaaaatataaaatcataaaaaatgtgtttaaatgcctagatggattcatgtgctgaaggatataccaaatgttgtggaataaaacatggagagacatccaagatcatccctagcctggaatgaagctcattttcctttagtggctgggcaggtcacaggagtgagatgggggagcaagctggatggagcagtgtggaggcaggcggcccctgctctgcttccctgctggtgtcctacagggccgcaggcctcatgaaaagctggaaatctggatttttacctcccaatatgcagttttttaaaataccaacaaaccagaccacacctatctgtaggccggatttagcctgggcctgtcagtttgcagcctctactctagagtaataagccaaccatcagcttcaagtttgtaactgaaaaatgtaatcaggtcaccctcttggtgcagtgggtagtgcatcagtctcataatctgaaaaatatattacccacctccatagcatcatcatgaggattaaagaaaataggacattgtcaagtatttaacactgtttggtacagctcatctttataagatatgaggaattagtctggacttacttagggtaaatgtggtatgttttgtgaggggagaagataatgcttctcacttgtcaatgcaggacagcgatggtgagaaaagtgatgacaacttggtggttgacgtttccaatgaggtatgtttgtggctactttaattttttgcacttgcccagccatatcaaagactagttgcccaaacaattagtatccaaaatatcttgaggtttgtcgttttgttattgttgttgttttttgaggcagggtcttgttctcttgccctggctagagtacagtattgtgaccacagttcactgcagccttgaactcctacgctaaagtgattctccctgttcagcctcccgagtagctggaactacaggcacgtgccaccacgcttggctcatatttaaattttttgtggagatggggtctcattatgttacctaggctgggctcaaactcctgggctaggattacaggtgtgagccactgcacctggcccaaaacatattcttgatttctaaagggacccactttttatttacataaaaattatgtactactgattttatatgttattgatctttttttttttcattgttcttattctattaagaataaggtgtcattctctactgcagtgaaggcacaccagatctctgtggtcagcctgcaggtctcattgacgtgcaatttgcagatgggtggggttttgatttttctttgggttttaaataagtactataaatactataattttggggccctcaatactgaatattttcgttagtagtttcagtgagtattgttatctgttctagcacatttgtgcttctaagcatgcattaaatgcttttggctagaaatgtccacacccaacaaccccagcattataaatgtgctgtgcttgcattactgtccacgatgttcctttgtaggatccatcttcccctcgagggagcccagcacattcccccagagagaatggcctagacaagacacgcctgctcaagaaagatgccccgattagtccagcctctattgcatcttccagcagtactccctcctccaaatccaaagaacttagccttgtaagcagctccttaccatctctctgagtgtggcctctgccaatttgatgtttgaatttgatgtttttatctttatatttctcacatttttaacaggacttttatttccaaatgtatatatgttcggtatttaagtttaattggcaaaagtatgtagagcagaataagtttactaacttgttggtgatgagtgtttattttatgattctttttgcaaggatagaagagggatatggggaaattgagtgaaacacgtcttagcgaagatgaacaatgcacattggggttacagagatggttttgtcgcctgtggtttatggtaaatttagtttggggcttgaatgtgattttgttgctagctttgtttgaattaccaagctacatatgacggcaataattttcccttcctatctaaaaagtaatctctcatttacaaaagtctatcttgacttacatcacaaatcacaaatgcaaaaatgaactgctcacccatcaggataatctccctgcaccctattcttctgtggctgtgtagttaattgcaactttgtgtggtgtgtcttttttcctcaccagttatttccttgtaacataacatttaaaaaaagaataaaaagacaaattcagttttctaataacctctggaattcacagctaaaggaaaggaaattcctcacttggtctgcaaattaggggggataagtgcgacgggctagattgttggtgttgtttttttaaattttattttctcttggccttctggccttcttttaatggcacctgctctctgcttagtctctatgacaattcaagcttggatgtgttttctaatgtgacctgttcaccaggaagcctcttgtgacatgaacaatctgccaggagcccacagttaccccagtctttaccaaagtcaccagcaagtggccacagttaggacatcctggtttgtgagcctcatctgactcagaccaatttcctagaaatgagctgctctcctctaaattcagcttcagtttatgtcttcccaaatattaggtctgctgtctcaaggaactcttttgtttctttgttaacttttctattaaagaaaatcaaggcccaagctgaagaacctcttccatttcttttcctcctttccttttctttacctttttactgtttaacgtcattgttaaaaccatgttctaattgctggtatatgtcatttcatcttgttagaatgaaaaatctactactcccgtctcaaagtccaatacccctactccacgaactgatgcgcccaccccaggcagtaactctactcccggattgaggcctgtacctggaaaaccaccaggagttgaccctttgggttagtaagaaaaaagttttttctatatttttatgctcgtttttaagaatttaaagcaatttaaggagtacagtacattaaaagtgctaatgaccagcattgaatggctgttagacaaagttacttaacctgaaccgagcacctgggaccaaccttgtctggcacatggtaagtgttcaatagaacaaagtgaatgagtgaattctgaaggcttgaatgacttttgagaatattaaaataagctcatttgaaccatagattctattttgtgacatgtttacaaatgtcttcactgttgtttcctgtgttcttcatttttcttccatccattttggtttgcagcctcaagcctaaggaccccaatggcagtaccttgtccatatccaactccatttgggattgtgccccatgctggaatgaacggagagctgaccagccccggagcggcctacgctgggctccacaacatctcccctcagatgagcgcagctgctgccgccgccgctgctgctgctgcctatgggagatcaccagtggtgcgtttgtgagcttcacaaataatattttagcacacggaggattgtcatgcttgattgattgcgacagggtctcgctctgtcacccagcctggagtgcagtggcatgatcttggctcactgcagcctctgcctcctgggcttaagcgatcctcccacctcagcctctcaagtagctcgaaaaaacagcatgcgccaccatgcccagctaatttttaaaattttctgtagaggcagggtttcaccatgttgcccagtctggtctcgaactcctggcctcatatgatctgcctgccacagcctcccaaattgctaggattacaagcatgagtcaccatgcctggcctatctattttttaatgtaatttatataatctaaggtatttagagatctgtgggtatttataagttaagctacatgtgattataatcttgaggtccattttcttttgtaaggtgaagaagtttcttttttattttatatgtctttttaaaagaatactaattttaaattttccaaaatgatactaattttggaaacttcaaacctacagaattagatcacatagtataatgaatgtaatgactctttggttctaccatgagcttcaataatcattagtataattttttaatctgtgttccacccccaagtatgttaccattaaatcctaaacattggttatcatttcaccaataaatacttctgtatatatctctaaaaccttatttttaaaggatctattctcccaggttttagaatagattttgagaaggataaaacaagtcaaatgtaactgtgcttatttctgttgtttgcttgggaaaaattctaggtgggatttgatccacaccatcacatgcgtgtgccagcaatacctccaaacctgacaggcattccaggaggaaaaccgtgagtacctttttgcctctgtgctcattgtgtgtcaaactcaggtcccttgctggccccgtagacttagaataccactagacagtgttgggggagttcccatgacttgtatttttttaccttgcaaggtatttttcattttctcttagcacaagaagagaagtaatgaagtggggttttgcattgtaaaattttgagctttaatatgtaaatgcaaattgcagaggcatctccagtagtcaggtcttctctacatctgttgcagatttcaaggcaattctttgttccaaaagtctgattattatgtgcaaacctgaatgttcaaaatttgaatatgttgggaaaagacatgccaaacctcaaaggctgaaaggaaataagggcactcttatgcttagttctgttttcagaaaaggtgacttgcttagttggcttcttataccgtgctctgggcatctggagcctctgtattcacagattccttgagttaggaaagacaaaacacaacacaccagttgttctagccttctctgaacggatctcattccaaatactttattttaatctaatgcacctttttattactacctaatcacagttgtctctgctaattggcttcatcttcccagaaacaaagattttactataaagtagcactggctgtttctttaaaatcccagctggctgctttctctcgcttctcctttgggaagcctcccccgcagatcctccttgccttgttagtcacctgtgtgtgtgcatttttctcatcactctttctgtgggcatcccctctgtcactacacatgccgtgtatgtgctgcctccccagtctccagggctatccagacctgaccctcagtagcagctcaaggcgccttctcccagaggcttccctggtagcttgcctgccttgaggtattttgtccttactgtccttcttcctgcaaaactttctgtggcttagtgtctcatttagttatctaagatgtcattatgtcagagcgttctgccctgacaaccctattatccctctttcccttcctccctattctttcctcttctactacctttttaatgcttttttatagccattatctgcctctccctcttgactataagttccatgaaaacagaacagaactttctgctattcagttatagaagcagtctcactgcctagaatggtacctggttcatagtggtgctcacggtatggatttattcagggaatggatatgtgctgatttctttcttctcggacctcccattgcttgtttattcactcccacacactcgggcacttagttttcaccctggtgttaattgcgtgccctcttctccccacatcccttcagtgttgcctaacctagaccctttctttactttccatctgaggaatccaaatctcagttcttccttttgtagcatattaatacttctctacagactctatcctaaccttcctttgttgtatcaagcacagtgctggctccacagccaagttgcttggtaaatatttggctgattaataggggagaaaagacaaattagagttcctcaagagttgaaggtataaatatcaattaccataaaattctgtgtacctgtgtgtgttttgcaaatagttgttgactaacaagtcttattgaccaagaaactttgatgtatttgaaggtgaaagttgggtctatttcaagcaatgctaaataacaaggttatacaattaatcaaataatgactcagatacctacaagttccatatgaacttgtggggaaagtggaagggttcctttagggaagaagtactatcccttttttttggttacttcttaggtaaccaacagttgtacccagagctacagcataaccactagagcaaatgagatgatgcttcttgcctcagctgctgcttcgaggggcaaggggtgtaagtgtctttaaggaaacaccttggctaagggatttggaccagttaaaccactgtggaatcacagctgctctgactcagatggtgcttctgagtcttgggctgacttcccttcatcagttttaactttcgatgttataaaatgtttaaatgtttaagatcctttagggtgggttaatggattggaggattgttgagaatttttgtttatgagagtgacagagtcacatctactgcagttggcaaatgacactttaccaggaaaatgacactactaaaaagcatgtggtgcagtcaacagagtatggttttgggagtgtgacagatccaagtttgaatttagactctgccagttgaaccactgagaagagtggctttatgcacaatttctttgtgagcttcaatcagctcattcatgaatcagggatggcccctcctcaacaagaaggatgtgaagataggaagtaagataatatgttgtgtgttcattcagtgccacatttgttacatggtggctgtttagtcaaccccagcattatttccctttcagctttgtcccagcatattattcatttttcagctacttatgtagtaggaggtacattgtgttttaggggcagaagtgacccaagaagatgggtcattggtgtgtctttatgtaacagagcatgaagacgtataaagttacattcacttatatgcatacagagataatatacttttattatagatttttacagcagaaatgaatataacagttatgtggctctccagatcataagatactgaattgtgcaatgttgtcttgtgcatatttttcaagacaaaacttttttaagtgtgctagaaaataaaataaaaaatcacctaaagtcttcctccaccatacatacccacaatgtaactacctttctccagaaagacttataaaagttatgtgtctctgttctaattatttcacacaatgaattgctagatatgatcagaaattataattaaatgcatgttccaaattaataaaatggtgtttattgtataattcacattgaatcctcttgtctgctcaggtgaattagcagaggttctacttcatatgtagttggaataacagcatagtttaatttcaacataagccaaaaatggcccttctccttcacctgctactcaaatgagacttctatggctagtgtataactatttgattaacatcacggtactaattgtatgagatgtgacatgtgaacacagcaaaaataaaagatctcacgttagtggattataggctgctcacaattcagaaatctgactcttttgcattgatttatttttataaagcaagattttcaaatgagaataatgcctgatacatagtaaaaaccttcaacgagtatttgttggctaactcactggtctgtatgctacttagaacagaattttctatcgtatttcaatgtaaaatacaataaccagacctctcattgtgacctcaaggtcgaagcccatcttgtgacacattggaaatgtggagaaggtactgtgcgcgtgagagatgagcacagcataacagaactgggcctcagagaggagaatgaggggaaggtgggaaagccagtgaccttctttaaatatgctgggtctttgtcaagatgataatccatatataacaagtttgacacacatgtttttaaaaaagcaaattgcatgtgtctggattgtttaaagtgtagttatgtcagagagtccaagcctagcattttcttcaactgtctcttattctcatcgccatgtttgttggagagccactctgctcgtagcagcttaacctgtggtgtgtgtgttcgtgttgagaggaggtcaggtcactctatttctctgactccctgcaccctctccctccagccctgtatttctagttatttgttgggcatcttagctagggatcttgggtgtatgttacttgcaccacaaattcattatattcagaaagtacttttgtaaattaggtcctcttcccagtttgccctttttttgttaactacaagtaccatgtttcttttttcctgagctcagaaactcagttactctagctcctcctcagatctcgtcaatttagtcctacaggattttatatccattgtaccttctaacttgtcatccttgcccttgcctggttcaggacccccagtacctcttacttaaattgttggaataattgttgttgtttgttgttgttgttgttgttgttgttgtttgagagagagtctcggtctgtcacccacgctggagtgtagtggctcaatctcagctcactgcaacctctgcctcctgggttcaaatgattcacatgcctcggcctcccaagtagctgggattacaggcacatgcgccaccacacctggctaatttttatgtatttttagtagacatgaggtttcactgactggtctccgaactcctgacctcaagtgatccattcccctcggcctcccaaagtgctgggattacaggcctgagctaccgcgcccaacaggaataattgtttttaattcctcctgtccatcctactccttgctaccaagtttattttatgaatagctttgcccagtaatggcacactccctttatccctcaaaaatctcttcagtcaattctgggaaggtctcaggctggcattctggtccttcccttttatagcattacattgattttaattatatagagatatagatctggtatgttttttcagactatgcttggccagttcctccatccacctactgtgtagttattattgaatgaattcctggattaaaaccaattcaaggatttcccagctcattttacctcatccttttggaacttttgctctctgctattcttgctatctggaatattttttccatctttctctttactcgatggtatcttttcattctttaaaaacccatctctattaccatgtctgtctctcatccaacataaactttctttccttttcaaaacacttcagaatactttccattagaatgtgacctgatattgtcatttctgtacttttctctcatcatgctaactagattgttagtcacttgtgggcaagaccaggtgcattacctagttttgtatccttagcatgacgtttgcgtcagagtatatggatgggaggtacttaacacattgtgcattaaattagttagaaacagagtagccctttgcgcctcggtttctctgattcctagcaatgttgacttccctcataccttccaggagtatttgctagttacagtcaaagagtttatcgaaatctgataataagtatgtactagagctttattatttccagttctgagtgccttctatgtatactaatagcaaacagagggccacattaatgtcattaatgaaagcaggctcttggaattcatttggactctttgaaaggactcttgccaggaacatagtaggtgctcacagagtggttgttgttgaggtgaaggctgtcctgttgaaggccttgaaggaaattgtgtgcctggtttcttaactatttgaaatctcagtgctctttaataaccatttagtgattctagactagagaatgagatggcttttctaataaattatcattaagaatgtataacaccatctaaacttggaataatctttctttctcttcctttaagatttagtcttcatgacctcctaattgctaaatcaattagcctttttctcggccatcatccctcagaacctcagcctttcacaagcgttactgccaccttctccttgtctgaactgaaatctggccgtctcctgagatcatcccttcacttgcagccctatacagggtgacctttccatttcattcactgacctcagcaccagcggtggggttaataacagctgtggttgccaccccttctccagcctctccatgaacagaacttttctacctgttggtgaaaaccttgctcctttcaggctcgtgccattggactaccccctcttccaccttgttgggagtatttccccagtgtattaaagacttgatacatggctgagagtcttccactacccagaggctgccataatcctggttgactctggtatctacaaagacaaccccccagtatcttcatcatggtcttggaccccctcatctctagtgaacatctgccctcctcaccttcagttacctgtatttacaggttcacaaagaagagcttatcatcacccctgtgtcacctccagattctaagcgtcccatccagtacaacctactgtggctccagtcagccagagtgctccacgttctatttccaacttaccactatctcccaggctctagccactgcttctcctctagattactgtgtagtccccagactagttgtctttcgttttgccacctacactccattcttcacccagcaatcagaagatcatttgaagacgttaactgaatcatgtcactttttttgcacaagtctccagaatcatatctgtactcatcacagcctatatggccctttttagtttggccttgcctgtcccttcactcttatatcctatatgctctccaccgaatgcactctggcctccttgcttcgttctggtctcaaggcctttgcatttgttgttccctctgcctggcacgttccccattacttatttgtaaggcctgtgtcattccttcagctctccgcgcatatgctgcctcttcagagagggccacctgactgccactgtgtgctcccctactctcttttatctgaaaatgtgtgtgtatatttaatggtattttccactgtctgaggtgtttatcaggtatttatgtttatctgttacctgttttcctctctaggatgtagactagtggaaggatagggactttgtcagtattgttcacctgattccccagcacctgatggtaactggaacatacgaggcatttaggaagtatttgctgaataaatgaataattagcacgctttcttgctctggccttcgaatttgccatattcctaatcatcatactgtcttcagacaattcgtacccattctttatgttgcagccctattgccattttctctgtccttttcactctgttaaattcctagactaccatgcattgttcactgcactgaccatctgacattttgatagttacttatgtgcatatctcactaatgaatgtgcccctcaggctgtaatttcaggagaacaaggtgtgtgcatttctttcttattccattcttaccataatgcttggcacactggcatactcaagaaatatgtgttaagtgaatgaatcttagtaaattgtcatgtgattgaacatcttctccccctttctattttattatctctgctaataatctacttccataactactctggccggagattccttaaatgtccacattctttgggattctgtatctggtctgcttttcactgcataatctgctctgggattcttctttccgtccccttagcttcagccatcacttctttatggatgatatctaacctgacctctctcctgaatcacagctgtttggatttctgccctgaagttcaagaaaaccaattccttcacctccccataggtgtacccttgagttatgctttcctgtcatctttactaggtaatgcagtctacctagtcacccaggttcttagccctagggtcctcttcagcatctctctctcaggtcacacatccagtgtatctccaagtcctgttgatttgatgcaagaaatgtcttctgtccattggcttcctagcttcccacctccttcccctccagcaagtctcacatactatgttcttctacaacgctctgtagtctgtggaggaagtaaaagcccgccactgtctagtgccctcatcttccacagccacaatgcatgcgtcattttttctgggagcattcaggtagttgaggaccattcaataatggactgaattttgatgaacatggccagcctgtaaatttttgcattaaggaacgataaactgttttaatttaattctacaacttccgcagtttggtccagcttcctgtcctttacgcacccacaatgctttcccttggtatgtcttttgtaaactattttctgtaagcagagcagattcccaagctccgtgcccaagtagagtagcatcttttccaaaatgggctgttgcctatgatagtccccaagataggcccagctgcctcctgcctgccactggcgtcttctgcttccagaaacctaacatgcgtcacaacagcctcactcgtcccttcctgacttcagtgccctaaaaataaaaatgagtctgttgggggagacgctcttacttaagttgcattttaggaccaaatgcttttaccacctgagggctttccctggaaatgaactggagatggaactgccaagagatactcacaggtaggcctttggggctgtcaggatgcctttttaggttctcattccatttggattgactaggatttgtgattgtcaagtctgatcaaggttttaaaatagggctttatctttttttttttggcacatctgtcatttcaacgtctaagcctagaggctcttaactccttaaagcttcctgattttggcctactcatctcccttagtaagtcccttgccgggaatgaattgatctataggcgaggtctcatcacaggcctctgattcatccaaaggagaaggcaatgcaggtttatagggcatccctgaaaggtggctactgcacttgacggtggttatctcatttaattctgtgaggtataggtagtgttctcttcattttagagactagaactgctgttctagtttagagattctaagtaactactgatgtcccacagcagcttgtacagagtcagcctgagatctggccctgtagcagcctagctgtatgattctggaaattatgttctttacactgtatggacaaattcgatttgttcgtaaatcacaagtggcactgaaggtgttttatttctcatctcattacactgaacagttaagtgacatttttttacattcccctctttcttttttcctctccattgccttagagcatactccttccatgttagcgcagatggtcagatgcagcctgtcccttttccacccgacgccctcatcggacctggaatcccccggcatgctcgccagatcaacaccctcaaccacggggaggtggtgtgcgcggtgaccatcagcaaccccacgagacacgtgtacacgggtgggaagggctgcgtcaaggtctgggacatcagccacccaggcaataagagtcctgtctcccagctcgactgtctggtgagtgaacatggatgaacaagacttagactttcattcagaaaacaggaggggctgatgagagaactgtatgtatgagcaacaccacacagtattgatcccaggtggatagttgctcttcaggggactgcgatctttcacttggaggtgtgtcttttgcttcctagacacacagtgatctagttcttcatgtgtggcatgtgcaccatactgatttcattaactctgcctcccatgggaaaaggcaaaccgcttgttttcctctctgatggttaagcaaactaagagcccatacagtgactatgagtgtgcacctaaatatcatctgtcacatgtaaagagtaacttactgcctcatgtggcaaatactagatagcccctcagctgcttcattggccttttcccttgagttccttaggaaatgtcagtttagtagaatttttgctatagcatgaggctacatcagttgaacataattaaatatacataagattcccgtaacctcatgagctaggaggaactttttttttctgtaacttaacactccatgatcaagtcttgcctctggtgcagctttcatcaaatgcatgatgccctttagtcacgtaatgcaggcccaggcaaaaggaacagactgccagggatctaccccctgaaactttcttgacatcagtagcaggacctttcaacagcagaactgagcctgagtctaccaaggttccaagtttggatactccaagactgtgagagctcctgcattagtgtacgtgtgtatctgtgtgtgcaaatgatgcaagcagttggttaatttggtggtggtgggagtgggtctagagctttgcattttgatgctaattaagattaaatatctcagtactacattttgtagatcaactttaagtacttccctaatttcatgtaattttctagcattaatccactttatcattgtcataagtataaacggctcattaaaccaggagggaacacaatacttttatggatttctgctctcatgttaatgctgttttcctttcctcatgagtaatctcttgatggtttttgtctctacagaacagggataactacatccgttcctgcagattgctccctgatggtcgcaccctaattgttggaggggaagccagtactttgtccatttgggacctggcggctccaaccccacgcatcaaggcagagctgacatcctcggcccccgcctgctatgccctggccatcagccccgattccaaggtctgcttctcatgctgcagcgacggcaacatcgctgtgtgggatctgcacaaccagaccttggtgaggtaggttagcaggatctgttaccaggttgtgaggaggagccgattttaccatattttgccaaagtgctgtgtatataggtatgggtgtgtgtgtgtgtgtgtgtgtgtgtgtgtgtgtgtgtgtgtgtgtgtaaagtgatataattatcttactaaaaattgttcagaacaggtccattttaagatgttaaaaataaattatcagtgtgaaaatcttgttttctgtagtacttgaacttcataaaatgaggtcttttttccttccttgacttatactaaagcatcgccaatttgttttaataaaatgaggtcaatttgacataattaatgtacataaagtttccatgaccccatgagctccatggacatctgtaatttgccatctgtgcttgctaacaaacgattattgttgatagagcctcactgagaagattcacagtgtatggtactgtcttgagtgccatacacatctaacaggttcattccttcagcagatatttagcaactcccatgggcctatgcactgtattgggtgcaactcactctgaaatggtctagattatctgttgtcccacctttgaggttggatagatataactttacaaatgagattataaaagattggtgttggtagatgggaaaagctctgaaatgattttctaggtgtcaataccctaagagattagcaagcaagtagaatgatcagctacaggtatgaaaaggttgtaaccagaggtagctacaagtcaggtgtgtaaaagaagaaggctttactatctgttatttcaaagtactgaaacctatagatcccaaaacaaatcatcactttcattgcttatcaggcagcctcttatgagaagctgcttctaaccctgttttctcctggtgaccttggtacgttttgccatgagtgattcctgggccagtagttcacactgagtgtctttccaggtgccttacttgagagcctcgccttccgtcttgcacagccacccacagacacattgctgctcactggcaggactggtcctgtcgctccctgtgccatccccagtccttctttaaagggaaaattaaattctctctccctcataccacagtaatagaataggtctcagaatatatctttagttagtgcatatatgtgtaggcgtgttttcttttgttaatttcagagatttttttcccattagtaatatcagtcatgttttcatgaaaaagtaatttgaggaattcctaagtattcaaaaccaagcaaaaagtacaggacatgtggcatctctttgtatatgctttgttattactttgaataattagaaaccataataaaccaaaatgaaatctacaaataaggcctgcattgaaattgaatcatcaaggaattctaaattgattttaactaaaagctaacttttcaagggctttccctccattttgacattttcaggcaattccagggccacacagatggagccagctgtattgacatttctaatgatggcaccaagctctggacaggtggtttggacaacacggtcaggtcctgggacctgcgcgaggggcggcagctgcagcagcacgacttcacctcccaggtatgatccgtggctgaggcattttaaagatacggttttaggctgaggtgggcggatcaccaggtcagggaatcgagaccatcctggccaacatggtgaaaccccatctctactaaaagtacaaaaattagctgggcatggtggcatgtgcctgtagtcccagctacttaggaggctgtggcaggagaatcgcttgaatgcgggaggcagtggttgcactgagctgagattttgccactgcactgcagcctggcgacagagcaagactctgtctgaaaaacaaaaaaaaacaaaaatgatacggttttatgaaacatatcacctactgaaagaagaggcagttcacttaccgtgtgatgatgtcacttttgactctggattaaccactttgaagtctcattactttgaaatcgcccatttgactttggttctcccctgtacaattcaaattatcttgattttcttcataatttaagtagtatctacagaagagatagtacctcccagataaaagaagcgtgtccactgtggccactgtcaccatcacctgttttaattctagatcttttctctgggctactgcccaactggagagtggcttgcagtggggatggagaacagcaatgtggaagttttgcatgtcaccaagccagacaaataccaactacatcttcatgagagctgtgtgctgtcgctcaagtttgcccattgtggtaagcaagcaccttttgtccattttctgtcaaccagaattgctccttcccccttcctgtgtttttatttccaagtcgaatccttgagttcattaccatgcccctcttcagaattctattacttcctgatacatgcctgcttccccaacaccatgtaattttctggcattaatccactttaaccttaaggattagtgactcgattaaatccagaaagataggctttatttttgaagtgaaagttattttttacaaatggatgagttttctgttaatagtttggtgttctataaagcaaatcttggtgtctgacagagtaacacaaacattgcctttttcaaaaccctttacctataggcaaatggtttgtaagcactggaaaggacaaccttctgaatgcctggagaacaccttatggggccagtatattccaggtaacatggaacttgttaactaccacttatgtttgtttaatcaaactctctgtgcattctctcagattaataatgtgcagaagtgtcctgggaggtcagagctagtattatgcacattgtacagagaaggaaactgtgtccaaggagaggttaagtgtcacagcaaagccgtggagctggggatagtccccagtgttctgagctcagagccagtgctgtgcctgattcagtgctcactgttgcttcatcatcaatccctttttggagtagaggttttatgtcttctgagaattttatacatgtatgtcttttgtaatttttaattttaaaacttgagcattttgcttaaatacactcttgttagtagtagtagtttttttattttattttttccaaagaagagtgttatggaaaagtttgataaaaatcagttttataaacttttattttccctattgactcagtggaactttgtatagcttgtgaaattatttgtagaaggaccaaattgtagacatagtacacatatatgcacgcgtgcacacacacgctctcctcctctctcctactggtatgtgagaatttcataggcaaggtgaaagacttgcctttattaaccttctatatttaggatgttatttcctagtgttcttttttacaagcaatataatagacttgcagttttcttgaccaagtggtattatcataaagtagattaattccatcgaatccaaaatagtatgcaagataatcagtaggacaaaaaacgccaattgttgcagtcatgaagcttagaatttaatagagcatttttcataacatggattatcacttgttagatagtcccaactgcactttaaaaaaagagtagtacattttttatagtaagcataagtactatgtctttaagtgtttaaagtattcagagtcctggttaaaatcctgtgttgttttcattttaaatgagcacagtttagttaaaagttaacattgaatccttcatactacagttgaatatggtatacaaaattctatggtatgtttttaactgttgaacctctcccctctcgcaaatttgtgtcacatttttacagtgggaacattaggctttttactaggaatatttttacattctttttttttttttaatgtattctcagtgccatttctcatatctgatctcactgaactctgctgcatccctctgaggtggtagacaggtaaaatgtctacctgtttgctattgtaaggaaactgaggtgcagacaggttaagtgacctgtgccgtgttccacagctcaacctgactccaagccatctgtttgaagttgagggtttttcataccagtaacaccccgtcttaatggtagaatagggtttgaaataaggtcttgctttgccagcagaggtgctcatgccattggcttgcctgcctagctgatgtccccaggacagaagcctcctgactgacctggtgaggtgtcgccaagggtggatccgatccacctctgccattttaagaaagtgccacgtggtggctcatgcctgtaatctcaggcataatttgggaggccaaggcaagaggatctcttgagcccaggagttcgagaccagcctgggcaacttagtgagaccctctctctacaaaaaaagtttgaaaattaggtgtgattggacacatcagtgtcgtagtcccagcatctcaggagactgaggtggaaggattgcttgagctcagaaggtcgaggctacagtgagccatggtcacaccactgcactgcagcctgagtgactgagggagaccctgtcttattaaaaaaaaaaaaaaaaaaaaaaaaaaaaaaaagcagcagtactgtccatgaccacctttcacctttccttgactgggctttctgtttggtcaaggagcacattacatttgcatttgctctaagtcctccatactcatgggattttctttcagtatttaacatttttgattatatgtttctttcctagtccaaagaatcctcatcggtgcttagctgtgacatctccgtggacgacaaatacattgtcactggctctggggataagaaggccacagtttatgaagttatttattaaagacaaatcttcatgcagactggacttctcctcctggtagcactttgctctgtcatcctttttgttcacccccatccccgcatctaaaaccaaggatttcagatactcattgcagttgtggagtttaatcccctttcttaacctcacttcccacttgctattgaattgtgaatagtcattaaaaacctgtgataccaaatcttcagctgtctacttggaagaacatggaataagcatacttaacagtgaaaagaatctttaattatgtattatatctgtaatatatttattttgtttaaagaaggctttctaacaatgactgactaaataaagctgtctgctcctgcattgataatgaaggtgcgttgtatttgatacccctccccccctttttttggcaaaggaggggaaaggaaggtttaaaataattgatttaaaatgtcactaagtgtagactgatgactgtatagagatgtgaaatgtataattacacatggaagcaatatgttgctgtgttgttattaggttttttttgtttttgttttctacatcttttaaagacttttggaaatttggctgaacaattagaacacaacaggccaactcatactcatttggatctatttagacaacgttaaccaatatatctatagctttagattatattcgataaaagtaattggactttttttctttttttgactcgttgacaagtgtctttgtaatatgtttttagttccctttttttgttgtattataggcagatgaacaaattaaatttggcctcaaagagagaacttactcccttctggatatttttgccacatttctttgcaaaaggagatatatatatctttagtcagttttgttgttatgagaaattatgggttattttgtggcatgctctttgggagctgcacagttatggggaggactcccactgctgtgcaagttaagtcttttacaaaacaaggacagcagaggagggtttgcagagacctccctctgaaaaacacaaagaatggactctctcctgggatgaggacttgctttctttacctccggttctttccatgtcttagttggatgtccctgaaatggacacaggctgtgccattgtgccagaaacattgtgttatcttttatgttgttgttgttgctgttaaactataatatgtgacttctttttttattattttttgtttgaatgctttaaaaatcttttaagtctgtggatctgctgatgtacagtgcctttgctgctatggatcaaaatcaaaagaaccgtgtagatatactttattgtataagtagaaaattacttaatttcatactagaaatggatggatgctgcaagttgaaatggactgtccattgacgttcctaatgtggtagcagaaaaaaaaaaatggtgtcttaagtgcttagtgtttgatgtcattaacagtttcgtaaaactctacagtgtagaaagattttgatactaaactgtgcgttgtacatagttctaatgcattgtattgaccaccagtacttctataatggtagattgtttgtgaattcagacttttaagcattaaacataaataacttctagta

SEQ ID NO: 36671 - DNA, 621805 bp, Homo sapiens
cccggccctccctgcacggcctcccgtgcgcccctgtcagactgtggcggccggtcgcgcggtgcgctctccctccctgcccgcagcctggagaggcgcttcgtgctgcacacccccgcgttcctgccggcaccgcgcctgccctctgccgcgctccgccctgccgccgaccgcacgcccgccgcgggacatggcacacgcaccggcacgctgccccagcgcccggggctccggggacggcgagatgggcaagcccaggaacgtggcgctcatcaccggtatcacaggccaggtgagtgcgggggcgggggcgcgccggccgaggcagcctgggcacgcgtgctctccctacgcgccgctactcgtgggctgcggtctctccaggaacagccctctcggcgtcccggaaggggtctgctgccgggaggtgggacggaaggtacggtgcagttagtgtgttgcgtgtggggtgtgcgggatacatcgagcgcctctggtctttctctgggggctgtgagcgtgtgtgccgcgcgggatgtcgcgctcacacccgggcaggaccgcccgctctcacctgcccctcaggtgaccgcagcgtctcttcctccaagcccatgtcgtgcttcgcagctcctagtgccggaaagggaaaagaaccggtgatcaatgaacttgcgggtgaggtcttcttgatgtgtctcggctcaaggggcgcttacctgctaacgtttgggaagcaagaaaaagggtgctttgctggtttcgtcccctatcaccggatttccagatagaaaagagaacatgaaagaaagtaatgctgtggagtcacctactaggacatgtttaggaaaaagaacttaaaaaactttttaaaatcacgccaacttctgagattcaggttgacacatttggaagtgtatccgaggcacactggtccaaaagtgcggctagttccattttcaaaggaataagttcgtcgagtaaggtaatcaagaggaggtcttcggaatgtctcaggctaagcatggctggtttgtgagggtcgcctcttagaggtgttgcagtaggtgggatccgaccgctgtgtcttaccaagctgtgctgttttagattcagtggtcatgaagtaatcgtgcccacatattgctgtagaaagaatgtgatgtgtgtgctcctgggtatctctgggtggtggccaatataacactgagataaaggtgataatggctaatacatattgtgtctatcatgttccagtcgcttgcctaacattaactcatttagttctcataacaaactctttgaggaggtacttttattatctctatatatgtggaaactgaggcatgggagtttgatttgcctgaggttaaaccgctgggaagtgtccagttggtattgaaaccactctcaaagttctctagtgttagaaagggctaagtgggcaggaggcagcggctcatacttgaaatctcagcacttcggtgtgcagaggtggaaggattgctcgaggtgaggccaggagtttgagaccagcctgggcaacatattgagacgttgtctctacaaaaaaatttaaaaaatgaggcaggcatgttggtgctcacctgtagtgctagctactcaggaggctgaggcaggaggatcacttgagtccgggagtctgaggctgctgcagtgagcaatgatggtaccactgtactccagcctggggcaagagagtgagatcctgcctcaaaaaaaaaaaaaaaaaaaaaaaaaaaaaaaaagaaggagaagttgaaattggccagatgcacagtcacagaatattacacaatttcaagtattgaatacctgatttactgctggttattcatgcatcttgctttgcttaaggtaatcataatagacaagagtttgaaaactagtaagaggtggatctgagtttgaaaactagtaagagggcaaggatctgaggttgagaaattgaatccttgaattgaggcagtaagacaggtcagggcctacatactgtcctcccccttctctttgttttctaatgctgggacctttctgcagatgattcccttttttccattttgtcagactggacctgaagctcaaatgtttaccaagtttacctaatctctggaaagtagagattttattttagtattgtccggaaattagttaagattaacatcttaactaatgtgctgtgttggtgtggcctataccaatttacacgaccagcagtatgaatcagtgcagattagaaatggaacctaattttgacttttaagagcagtcatttggctggaactgagtggccaggaaggtatggaagtgggcccccactctagtttgtcctgcagcctgtcatgggagtctacctgaagcaccacactcagcagaccactccctgactggaattttttggttcctcatttcatttccaacttaaaacacctgcatggctttcaggttgggttgaatctctgccccagtgtttctttcttccctccggcatctgccctctgcattgtctcctcatttggtgttgcattggcttctgtacccctagcatagtgctgaattctgtagctaccacataaacacttgcagatggaatttactgctcttttatgttttttatttgtattccaggacagtgactcccaacttgagtatcaaggatctctggagcactgtggtgttaatgcaaggggtctgaaaatccataccttattgtatgttttcttaataatattggctgagaacttactgagctattcactctgctaagcattttgtatatccctacctaagagacaggtataataagtatccccatttatccctggctaagtaaggttaaatatgttccctgaggtcgtacatctaatgagtgtcagaactgagatctgaacccagatctcagcagttgctgtaagtcattttgttatacagactgtggtgagccttatgagacagagagaaataaatagtcttactctaagaagagatttcagattcaaatgccactgctctggcacttggggctatcatggcatttgtgccaagatgggctcttaaatgggttgtcccaaattcccgcttgagaatagtgcggacagccagggtgtcctgtctgctgtgtatctctagtacgtattgtcaggcttcttattctagccttcccctcccatcggttcttgacacactccttttccaaagtgggaaccttattaaataggctttaaagaagctcaggctctggctttgcattgctgtctccaggccctctgccagccactcttaaaagctcacccccattggctaatgatgctgttctttactgcactcttggagatgttcttgctgttttttgaatactgttgccttgtacctctttggagtaattatttgtggctgaatggcctcacaattcttattccttttaaggtgagtctcagtgttctcagcctaatcctgataaatgcagccattccaggaacttcctctgtatttacatgtatgcagtccctgttgattgtataagtaatttcatatcttttgtcttgagattatgaactactttaagatagaaatctcattttcagcctgttacctcccacatgccttcatctagtggggtttcaaaactgttgacttactttttccattagcagaacacatcttcactgcatgtctgcagtgtccaaggcttgttttggtgctgctgcagatataaagatatgaaagttgtcttcatctgtttgtgttgctataaaggaatacctgaggctgggtaatttataaagaaaagaggtttatttggttcatggttctgaaggctgtacaagaagcatggcaccagcatctgcttctgctgaaagctttaggcttccactcatggagctagtgtatgcagagattacatggtgagagaggaagcaagaggtggggtggggtgtggggtgccaggctctttttaacaaccggctctagcgggagctaatagagtgaggagtcactcattactgtgaggatggcaccaagcattcatgagggatctgcttccatgaccaaaacacctcctattagttcccacctccaaccttggggattaaatttcagtgtgagatttggaggggtcaaagatccaaaccatggcattccatccctgaccccccagatctcatccttctcacatgcaaaatacaatcatctttctcatgcaaaatacaattccaatagtccctaaaattcttaacttgttccagcaccaacttaacggttcaaagtctgagactcaaagcaagttccttctagctatgagcctgtaaaaccaaaaacgaataatttttttccaagatacaatggttgtacggtcattgggtagacattctgtgactgcagcagccaggatgtcggagcagcatgtaggacgttccaggactccttgaggtgtgccaggccagctgtgccccgggcctgtctccccaaaccatgctgtcctcctaggtctctgggcctctgatgggagagacagcctcaaagatgtctgagatgccttcagggtcttttcccattgttctgactattagcacctggctcccttttatccatgccaacctctttagcaggtgattgctccccagcaccattggctttctttactgaaaaatgctgttttctttcactatcacatgaccaggttgtagatttgaaaaatttttctgatctgtttcccttttctctaccaattctacaagtaatgcactttgaacagcaaatgcaacagactgaattaccatcttccttatgacattgatagtctagtggtatgatgatggtgatagttataattatggtagattaaaataattaacaagtactgagcatttagtttgtgccaggtaccgttcaaagtgcattacattttgttcaaagtatatttgttgaagcaacagagagcttctatgaggtggttttctttttcttttctttttttttttttttttttgagacagtcttattctgttgtccaggctggagtgcagtgacgtgacctcggtttactgcaacctctaccttccaggttcaaatgattctcgtgccttagctgcctgagtagctgggattacaggtgtttgaattactgcttagctctttctgaactgcactggctttgggtaagtcacttatcttttctgccaggttggaagaataattcttatcaaataggaaataaatctgcacatagtagtggcctttgcctcattactggaatggaccttccctccatagtgttaacagaataataaaagatttcttgacttttaggaaaggaagttgaatgtgggaggtattactatttagccttgctttgcatggggaatctattatctagaagcagaaagttctgtaatatttggaatcaaccacaaggctataaagtactgggaggccaacagatttaatgtccagtgagtctttcaagactgtgcaaagcagatctgggagctggtcttatcttctcatataagaggattgtaggcagtgacttccattctaaatcttccttgctgggatttgcagtcctgggataaaaggtttggcattattgggctgggcgtggtggctcacacctgtggtcccagcactttgggaggctgaggcgggcctcccaaatctctggatcacgaggtcaggagatcgataccatcctggctaacatagtgaaaccctgtctctactaaaaatacaaaaaaattagctgggcatgggggcaggtgcctgtagtcccagctgcttgggaggctgaggcaggagagtggggtgaacccgggaggcagagcttgcagtgagccgagatcgtgccactgcactccagcctgggcgacagagcaagactccatttcaaaaaaaaaaaaaaggtctggcattattggaagtgagagagatgtcttgagtactgtcctgcttaatcaaagactgttacatgtgattaattgaaagagctctggactgggaatcagaggttgggttttgataccaattaattgtatagccttacattttttgagtgtttttcttaacttgtcaagtgaaagggttacctggttattcttagggatctaagggctgctcctagtctacagtagtgtgatgtttggattacatgctgacttattatgtgtacaatagagaaattatgcaattatctttatatttaagcagtgcagtaatttcagttttagacataaagccaattggattttttttttttttttttgagacagatcttactctgttgcctaggctggagtgcaatggtggtatgatctcactcactgcaacatccgtgtcctgggttcaagtgattcttgtgcctcagcctcctgagtagctgggattacaggcgtgcgctaccacgcccaactaatttttgtatttttagtagagttggggttttgccatgttggccaggctggtcttgaactcttggcctcaagtcatccgcccaccttggcctcccaaagtgctgggattataggcgtgagccaccgtgcccggccaggatagttttttttttaaatgaaaccaatgaactattaattttactgaatttgaaattaagtttgtaaactaagaagaaattcatatgagttgtatgttgtcagaatttgtaaggatagagtgaaaacttggagctgtccatctttgtaggacatatcaaatgaatgaagtgactttttggtgaggaacgattttttttttaactggtacataataattgtacatatttatggggtatgtgtgatattttggtacatgtttgtaaagttcaaatcagggaaattaggatagaggaaggagttttaaattcttgggtttttcttgggtagaaaaatggagttaattatgcccacatcacaaattgatgtgtggattacaaatgatgattatattataataaggcctatcactgttcctggcatgtagtgtttatgaagtgatagttcttatttattatgaataagttctcacagtgggaaggaatgagagaaggatggagaagtgcttgggaatgcagttaggggtatgtaggatgaatgagaatagtaaaagtatgaggataatgagatcaaggatgcaaatgcattttggtgacaggttggatggtaatagtatggccagaaatgcaaccactgggaaggaaaatcagttttctgggggaagacagtgaattattttgttcctctggagtttgaagtgcagtggtgcaatcatagctcgctgcagctttgaactcctgggctcaggtgatcctcctgcttcagcctccctggtagctgccaccaagcctgactgatttttttactattttttttttttttttgtagagacaggatctcaccagctgaccaggctagtcttgaactcctggcctcaagcaatcctctggtcttggcctcccaagtgctgataatacaggtgtgagccactgcacctggcctctttgtcttaaaaatgacttaaaagtgctcagaggtggctgctgtagagtgggcaagtcctaaaggtggccatgctgctgtgctgtacctttagccagtcttcttccctgtctcccagaactttctgtagctcttacttagaaggcatgaaaattaacactttccctttagtttcatgattgatgttaaccaggctattcttagtatatttcagttttctcctttctttctcctttatttatttgttgattatttgcatttcctaatgttaaagatacttccaggcggggcgaggtggctcatgcctgtaatcccaacactttgggaggccaaggtgggtagatcacctgaggccaggagttcaagactaccctggccaacgtggagaaaccccatctctactaaaaatacaaaaattagcctggcatggtggtgggcgcctggaatctcaagtactcgggaggctgaggcaggagaatcgcttgaacccgggaggcagagcttgcagtgagccgagatcataccactgtactccagcctgggtgacagagcgagactttgtctcaaaaaaaaaaaaaaaaaaaaaggtacttccaaacttccaatttacaatttctcatgcttttcttcctttcttgaggaattttgggaatctcacacttccagaagtaaggtgctcagttgcattaaccattcctgtataagcttaatacataggaaatgagtgagtaaaacatgtctgaaaggtaatcctataggatagaaagctgattatcagtaatgttcttggcagtggggcaccaatgtgccaaacctagtctttggcaagctagtaagcaattttcctgccaaaatcttgtgacttaccataagtagtaacccaattgtttatataaatttactcattgaaatgactcagctttccaggatattattttggcatttacttatgtagaattgagttacatagacttgaggttagatgattttatatgcagtgacgttcttggctgaagggtatttacttcatttgtttcagactgttcatactgtgccttttaaacaatttaccacatgtgattctaggggaatcctttctcagatcttcatactaagttcttttaaacttaagagtgaaaaaataaaggtatttactagggatttatagaaagtatttctttatactgactaattacacttgggaaaatgaaccaccaaagcttggttgtattatatatatattatgcttgagcatttggtttgattgtaatgtgaaatgaattgcttgatcatgtttaacaaaaatatgttccttaatgctgagtgaaaaagcctctaattggcacttttagaaatcttttaaaatcaaaacatgatttttctatgtttcttagaatggtactgtatttctatcacttttcacaaaagttagatttttagtattgctttattcgaactatatttttacatcggttctttaaaaatgatgaattggaattttgcaagtatatgcagacactagtagtattttttggtgatcaatattgataaacgtgtttattgtagtttacagtggaatccttcaaaatggaagctttgttgcaagagacctgcaggacaaaatgcaagtgtggcatatatgcttgttggagtaaacccagtcaaggagaaagacagcagaaaccctgtttgtcaagaattgtgggaggcctgagattttaccttacttgcaggctaacaagttagcttcttaaaattccacggatgatggcagaagacacagcactcctgggtcagcaggcagtatgaacttcatgtttgtgacagctctgtttgtatagtattttcttgcccctcaaagaccatgtgggtaacacggtggctgggtgggtctaggtggatgttgcccatgcagtgggtatgcaccacagttgagaaaatctgagattgggaaaccccaattttttataagggaactaataatcctgcccagcctttgctttgagggagacattatttttattattctgcatagcaaacaaatcttccatctgctccagagagaaacactattgctatcttaaaatgctatctacagatgtcctgtacaggaaagatagtagccaataaaagctgtcagtgcaatctgctcataagacatgcagaaactggagagacccatagagaactggctcccaacaccatttgtttgccttgttcctgaaacttaccagattggcaacacagaccagttttcctctttttttttttttcttattttttttatttttttttattttccagaaagggtcttgctcaggctggagtgcagcagtgcaaacacagatcactggagcctcaacctcctgggctcaagcgatcctttggcctcagcctcccgagaagctgggatcacagatgtgcaccactatgcctggctaatttttgtattttttttttttgttaagatggggtcttgccgtgctgctcaggctggtttcaaactccttggctcaagcaattctaccatctcaacctctccaagtgctggtattgcaggtgtcagccactgtgcctggccccagttttcctcttatgtctccatgcagactatggggagctccagctttgcatttgttttctttttgcttgaagaacaaaatgataagacctggatttgggtgcttagtatggaatgaattaggcattgtccctgggggaggcattttatatttccctgtatgtataggcatgggaagtatagtaggtttgattttgttggaatgtttagtaagtttaatctgatagattagtctcagttggcctgaagaagtctagctcagaaggacatttttccagccctgaagaagaatatgcctgcttccccatcacccctaaggggatgattctaactctgttggctgtggcacctttgtgtacacgtatcatcacttgtttttttgtttttttgttttttttgagatggagttttgctcttgttgcccaggctggagtgcaatggcataatcttggttcacagcaacctccacctcccaggttcaagcgattctcctgcctcagcctccagagtacctgggattacaggcatgtgccaccacgcccggctaattttctatttttagtagagacggggtttctccatgttggtcaggctggtctcgaactccagacctcaggtgatccgcccaccttggcctcccagagtgctgggattacaggtcctcacttgtttttaatttactcactgagtgaccgtaaacttcttgcattaatttcaatgctttctctttttttgctttaaaattgtacctgatgtaaactctcataccttcatttagagattactcctatcatttttgagaatgtttctctggtgtctaccatatgctaatagggcctgccctcgaggtcagaaaatttatgtcttttcaaatcttgtaagtttgctaggattttattttttttattttttttgatacggagtttcgctcttattgcccaggctggagtgcagtggtgcgattttggctcactgcaacctccgcctcctgggttcaagtgattctcctgcttcagcctcctgagtagctgggattacaggcacccgctaccatgcccagctaattttttgtatttttagtagagatggggtttcaccacgttgaccaggctggtctcgaactcccggcctcaggtgatctgcctgcctcggcctcccagtaggatcttgttttgattttcatgaattttgatgttatcattgaaatatctagaaatctgcatattttatttaagagagtctgctttttgtacacaaggaatgcttgttcttggtgaagcctcaggtatgatggataggaaggaataagaaagctgtttgagaggagaataaaaggacttagctactgattggattgttggattgggaaagtcaggagaagtaagggtttttgttttgtttgttgtctttatttttatggttgataccaatgacattcagtttgtgtaaatccatgaggacaagactgtattttactgctgtatccctagtgcagtgtctgaaatatggtgggctctcaatagatatttattgaatgacatctggagttcatacttcctcagaaatcctggaggaaatacactgcatataagaaggaatgggaatgtagatgtgcagtgtatcatactttagagcaggatcgacaaactgtatcccctggaccaagtccagctgcctcctgtttttgtttttgtttttcgagatggagtctccctctgttgtccaggctggagtgcagtggcgcgatcactgcccactgcaacttcggcgccccccaccgggatcaagagagtctcatccctcagcctcctgagtagctgggactacaggtgcctgccaccatgcttggctaatttttgtatttttagtagaattggggtttctccatgttggccaggctggtctagaactcctgacctcaagtgatctgcccacctcagcctctcaaagtgctgggattacaggtgtaagccaccacggcaagccctgtttttgtaaataaaggtttgttagagcatagaacacctgtttacttattgtttctggctgcttccacatagagttaaatagctgcaacagagaccatgtggctttgaaagcctgaaatgtttactctctggcccttcactgaaaaagttttctaaggtttgctgtagagctctcttccttagggtggatagtggaattgctactgatcatagatgatatctccaaatgagagaatgtggagacagaaggatgagagtgaggaggaggaaaatgtttgcatttcaggcttggaagagaaggaagctagggagggaggggagaggagagagaacaaaagtactgagtaatatcgtggaatctgagggaggccagagatgtttttgttgttttggtggtaacatgtaacatacaatttatcattactgacatttagtacatttacgaggtcgtaccttctttaccactctagttccagaacactttttgatcactccggaaggagagcccatacccattcatcagtcactccccatcccctcctttcccagcccctggcagcacaaatttacattctgtcttgtatgtttttccctttgccttagatctgggaaaggttttttttcgtcatggtggggaaatgggcttctgtgcagtcaggggagaagccgatggaggaaaggagtagtgtggttatggaagaggctgaaggggagaaggtcgcgggcatctggaggcctgagatgtgcatgagcatccagtcctgcaccggcgctggtgctgcagtggtgccgtctctgtcactgcagtgctgttctctgagagctgttccgcagcgtgattttgggtgctgttcctcattatgaagcctctcagtcatcttcttcagtctgcactgtacctttcatagatttctgattcaattagctgcagattggtttttgtggcttcctacctgaacgaagatagaaaatgatgatatatatgatggtggacggtaagatgacaaaccagttttgaagtcctctaagaaacatgaaagtggatgtgagtggtagatcacaccagtgaggttgtgattttgattagagtgttgtgagtaaatttcatgggccataagtgctgacaaacaaagattgttatggtttgatgtttcaaaaggggcatcaggaattgaggataaagtgtttgttgtacccccttttggggtctaggagaatgaatgagtaaaaatcctgaatgtcagtagctcatggagtgttagattttacatagactggtaaaaacctgagattgatatatggtggctaggttattttgaaagtaagaatcttaggagtaacaaattgctgtctgctatcacagtatttaaaaaaaaaaacccgttttacacaccaaaatgtaagaagaacatgctcccagaataaagaacactcaccaaattatatacttttgactatgtgaactactttttctcatttccatttttttcattttgctaaagaacgggttaaaaatgtgtcatggattggcattagtccatacagtacatttgggaaccacctattgaatactattaaaaaaatttcatttgtccaatttcatttgttcagattctgaaatgaaaaacaatttcatttatctgatttcatttgctcagaaccgaaatatgaacttcttggggatagggatcatgtcttaaacctgtggtgaccattttttttcttgactccaaggtaggacacacgttatctcatatataaatgatctagagtggaactgaatgttggaaaccagggctgtctggaagaatttggagttactatactttataatacttcattcttcctggtacccatttgatattgagcaccataaaaggtgcttggtaagcattcgtttgttggttgtttcagatttcattttaaccacttcctttggcatgctgagcaaattccttaggctttttttttggagacaaggtctggctctattgcccaggctgaaaagcagtggagccatctcagctcactgcaacctccgcctcctgggctcaagccatcctcccacctcagccccctgagtacctgcgactttgggtgggttctaccatatctggctactttttgtatttttctttttgtagagatggggttttgccacgttgcccaatctgatctcaaacttgtgagctcaagccatccgcccacctcaggcctcctaaactgctgggataacaggtgtgagccactgttcctggcccttgggcacttttcatacctcacaaagaatatactagcagaacttaggagtcaagatacccagggaatccttacagctctgtttctgcagctctccctagtctctgagtgtgcttggaaggaatattcaaatcatcattgtgttgtttcaggtttaacttgggaacttgaaactgaaatcaagttttggggaccttctgggtggtgacagatcttgttgttttgaccaggcactctttcttgtccccctgtccttataatgttgacttaggcatcctgctagctttgtgagttggtcaaccctgggtattaggggaaggaacggggggggggggtgggaggggggaagagaatactaaatgcattaagtgaatttctcaaggtggatgggaaggttttggggtttttttttgaggagaagtaataatacatagtagatttttgttaaagttttgcttttctacatttaaatataaaccttgaaaaggagaaataggaagagttgaccaagtattgaagtccctttttttttccttttggcttttttatggacaacggtggtttttaattttatcccttatcaattttgctattttgactaatttagtaagttcaaattatttaaatttatgtagtattttctttccattgagttgtcttttaatatttactgtttgaacatataggttttaacctatttaagcgttaccaaaagtttatactattgccagattgttactatggaaaatttcattttagttgctaaaaacaaggaagtattttatctaggccagggaaataattgggagcccaactagaaatcttagcagattctctatataggacatcgctgttagtggagggcttagggatggatccaggaaacctgagattactgcttaggtctttgaagaatggagatcacttaacctttatgggctgtggtttttcttctctttaaatatacgtttcagaaaatagatgtaaatatacgtagctaataaaagcatctagatttttagttttcatcagtcaaaatttatagcatgtgtaatggaaacttttagtaggacattgactgatgtagataatgcttaacgtttggatttgggaaagatttcaggaattaatcctgtggtaggactctgaggaggaagtcaactgtggactctggagaggggtcttcagaggagtctcgcaactgtggactctggataggggtcttcagaggagtctcgcaactgtggactctggagggaggtcttcagaggagtctcgcaaagcctgtagtggaataggcagcattgttgtttccatggcagcttggaatgtggaggtggaagctgcttccctggggctctaggcaggaataagccttcgaggtttacaggtagagtctcatgctggatgactgggttacaatttagtattcttcaggtagagcaaccaaataatgctttgaaagattcatttatcttataggtcaacagtttttgttttctatttagttgtagtaagattgtgttaataggcaaatatttttgtcagggatgatctgggcaaagtacccatttctggtacctgaattctggccttggaattaagataaatctgtaaagggagaggagagaaagatgaacatgagtttgattcctgacctcagtactcactgggtgtcacaggcaaatttactttttttttgtcttgctcttgcccaggctggagtacagtggcgtgatctttgcttaccgcagcctggacatgctgggctcaactaatcctcccaccccagccttctgagtagctaggatcacaggtgtgtgccaccacacgtgactcatttttgtattttttttttttttttttttgtagaaacagggtctctctatgttgcccagactggtcttgaactcctgggctcaagtgattctcctatcttggcctcccaaagtgctgggattacaggcatgaatcaccatgcacagcccatgggcaaacttttgagtctttttgaaccacccttatctgtactaggacgaaagaaagtgccttgcgtaatgatcttctggaaatgagaacattgttatcctggaggatcactttggtttttcttgtataccagactggatgcgggcagtgtcctacctctggacagtgattggctgatgccctctctcaccccatctgcagtgaagccctggggaaaagtggagccacgggagacccccaccactagaagtttgcttcagggactcttgcttttcctgtcttcttccccttccctttccccacttcatcacatcaatcatagagtttgcctccaggagctagcctctggtgtggttgctgcccagagcctggctgcctggccacttccattgccccattgtcgactggagccttattttactcacttctcagatgtcatacctggatcccacttgttgaagctgtcaacggggggtattggggctaattccaggggcaaaaagggagctctacagcactacacagttgtactgagaaagctattccatgcagcaaatgcattgttcagggttactcttaacactgcacattatggcgcaggaactaaatttgtgttcaaatgaatgcccttcctacagagaagtggactccaagtttaaatagctgatttccaagttttctttggaaggatttgttaaagcacacactttggatcagttcttaccaccagttccaaagctcaccaagcttaggtggaaggaggcatggctgccctggggatggggaagggatgctttcttaattgtactctgcatgggagaaatgtttctttctcttaaaagcagttttacctgtttaaaaaacgggctcagctcaaggcagatcacttaaggtgggacggagagggtttggagtgtatattgaagaaaaggagagtgcttataaaggtgggggaggaaaaggaggacgtgaaggcccagaagtgctgagaagcacagaagggtggtgttggtgttggcttttcagtcttcattttcctctgtgagtggatccttttagatcagtggtgggatgtcataaacgtttaatcctgagtgacacagaaggtgacacaggcttgcactttatatccaagaggaaccaagcacactcagataggtgcctgccattcttgtttctctaggaaaagttcctaaaggtgctaagaggggtacattttgtctaggttcagcactgggagggaggtgtaagaagctgcttgccttctttttaccttgtacttcactgcgtagacccagcacaggcttgggccacgtgccgagaaagggccgcacagccacaggttggctctcattgagcatggttatgtgttaactacccatatttcctggaaatgccacagaactgaagttggaagcaggtaggagagcctatgtctggacagcaaggggagtcctgggcagctgcacttacatggaccttggggagctggccccgttgttgccttgctgtcatggccactgagattcagctgctattgtgacccaggggacctctgtgtggcacagccttctgttctggaatcccagggaaacagctctggcctgcccgctccttcctatagttccagccacaattggcacctcactccctgcatccagtgcaatctcaggtgtctcctgctgtgcttgccttttccacagtcactctctaggaactactgaaattctcactagaatcagctgtttctctagatatggagcttgttccaaaagaatactttgcttttttgttgatgttctgacctttgatttcagtcctctccaaagataagaaacttgccatttgtagttgaagcatccataaagcatggttctgatgttggtggtgtaatagaattacttgggcaggttgaataactcttggctcttctatgcagttcagtgggcttagggtagaacttggagctggctgtttttagaaacattctgaggtgtttgaaaagtgaggtgttgtggttgagaaccattcatttatggggaccgtagtagtgacttgaaacattttatatatatatatgacatatatatggaaatatatatatttcataaacttttttccttaacatttattcagaatagtaaaaataatgttcactattgaaaaattggaagtataggaggatataaagtttcagggggaaaaaaaacaacacccgcaatcccaccactcagaagtaattactgcctgcattatcttttcttcattgttttgactaacttgttactgattgacttcactgcttttcagcaaatgttactggccttgagttggatatggaacttaaattccatctggaatcattcctggatgattctttcagagtcatcaagtactgattgagtacgagggactccagggatgaatgcatctgggggtctagggtgaggaaaatcccagcctcaagagatcttgttagttaaccagcttagcacctcctattatgattgtcatagacatttgtgtgtatattttagttcacatgttaggtgtttttaatggtttcatattattttgagtgatagaatttaggagagtaaatgctagtagaatcagagttcattagtttttgacatgttatatgcaaacacttaaaaaaattcctgtgatgtttgctgaagtttgcatttccagatactcatattccatttctgtgtattctgataggagggttataatatctctgttgttggggctattgctctggagtatttatcgattaacttttgttaatgatatactctgtgaaagcactttattaactggattaaaaaaattaattgtagcacacagtaatgcgaaaatttagttggaatgttgcccttatggacagttatcataggcagaatctaactcttagatgggaacagcaatcatgatctcacaggtctcctacagctctgacaaattctttcaaaattagtgaactgcattctgggtctctactatagaagagtctctgacttcacgggtttcatgttatttctacccaggaatcaggatgcctcacccaaaggcagttttgacaaaattaaagtatattgttggtgagtgtccagaagagagtgaaaactgggatggcctggctcagtgttggtctagcagaaactacctctagtgtaattgtttcctttctccctcctctttgttttctgcctctatttcatttctttcttttcacagttttttcttttctattcctctctctttttttcttttcttaggttaggctttcaggggctggaatgggagcagagttcacctgccaggaagtgagaatggcaggaaagctggaatggcagtccttggctctcctgtggtcgaggtctgattaccttctaggtagtcattgtgtcccaggagatttcagagaacaaacagtggaatcttatttaaatagttctgttaggagcattaatgttgtttgtaggtcatggtccagatggaagctggcccttttctgacaaatacctggaaacatttccttattctactgtacgttaggattttgcaatcattcttttctgatccctagcttactggataatcacaaaggctttttacttcctttgtgctgtaatattgatcatctgtgttggttggtttacagccaacacactgatccggatgcaagccggaaaatctaagggttggcaaatgattcgtcatttgcatagaacagcctaggactcttcagaatgaacttatggaagagagctgtggcataggagcaggagaaggtacaagttagggagcagtttggtattgcacttcatctttagttcagctttgttgcagggatcaagactgcaagttaaagggcaagttagggggcacctctgtctttaatgagatcataggataaaggcttatttatttgtttgtttgtttatttattgagacagggtcttgcttggttactcaggatggagtgcggtggtgcagtcttggcttactgaagccttgacctccccagctcagacaatacttctgcctcagcctcccgagtagctgggaccacagttgtgcactaccatgcccagctaatttttttttttttttgtattttttatagaaacgaggtttcaccatgttgcccaggctggtcttgaattcctgggcccaagcgatccacccacctcggcttcccaaagtgctgaggttacaggcctgagccaccatgcccggccaaggcttactgttcatctcaggtagcgtctgacatcgtgtggacgtacgtgcgttcaaatctcctctctgccagttctcagttctgtgactttcaagtaattattcagcctctctgtgcctcagttttctcttttgtaaagtgaggataatggtactagccataggtgagggttgaaggacacagtgtctggcacataatattaataaatattcattaatgttttactcttggctgtcctgaacattagtctgctttgacctagaattcttttcctgaagacacgctataattttgatgagagtaaacaactaactcttatttgcatgttcaaataaacatgtttttatgaaggtacttggtgttcattaacaaatgctatacttatgattttttttctctgagacataataccaaacttgtacataaaatatttctgatcactgatcttcgctcctataactataaaattatatgtaaaatagctaaaaactactcagtgcactctttagaatatatgtatttctcctatgagaagcatcattgagatctttatttgggaagcaattaggttgcaaattgaaaacagtttccaacatcatcaccaaactgaaaatgccaagttgtctgagtctaatgtccagaagtcattgtggccctgtggtcagtgttctgcattagggatccctgcaacagagctgaattaaagatgaagcacagtaacccaacacctgtgtcaataagggtggataatttctagggttccacaacgggctgtcagtatctttctcattattcccccagcctttgtttcacagcccagtggcttcagtcactatgtccattttcttatctcttaaggactgttcaactcattatatttggttgctttccccatcctaccctaaactgttgttatataagatcttctaaattacctttcacggctaaaccctgcaacttcagtccttgtcttacttgctttgttggcgtgtgttatcactgtcacttttcctcttgattttccctcctctgctggttttccttgtacctctttgtcagtgcattgttctgcccacccttgcaggttagtgtgtcttaacataccattcctgactctctcctactttgttcactttctatgtctacaactgcagtcactcttcccttgtgaatcccaaagccttgtctccagtccagatttgtttcctgagttccagaccctgagttccaaatgcctcaacatttccatgtaggtatttcatagacatctcctactccacatgtccctcccttctatcatctctgtgtttttccccaccctatttcaaagcaggaccacaatccatttgggagccaaagtcagaaatcttggagtcatcctatcgtcctcctttcccctcactcctcatgtcttcaccagcaggtcctgctgattttaccccactagcatagctttggtagcggtgtcatctcttgtcctttccttgcccacatcagttaccttgtcctgcctgggctgttatagtaacctcctacctggtcttctgcttccagtcttttttttttccattcatttgctgccagtgagttttagctggagtgaccatctgatcatgtcagatggtcgctcctcagcttaaactattggtggctctctcttgccctggggggagtgtaaactctccagtgtcccagtgcctttgtgactagcactttcctgcctttgcaccacatgccccctggcttgtgtgtgttttgtaacccagccattttgtacggatagtttcttgaattcaccatatccacattagtcatggttctctggagaaacagaaccagtgggatggatggatatggatatatatatatgtgtgtatatatatatagagagagagagagcgcgctattgattgattgattgattgattgattgatttgaaggaattggttcatgtcattgtgggggctggcaagtctgagatttgcagggctggctggcaagctagagacacaggaaagagttgatgttgcagctccagtccaacatctaggccgcttggaggcagaattagttgttcctcctgggtaatgtctttgagtggatgaagcccactcacattgtagggagtattactcagtgtactgatttaaatgttaatcacatctaaaaaatagccttcagagcaacatctaggcaggtgtttgaccaagtctggttggcatatcctagttagcacacaaaattaactgcctcactgtctttctcaatgttgctcgtgtttgtatctgtccagatttcccccacacctactgtggtgcctactgaccgcctggaaacctgccactcatcctgtgctccactctcagcctgccctgaccttctcaagcagcacagcatttcttagtacagcatttcctttttttgttcctaattggctggtaattgcgtctattacagtattccccctttgctgtgagtattcttaaattgcctaacagaatcagtatgcctcaaggaccaagcttctattgtttacattcaccagtgcttaagcacctgatgagtacccaataattgtgtaatgaggcaccgaatgaatggagacatttgggccaaagggtcggagataagcagtgagaatggaagcagttgagggagaaagcagaggttttggagccatttggaattggaggaatcccattcactgcaccagggtgtggtctctaaccccaggagagcattttagacgcctagggaaagcagctctgcagtcagattgacaggatcggagtaaacctctgagaagctccaaaactcaatcccagatcatacttcttacagtgagtgctggtctaatgatttccatagaatttgcatcgtaatttggtgacagtgtgtaaaagctgtcattatcagacttcagcatactagtcgcttccagctaatcacctccatgcaggggagcctagactgaaacattgttgcttttcattattttggagaataatttaggtagaattactgtttaatttttgtatttcctatttaagaaaacctgtttctttacggccctttgactttcattttctctttttcttcccactgacctggcggcttcttaaaggggcagcaccaagtttcctgttgcccctgtgggcagtggccacagattgtcttctttttcttcttttataccccatggcacattctgagagtattttcttttttcgttgttgtttgttttctttttgcttgggactgctataatgtgaatatgatattctcattaattcatttactcatgttgcaaaattcactaaaatccctttgttaaaagaacattttaaggccgggcatggtggctcactcctgtaatcccagcactttgggaggccgaggcagtcggatcacgaggtcaggatatggagaccatcctagctaacacggtgaaaccccgtctctactaaaaatacaaaaaattagccggtcgtggtggcgggtgcctgtagtcccagctactctggaggctgaggcaggagaatggtgtgaacccgggaggccgggaggcggagcttgcagtgagccgagattgcgccaccgcactctagcctgggtgacagagcaagactccgtctcaaaaaaaaaaagaacattttagatgacactactttaagtaatgtaatattgtgtttaagggagcttgattaaaataataaaatgcaattgaagtcaaaacagatggataaatcatgatattacaagtgagaactggaattctacgtgaagccaggaataaagctgagaggtaatctttgagccacaattttgtgtttttttgtttatttgtttgagattgggtgttgcttcttgctctgttgcctaggctggagtacagtggctcctgtaacctcaaactcttagattcaagcaatcctcccacctcagtctcctgaggagtacattacttgtggtaatgtactacaggtgtacattaccatgcctggctaattaaaaaatttctgtatagacggggtcttgctgtattccccacgctggttgtgaactcctaatctcaagtgatcttcccacgttggcctccccaaatgcttggattccaggtgtgaaccactgtgcctgagcttgtacatcccttcttagaaggccacagctttattaccattatcaaacagggacatacaagtacaggttgagtatcccttatctgaagtgcttgggagcacaagtgtttcagattttttttttttccgattttgaaatattttcatatacgtagagaaatgtatatacaaatcttgggggtgggacccaagtttaaacatgaaatttgtttatcttcatatataccttaaacacatagcccgaaggtaattttatacaacacattaagtaattttatgtgtgtagcaaagtttgtgtacattgaactgtcagaaagtgaaggtgactctatctgagccacccatgtggacagtctgtagttgtctggcatccccatccttcttgaggctgaatttatatgctacgtataagcaattattgtctcacatctattcacattaaagcacttaacagtaaaaaatatgacatgccattattacagcgagaaaataagtgtcagggtaaccaagcagcacagagcatcaccagacatctgtaccagctgctaaaccacagcaacagcacacagcagcaggctttccgtctccatctgtgaggccttgtgttgactaaaaggttaccgtacctgtatcttgtgtttggtgggtgaaaagaaacatcagaagtattgaaggaccgggaaattgagtcctctagggataaggaggcgttctgctggatggcttttaaagatgtttcctccggagtcatctgcctcattagccatgatttttgtcttacaagtctttgattttatacactgacaggatttcatgttttattgtgaatgcacactgccctagcccttgaataagcccttcacacattttcaacatgttgtctctgggcactttttctgcagtgttgacatcatcttcattgtcaccattataggttgaatatcccttatctgaaatgcttgggaccagaggggtggaattttccacttctggtgccatgttgacactaaaaaagttttggatttggggacattttggattttcagattagggatgcttaacctgtagttgtataatttatgacatttgaagaaaacggaagtgacccggctgctcaggagcaatattcatgatactgaaatcagagggaatttttttttaaagtttctggtttaagttggtgcccaggaggtgtggtcttttaactggtgtggtcggtgctctgtttgttactggtctgtgacaaggtaagtacagaaaatgagagtaaatttagaagcttttatagcaagttcctgagacatttacatctaatcatttttttttagtaactcaccttcagttgtattttacaaaagaaccagttcatgatggattagaaatttaaaatgaggatgctgacaataactagttctttactgcagacagtttgagaagcactggtttagaggatcctgtgtaaagtgattacgaatatcgtccatatagtaagttctatgttgtcttctcacttaacaggatgcactgttggctgatggcctaatgacagcatgctcttcagccaaactggttctgtaggactcaagtttctaccctctctatcatctggcttctatttagattttgctttatttccaaatttttatttatcttctgggtaggtaatatattcagctaatttaaaatataaagatgcaaatgggtattcaggtgagtcgtcctatgcctgtccgccacctccccatttcctcttctcagaggaccgacctgttgcctgtttactttctttttttgtttttcacacagggtcttgctctgtcgcccaggctggagtacagtggtatgatcgtagctcacttcagccttgacctcctgggctcaagcggtcctccctcctcaacctcccaagtagccagaactcaggcctgaatcactgtgcccagcctatttatttattaagagatttttaaagaaattcctaatgcttagaatctgtgaaaaagcacaggtgttaggttagctcttggaaccttgtgaccctgaataaactttagcctctacaaacctcagtttcataatgtatagaatgaagataattaactctaatttcagggttgttggcacgtaacatagctctcaataaatgatctggtgattgtaatctgaaatactttagaatgcacattaagatatatagaagattcataattacaattgtgcatattaaatatatttaataattatttgggaaagataaaaattaagataatgttctgtactctctgaggtgaatttttaaaaattgcttattttccattgcaagatgtaaaagtgtggtatcatagtatatttgcaaaagtgaatcactactttctggcaaagacagagtgtcttagtccaagaaacaatataaggtgaaaaattttgtaatttacggatgatctgatctaactggtttgtcctaatttttcacttccggtggtcaaagatatcttcatcccttgtttaaaacttagaagggaggcaatttctgtggacttgaggtggagaaagatggggttcctttttgctgtttactgccttgcttttctttcacctgtgcatttccagaggtgagtctgggtgttgtcttggtattcagatgagttcatcgtaatcctcaactttcttctctttcttttcctctttttctctgaggtgttcgctccaactctgcatatgttacaaaaaggggagtaagtgagaaaatggtcaggcttggggtggtgctggggaagcagtgaggaaaggtggtgaggaggtttggaaggcgttttggggcttaggggtacccccacaggtgatcgtgaatactcacttgacaaaccacttgtcagctcatttggagcccgagagcagttgttttcagtcactttgtcctttagacactggcagaataattccagagtccaaattaacttgggtaaaatactgcttgactttttattttctggatcaaaactaatcttttctttactcctttaaaagaaggatgtgtagggctgtttcttggtaggctttggctccagttaactcagttcatccagggctttggggggcactgggaggcttggaggggaatgggaggggcttacttacctttattaaagtgccctgatagttcagttattaacatgcaaagccactaatagcagctgaaacatattgagtgcttatatataccaggccttatgtgtgttaagatgtttgcaagtttaatcttcagaagataccatcactttataagctatttgcagcattattgtaagcacattttgatgtttactatttaaaacagagttgggaggtgtttctcctaccttaccccagtaaaaggcttagttcaaaagcaagttaatgagattatatgtgtttctcccttaaagttaaacaacaaaccacaaacataaaccttcacttaatattgaaaatattattacatgtcatatattttactatataaatattaagttgtattattaaagtattatagtatgttaaaaatatatggcagctctctattacaggcaaacacgtgtcctggtaatagaactggcagctcttggtgtggtgcagagtgaggtgaggggaaattaagcagggcaggccaggaagcaggggagggtcaggtgggagggggtgcagccaggtgtcccagtgtgggcttcacagaaactgctgtctgatgatctctgtccctctagtgaccaatgccaagctgcttacctgatgcttacagttgagagctgtgttctgagctgggtgcagagccagctcgagtccacgtgctgagcgctcaggccaggtgggcggctgaagccagggcggctgcgggaggctggcagggaggtctgatgtgcgggtctcagaatggtgcaaaccttgccaagtctcggggaagtgtcctggagtaggaaccactgagctccctttccgtgaggagccatgggagttggctgcgaaaaggggttgaggtgcaggggctgctgcagaggcacctgcccaggagaggcgggtgggaagcagccaacttaaagcactttgggggtgtttggagcacgtaaatgcagtgtaaaagggatagcacaaagggctatgaagaatcctagtgattatattacagatgtgcttcctccttagaaaatttgtatgtgtgcaagttgatagttaagcaggtttcagtgacccaggctggcattgaactcctgggctcaagtgctcctcctgtctcagtcttctgagtacctgagactgcaggtgcgtgctgccacaccagctcagacctctttaactgaagtcaggctctttcccacaaagaagtgtgagtgcagtttacccatgtgcacacgtgctcacacacgcttacacctgcacacacctccatgtaatcttagaggttcatagcactctggaaacacatgcctgttactctgattaaggtagaatctgtttcatactaacttaagccagtaaagatcatgtttttgttaaaatgttcaaaataacttataatgtaggaattatggaatgagattgttagtctcttcaattgagtttaaacacattatgtacatatttctgaactttaaatgctgtgtaactagaaatcaaaatatctttcattgtaactccttaagtagcatatattgtcccctttaaaactatttaatctaaaatcttttaagtctatatgctgtcctattcccaaaatgattcaaggcagccttatttatttaaactttttattaaggaagttttcaaatatatactgaagtaaaaatcatagtatagtgagcccccacatacccatcctctaattgtaattattaactcatagacaaatttatttcatatgtagctctatgtttccgtgatccccttccaaattttttacagtaaattctggtcactgtatatgatttcagctgtatttattatattatatatctttaattggctctttgaaaaagtaactacacaacctttattgtatttactaagttaataatagtttgttaacacaattagatgtctatcaatgttcagatttcactaattgtctcataattatttttaataatttgtttgaatcagggtccgaataaggtgatacattaaattggtcaatgtctcttagcctgtctttaattacctcctttcccccttccttcctttccttcctttctcctatttttcttccctccccatctctttctctcttctccctctctactgtctctttctccctccttcccccactgatatggtttggctgtatctctacccaaatctcatctcgaattatagctccattactcccacgtgttgtgggaaggacccggtgggagatcactgagtcatgggggtggttgcccccatgctgttcttgtggtagtgagtgagtctcatgagatctgatggttttataaagggaaacccttttgcttggctctcatttttccttttgctttctgccatgattgtgagacctccccagccatgtggaactgtgagttcattaaacctctttttcttcataaattacccagtctgagttatgtctttatcagcagcttgaaaacggactaataacatcctctctctgtctctttttctctgtgtctctatctctgtatgtgtctctttctcccttccccatcctctcttataatctgtttgttgaggacactgagccatttgctgtgttttgtttcttccatagtctgaatttggttatattcccaaagtgttcttttatccctttatttcctgtaaattgatgtttagatttaaagacttaatcagattcagtcttgatttttcttgatgtggggtggagacaaaagtacttcacagttggtcttaacgtacttacattaagaagcatgtgatgtcttggttttcttcatgtaatatcagcaaccattgaagatcattctcaagattatccattatttcattagaagttgcaaagttgtgataatctaattctgtagttttttcttcagtgattagtggaatacttttaaaaagagaagctcctgctggatatggtggctcttgcctgtaatcccagcactttgggaggctgaggagggaggatcacttgaggctatgaattcaagactagcccaaccaacatagtgagaccttgtctcttaaaagaaagaaagaaaatttatgtaaaaaaagaagctcataagtgtaatcattccttggtatccatgaaggatagattccaggaccctcgcagacaccagcatccacagatgctcaagtcccttaaataaaatggcataatatttgcatgtaacctgcacacattctgctatgtatgataaatcatacttagattacttataatatctaatacaatgaaaatgctatgtaaatagttgttatactgtattgtttagggaataatgacaataaaggtctgtacatgttcattacaggtgcaaaaccatccattttttttccctcatatttttgatctgcagttggttgaatcctcaatgaggaaccgatggatataggggccaactgtattcggttactctgaggtatagaaaaggcaaaataaatgatcagttatttttctttaccagtttttaatgacttggtttcataccaatttccaatggtgactaattttgtttttagtaccattatgaattcatggaatgaaatattgttgatgtgtgtcagttgaagcttgttgtcctattgttgaagttctagttgtcctaatctgtgaacctttccatttggcctctgtgtccttttgatacaggcttgatagtctttgcttcattgctttctggtatgacaagaggattcatacatttttcctgcaccagatctggaatcagctctttttctaaggagcccaaaggcaggtttattttaattttgaaaatatttaaatgaaaaattaacactccgtaggtcatcttgacgttgctgctaaagtacttgttttagttgttgcctcaaagtatgtaaggaacattaccttgttcactttttcatttaatcagaaactctgaagagtgttagtttaccccttctcccccttaagcttgaattctagccttcgtcctcctattctcatagaccccactgtgctttcttctggtcctgctgtgtcctctaatgctcgctgattggtattctccttatgtgggttagtttttaaagggtgctcttcctagctgccctgcactgaagcacggcccagcaatctgctctgggactacccttgttttatttttttactccgtatgtgcccctccttcaccccaaactatagtagaactgttttgtgtacctttatgacaaaatcaatttgtattttatttgctctcctttttcaaagtgagtttacatcaaatatcccatttaattcctacaactgctttgtcaagaccattgggtctgtattgttattttcatgtcacaaatgaaaaagattgaaacccaaagagcttaatgggcctaaggtcccaccattagtaaatgacagattaatgagcagctggaattagaatttagagctgcagagtccacccccactgccaggtttcaccaactaccataaatcaagggattccttgctacgtattttgagggactcttgagtcaggacagtctaaaaaggcttccctcagtgatatttgccacctgtggtgagcttttgctgtggattacagttttatgatttctaatactgtggacagagatcagcagtgagagcccacgccccctttattgaattcaaaaatactgggacaaaaataatgtacagtagggggctaattttgatttccctgtccctaaggttcctaagccacctagaaagggagtaaccttaggggatacaagttaagtaaaagaatgccatgggcatacagaagaaatgataagaaaaggtgatatttttctttttaaagacttaaactgattattttttacaggagtaaccattcagaaaatactgcccttttaagctttccagaggatgacacacgctcttatggtttatagtcagaatccatgtcgagctgcacatgtgaaaaatgaatgtcatgttgttttcaagtagtaagctcaatgtttctaatttagttttttttttttttttttttttacaagttaatctaattttggtataagtggaaaagttgataattaaagaaagcaggtcctttctaacacaaagaccactaaggatgttttctccagcaattcttaataactttatagtttttattcccttgcaaaacatgggtttggggctgtgcagttagagaatatgtattgtttaagtgtaaattttaagcacataaggaatatcctataacttgtattattatctaaaaattgttgtaatgtttttgaggttttgtcctgttgatttttttgttgctctttctttttaggaaaaattctttgaaatgttggtcctgcaatgctcgctgcttgaagcagtgttttgtctaagcttgggtggattctgaattgttaacatgtctgtatgcttgcctgcttaagtttttgacaaagaccttcttgaactcttaactttcccaagtagaaaataacagtagagccactgcaggagttagttgagatattgctattttataattgaattcatatgttaaaagctccaggtttgaagtagtataacttttctttatcatatcacaaaatatcacatctacttggcttcttaatcaattgaattacagagaaatgtaacacaggttctaaattaaaaacaaataggtactatgacattaaaattccctgcacagttatactatatttacttacttgaatgaactgtaattaaaaagagatgggttaaattattaccaattgttgaaggtttagttaaattttaggtgacgaaactgtgaaaagggataggaaagtcatatttttggaaggcttttatgtataatgtcttacaagagtacctagttcctactttggctcacctaaaagactggaagtcgtaaacttggtaacattgttttcaaattgaataaatatttcatgggaatttagaattctgggctcattctcactaatgtctgttttctgaccctacggcatagattatttaaaaactactaacatgaaatacgtattttttcctgccttacgtgttctttgggagttaaaaaattttttctagttatttttggtggggaagatcttgctacaaagaggagtgagactatttgagcatttcaaatagacctatttgagcatccttttggtttattttgaacatcttttgatgtagggtctattttttaaaaaaacatatagggcagatgttactattaattagtcttatctaaagtttaacatgcaaattagagaattgtaggagaaagtaattgaaagtgttatacacattaaaaataagcagatgtcatttggaaaacaaatagatacttgagattattttattacttcttcagcaggtatttgctgaacacccactatgttcaggtgggaatgaacgtggtagacatggccccagacgtcaagtacgtgtgtaaggggcgttagtaatgcacatccccaaaaaacattcctcttactcttctagtgtggtggcagaggaaagacagaagtaaacaaaccagagctgttttgggtaatcactgtgttagtccgttctcacactgctataaagagctacctgagactgggtaatttatgaagaaaaagaggtttaattgactcacagttatgcaggctgtacagggagtatgcctgggaggctgcaggaaacttgcaatcatggtggaagggcgaaggagaagcaagcacatcttcacatggcatcagaagaaacagtgaagggagaagtgccacacacttttaaaccatcagatctcatgataactcattatcacgagaacagaaagggggacatccgcccccatgatccaattatctcccaccaggtccctccctcagtgctgggaattacaattcaacatgagatttggatggggacacagagccaaaccatgttagtcactaagtgccgtgaaagggatgaactacatgtggtgtgatagggcagagggtgggtgtagaccctccaggtgccgtgcccagagatgcgggttcaggaggagacaccactgcccatggcccacctctgtctgtctcttaccccaccttgggagtaagcagacctttcctgggagcccctagctgatttcctttcccaccttgggagtaagcagacctttcctggaagcccctagctgatttcctttcctgtctcattggtctgaaatgaaccccatactcatgtcttagcccgtccattctcgaggcactcctggggctgcgttacaccaggaaaggatgggtaagcacattggggattttgttagataacttggtagttaacaaaccctgaccactacaggttttcttaataataggtaaaatatattgagcacttactatttgccaggctaagtgttctaagtattttatgtgcattatgccatttaatccttttaacagtgtgctaaggtaggtgcagaaactgaggcttatggagatgaacttggcctgccttgtgtggtggacctgggatgctaactgggcactctggtttcagagcttgcatccttaaaatgcaatctgtggaaagtaggaaatagatttttgaaatattctgtacaaatttgttgattataataaaggcactcaggagctaaattggttactttcagtagctagaaaatttatttatatgaagctttgttttctctagtgtagaatagtgattatctttttcactaattacatacaacagaatatatcacctttctatatgttaaggctgtcttgtttacggatcatttcacgctaggttttgggtcctttgggtaaggagtgtgtgttctatcttcctgtgcctggcagccatggtagtgtgagctgggctctgttagcctcttggtttatctgaaacagcttaagaatctgtcttaagcctagcattaaacattgtggtaaatcgtattagaaccccgaagatagattttcctcccaattttaaaattattttttcttacgtgtccttttttagggccacttactggcttctagaggttttataaatgcacgtttgataatgctaaacataggtaaaataagcagaagttttctagaattcagtccagagagagagagagagagagaacgtgtgtgtgtgtgtgtgtgtgtgtgtgtgtgtgtatgtgtatgtgtatgtatgtgtattagagatacattacatgcaaggtttgacttggcacttgaaaactgacagcaggtgtgtgagtacccactgtggtcaaggcatcttggctaacacctgcctattgtgcgggactactccccctgcagggggaaggtgagctagtcagccagttctggcatttgccattgagctgaggctgcttaaaacatcagatctgcagagtacattgtgttcagtggcccagacttttttatttccttaactagtagcctctacccccacagtatgtactaatttcaggttcactgtggggcaaccagtgctcttattttttcaaccaagtgtattttgggttcccatcatttaaaataaaggatattttaacaccagaatagttaggaagtaatctcaaaagatgttataagaagtctgattatggagtcatgggcttatctaataaatcttgatttctttttttattttgcaatgccctgctgaacacttaaccatgtgctgttaacatgaaggaggtggggatccaaaacagttttcttgaagtgatggaagaggtttctaaaactgagcttgagaattaagtttggtaatattcttgctcttatgcttggacaggacagcttgggtcagacacgtagttgttacctgtgctactgatgagaacattagattgcctaatagttttttttttttttttaatgtagcccactgtaccggccttagaattcagttagtgataatcgtttagcaaaatgtgtttaacttgaagaaaatagtaaaacatgctctttctaaaattatggcttctcaaattaccacatcttgggcaagctattttctaaagtgcttttactttccttcgggtatttcagctacattgagctcttccacagtttgggctgccataaatctatgggaaagtgttttgaataattatgcagacagtttcttagaagcatctaacatatgtgggcctccatcagtaccacctctttgtggccctgcaagctgtgggaaaattgtctgtacagcttgtatataatactctacaattttcctgtgactgtaaaaagtatggactggcgatcagaaatagtagcttctgtttttagctttgctatgatttgatatttatccttaggtgagttgcttagcctttctttgtgacaattgtgtcatctgtaaaacggaatattgaatgtagataagctaactgcactgttcagctgtgatgcagctggtaacagaacaagtctcctgaaaatgatggataaatcttttctaatctaaactgctccagcagcagttttgggtgatggcgtaaacttgagggtagaagccagatatagaaggaggctacctaggtcattgattatcgttgaccccgtaatcagcagttcttgactggctaccatcagacttctcttacatgatgtgtgttgggttctaacttatgcacagcttcacctaatcctaacagagtaaagcttatgttttcatgaccttataagtaaaacttttctaatctgggaagggaatacctgtctgccttttccacctcatctttcctgactgggtttttcatatgcctggaaaaagctactaacttggcaaacatatatatgcttaatttcttggttctcaagatcctgttttagagaaatcttctcaatattttcctgttgagaggaatttactgtgtcccttagttattaagaaaattgcctgtggccatgttaaccttacagtcttccctgcagaaacttcaaatgggcaggactgtaatttccagaggggaaggggtgatctaaaatgagaatcacttttatttttacgtaacaataggcgaattgctcttaggggtagtattcattccttcaacaaatatttactgagcatctgctaggtgctaggaacaaaaccgtcctaggaacaatgcagacaagttaatgggcaatttgaatccaatacagattttgtaagtttgattacaattctaaactctaatgttataagctcagtagtttgttgtcattgtggcatggacaaccagttagtcttcacttcctccttaaaaatacaatccctatattatttggggtgaacactgagcttaattaaatgatgacattttccagcttccttagcagtaaatgtgactgtgattcaattctggccaatgaacataagtgacagtgctttgtggaacttctggaaagcctgcttaaaggaagttgagagttgggagacatgtcccctgtgcctttaccttctgcttttctgtttcttggtacatggatgtgatgtctggagctccagcagcagttttcattggtgacataaacttgagggtagaagccagatatagaaggaggctacctaggtcattgattattgttgaccccgtaatcagcagttcttgactggctaccatcagacttcttttacatgatgtgtgttggattctaacttatgtgcagcttcacctaatcctaatagagtaaagcttatgttttcatgaccttataagtaaaacttatgttttctctgacctcatggcatggctgtgaataccaccactaagacttctgggagtgtggttttcagtagttcacccctgtgcttattctcccttcatggctctgatggactgctggagtaatttcagataacaggtaaggacatcctcagactaaggaatatcatctgtactgttcctaaacaaatatacctggaaatactttaaagcagtggttcccatagtgtttcctcagatcagcaataccggcatcaatctgggaatttgtttggaatcttaggcccacattttgacctaccaagccagagctctgaggggtggggcccagcagtctgaatgagtgacttggatgcagcctaaagtttaagaaccactgctatatggtcttctgcatcttgatactcaaagtggtatatgaatatgaggttggtcaggtgacagtgatggttgagtttgacaaagttgatgaaaataaccacttggactctgttcaacttgtttcctcttatttactactgaatggacaaatgaatacatcaaaagatgcatgaattcatgcaagagacaagtagacctatgaaggagtgggcataggtcttcagtgcctcctagagcctcccagaggcacccctggagtctgaccacactccacttgggttgagaacccagaagcatccgatattaaagataacaacactttgcttgaatgggaaaactcatttcagagttggatgtccgggcttttttttttcttgagatggagttttgctcttgttgcccaggttggagtgcaatggtgtgatcttggctcaccacaacctctgcctcccgggttcaagcgattctcctgcctcagcctcctgagtagctgggattacaggcatgtgccaccacgcccggctaattttgtatttttagtagagacatgatttctccatgttggtcaggctggtctcgaactcctgaccttgggtgatctgcccgccttggcctcccaaagcgctgagattacaggtgtgagccactgcacccagccgtctgtgcttttatactgccaccaaactgttacagtgaaaaatggacaagttgcttgaaaaaggacaaccagcctaaactgacttatcatgaaacagaacacacgtgtggtagcatatctattaaagaaattgatatcattatcaaaaacctctctgtcacacttacacacaaaagcctacaacacccccctccccccccacacacacaccctgaaggcttggactgaagagtgaaaaagagtccaacttgtagcaatctgtgggggtagatggaagagatggaagcagagatgcagtggctccagcataagaacttctttggtaacatctctgcatatcgcaagggctgcattgtgcaggacttgtaagaatgtaggcatttggatgtcattctaattggaatcggaaacaaatgggagctattaaatagaaaagaattaggatctgatttgtgatgtaatcctcattctggcagctttatagaagctactccagagggccacgctggaagaagggagaccagttaggaggctgttagaatagtctggacacaaggacagtgtgctttggattagaggacatggtaagaaggcggcaggatgtgtgggatttgctacaggattgaacttaaggagatgaacttttcaatgggggagttttatatgcaactaatggtgaacttaggtagaggatggggaatagtagcatttaaaagcaaagaacatacagctctgggttgattgcttcagctttgcaactatccactgataacttggctttaaccaagttatgctgtatcttcaaaattttcatttgtaaaatggtgttattaacatccacctttgggattgctgagagaattaagtgagaaaaactctgttaaagggtttaggacaatatccagcgacagcaaatgctcaataaatgtcataattatttttctttgtaaaactttagacgtaaaaaaaattcaatattagaaaaagttcttcatcaaaccacacatagtatagattgacttttgttacagaaacaaatggtattcataaattttagcattatggtaattatgtaggagataacagaaaaatggcccctaacacaagcatgggcttaaaaaagagtgctgtggtcaagttgtggagctaaatagtttgccaccttttaccagtaggcgaaagggacattatatgatgatccttggtcttgtaaactggtcaaaaccatcagtgataaaggtaacctgtccactagggaagtgctggccaataaaattttctgcaatgatgggaatgctccgttctgcaccatctgaaataacagcctctagccacgtgtagttattgagcacttgaaatatgactgatgcaattgcacaactgaatttctaattttatttcattttaattgatttaagtagccacttgtggttagtagctactgtattgaatagcacagctctggaaggtgagcttgtaaatgcagggacttcgtatcataacactgtccctacatgcctaaagcagcatttggcacatgagcaatatttggtaaatattagttgaatgagtgaaagggtatcctttacacataagggatgtatgcaggaagatagtaaatggaatcattgctatttaattgttgcattacagtagtagagggatgagagagcattggacaagatttgggggaagaagggagatgacaaagtgggcaggagcacttcttggtaaaaaaattaactctacctgtggaaaggcaaacataaagagggccgggaaaatgacccgatcacagaccagcccacagctgtggtgattgatgatgtatacttggcatgtagagaaaatggtgtgaatcttaaccctatccctaaccctatcaaaataaagacaactaggatgctagttttgtagtttcctgaaataagtttccttaagaatgttagtcacccaaattaagaaaatttgtaaagtcaggttttccagagatacctctgcttagcttcaagggaaatcacaccctcccaccctcaattaaggaaaacgttaaatgctgatgtatgttggtctacaataatctttagtcttacaaaatgcctttttccatgtgaaatcgtgtgatcatttacagttttcattccctgtgctattgcgatgatgtttcacctgccttcctcccagcctacagcaaggttttctactaaaatgtacccacctgtgaagaaaacctggtagagttattggaatcagcgtaaactacttatatttctttggtataccagttagattctattttaaaaacacatttttttttcgtagtgttaaccactgtctccaaatcattacagaaaacattgttttaaaagttatttaaaaaatctggacacataaaaaaaaaatcatagcctaaatgtcacaccagtattcacactgtgcttccacagtgggcctactgtactgtccaaagaaacttggcattttgtctaagaataagtcaataacaggaactccatcataaatgccctggtttcctgctaatacaagactctcagctgctgactctcactaggcaggagcatacaagtttaaataacagctggcagcaaagcccgacagggaaggccgtattatttttaaattggagaattgtttttcataagtttcttacatattttttttccaattttaccatcatttttcatttcaaaattgaataaatgtcctcaaagtgacaggaaaaactacattgaatcaataaacgttaactaccccccaaccccccagtggcctaaagtaactccagtacataagcatcggccttttattaattggacaagccttcaaaaatgaggaaaagtaatttatgttggcaatttgattaacaggcttcctatgaacacacattcctgtaaagttaacaagtatgagccattcaagacacaccaagaacggttcttagaaaccttgcaaatgaaaatgtggcaggatacttctggccaaagggggtgcacagcccagacccaggcgcctttattgcttgattcagggtgactttctgcagaccctgtcaagtgtaagatgccatgactgcttctttaggaccaagctcacaatctggaaccttctttgtttccgtctctgctccatcccctctctccactgtggtccagaaccagggtcatagcttatctttattgcagcaggaggcatttcaaggcagaaacagcccattctatccaggtaaaccacaacagacgtggcatcatgtcagattcaatagctctttcatgcagtagctcccttcccttgccaggacataggccacgaggccagtctctgagcctatgagctaccgtgactgttcccaccttactcagtttccatcaattaactccattctcttccatcagcctgtcccctcctctgcaactgaggcacggagagaattaagaggttgtcaaataagcatttgagttgaaaccagacatgtaagcatatcaatgtcagagaagattgtatctgtaaaaaaaaaaaaaaatagaaagaaattggcagcagtcttactcgactgtgcttactcgactgtgcagtgaggacatgctgccctcactgcctagatggtttcatctcggatgtgcatgtggtgttctgtcttcatccttcgcctctctgctaacatgctgccctcactgcctagatggtttcatctcggatgtccatgtggtgctctctcttcatccttcacctctctgctaacatgctgccctcactgcctagatggttacatctcggatgtccatgtggtgctctctcttcatccttcacctctctgctaacatgctgccctcactgcctagatggttacatctcggatgtgcatgtggtgctctctcttcatccttcacctctctgctaacgcgctgccctcactgcctagatggtttcatctcggatgcccatgtggtgctctctcttcatccttcacctctctgctaacatgctgccctcactgcctagatggtttcatctcggatgtccatgtggtgctctctcttcatccttcacctccctgctaacatgctgccctcactgcctagatggtttcatctcggatgcccatgtggtgctctctcttcatccttcgcctctctgctaacatgctgtcctcactgcctagatggttacatctcggatgcccatgtggtgctctgtcttcatccttcacctctctgctaacatgctgccctcactgcctagatggtttcatctcggatgcccatgtggtgctctctcttcatccttcacctctctgctaacatgctgccctcactgcctagatggtttcatctcggatgtccatgtggtgttctgtcttcatccttcacctctctgctaacatgctgccctcactgcctagatggtttcatctcggatgcccatgtggtgctctctcttcatccttcacctctctgctaacatgctgccctcactgcctagatggtttcatctcagatgtgcatgtggtgctctctcttcatccttcacctctctgctaacatgctgccctcactgcctagatggtttcatctcagatgtgcatgtggtgctctctcttcatccttcacctctctgctaacatgctgccctcactgcctagatggtttcatctcggatgcgcatgtggtgttctgtcttcatccttcacctctctgctaacatgctgccctcactgcctagatggttgttacatctcggatgtccatgtggtgctctctcttcatccctcacctctctgctaacatgctgccctcactgcctagatggtttcatctcggatgctcatgtggtgctctctcttcatctttcacccctctgctaacatgctgccctcactgcctagatggtttcatctcggatgcccatgtggtgctctgtcttcatccttcacgtctctgctaacatgctgccctcactgcctagattggttcatctcggatgcccatgtggtgctctgtcttcatccttcatctctctgctaacatgctgccctcactgcctagatggttacatttcggatgcccatttggtgctctctcttcatccttcacctctctgctaacatgctgccctcactgcctagatggttacatctcggatgcccatttggtgctctgtcttcatccttcacctctctgctaacatgctgccctcactgcctagatggttacatctcggatgtccatgtggtgctctctcttcatccttcacctctctgctaacatgctgccctcactgcctagatggtttcatctcggatgtgcatgtggtgttctgtcttcatccttcgcctctctgctaacatgctgccctcactgcctagatggttacatctcggatgtccatgtggtgctctctcttcatccttcacctctctgctaacatgatgccctcactgcctagttggttacatctcggatgtccatgtggtgctctctcttcatccttcacctctctgctaacatgctgccctcactgcctggatggttacatctcggatgtccatgtggtgttctgtcttcatccttcacctctctgctaacatgctgccctcactgcctagattgtttcatctcggatgtgcatgtggtgttctgtcttcatccttcgcctctctgctaacatgtcatcttctactgaggctcccatcccttccactctcttacactgctgtgttttttcctatagcacttttcatcacctggcacatgtatttgtttctcgtctgtgtcccttgtctacagaataaacttcctcagtgtagagtgttctgtttactgctggagtctctgctgcctagaataatatctgacacagtggatgtgcaataaatatttgtttaataaatgaatgaatatattctagagctatttgtacaaggcagagatttccagatcacagtgttcatatgtataacatacaatcctgtaatgtttctaatttgctatggtatggaatagcatttaccatatatagcttaggtttgtaggctttatcttttagaaatccttaattcttagacttctcactcatttatttatttttgataaatattcctgtatctgctctgtacctggtactatttctaggtactgctgaaaagtggttaacaagcagacaagtgttctgcttttaagttgatacttgaatgaagaagactgaaataaaggaagatactaataatttcaacaaatgataaaaagccatgaaaatcatcttaggaatagagattgaaatgagcttggggcattgcattaagttgttggtaagaaggccttcagaggagctgaaaatggagaggaggaagggtttcaggcagtggaaaagatggcgccaaggtcctgagtaggctgtattctagaacacagagaaagtggcagtacatttaggggagggagcagtgagtggggagagcagcgaggacagagagtggaggcatttgaaggcagaaagtaaatggattgtgtaggccattgtatcaggtttatattttattccattagaaatgggaagccaatggaatgacatttgatttgtattttataaagatttctggctgcctgtgagttgttgtgtcagagaattaatttattttgggttcctgttaaggtccaacagagatatttgagtataatactttgttgccatccataaaactaaatattttcattaaatggagtttaggaaaatcttgattaatgagtaaacaccaccatgtattgtggacatgaagttaaaaacaaaaggtaaattagtctaaatatttataccattatgtccaataagaaatgaataatgttgaatatgaagtttttaatatgaattagggaattacattttgaaatattttaggataggaaaatgggtagatgattagagattcagctttatgtataaagatagttgtatgttctctttaggttagcaatggcaaacacttgatataaggacatcataagcaaagctgtaagccattaccaagcctgaattattgactttatgaatggtctgttttctacctgttctcattctaaccaattgtggtcttagagctaggctagagacacctctgtagatagactagtataattcttctggtttaggatccacaattgctaccctttctattccagacaccatgcatttcaaaatgcttagtttttcttgaacttgttgagaagtctgatgtggtatagaagtttcagcagttctaatattttccagtttcgcacaggcaaacataattttctgattttgtaaaatacctcgtagcagtaaaatgaaatttttcttattcatttcttctctgcagcattacttttctttattgcttaattctcttgtttttttttttttgtttatttgtttcttatccagtgatctctggaacatgattaaaaactcatataaacttggaccttttggtcattgaagagtcttagcatactttgacattttagaaaagaaaaacagaattgaaggggacacaaggtacattggtttatgggatgttcctcaaaccctttctcaaatattttggatgtatttcatttcctaacaaatatttttttcctattttgaggcaggaagtgaggatatgcctgttgacaggcagccccttcttcaggaattacatgtatctgtataatgtgtacaggcatatgcatctgtgtatacatagccagatttgtcatcatggccaggaaattaccctttagctcctgctgcaagttctgcattcttcgttacttttctcattggctggtcctggtctcaggctcccttccagtggctgcttattttagtaaatttcacacactttcccatcattcgttcacagtaagcctgtggcacgatgtgcatcatttccattttatagatggggataggaatgatcagagaagttactttgtacagtgtctccccgatggtaaatgatagagatgggatttggggagacctggctttctgactctaatgcacgcatcctccactggtacctgtgttgtttctcaataacagcttgaggaaatgaatgacagaaagtaaaatctgccttttagccctgcagaatgggctcctctgtgagaacgtggcttccatgagaggggtgtcttcctttgccatccctacttgtgccattgtttctctcacaaggcggctgtgtcctgttagcacccagaattaggaagtgtggaaaattaaagccatattatcctgttaaagtgtttcagggaaatgggatactttgatttgcatggaggaaaatgccaagcccatgtgtcactttttgatttgttcacagcaaagccagagcttctctagtgcagtgctcccttgtgaaggcaaatggtgcagggccaggcaggcccttttacgggaaatgtcatcatttttatagacctggcccttgacgtggtcaggtttagcaacttacttgggaccacacaggcagtggagctggagaaacagctggcaacaaagcctcctccttccagccaaatggtctttccctgaaactatctaccttcctcaggaaactagtcttttaatagcatctaccctccaccaagaacctgggcgggaggaggaatagaggcatcctttgagagcctccttcccactcagtgtttccacttggagagctgggcggccttgagtcgcttggatgagtcagggacatgaagcgctttgccttatggtgcgggagagcctctggcatcacctcctactaaagccagtaatgggaacagttatcataatggatgtgtcagtttgctaatgacattatttaatactgactttattcgttcttcacataagacattattgaaacttaaattgaggaagttgcttctcctaggaagggtgtgggactgctgctggacacagaggtttaacttgcaacccttttactagttaaaaggcttaaattttcactggctttttgacaagtatccgtttagaatcaagtcatcaccaccattatcattagaattgtcatggctcctgtctaatgcactccagctgttaggctagtaagcttgaagataaaggtatgctttggacacattctgctttgataaaaatcttgatcaccccaagagtccctaatttgaagtcagagtcacaaagattggtgttctgcagctttcctcttggtaacagagtgtacttttgtttaactttttttcctgtgttttttaaccaacatctctgagcacctattactaccttgcttgacagttaagacagcaacctttaaaagttaatgtggtctgtcctgaactgtccagaactaggcaagaggtaaagaaaccacaagcaaacctgaggcatgatctgcagtttatttgaatttgttttggattctatgtttactgtaggcatcaaacactgtagaaaaaaacataagaaaacagttctagagacctgctatggtagatttcaggagtgccttctgtacttagcaacagtgaactttttaagtgcttccaagtagacttgtgccttgtgacccacactattactacattttggtaaaagtaaactctttctggtcttggcaccaaaagtaaaacttgtagagtctaattaaggttgtgtgcatagcactaggtgtttatcagtgcagtgagggaaataaaccaccaggtggctcaagtatatagcatctgcgtgttttagtccttgataattatagttttgcagttgctttgtacttcagggagaccatttaatataaaccattgtaataatttatctagttttttacacaatcttagaatgctaaagtagaagattgactgttttgaactgttactaatgtttgtaagtttttgggcacaaacttatgttttgcttaataaaataaaaacttagacattatttgtgttttggctgaaatcagtccccaattgtcatcttgggatgttatgattatttacttatatatgtatatatttattttggcatatactctccacagttgcaaatgaaattaatagatagatgtttaacttcactgttgaaatttaaactgtcagcatgatttattatttatatatttatttttattaactttttttttttttttggtagagacaaggtctttcttatgttgcccagggtggtttcaaactcctggtatcaagccagccttctggtttggcctcccaaagagctggggttataggcatgagctgccatacccaaccttgttgccatggtttacattgtcttattttataccttcattctttagaaaaaaagaaggacacataatacctaagaaatcaacatgtaatttttatggacttaattatttccaaagaaggcttttaaaaacttactttatcccctgaaaaggaagttgctttgtagctttccacttacattaggataaaaagaataaaatgtcaaagtatttgctttactttagaatatatatgcagcaaagttcaagaaaattatcacagttctcagcagaccaaggcatagcatctcagttttggttctcatactttttatatttgaatcacagagttcttggaatagatttttttttttttggcctgatagccttaaggaataatggaaaataaaacacttcttcaaaaatgtaacgtctaatttcctatttgtctaggtctttttgcttcagaatttttgaacagaatcattaagtactatcgcttctacagaagaagaaaaaggaaaagacagtgaaattcaaatccgttttttctttatactaagtctggttaaagcttttactggagaaaagatgcaagcttttaagcatgtgttttaaaattactatgattttacccttgctaacttcatgtgtgtataattacctcagaaaggaaacaaagatttttattgatattatttaaaataatgttttctttttctttttagcaaagtacaggctgataattccaaaggctgtttaaggggtaattgtggctgacagagcagcattcacggaacatcactactgtgcttggctggaacagtgtcactgtgtctgaaagtcttgataatgttcagttgactgtactaattgtcctgttttatgcatggctagccaagtggtaaccaagagttttaaacaatggatctttattaaggtattaatttttgtcaaggaaactgacgtgatttgaaagaatgtttactgtgtgtgacacgtgtggaagaaattgtttgtgttttcccctcttccatgtttaggaaataaaataaccaaaaagtgtgtgcgtgtagcactttttaaccttaattgtcttttatttatattggtatcttgatataaaaattgaaatttgttataatgataaagaaattagagatgtgaaacatgattgataaagtaaggaagtaaaattggtaaaaatgcttaaagatataatttagtgttataatacttttagctgaaatgtttatttattgggtttaaacaactatatatgtatgtgtgtatgtttaaaatatattccatgaggaatcgacctttaagaatcatgaagcatattttccccaactttcttcactcttctttacaagtcttaattttttgtattgtgaatattataatgccatttctctctgctttaatgttcttttaaagaacattcaaagattacagtgatttaaaaaattaaccttgaactcaagaagaactcaatggagaatacagaagcaccttaatcaatagatgccttttcctcccctcacacacacacacagtccaaactgctgacagagctgagattaagccaggatttcctgaggcatgggaactacctaacttgacttacatcatgctgaattgagaaagacacatcatatttataatgcttctttttttttaaaaaaaaatagcatttttggctggacgcggtggctcacgcctgtaatccagcactttgggaggccgagcgggtggatcatgaggtcaggagatggagaccatcctggctaacatggtgaaaccccatctctactaaaaatacaaaaaattagctgggcgtggtggtggatgcctgtagttccacctacttgggaggctgaggcaggagaatggcgtgaacctgggaggtagagcttgcagtgagccgagatcgcgccactgcactccagcctggcaacagagcgagactccatctcaaaaaaaaaaaaaaaaaaaaaatagcattttcactaagcttccactattccaggaatccatctggctatttcatgtgtatttgccacctttacaatcctaaaatgaaatttgtgaataacatatcctaattacacatgttatttaaaaaaatccatataccctttttatgacagtgaaaaaggaaatgaaaagcaagttgtttgccaggagaacttgcatctcagtattcagatgtggagaccctgctgcctagggtgtggaggaactgctcagaggccacactttgggagcatccctgctgtggcagctgcagatgcagactgtggcacgtggatggcagtggagactcagcaagcactggtggtgtgctgttggtgtcattgtttcttgaaatggtcaaatttggttaaatttggaataaaatggtagtcttcctgtttaacacatactttgtaacacatacgttgtgcctatgtaataacttgagtgaggttttacgctcagacaattataaacaggttttttacccacgtgaatattcagcaggacttgaggaagttgtgaggaatgcagaagtctttggccgtgcagactgtcctgggtgtcttaggacctctagtgttcctggtttccacccactcagtgccagtagcatcccccagtgattgtgacaactgaaacgttcacaaattcccaaaaccctccttagggatcctgggatgagggctatcagagccaatggttaagccctagcacatttctctgccactttctggaaatagtgttacaggatctttggggtgtcatttttctggttggaaagctgtggccagtggtgtctttgtccaacttttgtttgggcctgctgggcttgttcctcccacttggcctggcaggctgcacttagctcatggtaccggcctggatcccacacctccaagggagactgagtcaggcgtggactggcaagacgtgtgtgagtgagtgcggggttgggctactgcacagtcagacatgctggctgctgctgtggggctgtcagctctaggtgccagcatgggcactggctctctgtgaggctgcggctggaccaggtgcactgcagacagcttccccagctggcaccaaggaatgcaatggctcccagaagcttggagatgccaggaaccatggggccccaaagaaggagtcacagccctggcttggggagctcccaggtcagggctccttgaaggaccacagctgttctcccctcttcacctgcaatttgatgagtgaggagcatgtttcagccctgtgtgtgttacagctcttttagccttgccatttagtgggtcctgagttcttgtcttgtgaccaggaagactgaggtacgcagacaagtggagggtgagcaaggcaaagaggagctttattgagtaatagaacagctcagagaagacccacagtgggcagctcctctccatagccagggtgtcccgatgagtgttcagctcctagcagagagggtagctcctctctgcagctggtcatcccaacaagtgttcagctgtcagcagagagggtagctcctgtagtctgcagctgtcggcacagaggaggccctagagtgggtggcttctctctgtaggcagcttgtcccattgtctctgcagctcttagcagagagagtagctcctctctgcatctggtcatctcatcttctccccatcccctgccctgctctagctgagcccggggcttttatgggcctcagagtggaggaagtgtgtgccagttggtccatgggtggtcatgggcaggcccagaaaagtcaccataagcctgcagtgtggtctgtgggactggtggcctggctcccagccttcatgccctccctggcctgaaggtggggtctcaccagggacctacccccttccaccccggagcctgtctgcttcctgccatggtctgtggtacccaggctgctcatccatggggtacctgcaggccagcatcaagctgctctcagtgtccccctaggttccacatcccatgcttgtcagcacacagagtctggagggagctgaggtggcaggaccctcacatacctggctgggctgtgacagctccccggcttggccccaaccccattcggagatcatagcaggtgcctggagcggggagaggccagacagtggaggtaggcacctccgagcctgcaagggcaaggcgggggccttccagggcccccaagagtgcagagaggcccgggtccacagccccacctgggcggctgcagatgtgtctgggagggcagggctggtgcctgctcctggctcccggttccatgaagcgggaagtcccagctgtgcccccttgcagcctgggggctctaggtccttgctgggcctgggctggtgtccagggacatcactgtgagctcccccgtggcccccgcactcaggggcagcctagagctccccctcatcccgcttgcggcccttccccagggggtgcctccaggagcggatagcgggtcgggagtgtcaggcccggtggtcaccccatgcggggcggacccctggggacatggctgtgggtggccctgtgcagagtcctctctgggggcgcaagaacacggcacccttggtgcagtgggcgtggtgaccgcaccactggctgggtccctgtagtgggcactgctcccatttccccctcccgccctgggtcccccagtgctgcctcctcctggtgccctccccgcagcagttgtgggtgagagtggtggtgtggggctagggtccggagccactgatgttccaggcctgggagcgggtcctgcctggccacatgagggtgggggcagcacagtttgctgccttggggacacggggcacaggggacccacctttgccattgctgctcctgcagccgctcctgctgccgcctcccgccaccacccacgcctcccctgccgtggacagccccctgctgccatcaataggactgttaagaaccttctttgtgataggcagtgataggtgctgccaagtggaggatggtgccactggtttccttccccaagagagtgcagtcttttttgcaaaaaaacatgtgctgtgtcagggagggtgaggtaacttggccgctggtggaatccagaaaaaagtattctctcccaaattgtggcagcctcttggggtcctgtccgagaggacactgacctcaggaaacactgggtgggaattctagttcttcccccatgagaagtgagaccttgagcaaaaacatgacttgtctgagccttggtgtttttatctgtagaagtgaggatcatgagattacttacagagcagaataactgtgagaattaaatgagaaattttatgtgaatttcacagtatattatagtgagtgcataaaaggtttccttttactatttttttaaacaaaagtgagaaaacaagcaatcaaaatggggttagggttagtcatactaaactatatttgcttttattagaaacgtttaaaaaataaaattcccatagtttgcaatgtcaggttcccattccacatttgctcttttttccctgatgtggttattttcagaaataaaatataaaataaaagcattttgtactttattaaaagttgaaggttgaatgttttccgttggctgagctgccttcctgagcttaatgatctcaccttgatggggtggaaaaggagatgggagtagtgaaaggacttggagccaggagtctataaaaggttcacatttgataccacgagttaccccataatctcactgcgctccattattaaaacagaaacgctcttactacacattgttaccaacccagtagtcctggagtcatgagttatcttggtcactttaagtttgagcagaattgatctctgtgttgtagtagttgttactttgccgacctagaccatcagttatgtagtagcatatcaaagccattccccagaacgggtagaatacagactgagaagtaattattttcaaatgtgagagtgtgcttccaatcctccagagcagtgtactagtttcacattctgcaaatgtcccttcccccagaaaaatgctctggatgtatattcagaactatgaaggcaggagattatgaagtgcagagtgagcagagcacagagggcagtggctcccaccctgggcttctaaatcataggattcctgggccccatcccagatttacttaggatttcttagggtgggacttttgggggaggacaggttccccagctgattctgatggtcatatggatttgggaatcaccattatggactgaaaaattaaccctccgcatataagattctcctgcatctccagttgtccatttgatatctctaaatctctccctaaatctgaaagtcaccacaggtaaaacaacccatctgcacccctgacggtctccttcctctcaacctactcctacctctgttgtttgcttggctaacctccctgtaacccagactcaaaacaccagttgcctttgaacagttttctgctcccttttttccctcagaccagtcaccgtgtgttctgtctctttcatttttcttatctatccttgtccctttcctgtccatgtttttattaaccctcacttggtattttgcagtctcattggttttactggattcagtgttctccaccagttcatataactatgaaatttgttttcttagagcagccttctgatactgagttcagctcttcagccaagtgttctagctttgtgacacggtcaccccagttctctctcttctatgtatggcaagctttggccatagtgggctgttgagtgttctcttaccttaccctgctgatctttctccagggcccaccttgttgtttctgggtatggcagcctcttccacgtcctcacctgtggctctcccaccattccttataacccagctcaaatttcatgcacttagaaggcctcatggttcctcctttgcaacatgtgccctcgcctgcctcgcagtcttctgttgtatgttataatcagtcagttattggcttatcattatgatgggacagtaaattccttgagaatcaagacttgtcatcttgatatcctgacacttagtgaggaacctaaccattgtcgatgaagcaataacttgaaatctttagaagtgaaattacctggaacatacttcattgctgcaaagagtacgaattaaaacctcttaactactttttcctacttcagtaatgaatccccgtccatatcaaaatagcattttttccctttggctctcaaggggagagatggattagtgaccagcatatgatagtttcagacatcccagatgaggcagctggggagactaaaagaaggttgctgatactgtttttataggcagtgctaaattacctttggttttggaattaaggtgttgaataagaaagctaaaattattttttggccattgatgcatttcagctaaattggactttgtgtctgaggagacatttctgagcatttgggtaaaataaccggatttgtactccagctgtctccagagcaggagcctctgtgtgtgcttcttgatgctttgagtccccctcctcggtgggcatgttgcccccagtgatgcagcaggttgtcagcctgaattgagaaccagcctgcatgtgtatggaattgacttgtcagttattaacagacctgggttagtgtgctaatcattaccatcctaagctgaatgctctgcaaggaggctgaaggcttgactgttctcctttcctaggcaaattacttgtggatattgtttcctaggattttagaggcaagaattgaatagtgattctgaaacgagagtggtggtttgaatccacaatttcctgttctttagaaattttattgaagccctttttaaataacagtctccttgaataaaataatttcagtgtgaaaacctttcttcattttctcctaatgtggatgctatttttctattgtctgttgcagtaaaagaaaggcagacaaaagtcacagcctagggtttaagtctttactgttctactcgtttgatgtgtcatcttaagcaaagctttctcaaatttaaaccttaatgttcttttctggaaagtaggcagagtgatggtggcaccactctcataggataggatctcatggtggattaagtgaaatgaggcatagcaagcactgtatctctcaatgtaaattttttctaaatagaacactgtgaggaggcatttttgtgtttcttccattttgcattttgtctcagagctcactacttctctaaggagtagtttaggtctgcttggatgagagtcaagcttgtgacatgactgttggtgccataggtaaaccaaactgagagaaatatgaacatttgctggtgataaaagaaggaaacgtacttcccacaggtcttgtaggccactgtgacttcatcccagaccagtggggtagaagtgaagtagaatctgaagacaggtaggggccactccttggcctgagacaggaacgctttacctgcacaccagcctgagacatcttcctgcctcagtgcagaaaggaccagctgaagccaacttactcatccatttcttttgtgaactttgctgatgaatgaagaatatctctgtcattgtaaaattcatacaatatacacaatatagaggaaaataggaaatacgattgactaaagagcaagaatcatttaggatgttttaatgatctggtaaagtttttacatttattgtttttaaacatagagaatcactaatgtttaatagtagactttttatcgaaagtataaagcttatccacatgcataattataaatatgaaatatatgtacacgtatatatactatttgtgcaatgtggcaaatccaaatacagacttcttttaggcacccgttttaaactccaacagtgagagaattagtacataaccactcagtaatttcagttcttcaccttgattagtcagatcctcctaagcgaaactgtgtaggtggttgtgtggtttttagtacttgcttgacagaatggattttttttctctaaattaataaatatacctaaacaatggtcttcagtgtgtattagagcaaatgcttgaaggcagctggaagggacatcaaatacagagatgaagttcttttagcatgtttaatttattatggaaaggctagcgaacacattgtttctgcagaagtaactgtaggggcttgttatagattcctctttcatccaggttgattcagatattcaagtgtattaatggaaatctttaaatagtgccctttgccttattttgggaatcagctaagttgagtaggtagacttatgccagatttcattaattggtatttttgctaattttaagggatacttaaaaatatcccctgattacagtaacataaacatctgaagtgatttttgaattgctacacaaacagtattctattaacattgtacattaaaacattgcagcggtccgcataggctgtggaaatgagtagatttcattttcctacattccctttatgtttctgtttgtacacttggtttttacatggcaaatttcattggttcctagtgccagtttggcttcattagaaccacctggcaactctgttcactacagtttgggtgacttgaagcctagccaagtttgggactcattggtaagaacattgtatttaatataagaatttaataaatatatgttaacttattttttgagaattattactaaacgcgtggttctcagttttctcatttgtaaaatgggaataataacaatctgcagagttttgggggagataatgagttgattgaatgacagtggaaggaatgtgagcatattctagaaactcagggtgcagccccagccttactacatagacgaggctgatgtgttctgaatggggaccttattttaatcacaagctgatgaggcttcaggaaattgggttatggatttgttaggtttaacattatcttggccctagggtggcagtatttaggcattgattacatcttgggtggctcttttaactgctcatctgagacatgtgggtgaaggaacttgcacacagggtggaatgacacagggcagccttggtacacatctgggcagtttagctgtggaaaatgagtaaaatggctgtaactgtatttattgttgttggctccagacactcgttgaagatgtttaactcttccacattgttggatcctcagagttggtatctcaatgtgtaccaatttagaagtaattattttgattaaaatatttggttggtgtacaatacaaagaatacgtaatgtaaagtgcagtagttttgaggaagaaatggtggtgtacatgagagtcagaagtaccacattggatcagatgcatgccaatatgctgcagctggcggtgaccacaggcatgttttgtaggaggatgttgttgttgatatcaactttgaaaaaacttaagtttgttcagtaattgtatcccagctttcatttcttcctccctgattaggatgcatttggcatacttcactgcttagctaagtgctgaagatttttcagaactcaggaaaaaccgtggagtcaaatctaagtttaaagctggctttgccttgtcggcttgaccaatagcctatcctccctgggcctccaccatagaacgtgagccctgtgagtgcagggatcttgtctgttttgttgatcgcttcaattccagtgcctaaaacagtgtctggtacagatcaacacataaatgaatagcgactctagagtgtggcaagtattgtgaaaggaattagcttggtggcacactggagcaatgtcacagtcttatctgctgacagttgtgtgctgattacaatggttcccaatggtataaacacagaaaacaagagacttttatggtaatatgatagattttttgactgttaatgctgataatgagaattttgggcttgtattttatatgtttttaaagttacatttttaaaagaaaattttttattgaatttttacaaaagttttatgacagattgacaatgaaaaacaatgggtccttcatcacagatagtttgggaagcaccgtgctagagagtgacagggaatgatagctatgtaggtccgggcagcctctctgagctgagatttgaactgaaatctaaagtcatcagagaggacctttctaggcagaacaaatagaagtgcaaagacctcaaagtagcaaaaagcctagttagtgtgttcaagggatggaaagaggccaggagtataatgaggaagagaatcgttaagagaggtggggggaaggtaggcaagggccagatcttctaggggcttaattgacttggtcatgagttttagttttattcttagtgccagttgttgagtggaagtggtgtctcacgtgtggtttgagatcacttttgctgcatatggattttagggagccaatagtgaaagaaaatatacctattaagaggctattacagtagtcaggcgagagatgttggaggattggataaaagtgtgggcagagaaaatggagagaagttgaccgcctgtatgatacaggcatacctctgagatattgtagatttggttccagaccactgtgatcccaaagtgaatatgacaataaaatgagtcacatgaatatgtaagttatatataacttatgcatatacaagttatatataacttatgcatatataagttatgttgtgcatatatgttatgttgacactgtactgtagtctattaagtgtacagtagcattatatctaaaaaatgtacataactaaagtatatcttatgctaaagaatgccagtgatcatctgaaccttcagtgagttgtaatctatttgctagtagagggtattgcctcccttttagtggctgctgactgatcagggtggtggttgctgaaggttggggtggctgtggcaatttcttacaataagacaataataaagtttgccacattggttgactcctcctttcacaaaagatttctctgtgccattcagctgtttgctaacattttactcactgtagaacttctttaaaaaagggaatcaatcttctcaaaccctgctgctgctaaatttatcaactaagtttatgtaatactctttgttgctatttcaacaatgttcatagcatcttcaccaggagtagatttgatctcaacagactactttctttgcttatctataagaagcaactcctcagccattcaagttttatcatgatattgcagcaattcagtcctatcttcaggctgcacttctgtggttcttcctccatggcagtcttgaccctctcaaagtcatccatgaggattggaatcaacttcttccaaacttatgttaataagttccaaacttatgttaatgttgctattttgacccttttccatgaatcatgaatctagaatggtgaatccctatctagaagattttcattccattagatgaatcacttgctgtggcaggtatagcctaagaaaaatgcatttcttaaataataagactgaaagttgaaattactccttgatccatgggctgcagaatggatgttgtgttagcaggcatgaaaacaacatattaacctccttgtacatctccatcagagctcttgggtaactaggtacattgtcagtgaacagtaatgatttgcaaataatcttttgtctgggcgtggtggctcacacctgtaatcccagcactttgggaggctgaggcaggcagatcgtttgagcccaggagcttgagaccaacctggggaacatggcgaaaccctgtctctacaaaaaaatacaaaaattagcctggcatggtgatgcataccctatagtcccagttactcgggaagctgaggtgggaggatgacttgagcccgcgaggtagaggatgcagtgagtttagattgcaccactgtactctggcctgggcaacacagtgatactctgtctcaaagacaagtaaatcttttgagcaataggtctcaatagtgtgcttaaaatattcagtaaaccaatttgtaaacagatgtgctgtcatccaggctttgttgtttcatttatagcacagaaacataatagatttaacaaaattcttaagggccttataatttttggaattgcaaataaacactggctcacataagtcagctgattagtcccaaacaagagagtcagcctgtcagttgaagctgtgaagataggcattgacatctctgcagctatgaaagtcccagatgacgtcttcttccaatagaagactgttttgtctacattgagaatctgttgtttagtgtaaccaccctcactaattatgttggctagatattctggctgacttgtagcttctctatcagcacttgctgcttcagcttacactttcatgttatggagatagttttttcactttggccccatgaaccaacctgtgctagcttccagcttttcttctgcaatttcctcacctctctcaaccatcatataatagaattgaagagagttagagccttgctctggattaggctttggcttaaggcactgttgttactagtttgatcttccattcagatcactagaactttatccacatcagcagtaaggctgtttcactttcttatcatttgtatgtacactggagtagtacttttaattttctccaagaacttttcatgtgcattcacagctaagctaactgtttggtgcaagaggctacctttcagccggtcttgactttggacatgtctttctccctaagcttaatcatttctagctttttatttaaagtgagagatgtgtgactgttcctttcacttgaacacatggaggtcattgctgggttattagttggtctaatttcaatgttgtttttctaaggaagggggaggcctgaggagagggaagagggaggagagtcagttggtggagcagtcagaacacacatgacattttccgattacatttaccattttgtatgggcttggtttgtggtcctggttcccctaaacaattacagtggtaacaaagatgactgatcacagaccaccacaactgacataataataatgaaaaagtttgaaatactgtgagaattatcaaagtgtaaaatagtgacatggagcaagcacatgctattggaaaaatgtatgacacaggattgccacaagccttcagtttattaaaaaaaagcagtgtctgggaattgcaataaaacgtagcacagcaaaacaagatatggctgtaatttgaaatagaattggtaggatttgccgatggattggattttgtgagtaaagggaggagttaagaatgaatcctaagtgttttgatcatttgggtgaatacagatgccatctgtcgagcagagacactttttgaggagagaggtaggtgggaattaggaattgagaggtattagttatattccttgctgctgtgtacctttttaatgaattctgttaaacatggaatttcatcgatctgtctttttttttttttttttttttgagatggagtctcgctctgtcacccaggatggagtgcagtggtgtgatctcggctcactgcaagctccaccacccgggttcatgccattctcctgcctcagccagcctgagtagctgggactacaggcacccaggtgtagtcactacgtctggctaattttttgtatttttagtagagactgggcttcactgttttagccaggatggtctcgatctcctgacctcatgatctgcccgcctcagcctcccaaagtgctgggattacaggcttgatccaccgcacctggccttcatccatctgtcttatgtacttttgttacaaatgacttggagaggaaatacctaatgaagtaggcttcttggacctctggctggttctaacagtttaaaaacattggagaaagaaatcttgtttatcaaatattttggaaattctttgtaaaattctttggaattaatgggaggatttgttcacattagctattatttgttccaaggtgacatcttgctctgtatttatttatttatttatatataatttatgtctcaactaattccacagaggaacaagttactcaagtagtcaagtatagatagatattgtgggctactatatagctttatcacaattcttcttaagtcagtgagaggaaaaagggaaaaattcaatttttcatattctaagtcttgaactttattttccaatttttatgtttgctaaccatttttttcttagtacattcaaaagatgaaaagatcaaaatttattgtcaaacttggaattaccacactggacctagcccctggtcaggacagctgagaaagcagattagttctggtatatacctttctctgtagcattagtcttttcaaaaagatctaggtgctttatgtttggtttgtgctctgtaagttgagatcttgacatccttcatcttttatttccctgagagaggtactttgatattttgaaatatgcctttgacattgcacaacctctggtgtctatgcctatggtggtagccagccagttgctagtcctctggctttgttttcctcctgcattcctgagcagtcttgaagtacccatttggtttcatttagaccacagatccagaggaactgcttggtcagtccacctgcagttaacctgttctttgtaatgggcactggtaggaaattgtggtgttacaatgcatctttctcatctttaaatgtgatcagatagatgggtgtatcaccttaagtttcatttctatttctaaacgatgggtgttttgagatagatgagtgtttcaggatatttgtatgatcttatggactcacattggtataagaaacttcagggcttcttctaaatgtctgatagatgggtagatagatagatgggtttatcaccttaagtttcatttctatttctaaatgatgattttactgattttacatactttggcagtatcttaatctgtttgtgctactgtaacaaaatactacagagtaatttataaataatagaaatttatttctcaaattctggaggctgagaagtctgatcaaggcactacaggattggtgtctggtgagggctgctctctacttccaagatggtgcctagtcatggcatcctctggaggatgttctcacgtgggagaacaaaagaatgagaatgactctctctgaagcctcttttataagggcataatttatttgtgaggacagaacactcatgtcttaattacttccccaaaggtgtttcctcttaatactaccacagtgggcattaagttttaacacatgatttggggcaatattcaggctatagcaggcagtaattataatttcaaaatggagaaccctaaaatattttttttttggcataacctttttgtcttctctgtggaccttgatactgttacttcttgaaatcaagttttaagatattttgaaatgttttattagagagccaacaacctcttgtttctctaaaggagttatcttagatttaagttggattgttctgtaatatttgtactataacgttttactgtgtttacgatgctcatgtgcatgtactatggtggtttgcatttatttctcatcccgtggatttcataatagtattcttgaggacaggcagcattcttattcgctgtttatgccacatgaagaatgaaattgtcttttgcacaaagttattcaatggaagaatattgagagatttcaaattattctgttctgataatgacatctccatttgtctatacttgtttgtggtatacaccattttttaacaaagaatatttccaaggatgttttggcatcagaatatcattgttagtctggaaagtcagggcctgtggatgttcaaagacattgaaaaaggggaattaaatatgaaaattcttttaaatcctgacttaatgccagctatgtttcttgatttaaacttttattttagattcatggagtacatacacaggtgtgttacaaaggtacattgtgtgatgcttaggtgtggagcgtgaatgaatctgtcactcaggtagtgagcatagtgcctgatatggtttggatttgtgtccctgcctaaatcttatgttggattggaacccctggtgttggaggtagagcctactgggaggtgattggatcatgggggtggatctttcatgaatggctttcatgaatggcaccacctaccggtggtgttctcttcaaacagtgcccacgagatctggttgtttaaagcatgtggcacctcttccctttctcctcttcctcctgctttggccatgtcagacatgcctccttccccttcacctccttccaccatgattgtaagcttcctgaggcctccccagaagccaagcagatgccagcatcatgcttcctgtatagcctgtggaaccgtgagccaattaaacatcttttctttataagttacctagcctcaggtatttctttatagcagtgcaagaatggactaatacagtacacaataagtagttttccagctgttgctctccttcttccctcccgccagtagtccccagtgtctattgttcccatctttaggtccatgaatacccaatgtttatctcccacttatatgtgaaaatatgtgggatttggttttctgtttctgctttagtttgcttaggataatggccttcagctgcatccatgttgctgcaaaggacacaattttgttcttttttatggctgaatagtattccatggtgtatagataccacgttttctttatctagtccactgttgatgagcacctgcgttgattctatgtctttactattgtgaataatgctgcggtgaatattcaagtatgcatgtctttttggtaggatgatttattttcttttgggactgtcttgttccagttctgaaggggaatgcttccagcttttgcctgttgagtatgatgtgggctgtcatctgatcatacatggttcttattatttttaggcacgttcctttgatgcctagtgttttgagggtttttatcacgaaaggatgttggattttatcgaaaactttttctgtgtctattgagatgatcatgtggtttttgtttttaattctctttatgtggtgaatcatatatattgatttgtgtatgttgaaccaatctggcatttcagaaataaagcctacttgatcgtggtgaataaactttttgatgtgctgctagattcagtttgccagtattttgttgaggattttatgtctgtttatcagggatattggcctgaagttttattttttcgttgtttttctgccaaattttgatatcaggatgacggccagctatgtttttattcatctgattgtctagttgtttttgtcttcatagttactaccccaaacccagtctactttcctgatctctccagattatacgtactgcagacccatctgctttaacaaaatctttttcccacttcattgagattaagtctgcccttaggtgaagtaccttcatcccttcataatctctctgtggtttaatggtccccttcttcttagtctctgaacaggaaaacatgcctcctgcttaccaaggctggcgttccaactgcgttcttggtaccaaagacttttcttactggatccagctccatttatttcctgccctttcctgtttctctcttccccatctgcctacaaattttctgagaccatccctttcctaaaagagctctcttcctttgtcactgctgcctgcttaggttgctttcctaacctgcttgccttgatggccacatcttttcgaggtgtcccctcagtgccaggccttttacctgacccttctccctccttggccctgcactataacctgtgtgcaggactgccctagcactgaaaggtgtcttctgcagggaaggaagcaattacttctgggccaattcccactttactccccaggattgtctggggagagtttctgagagggagtgtgagatgaaggatctctccatatggctattctttcccacctttcttgcttccttgcactcttcacatgccctcccctcctaccccaaccagcagatcaggttgtctctacaccttgcctaagttaagccagtaggtggtttctatgagctttgctctgcttccttcctggtttattcccacccaaccccgaatttcctccaagttaagttggtttaccagacactgggttaggaacttcatgctttaatctttgctcgacttcatgaaacactgctcacttcacaaacatgtgaaacaacttagctgaagtaatgcagctgggaagaaccaaatttctgacatcaaagtctgtttttaaccattgctgcattgtcttaagtgcttggaattctttccacagtgagataaaatattaagaaaaaaaaattttttttaagaaaaatgggtttttctaaaccatttgtttagaaaattgctaatatataattaataaatatagtgaatcagaatctgtcctgttttggtactatttgtcaatcagcaaaagtaactgatgtggggaggcagtcatccctggttgtagaaggggggctggacaccagaattacatgttgtcagtgtgcatttagctgtagtcacatctgctgtcttcagcctcttgacagtaaagcatctgtgctctgaggcacttttgtgtgatccagttttgtacacaggcagtttgttgggagcgttaccattgcctctggttcctcatgtgtaaaatggtgagaaaatagtattaccttataaaatggggctaatcatagtgccacaagcctgatagggctgtttatgtgggttcatgaacttacgtgggttcatgcataaggtgcttacaacatgttttaagggctatataaatgttagctataaaaataataattactcttattgttaatagaaattgttattggatattttatttatggtaacatgagaggggcagtgtatctgcctttgtacgtgtattaaaaccaaagcatgctcatttctcaggagctctgttctgtgaggcttgggtaatgacagtgtgagcatgactggaaagttaaattggagaggggcaattcattgagtgaaatgatacaacctctgcttcttggttcttcccaagctgaggtatagtaatgctgctctcttttttctgtcgacacaactccctcaggaatatctgcagagtagtgggtctgatgtctcttttgcttaacagtttttacatagtaacttttctacctcaagtccgaggtggcatatgtcttcttggaaaagaatttcctctttgagctcaacagtgacaggaaccatatttttgttattctttagactgcttaaattgctgagacttttaaaggttaataatatttttatccaccttcaatttttcaatttactgttgttatattgcataacatgtgctgttctctttttgagttaatatattgtaagttaacttacattaataaataaaacatctcctttttcaagaagcaaaaatgtgattatttcatagatccccaaatcatccaaccataagacttctcaagagatctttaaaattattactttgcactgtgtttcaaatagctaccctcaccccccttccccttcagatgatgagatagttcctctggtgtggtctgtgtggcctgcctagagagccctgatgccccacagtggctgtagacctggccccaagtcctgaaggcttctgccttcccaggtgcatgtcttatcctgtttcctatatttcatatttgtggttgagcctttagaaactaggcaccattcggccaggcatggtggatcatgcctataatgctagcactttgggaggccaagatgggcagatcacttgaggtcaggagttcgagatcagcctggccaacatggtgcaatcccgtctctactaaaaatacaaaaagttagcctggcatggtggcacgtgcctgcagtcctagctactcgggatcctgaggcaggagaatcacttgaacccaggaggtggaggttgtagtgagccgagatcgcaccaccacactccagcccaggtgacagagcaagactccgtctcaatttaaaaaacaaaacaaaacaaaacaaaacaaaaaaaactaggcaccattaaattctattcctgtttgtggctattctttgattgtctcaacaatacttaagatgaaaaaataaagttttaaaaaatttagcatggtctttatccttgatttagatactctgcaagcatagtttaaaaaagatgaaattcacccattaaaaaagatgaaatgggtgaatttaagcatggagttctaaacttttctatgcgagacctgaagatatcttagcaggaaagaatggtattcaaacattctcttatcctttttaaaaagtacttttgtaagcattttatcatccatcccctcagccttttgaagtagattgtgtatttgattatattttttgaaattcaggaactctgagcctccagcatctaagcacagaaccttgcacacagaagatgcttaatacatatttattgaatgagtgagaccgcccaaggtcacatgattagttactgttcgtagcctgtaattcatctatatcttggtcctcagtctcatggttttactcaataattataatgtattgggatcgagggttggaatcctcacttggacctttctagttatatggcctttggacccattctggacctcagtttgcttctaagtaaattggcgatgctaacctgccctttctgttccttaggatgagaagaaatgttactcagatgcttgaggaatggtagatattcctaaaaccaatcttatgaaatgctagcgtaagactcagtgggtgtggaaaccatctattttataatctctgaatatgggcttattgcacttataaaagctaccactgcagtaattcagaagcctgggtattttccttgactcttgattatcagaactacaagcaaccacagcctttataagcaatcagggaattattttttcctgtatcattgatgtagaatagaacttcctgttttcactacttctctgtataacttcaatttatgcccactcagaattaattatacaaagaaaaatggatacatattaaactgtcttctgtgcccccagtctctacttttgaacccttctaaatccgtgactttctctgccttgctgccctccttccctccatgccctgtaaaaacatggaagcatctggtattagttaaagttatcaaatcatcggctgggtgcaggtggcctaaaactggttcattctgaagtatgttgtcttaaactatggatttgtactttaactcctttaatttcttactgtagatgaaaacatttctaccctcctgctctttttggataaactaggtatcagcaagtaggcaggaagatttttctatttttaataatgaaaggcttaagactcaattttcttcagactgtatctgattatatttcctaagtgttgataagcagtagtatgttgtttttaaaataacctagaagtgcagatttcttttttaatccattaattagactagtatttaaaaatttctaatatttgtgtcattttaaaattagtaattttatttctttggaaactgagaacacggcattgtgtacagtttatgtttgtttggaactttttgaaattttcaaattttctttgtggcctaatatgttaatattagtttttacaaatgtttcatgaatgctgtagaaggaagatatatttttaaaatgtcagtacaaagcctgatatccactaatgttatcaattgtataattccagtcctccatgctttgttaagtttttcctacacagtaggtcagactgaggtgtgtgctcttctaatgtgagtaggttttggggcaccagttttccatgcaattctaatactttttgcattttgtcatatcaattctgttttttttttggagatggagcctcactgtgtcgcccaggctggagtgcagtggcgcgatctcggctcactgcaacctccgcctcccgggttcaagcaattctctgcctcagtctcccgagtagctgggattataggtgcccaccaccatgcctggctaattttttggtatttttagtagagatggggtttcactatcttggcaaggctggttttgaactcctgacctcgtgatccacctgcctcggcctcccaaagtgctgggattgcaggcgtgagccactgcgcccggccatatcaattctttttaatctttcagtgtaatggtagttcaaacagaaattcatgctttttgtgtcttaattattgttccacttaatacttttgccttgaattctattttgtcttgtgttcatattgtcactctctccttttatttttatcttcttgagatacaacatatctggttgttttgagaggtagtatctcattttttctcctcaatctgagagactttgtctttaatattggggaggtcaattcatttatgatgatcatcataaaagataagttcagttctacttgtgccttcttattttttgttttaaatgtattcttgcttttcgtgggggttgggaggtctgctttttgttacacatgctgtctttgatgtcttccgtagtgtttggaaggtatctttttttaattctacagtctgggaaagcctctcagattagccggccacgtgagttgtttctctgccatttattgcgtcagtttagcccctcactgctctctgtatgcatttaagttctgttgacattttagtttccttccttattttgttcatctccttacattatcctattatctttttaccttaacttctttctttcattgtggctctttgcacctttttcatggaagtctttgtgcattttaatgtggatattgaagactttcctgatgctttcttctggcttctgtggtaaatagtttcacactatgtatttctgagtccttaggatgatgatctcattttttgttccctgtgctatccacccacctgcagcaagcacaattttgttagttttattttctctttattaaatcctaatatatttactgactgcttcctagagatacataggtaaattagacagactttattctgtgtttgttttctggattttaatttttctccactcagttaattgcatctaatcatcaacacatctgccatttatttatttatttttgccatttgcttgtctgttcgggtagttgatcttggacttcctaggctccaaatctgtgagaaagaagagaactaggcacctagtttatggtattttgttatagcagaccgaatgggccaagaaaatgttaaacaaattacttacattctgtctctgtcctgtcttccttttttgttgttattcttttaatcttttgaatatgtgtacagactcatcactccattttattaagctcctcagaccactgaaagttgtgtgacaatgccataagctttactcttaagattaagaagcacagactcctgaattcaagttcatgagttcctgaattcatttaccaatgtgtatttgcaatttttggtactatgatttggattgacagatatttaaaggtagtaatttttttcagtctgatacatacttgtttttagagtattttttttttcttttggagacggagtctcactcttttgcccaggctggagtgcagtggtgcaatctcggctcaccacaagctctgcctcctgggttcatgccattctcctgcctcagcctcccgagtagctgggactacaggcgcccgccactgcacctggctaattttttgtatttttagtagagatggggtttcaccgtgttagtcaggatggtctcgatctcctgacctcgtgatccacccgcctcggcctcccaaagtgctgggattacaggcgtgaaccaccgcgcctggcctgtttttagagttttaacttctaaaaaaggtaaccaaatgggttagtctgtaatgtaattatgccttttttttttttatttttttttaaggcagggtcacactctgtcacccaggctggaatgcagtggtgcagtcatagcccactgcaaccttgaactcctgggctcaagtgatcctcccacgtcagcctcctgagtagctaggactataggtgtgcaccactatgcccatctaatttttatttttttctgtagaggtagggtcttgctgtgttgctcaggctggtctcgaactcctggcctcaagatatcctcctgtcttggccttccaaaatgtttagattataggtatgagctagtacacctggcctaattgtgcttctatttagtttagaacatatggtaacaaggataatggatttaaaccaatctgtaagtaataacattctcttaaaattgcatggagaaagtcgaatcctgttttctttctttctctctttttttttttttgagatgtagtttcgttgttgttgcccaggctggagtgcaatggcacgatcttggctcaccacaacctccacctcccgggttcaagcgattctcctgcctcaggctcccgagtagctgggattacaggcatctgccaccacgcctggctgattttgtatttttaatagagatggggtttctttatgttggtcaggctggtcgtgaactcccgacctcaggtgatcggcccaccttggcctcccaaagtgctgggattacaggcgtgagccaccgcgcccagccagtcctcttttctaatataccaccagatagcaccttctgaatcagcccagcacccttaaagcagtaattgatagtcagggcttgccagctgaacacgtaactgagttctctctggatctgtgttttgaatcagtatttgaggatggtgttctgctgtaggagttgtgtaagttaaaagtctcagatcctggcaaatattttatgaaatcaaagggaaaaataagttattcttctgatggcctctgttttcccagaaaacttaaaattatattgcctttttttttgtttttttttttttttgctgcctggtggctttaaactattcttgctctgttgcccaggctggagtgcagtgatgtgatctcagctcactgcaacctctgcatccttggttcaatcgattctccagctccagcctcctgagtagctgggattacaggtgcttgccaccacacccagctaatttttgtgttctgagtagagacgagggtcttaccatgttggccaagctggtctcgaactcctggcctcaggtgttcctcccaccttggcctcccaaagtgctgggattacaggcgtgagccaccatactgttatatgtagtgttgttgaaggaactctttcttatgaagatttttcaactggttttaatatcaaatggacttttaagtatttttgtaataacgatattaataacttctgtttcattattaggtttttcaaagtgccttccagttcttaatttgtccctgactcatgttgggtgaatttaacaccttctgatgtttaaggttatcctagatactaagaatgtgggagaattttagttttttttccctctggaaagatgactgtggagtctaaaataaagtctacaaattctctctgaatcctagtatctttattcaagtgttctttctacctatgactttaaactttcagtatttacatgatacggtcttggttatataatcatatcttgtcagtgtaatatatccagatagaattttaaataccagtggagttttttgttctttgttggctgtaaggacttagaaatacatcaaaattgagagcagacttttttattctaaatattcagaagtggagttccttttaataattttgaccttgcttacaatacttgtattaaatttatgtttagaaacagagtccttatttggcatctactttgccccattttaagagtttcttttaaaagaagcagttgatgtgttctgactggtatttgaagaatttaactgattcatttaacttcagaaagtacagcaaagaaaagaaaaagcatagtagaaatctaaatttgtggtttatgaaatggaagcatagttagggtcttttctacagtgtatcctctctcaatgtataaatacactgtcttagttatttaatattgatttgtggtgatgtaggctaaaggctgccatctgacattcatatcatgtaagattttcttgcctcacattctgaggcccacattttgtttgtagggaagtgaccttttgctttgctccttgtttcttctactcatggatctcaggccttaaagtggtgcgcatgaagctgtccggtatcaaggtagttttggttttggatgctgttgttggtaaagaacaagcttcacgctcacccttccctgcagtttgcagaccctcagagagctaaggagggaaatggaaagaattggagcatgactgttgctaacacatctttccttctgaggaaggaagggaaagagcaggcaaatgtagaaacaataaagatggaaggggcacccttagagaagtttgtacctcctcagtgtaggggcatgaaatgacacccacaaagaagagccatggtattgtcttgctttctgcctcagtattggctaactttcactttaaaggaatttttaaaattggtaggacataataaatgcttcaatgaaggcaccttagtcatccagccatttgttcgcttatttaagcagtacttattgactgcctgctgtgtgaatccggttgtttcactaggcattgaaggtacaagaggaatgttgttcccatggaattaataccagtatatatatacgatttagtggagtgggatgttgccgaaatggaagtctgtgtaacttgtgatgggagcaaggaggtaagagcagccagaggaattatcagaggaggattggcttgggctgggtttttttcaggcaggctagctgggggcaggcattttaggaagaagctgcatgtaaagacaggaaagggcatattacgtgtgagggtgggggaagatgcatggcaagagattaggtggaatcataagggcatcgtatgtcttctggtagaattaaggtttatgggggacctgtaaagttgaagaggttttgactctgatgagatttgaattttgaaagatcattctgctagcttttagatcattctggtagatgatgttctggtagacaatgaattggagagggaaatgaaactgcaggtgtgatgaccagtaaggaaactagtatactagttgagattagggatgatgaggagctagatgaggcagtatagataaaacaaagaaaatgggtgtggtaagtatcaagaagacagaatagatagaatgtattgactaattggtgggtatagaggagacatctaggatgactttcccattttgccttaagtgactgggtgagtattagcacccatatcttcctggttaaccaagtgaaatgctacgaaaagtttaaggaagacaaggtctgaaaaaatgtccactgaattaggtatctaggaagtcattggtgaatttactgaaatgggaaagtgtaatgattcagtcacagtttaaaattgcttgggagaaacagtggccttgaaggtgtcataggtttgctgggcagttctgactatgcaattgcaattgaatcatctatttgtagaggcaacggtcttccctgggattttccttggcctatttcagctgcctgggattaggaacagagaatgtaaacaagatcttggctgatgaggaaggagtgggatggcagagttggggttttgctcactaggtgtgacaggctggcaaggtgtcagactcttggaggaactgggagaacaattagcattggccacattttttgcaggtgaagaaactgaggcctgctgatgagtgatttatcacagcagaaggagcatgcttttggagtaagatagcgcctgacttgatacttattaactctgtgacctgggaacattattttaaaatctttcttcacataaatcttcttactctgccattccagatgaagaatctaagagcagctatttgtgggtgattgtgaggagtagtatgaataaggttctagggttcagagtcagatccgaatttgaatttcagatgtccttgtgtaatttacttgaactctgagcttgtttcttcatctgtacaatgaaaatattcttacatgctgttttgaagcctaaaactacaagagataattgtaatattttcttagtatagggactggcaaagagtaacagcacagaaactgacagccatttattatgttgttatttttactgggaatctttgggaacagttgggcttttctttccctcagaatttgtgtcagttactttatggagtttcagtaagataaactgaagatattcagtataggagtgaattttcccaaatttgttctgcctgatactccatatgttttttctgcatggggaccgtcttcagttctggctagtgttctgcgagtgttaacgtgaatgctcacgttctctgttttcttgcttcttttttgtttttcctgttgaatgctttgcttgttgggtcgcccagtctgtcatccatttagtctgtttccatacttgtctttcatatttactggctttttatctctgagtaacttcagatgatttcttctaatatttgccttgattcttttttttatctttatttttttacctttgtcaagtctactgttcaacccatccttgagttcattttaataactatgtattttcctacgtggaatgtctgtgtttctttttcagaactgcccatttttatttcaaagtgttctcttgttgcattatgaatttgattccttcctttatgtctcaactctatatattttaaagtcctgtggagaatattctgttgtctaatatatgctatatgagctgacattattttatttagcttttaacatgagttgtcttccacaggatgcagattatgagataaacatactatgctatgtgatggttattttgtgtgccaactgacatttggtcagacattctgggtgtatctgtgagggtgtttttggatgaggctaacatttgtgttggtaaacttgagtataacagatggccctccctaatgtgggtgggccccatccaatgagttgaaaggctgaatggaacaaaaaggctgactctcccatgagtaagagggaatttctcctgcctgatatccatgagctgggacatgggtcttctcctccctttggactcaaagtgaaataccagctgttctcaggtctcaaagctgctggctttcagacaggaactataccaaggctctcctggctcttcagcgtgtggactgcagatcttgggattgccagtttctctctcatactgtttctatgtctctccacacactttattggtcctatttctggagaatcctgactagtacagattttggtactgggagtggttctagaggagcagagtttccaggatgggttttctgaatgtgattctggggtttctagaagtggctctctaatctgataagactaaaatatgctgataactctttccagtagtaaggagagcactgataggccatggcatgatctggcaatagagatatacaagatatcaccattggatactcctaaccaaccacttaaagcaatcaaggatctgggtactgtgtatatgatatttttgaacatttttggtaaactaacaaatacggtgagattggctggttgtcactggacaaagtggggaaagaaaaggatgagctcaagcattttattttccagctcaaacaccacataaatgccctgaaggcttgtatgtgtgccctgaaggagaaccttaagttgtattagttgcagggctgaaatggctaaaaaacccagaatcttatcctgtgactggctgtattatgatgcaaattgaactcccagtctcatagggtgaatactgttaaaggcattgattgggaaggaagggggtgccgaaagttgggatggggatgtgtgggaagatcctgatgaagctggggatatcgaaccctaaattctgatgagtcctctttgccagtggatgtggcctctccacccccaatgggagtagcctctccacccctgtttgagggcattaaccctgcattgtctaaggaaactgtagtggcttccttgaggcagttgctttgtaagataatgctgagtctactcaggacccacctttaccacggctctgtttttagaccagtaactccagcaggctcctaaaggtgaaggttcaagacatgacccctgagaaggtacactacactccaaaataactacttgagttttctaacctatacagacagaaacctggggaacaaatgtgggcatgtatattaagactgtggaataatggtggaagaaacgtgaagttgtatcgggctgaatttgttgacatatactcactaagcaaagattctgcatttaatgttgcagtttagtgagtcagaaagtgctctaatagtacgttgggttggctgaaccatggaccaaaaggtggcctacggtgattgaattagaaatgctagacttggctcattttaatgtagagaaaaggattcaaaggcttattaggaagaatgaaatgttagagtagatttgtcgttaaagacctacttgcccaccacgggagggtccagaagacatggctttcacaatggtgagaaatgcatttgtgacgggagccccagcatcctggaagagctctgtggttgctttcgtctgttaggccttacagtgggagctgtagtcactgaattgggaaacctaatgcagcaggagcaattggatcccaggggccaagtggcagcgctcagcctgtggtgttggctagttcatcctgtgtgtctaatgtgggtaggtatcaccaggtatttgaagtcctgaatagaacaaaggttgaccctcttaacaagtaagaactcttcctgcctgactgtcttgagctgggacatggtcttttcctccctttggactcaaattaaaatgttatctccttttggttcttgaacctgtcagctttcatgctggaacttacaccattggctctcctgggtctacagcttattgactgcagatcttgggacttctcagcctctataatcacacgagccagtttgttgtagtaaatctctctctctctctcacacacacacacacacatagacacacacatgttgttggtccagttttcctggagaaccctgactaacacagctatttagtgtttgcctctcctggaccctgtggacctgctcaagaatcccacatgatgtgagtgggcttggaaatctgacttttccttggtgattctctttccacctgagaatcaaggcagatgacaggatttctgacacttcccttgcttgtaggcaatttttatagtccctgttcactgttaggacagtttattattgtcacctgggcctattattcagcattataaaagtagcctcctaggcacatgtcatcggtcgtgattgaatatatcaagaacttgtccagactttccttacgacagtttacatcagctacactacagtgtgcaaggatcaatgagaaaatgagagagctgtctagatcagtgggctgttgctcctctaattttttattttttgatgtagtcccagagccgatagagtgagtgagagggatggccacaaggaacaaaggatggcaggaatgaactgaaattgcagtggccccagagcttggagagcaggagggaactcggtttcctgtggaagcagtgtgggtgggaagtatgcatcactgctgctgtctcctctcaacccagggccacttcttagacgttacttatctcatgggtctcactcaaatctggtaatgtagggaagcaccaggaaagttttgtgtgtgtgtgtgtgtgtgtgtgtgtgtgtgtgtgtgtgtgtgtgtgtgttggaatgttatgaaaacctgatatttttattctattatttgaaccaggaataattttgctagcaataagtaagactgttttaagtatgaagtttaaaattctaaccctgaatacatgagactagaaaaaacaataaggtctactccttttttctgcttccttttagcagacaagtactttcaagccccagaggtataaggaaaaaattatgggaaagaactttggaaacagatgtctattatttgatttgagccacagaaagccacagtcttaattagtggaaccctggtgttccatgggaggagattttgagaaccaccaaacttgtctagtcagttccttgtcaccattgcaaaaactggcctccctacgctgtggcttactcacaattcccaggtcatgtagcttggggcagaagcatgattagaacctaggcacccacaggtattctttctgctccttggaaaatggacttcctttatttttaaaataggcattggaatgtatatcttggtgtggctctggggccagtttagtctcaagagatttttgtctatgaatgcagtgaccttatcaagcatagacaatttcctgtgtcattaagatgttccttggcagaatattatttttcttggtgaatatattgtggtataaaacatgcatagagaaccagctctgtttttttctgagtgaattagctgtattgtagcttatctgtggcaagatcttgcttttgagtttattgacagtgactcctgtcattagtgacttgcttgaatgaggtcttggctttctctccttttattttgactttttagcagtctgagtcacagccaggaagtcctttgaaaccaaacccttagcccttttttgtgtttcagggacagtttgggaaatgtcccttaaaggggtcctttggtttctctgttgggtcccttatctttttcaccagccccacgtaggtccttgttctgtcctagactgattggtttgaaggtcacagtggggaattgggggttcccccaccacctctgggtcagcactttatagcacagttttattaagatgtggaaaatgaattttcaaatcctcaagtacacccaaattgaaacagaaaacctccaagaaacactgtgaagcttcctgagggaagctgtcaatcctctgataattcctaaatcttgtcccagtactcataagatgtcagatggtagatacagtaggtgcactgaaagcacctgtggtcagtcgtgtcatttgttactatttaacagcttgtttcagtcagtgagcaaaactaacatatacacagaactaaagattttatactttaaaattatcttagcatataggccgggtgtggtggctcacgcttgtaatcccagcactttgggaggccgaggcaggcggatcacaaggtcaggagatcgagaccatcctggtgaacatggtgaaatcccgtctctactaaaaatacaaaaaattagctgggcgtgatggtgtgcccgtagtcccagctacttgggaggctgaggcatgagaattgcttgaacctgggaggcagaggttgcagtgagccgagatcacaccattgcactccagctagggcaacagagagagactccgtctcaaaaaaaaaaagttaacatataatccttttgacaaagtttattaaaaataattctttcaaagagcttcagggtatggtcattgattattcagcttgaaagaataaagaaaatatatttagagaagtggtatttattggaatatttgcagtctgtgctcattcagtaaattgagtttgaacaacaatacatcagagtctttggtcaggtgtggtcgtggctcatgcctgtaatccagcactttgggaggccgaggtgggtggatagcttaggctcaggagttggagaccagcctaggcaacatggtgaaattccatctctacaaaaaattagccaggtgtggtggtgtgcacctctagttccagctacccaggaggctgaggtagctggaactacctggtggttgaggctgtagcgagccatgatggcaccactacactgcagcctgggcaacacctgtctcaaaatcttcatagacttatataacaaccatgacaattgaatgacatttttctacaacttgaaaatttgtctttaaaaagaatctattttaaaaaagagttaataaagttggagtttggtgtcagacctaggttgattcctagttctttctagctgaaaagtgttccacctataaaatgggatcatagtagtgcttatccattatatcttagtgaagattaaatgttagaagctgtgttacatatttagtgcaaggcctggacactctctgttaatgtcagccactgtcactcttctgatgagaaattgttatccgaacttcactcttctcagagttcagatatgatattttggctgaacttgcaatttagaaagataaaaactatcgcatgtagtaaaaatctgttggaaaatatagtactacttttctttaatgggggagaagtttatgtttttctttgaaatatgttaatatttaggcttaaattgttcatagttgctttctattaactctaaaagattgaatgattttttcagcccaagattttttgtaggtttcgttgttaatttatgctcctgtgcatggtgctatataatatgactataaaattgcatattttatatattacagttgacccttaacacgggtttgaactttttttcaataaatatattggaagatgttttggagatttgtgacaatttgaaaaaacacatagatgaactgtgtagcctagaaatattgaaaaaattggccgggtgctgtggctcacacctgtagtcccagcactttgggaggccaaggcaggcagatcacctgaggtcaggttcgaaaccagcttggccaacatggtgaaaccccatctctagtaaaaataccaaaattagttgggcgtggtggcatacgtctgcaatcccagttacttgggaggctgaggcaggagcattgcttgagcctgggagatggaggttacagtgagccgagatcatgccactgcactccagcctggccggcagagcaagactctgtctcaaaaaaaaaaaaaaaaaaaaaagaaaaaaagaaatattgaaaaaattaagaaaaaggtatgccatgaatgcataaaatgtatgtagatattagtctgttttgtcatttactctcataaaatatacacaaatctatcataaaacgttaaaattggctggatgtggtggctcatgcctataatcccagcactttgggaggctgaggtgggcggatcatgtgagcccaagagtaggcaattagcagttaaatttttgggatcagaagttatctgaggatttctgactgcacaggaggtcggtacccctctgtctcctccccctcacattgttcaagggtcaactatacgtagaaggaatttttaaaaataacttttttggcctaaatttaatatgtatccccaaagttggacttagtttaacttaacatgtgatagaaacactggaagtgttgactttcatgaagtgtcgcaattctaaaaaattgaggaaaaattcagtacatattcagtacctgtgtttatccagagcacataattacttatcttccttctaaaccccaacctaatgttcagtgatttcttttcttgtgagagttaagcttgatgctttttgatgtaagtaggtatacttgtcaaaaacagctaagaacttggctcacctcaccgcctctggcagcgtaaggaattaaccaccgtggacactgtggggaggaagcatcattgatgccggttggcaaaggaaaggccatagtcagcgcatccatgttgccactgctttgagtgagcgctagggggcggtaagaagcgattcgctaagtccccatcctaactttccccactttcttgccccaatactgaagggaagtcagaccaaatatcttgataaacaaaaagtggccagcagatagccaaagaggtttttactaaggagtgagcagttttgatttgtgattcttactgaggttggaagttcctattttgatgtcttctgaaacattatcacttccatttaactgatggggaatgccattttattttagcatctagattatttatttgaggttgattggaaattttgctttacaattctttttcatttttcagaaaaaccagttgtcacatatttatgctttacttttgtgttgtatttttaccaaactgtaggaagtacttttttcaattataaattaaggaatccctcccagagcagttacatgaatgtcaaattgagatagcctttgaattctgtttcccttatgcgtacatatgttttattttgctattgtttttaaactattatatatgtatgtatatatgtatatagcattactagaaactattttgctattgtttttaaactattatatatatagcattactagaaactatgaagggaaaataaaagctggaaccagcaaggtgatgaaaaggccactgtgggagttgaacatgaaagaatggtgctttcatgaggaaggaggtattgatgtggttttgggggctgaggtttgtttttgtttcagctaccatcttagagacaatagtgaatcagaactgtatcaggcaggcagattttaatgcccatttccaaacagagatgtctctcttagatactcagggaaagagtcacatagaccatctgtatttgttctgcttctcattttacccttgaggaatgaaggaattctgttgaacagtgccagcattagtttaggctgaaacatataattgtattgagtaataaaggaattttaaaattcctgttttttcctgtggctctctttcacaaaacaggctaatggtgaaatacttttgcaagtgttcccattcatctctggctgatgcaagatgcctagtgccttgtggtttcctaattactgaagccctaatttctttggcaaatctctcccctatagatttcgttttggtagtgaaaattactcacaagacaagatgagcactggcatctctggtctggttaaggcaacatctggatgctgagattagccatagggatgggtcatcttttctactcaggtcagcagattagttgtccttggtcagtgggctgagacatagatttcttaccacttacttgtttcctggctcacttaaaatgaatcaaagacaatagcttgcattctaccgcagaaattagcaatcatattgcccacagtcagaaagaagacaaagaatttgaatgcacttgactatcttagtggaggtctctagaaacttattgcccaaagtagggtttacagataaactgtcctctgagagcctgtaagacatgcagagtctctggcccctgcccaatcatactgaaattagaactttcatgttaataagatgtcaagtaatttggatgcacaagtaaagtttgagaagctctgctctagaacataagtctatgaagacgatctgtgctgtgctacagttataaatggagtttttagtgagtctgtcagtcactgcagtactttttacaaaaggtaaattcctctggaatatgaaggaataaaagtttattatatacacaggtagaaaaaaaatctgaactagtttttctgtgatttttaaaataatttgttgatagttttatgttcaatgaatttagcaatatgtacagagaaaactgtggcatttggctttcttaaaatcctgagacctttttcctttcttctcattttaacagaacattgaagaaagtatgggtttatatatggcatatgtaaagaaaatagatgtatattcagaaaggaagtttaaaagttctcatgcacagagataaacataatatctaccccgagacatattcatcttttaaaaatagtgatgttttgaatcataatctcagttcttaccttactttaggaaaaaaagaaagtaatttgctttgttggtcatattttgaaatttaagttttttttatttcttaaaacaaagtatcactacacttaatattttaatagttatcaaagaaatgttctaagactatatttgtaaaaaaacagtgacttaaatttgttgtgaaagtcattatttgcttgtttgcctgattctcttttgttttcttattaatctcaccatttgtcgagcatgtgctgtgggctgatactgtgcaaggcaggcaggcttgcctttgattttcttaaaaaatcaatatcctttttcagtaaaaacatctaaaaaaattcaccgtgatagtgacgtagagataattgcattaccataggaaggtgtttttttgagtgacaattagtctgttgctagttttcctttcacacctttaccttgaaattatgacatgcaacatacaaacaaatatgggagaaccagcttttcaagacgctctataatatatttataattttctaagccccgaatcagaaagtggtatcaattgaaaatatttaaagcaagaaaacactatattatccatctatttagatttttcttgacatttaggaaagctaacaattattcttccttcctggaatcattaaaaaaagtaaccctaatagtcaagtctaataaatgtaaaaaacaatgagcgatttaaattttcttttgttgtgggtttatttctttatacctgagtttgattttataagtaggttagtttaaaatatcttttcaaatcatggctgttgtatctggtttcatttacgtaatttagaattcgcatttgggaaatcttcacgacctaatttaaaaatacttttcagcagagatactgattcttatccttcatttcaagaaagagcaaacagcttgatggagctgctgcttaagaggaaactggtatcatggctattcttcttacacatcatttttcttaaggatatggtatcccagagtgctccattaatacgcaactcctgtgaacgtggtgcctgaatttgaaaaatttaaaacaattatattcttatctgctgcttggtacacactaatcttctcctgtcagtcagatgcaattaggttgaaatgttgatctgtcatatattggtggtaaggaagtaaaatgcttccttttaaatggaggaactgtgagagaggtccaaaataaattttgggcctttggtcacaaggttcagccacaaaagacatccacccaaatggtaattaccttttatgtcatgccgtgaatccacttcatttctggaaactgtccaattttctgtttgttttaaaattaattattggggaaaaatcatagtcttttttgcagcttctcagcttttgtgttttgtctgttaaaatataattactaggaaatagtaaagataaacttggttgtagatagtcttctgagtgttaaggacaaatatccttatgatttgatatctttgcattatatcagattgggcatataaagcctcatttaaagatgttaatttgtttgcttttttgaagtggtcgacatttatcaagtatttgtgccagtatgggaaatgtatataaaaaatgaagtatgatacatgtcttatgggttgaaaaaagataatgttgtgaaagagttatcagcctctttaaaggttgaatattagccttaaccatatgaagtaggtaaaaatctgtagagtgttgaatactggaattttatattgttcaactttttatattattcttggaatagattggtttttgtctttttttttttttttttttttttgcatctcttcaataagaggcttttgttgaactcgtctttagccaaatgaaattcagcacagggttgggtctggccaaaagttcaggtcgttagtgataaaaactttgaaaaatccagcttttctctgatcggtcatataattgcatatctgggcatatgtttattgaagtaattattattaatactataaaccctagaattagtcaagagaacaacgtttgggtggcaccagacaatgaatgtctggagtcgagtggcctaagtttaggtggaaaaacctttttctgaatttgagttggaaaagaattggtgcatacttgtggtcactgcctttctttcctattttatatgccaaaatccaaattacagattttaaccacttcccagtatcttaatttaattttgaatatgagtactttttgaacattactttttgtatgttagttaatgtaaattattaacagcaatctgaatagaaaagaaaatttattttaaatgttattttgctgttggatagaatttctgaaatagaagtaaatgcgttcccaaatagggttgttgtatgtattcacaaaccatttttcttttaagtcagaaaaatgtggactgggccaacagctgaagaagaaagactaaatatacttcatggtttttccatttttgtgtctaaaatctaccctgaaatataaaaatcttttaatttaaattttcaataaacatgattgtgacttggaattgtgcgtgttgggaagaataattagttgaatgcttgaatatagaaacataaaaagcaaccttcatgcatcctttcttacttttctttttaatgaaagtattgtatggacaaggcaaaaatcaaactgtatataaagtctctctggtcacatttatccctagtgctatatcttcccttcagagtataatttttggtatgttttctagcaatactagtgtctaacctctacaaatttctgtaaacgttatattctgcatacagttctgccttttgctggaatagacattcttgttcttgcacatgtatataacttgtcgtacatttttgagtatattcttagtctaaaattcttagctttggaattgctgggtcagagggtaatttttcttctctaaaagtatctctaccaatagcatatgaaaacaccttatcacagtggggtttagataacttttttttgtcagttcaataggtgaacaatatagtatttcattttgatttatatttatttcattttgagtagggatcagtatctttgcctgtaaatctgtttatgagttcatttatatatgaactcatttctcttaattgcctgttcatcaactgccattttccctactggactgttgttatgtttacttttcatattggacacattctttgtttatttggacattagttctttttgttatattcataaattttttccctccagtttgtcatttgctttttaattatttggtattttttggccctacagaagtttttagttttcctatagccagtcagattatcagtctttttcctttatgatctctggattttgtgtccttcttaaaatattccctggtctagggttgtaaatgcgtttatccagcctttttctagtattttatcataaaatttcctttttaacctttgttgtatctgaaaggtcttttggcataaagaatgaagtagggctgtagctttacttgcttcctaaaatgttgtttccaagcataatttattgaatagtccattgattaaaagatgctacttttgtcttttttatttatttatttattttgaggaggagtcttgctttcttgcccaggctggagtgcagcgacttccgcctactgggttcaagcgatgcccctgcctcagcttcccaagtagctgggattacaggcgcccaccaccacgcctggctaattgctacctttatcttatactacattcctgtatgtatttgggactgtatctagattttgattatatcattggtatctctgatatagttatattttcataatacataatttttatgattaaaatgattctatccttttaatattttttaagatctaggttatccttgcatatttatatgactccaacatataattttgtcacctgtccaaatttttgtaacttgttgtttaattaaacttaaagttaattagagtacagtggatttcttcatgatgttgaatcttctaatccaggagcaagaattttcttccaatatttaaaaatattttctgtttatacatcttagaagagcttaaagttttctttatattgttcctattaatatcttgttaactccattttaagtgttcaaatttgttgctagtataaataggatatttcctcccagcataattttcttgaatgttatcatttttaaatttggaaactcctgattttgaataataattttgtagccagttaataaattcttgtgttttaggtatacagttatatcatcaatcaaatgataattttagtcttctttttctttcttttatttaattgcattggctagtagcagtaacaaattctacgttttttaaatactattaaattggcctataaagtgccttgaatgaattcaatttgattttaaagagcctttcagaaaggtagtcttgagtttagttttgtatttaataaaggactttaaacatcattcttaaataaagtcaaagtataaggaactaaaaaatgtggacttaggtatttgtttactatattgatattttcagattagagaactatctgtgtttatgacattgacctgtcgacttgtgtgtggccttcaactatgatggactttctaacagaacatgtcatctttaatttgaaaacctggtacagattagcaaatgccagtttaggccagtgtttcttaaaactattggtaaggtaacatgaaatattttaaggggtacatttaaaaataatagttatatctaattttaatttgtcataagaaaaaatcatatacccatttcttacctgtgtgttaatggttgacatttagttagaacaagattaagatgaatggatttaaagaaaaatttacagtacacagatgtcttaaattcttaaagagtatgagaaattgattgaaatatagaaaacccagttttagattaatattaaggtgcataaattttcagagataaagagtaggttttttgcatattttgttaatagcaaggcttagtaaataacagtactggtgataatactgaagatgattatgagtaataggttacactaagagcttttatacattatctcagaaactgattacaagaatttaccttcctggcattacagtcacaaagacatatagcttacttgtaccagattacatagctagcaaatggctatattgctcatgtattgtaaattttatttactcagaattcactccaattcatatttacatgagataattatttttacaagttatatttgcttttggggatcttcaatgaaaataaaataaaaaaattgttttaagtttttgatttttaatttttgtgggtacatattaagtgatttatgggttacatgagatattttgatacaggtatgcaatgtgtaataatcacatcagggtaaatggaatgtccatcatctcaaacatttatcctttgtgttacaaacaacccaattatactctttaattttaaaatgtataattatattatttttgatgattgtctccctgttgtgctagcaaatactaggtcttattctttctaactattttttgtacccataaaattaaatattttaagctaatattaccttatagacaaatacatgaaagtagtttgtctcgttaaatctagggatatcgctaatagttcaggcatttctaagggaaatttgccagtgtaaaagcagtctaatcatatttcattcataatttccaaatattcaaattagctagaagctgtgaactttgactgtggtctgtataaatttttgtggaatagagatagcttgtattaggtatcatataattaaagatagaagtgttgataacagaagtggtagtcagcctaagcacttttaaatttactgagtaattagaactcagtttatggccaaaatcttcaaagtttgcagaaacaccccatcttttaaatattctttagtttaagattgttgtggattcttaatctgaaataattgcttcttataggtggaaataattttagagattactttagggtgtgaagccctaattttatagatgagaaaactgaagccaaaagaagttagtggttttcccacaggacattgttataaatggtaaagctaatctgatactggaatccacatccctagaattccatggagatagtttcgtgttagtgggagaggtagactttatagccagaggcattccacttagtgaaattttatttttatgtttaaaaatttttatttttttaaaatagaaaggagtctcactgtgtagcccaggcttttcttgaactcctgggctcaaatggtcccacctcagcctcccaaaatgccaggattagagtcatgaaccactgcatctggccttagtgaaatcattaatttatttcaccttgatcagaagttggtgatttcattgtcattctagtcagttccaaataccgttaatctgtatatacctgttcctaaatgaaaattattttacaagtacttgatcttctctcacaatacgtactagatggaatgagtgttttttcaaggaaataataaaatacttacaaactgtaagaatactgggtcgtggcagtgtttgccttgagcatattgttaatatgattaaaaatatcaggactcaacctatacagcaaaccaaaatagagggtcttttaaaatttttctgttatttccaggatataaggtaattttaagacatgtgaagaagatgaaaaaaagaaagagaaagctcccaagcaaaaaaccttgggacttagttaatgcacacaatcctggctggaatctgctgtgtgtactcagtctccccacagcttgtaaagtcagttaaatatagtcaccgttgggttctggggacgagcaaataggaaaagaagggaaagctggaggcgtgttgtagaaatacacttcaaagtaatttattctaacgctttttaaagccctctttgtaaatgcacttttaaatagtagttctgtttccttgaatccacgcaagagcataaaatagactggattcagaactggcgtgggaatattgtcagctccattactgcctgtgttgggacagctgctctgctccacgctgcctagtttcttttaatggacctaggttcaggtggctgaaaaagccattctgtggtagacgcctcacataatccttatgtgcgtgtttattgtgtgtgcctgttcatgggagttctgtggcagttaaattgtccacccaggatttccagacagaaggaaacacacatgtaagtgatgcagtatttgctggtggtgtggctaaaaaaataaaaagtcaatacaccttgttctctttacattcattttaatgaaatcaacaaaactgatgctctcttcaaatcaaaccactggctgttcaatgatttttccaattaataagaatatatagttgcctaccttttttttctgtgagctaagcattccaagataaagcccttaatcatcttaaattgtcggggataactttgagcaagcagaagaaatgttatgtgcgtctatttttattcttttccgtattttatgtcatcaaggtcttgctttcctcattggtgaagcagttatattaggtgatccctcaggtgctctccatgtctgatgtgatgattcgtaaccatgctgtggaagcctgctgtatcagcggtacctgcatgttgtacctctagggtagggtgcttgtgttacagtgcagtccagatgagcagtttctcacgtgttctaccgtattgctgcatgtccgtgaatggtgctcccatagacttactcagatttggggtttttatgaaacacagcttcctaaacttcacctctttgacaaagctgatataatacacaggatgtaataataggtctttgagaaccttccatcaagactaacttcaggccggacgtggtggttcatgcctgtaatcccagcactttgggaggccaaggcgggcggatcacctgaggtcaggagttggagaccagcctggccaacatggtgaaacacctgctctactaataatacaaaattagccaggcgtggtggtgcatgcctgtaatcccagctacttgagaggctgaggcaggagaatagcttgaacccaggacgtgaaggtttcagtgagcagagatcacaccattgcactccagcctgggcgacaagaggtaaactccatctcaaaaaaaacaaaaacaaacaaacaaacaaaaacttgatagatgtgaatacaaactcagagatcagagaatgcttgtaagtctcatatttatactttgctgcccggcttacgacttggaggtgcatgttgaatcactgaatagatctattaactggaggtgtccacactgcaaatcagaatttgccacacttggcttagtcataccagcatttaatttattttggatcagcccttctagcaaggaacttaaggttttactactctaaaaatgcttttgaaaagttatttaccctgttgctcactcaacgtctgacaaaaatgtgaaagtgtttccaggaatagtaaaaatgtgtttcaaaacacaggactgaaacagggagtttaattctatggtatgggtgccgcactttgagaatgtctaatatacaacaacctttttagaggcttttacccaagattctactcctaacgtatttcaaatgtgagtcaatatataaatattttgttaagacaacttgtcagcaacacatctgtgtcattatgcataaaatgcaactacttttagtttctacgttgtggaattatctagtatgctcaggggacttgctctaaatttaaagcatgtactaggcttggatacatctttacatttttttgagtctcttaaagaaaaaggtctgtgttttgtagcatgatctgctttgtaagcatctcattaagaaatgaatccctgtgagaaatacaagcttgttgctcttctcacttgatggatggtggtggcatgtatgtggagaggggagggataaattgataaatgtaggggactctagagtgatgatctgggaatgatgcagaggtttccaatgtcttaacgccagactggagataattaatgctaaggtttcaaaattataggagtccgatgtctaggtctttccttccccatttggaattttatcaaaatatccttttggaccaaatcactggaaactttaggttcagagtcttatgcatctcttctgggctagcaaccaatgtcacgtactgctgaaattagggacgctaaacgtgtatgtgagtgggggcaagctagtattggttttctactcttggcagagtctgctgtgtcagaggtttaaatggttaccattttgattatcttcatgatttgtttcagaccatcgctcttgcattttggccaaccggtaacttttttaaggtttcatcaaaaccaaacagctttctgaatagtactgtttttctcttcatcccagtatactgcctttgactctacaatagtaaaagaaaataaacatcttgagtttaagaatcaactgggtaagtataagtcaaataggactcctattttccttcacctttggtcctgcagtgccagttaatggtgtaccagatctatcagcaatatcctctttccagtcttcatacccttgggatgcaccgttctttctaccaagaataatatcactttcctcttctctgctaagtaagttcctttccatctccaaaaggctggctgaaaatttatctttaggaagactttgctgttagattgtacttaacagttaactcttcctttgttccatttagggggaaaaattactttgtgtattgtagtagaaggcactctgaggaaagaagatcaacactttcataccccttcaggaactgattgtctagctgaagaaccaagaaaaaaatcaaacatccctactataaagacattttgagaggggcgtgttgttaaaaagcttgtttgagtgtgcaagaatacagagtacaaaagaagttaattatagcaaaatacttgagtgagccgtggaatttggccctttctgatagtatcataagatcacaaagctttagggctacaagagtcattagagatcatgtaatataacataattcctgtctgtgagtattttgttaatgccggagactcaaaatgcccaaaacgaagtataatcttttcccaccaaaccagcccacccatttttaccattcttcagttaactcgactgtcttccttcctcttgccctgtaactgttgactttgcccatcctttatgtgttcatatcactacccttatttaggaacttaaccaccttcatatgtcttcaaggtatatcctacatcttgcggtatgagcaacttcaacattggaaaataaatgactgttgatcttgtaaagtggttttaccaatttacagtcctaccaacagtgcacaagaacatgtcttcctaacatatcttcattaataattgattttggtagtttatcaaactttggctaatctgctaggtgtgaaacgttatttcgctgtggttttaacttgcatttccatgattgctaatgaaaactcaggatctttcatgtgattactggtgacttatgttttgtcttctatgacatacctgcccatgcacttgccagcatagttgtctctcagtatgcatgagcgattggttccaggaaccctcatgggtgcttagtcccgtatatgagatggtgtggtatttgcatataacttacgtacatcctcctgtatactttatttttgagatagatgtcgctatgtagccaggctggtcctgaactctgggcccaaggcatcctcttgtctcagcctcctaagtagctgggactgcagtcctccgtatactttaaatcatctctagattacttatataatacagtgtaaacactgtataaatagttgttatactatatttttaaatgtggcattgctgtttttttattgtttgttttctgaatattttccatctgacgttggtttaatccgtggatgcagcgggccatctgtgtttccattgggttgtctctttattttatttatttatttatttatttatttattttgagacagagtctcactctgtcgcccaggttggagtatagtggcaccgtgccagctcactgcaacctccatctcctgggttcaagcaattctcctgcctcagcttcccgagtagctgggattacaggcatccaccaccacgcccggctaatttttatattttttttagtagagatggggtttcaccctgttggccaggatggtctcgaactcctgacctcaggtaatccacctgcctcagcctcccaaagtgctgggattacaggcatgagccaccgtgcccggtctaaaaatttgatatttaaggcttcttagatacgtttggtgttttgggtactaaatgtttctgttatatgtgagcttacactatacttagtgcttaataaacccttgaaatctattcatactacctgttatcatacacctaattgaaaattagggattcttgcccaggcctgcgtctccatcctcatctttagtgctgtcccaggaccctggccccagagacatcaaggcacagcagccaactggactggccaggttgcctttttattgcccagtccctttgcttggaaagtccttcttttattcttatcctcgtggaagcttctatgtttcctttattgttgatgtgctttgagtgctgcctttgtggatctttttctcaccttccagaggccttcattgtgtctcctacctggccttactttgtgcagtcactatgctggggatgtagcaggcacagttgctgaaggcttgaagtcaggtagtctggtgtattatttacggtttttattttctatatattatgatgttttgacatcttagaaaccattgtggttgggaagaggctgcccttgcaggtctagccagttctgagagggagccagggcctagccaggagcatgcctttgagatacaaaccaactagtccatacccagacctcctctatctggcccttacacttcaggaagcagtattcccttgcttacatcattcaaggctaggtgccaggcaactagagaccacctctgtagcccaaagcctgctgaaattattcaacttagccactcctaacctgttcaccctgccccgccttgtttttcctggaagtccattaaagactgtggcctagttctctcctcctcctgcccactctgcctctcaccagcctgaggcgttccagtgtggcctgcatggcgggcctcctgtctctaggatcactgaggacaatcagctgattcctgagcctctactgtgtggcctcttgtgaccacacctgactgggatcacctaaaatagcatagaacgtatggtttgtaatcttcctttgccctctttctagctggtgacctgacctgacctcctcaagactctttatttcctcatccttaaaattgggataattatgggaccctccctaaagggttgttcagaaggctaatgcacatagaatacttccagtgctgcctgtggtaaatattgcctgttatttttattattactgtttttacatatgtcaatggacacaactgtcttatttactgcattgctgttttttgaaggcaaggcatctctgtaaccttggaccacttcctaaaacagcagatttctgatgaatgaatgaatgaatgaatatgggagggaagaattggagccaagatatggaatgttcacgtgaagatgtttgtttttatttggttatgcttttgacaatggaggtgatagttaaatgaagagccttgattcctttactaaaaaggctggatttaaccagagggacctgtgatttctacactgttgtgaggagccctgagttacctggaatgcctcaagatttgctaagaggtggggtgggagtgtgacacaaagggtagtgggaggccactgcttgggaggcgccttgcctctcccacagccattcacagcttccccacccagaaaccagacagttctgtggtaatcccttgcatagatttgatttctgcttttaaaaaaaattactttagaataggcaatggaaatcaagctgatttttaagtaaagagtagcacagtcagtttatcctggtgtgtgggtgctcccacctggatgctggggcaggaagaccatggacactgcccagatgatggggatgggagtggatggcagtggttaagtctgagaagttctgtaggggaaaggagagcccgtgtggctctgcagagaaagggtcagtagtgcccctcaattgacaatgtgggagaccagagcccaggggtatctcatgttttaagacaaagaggccaagctggtgatacaggtttgctataaaagttgtagacatcatcagggcattggcgtgtctgctggagccataggacctgtgagattagtaacccaaggacaatgaattttaatttatggagcaaatatgtattccagccaaccagcaacatcatgttgagcaatgcagtcatggtcctgtccttgtagaccctacagaccagtgggaaacagtggggtctgatgcaggctggagggatcaggatgcatttctgagaaagtggtggttgaatcggcatttagaattgtgagttccactgaatgagtgtgtgagggacaggggcagctggaagagttgaggaaggaccagcagcttatgccaagctcaggagcgatggatgatggaccccagagaaagccagtgtgacaggcaggcgagtctgggggcttcctgacagttaactagaggtgcaaagagtggaaactctttcctccaaacttgcccggccaccttgcctgacctttcagttgccactctcctgattcttttggtcttgtgttagtccactagggctgccataacaaagtaccacagactgggtggttcaagcaactgaaacttattgtctcatagctctggaggctggaagtccatgatcaaggtgttgtcagggttggttccttctgagggctgtgagggaaggatctgttccaggccccttaccttgccgctggtggttttctggcaatatttggtgttccttggcttgtagaaacaccattccacttcatcatcctgtgacattcttgctgggtgttgcctgtgtccagattttcttttctttctttttttttaaataaggacaccactcatattggattaggggccacctactttagtatgacctaatcttaactaattacatctgcaccaaccgtatctccaactaacatcccattcccaggtcctggaggttagggcttcagcatatacattttcagggggacagaattcgacctataacagatcccgcttttgccaggtattgttgttattgttatttaaacagctccttcgaatatgaacaggaacctgctcttttttctcttatggcctagggacaaaaacgtaaaattgaaactggcttgtagtaaacgtgcagtaaaacttaaatagtaaggtctttgttcaagtgccataatttacctcccccgtataagaaaatacaagtgcctattgttgggcattaacctaccagacagttaccgccaaatggataagccggcaaccagtggaaccaaaatgtatgctataggagcggggtcggagagaagggggagtgtaggtgggaggaggagtgttgtgggggagaagaaagagaagagagagagagagagagagagagagcacgcacaaccaaaaccaaacccagacttcccagtgtgtcgttaggtcgcagccgtgctgagtcagtggccttggagatggcagggccacagtgtgtggctgccggccgtttgtggtcagagatgctgtatttagaatgtggcttccagcctacctggtcacctttccttgacatcctgtggcttcccaaaatgggggacctgctgtcagttcaagtgaagtttttaaacggcagtagtttcttcccctcccctcttcatccctgcctgttcagaatctgtttccaactctccgtcagcgttcacggttttatgaaggctgaaattcaggaggtgggcacctacctgtaggcacataagctgggatacgttctggtgggtcagtgcctgtgctacgcaggttattcaatattttgaatttcacccctagtttcacacaatatttttgaaattcagtttttattccagctctacatgtgcgtatgataaacaggcctgtgtccagtttaggtcatgaaatcttagacttgtggaagctggtcagttttgaggtccagcttcctatgcagtgtgggttttcttctcctgtggcagcctgataacttgtctccacaggaagatccatactggccaggtgcttcttactgcagatgcccatgggcagcttcctgttgacctgatcccactccccttgatggtttcacctttgacttttattgaaccgtttgtagctcattttttgttattaacaatatattttagcctttcgtttacttgaaggtactgctattttgtttcccatttgaatattgctctctagcacaacacttctttcattcttttatgtcatttctcactcgtcacactgtgaagccactttagtttgtcagcatccctcatgacaggagcacttcccagaggaggtggttccatcagggcagagttcactgctgtcagctgggagggctggctcagctgctgacatgttttatcttccaaagcaatgcattctgctactttgaagctaccctgaatccagggtcacagggtcctggatttcctcaccccaaatggttgacttcttgcaacatttcttaaaaaccttcgatcgtttttgcattgtttgaataaagttcagacttacttgattaaattgccttccagaatgtgacttgggttaggaattcccaaactttgttagaggaatgttaggtatgccagatgctaaaaggtgcatgctttcaccaccagctctctctttctgggaaatgggtattctctcattaaatagactgggaacgactgcttgctagattgacctcttgctgattcacaaggtcgctttgcatgttgcaggttttgagaggttctaagctgtattagtttcctatggcttttgaaacagactgagtggcctaaacaacacagctgtcttctcacagttctggatgtccaaaatcaaggtgtatgtcagaaaggccatgttccctttggaggcttcaagaggagaattccttgctttcttcttctaacttctagtggctgctggaatcccttgacttggggcacatggccctaatctctgcttctgtggtctcgtggcctcgtcttctgactgggtgaaatctcccactgcctgtttcttataaggactctcgcgattatgctcagagttcacccagataatccacgataatctccagtctccccaacgcaaggtccttaacttcatcacatctgcaaagatgattttctaatatgaggtatcagtcacagatttcagtggtgaggatgtggctgtgtcttttgggggccattttttagcctgctgcattaactccacagctgactcactttacctgttcatggctaaacacactttgctcgcgcttcgcacacctactcctcctgcgctcagctgcctgggctgtttatctgcagcatttatcttggactacgcagctcaagtctttctccctctttcacgacgtcttcctgtgagttctggcttccttcttttcattgcaaagtagtttggtttatatatatatttttaacacactctgcatctcttgcctcatctctcatgaaaccctgtgctgttgttgaacttctggcggtgtggaatagtggataagagtctctggagtcagactgtctgggttgaaatcccagttccccagttaatagctttgtgactttgggtaagtcacttaattacttttgcctaaattccattgtctgtaatgtggggataattagagtaaagacttctcttccttgtgagaattaccacaattaataaatacagactgccatgaacacagcctctcatcgtatgatcaggaacaatagctataagccacatgtgtctgtcgagcagttcagtgtgactagcgtacccgaggaactggatttttaagatggaagcagtgcacgatatatttctgttaaacacagttttcttgttttggtaagactacattagcatacataaacacactaccaatcttgctggtgtcaaataatttattcagtatatactttttctgtgttctcactttatagtatttattaaatattttgtgcagacagtgcagcttatagtgatgcaagtacattatcattagtaattaaattgaaatgtttgttttaaattttttatttcaatagcttttggggtacaagaagttcttggttacgtgggtgaattgtatggtggtaaaatctgagatttcagtgtacctgtcacccaagtagtgtacatggtacctgacatgtagatttttatccctcatcccccagaaatgtttaagtgatatataaaattaaggtaactacatcacttgttagtaaataaatatggacagtttttaaatttgaagtgaaggcatactactgttgcggagtgagtacagatacagaaattagtagtatgatcaaagcagtgggaacacaaagagactagggacttcatgatgaatctcatttgcaattgtataaaaaatgtaaagaaaatgaaatgggcaatattaagacattttcaagaaatctgtggtagatttgatgagaagttttttctcaaaggtcaatgaagaattgatggaagtaattgcctgaaagcagaatttagtgttttattagtccgttttgcattactgtaaaggaatacctgagaccgtgtaacttataaagaaaagaggcttatttggctctcagttctgcagatgttagcatggcagtaacactcattcatgagggatctgtccccctgtctcaaacacctcccactagaccgcaccttcaacattgaggatcacatttcaacatgagatttggagggacagaaatctaaactatatcaaatgttcattaagtttaaaaattttaacagagtatgagcctgtaactttggccacctatacagtgtcttggattcatgcactatagaggaagccagtttaagatggagagatggcagaaggaattattgcaggtaccaaaattttattagaaaattatgagaagagacaaaaatatatttcacaaaaacttaaagatatttttcactaaacagttgcctatagactacatgacccatttgaaatttgaaacatttcaattactttcctttagctttgtgtaagttatacagtatgatgatccattgtccgattaatacagactttaagatttataaataaatgttgtaattttttttgccaaaaataacagatttgtggcagagatatttttgaatgttttaagaacattcaattcaaacatttgactgtttcaaagaatttcagatggatatgaaaaaattaatttctattacagttgacccagctctcttagaccgaattctgtatttattggaatttttcaagaggctggtatttctcttattgcttcattcgactgtattctgaagctggacagagtacaatacagtagttaacttggcaaaaagtgtgacacatactagtagttaaaattatccagtctataagtgtaaattcatagatcattgctggtttatggacctgcagaaagaaatggaagacagtgaaggcagtgaccttgtgatctttagcagcacttgttggtggagtcctggacgagttttacacagatttctatagcataatatttactccaaccaaagatgatcttttgttgaaacaaaaaggggcacttgcccaagtattcagtacttaaaaagggaatatgggccgggcgcggtggctcacacctgcaatcccagcactttgggaagccaaagtgggtggatcacctgaggtcgggagtttgagaccagcctgaccaacatggagaaaccctgtctctactaaaaaatacaaaattagccgggtatggtgacgcatgcctgtaatcccagctactcgggaggctgaggcaggagaatcacttgaaccggggaggcagaggttgcagtgagccaagatcgtgccattgcactccagcctgggcaacaagagcaaaactccatccaaaaaaaaaaaaaaaaaagggaatatagcagtatggtttatgttttctgactcagatcacactacttttgaatgaactaatttgaaagtctcaggaaaggacaaggtaatttgtcaactagctaggcagatattagaattcatgttgaaattgaaggttttcataatataagtcaatagtaatgattaatgtgcagaagattttaattataaataccattatatatattggctacaaaaactagaatttgaagagctctttgttgatactgataaatttagagttgttttccaatttatgcaaatattcctttgaatccagtgttaatactgacttgacacaagagttaattagcttacttaacttgaaccgatatggatttgaaactgatatgcttatacttcaaagtcaaatcagtttttctttcttttttttttttttttttgtttgaaatgaagtctcactctgtcacccaggctagaatgtagtggcctggtcatagttcactgcagtcttgaactcttgggctcaggcaattctcctgtcccagctttccaagtagctaggactacaggcctgcctcaccatgcccagtttactttaaaataacaaacattttctttgttttttttggtacatggtctcattctgtcacccaggttgagtgcagtggtgtgatcatggcacactgcagccttgaccttctggactacaagcaatcttcctgtgtcagcctcctgagcagctgggacacacccagctaattaaaaaaatattattttaaaaatcttttgtagagatggggtctcactatgttgcccagggaggccttgagctcttggcctcaagccatactttggctttggtttggcttcccaaagtgctggaattataggaaggagccaccacgcctggcccaaatcagttcttttaaacaaaagtgaaccagttttgtcaatgtacttgtgaaaattaaaggaaaatgattttttggatactcaatttcgttatgagaaaacttttaagtatatttggtacaggttgggtacatgaatttactttttcaatgatcagttttatgaaatctaaaacagatcaagtatttctgatgaaaatttacatttgaattgtgatatgccataagtgtaaaatatagtcatgtgctgcataatgacatgtgggtcagcaagggaccatacacaatggtagtcccataagataccatattttcactgtaccttttctgtgtagatacacaaatacttacaatagtgcgacagttgcctacagtattcagtacagtaacatgctgtacaggttgcaacctaggcaccataagactatatcatatatcctaggtatgtagttggctctactacctaggtttgtgcaagtatactgtaatgttcatgcaatggtacatttctcagaatgtttccccgttgttatgtaattcattgactgcgttggattttggagactttaatatgaaaaagtatgtaaaatatctggataattttttattaacatgtgcataaaacattctagatatatgtgttaaataaaattcatctttatctgtttctttttaccttttttaatttggctactggaaaattaaaaattacatatgtggctcacattatatttctgttggccagtgctggcctaaaatgtgagaagtatgtagtgaatgaatgtcggcattaatgtcattgctaatatgatgatgatgatgatgatgatgatgatgatgtggtagatgtgttgtttccttgtcctctcgctagattatagaaactcaaatgtaggaaatgcatcttattcttattttcatttactctgtcatgttgcatagtacatcagatattaatagatggttattagctgattgattgctccatgatctgcttttaacaatgaaaattcagacctcactgtttttaaacctcaggataaaggtatccctttaaatgagctcaggcaagcatgcacacactcactcacggatacacaaatacacacagtagcacgttgtttagtatacttaaaggggggattagtttaagcaatggcttttgatagtggattattgcaaggataattgaagatacttaaatttgaaatattattttgtgctaaactgtatatgggtttttatataaatttattaatttctttaaaaaactgctgtggcatcttattttggttgaaacgtttttattttgattgagggagaggtattgtggacataacactgtaattagaattaaacaaattggtttcatattctgccaagttctctaactagctctatgaccttgaacaagggatttatgctttcttcaattttctgatccggaaaaatgaggataatatcagctacctcaccaggatgttgtgagatataaatgggaaaaaacatctaaagagtacttagcaactataagaaattacaggaatgtaagatattattttgatagaaacaataataaatactttgctgtatagtgtaaggttgaagaatgtatgttatagtataaggcaaactatgtctatagaaagttgatagcttaactatatgactcaaatagttgacttaactatatgacttaactatatgactcaaatctactgtcaaatagccaagatatatcataaatattaggagagaatagctgggaaacagaagtagttgttagacatttaagtattttaagattagaccaaaaagtgcatgtggtcaggctagactgaatcagagacacctacctgcttttcagcttctacactgaaggtaagactcacttcggccttagcataagggcctggctagattggcaatttaaagtttggtgctattgagaccaagatgtgggtggtggtgtccaatccctattaggcgaggaagttatttttccacctagagaactccactacccttacaaagctctggtctttttcagtggaatcttgaaaatgttttctatcagtaccactgagtagagattttaaaaagtatatggttgaataagagctaagcccccgctgctgttggcaaaagaaagcaaagcaacaaaataaagaacaacctaaaagcattagtcctatagaggttcaaactgcagtctcagtatctcgccaactgttcattttatcccctttatttctgtggtggagctgagctatctagaatcacaccatgattgtgcagtctacaaggcagtgacactggaagacagctgcacaagcatgaaggaggcacagactttgggacttttaatatgtgattcctccacgcccaccacaagttattttggataccttctttgggtggcagaaccgaaatacacaatatagcacaacctaacaaatacagagatttagtagcccacagaatggagttttgccaggtgtgcctatccccagtcaccacaccccggtgaaatcaacattctttgtgctaacttggagctctccttgcctccggtgacttaaagttgtttttacaaaatttgatatatccttgggcactgaatatgagttagctttattagtttaatgatctgcacctttctgggtaaatgcttacagatttctacatttacgctcctgatatatgcttgaattttgtctatttttcagtaattttaagtaacaaaatcacagttcttaacttgtatgtttcttcagtgatttacaatgtttcctgtctgtctggaactctatagtggcagagcagatctgaaatgcatcagagagttgacaagtgacatttctatcatgacctgcacatattttaagaacggtcttaactggattaattatatccttgaaagaaattgggttaaaaagacaagaatatttttaaatagttaactctgtgcttaaccaacagcagtatttcagtagcagactgttaaattaatgtacagtgaaatagggaaagatatagtcatcagtatttatgtatccttttgttattcttatgacctttttaaagccataaacaaaaggacatttgttttgccttcctgccttagccaggacacaaattataaaaagaaatgcacaaggaaacattaataaatcaagtaaatactaaaatttcataattcttctctttttactgcagtttttttccttccaaatttaaagtttttcattaagcatggccttgcacactggacaaagtgcagctctgttttagagtacctgcaaaacatcatttcctctataaatcactcgagtgattagaactgcaaagcatggactttgcaaagaaacagcctttaattgtatggcctgtcactttgagagatagtgagaaagggaggagagaggaactctaattttatttttcatcagttttaattttttaatatgtgtagctatttactgcaaagaagttattatttcagtgtgaagttcactgttaatttattattaacttccctacacacctgtacaaatctttattaatgtatttggaaccctggttctaaaaactttcagctagtatattgtaaacttgaaaggagttactcacatcagcactgaactgtccggttaggcagatctttaaaaggatctgatagggatattcttcttgtatttcctgtgtattttcccaatcctgatttcatgctcgtgtggtgatttatttttccagggcactgtgccatccagtatagaagaggtcagtgtggtagtatttcatagcttttctttcatccacaaagccttgccaccttctgtccatgactcatgcatctactggtgttctctgatagcaagaacattttgattagctgtacaggttacctggttattattctcatgctgtccacatgtgggtggatgtgtgtgaaatctggaggtcctagccaatgttgaaacataatcctatctagaccaggaaatgcctggcttcccagatacttctcagagcaatagggcagggactaaatttcttatttccttcctgtcctcctccatcccataacacctatggtccaaatgggtgtttgatagtcattattaatacattctatagaagccatattttatgtgaaaatatctctaggcccatcattttccattctaataggatccattatagagggatcgatcctattagtgaagcaaattgccatataaataatgtattacaagtagacatagtttaaatccttgttctacctactaactattagaccctgagctattacctctcaattcacctcagattcctcatctgtaaaatcgagatgaaaacagtaccaatgacatggggttattatgaagagttaaaaagatactgaatgcagagcacttagtgcatactgggcatataccaagtgctgtacaagtgctcactatccttcttagtactgctgtcatcatttgtagtgatagtaggccatatgaagatttttttttctctgatggatgaaaacttcagtatgagtggcaagaatgggatggagggagggagaggaaaatagaggttcaaataaaaggagcttacgttaagaaaaaaaaaaaaaaggaaaaccagtgagatactgtatgccttgggcatgcttgtattcacgtagtgatgagcaggtggactcacccttgctgtatctatatattatgtaccacctagcacacacgtaggctgttaatagatgcctttggatttacagatgttctttaacttacagtgggggtctgtccctataaatccttcgtatgttgaaaatatcaaaagtacatttttgatttacagtatcttcaatgtattatgggtttatcttggactccattgtaagttgaggagtgtactgaatgtgtaccgttttcataccatcatagagttgaagaattgtaggtggatccatcgtaagttggggactggttgtccctttgaggcttctccagcatttctgggactgtatttattggagtatctgtgtgtgtgtgtgctgtttttctcctaatcatttaattaaaaattaatctttctataccttaccaacagttgcttcctttgtacctgcttgttttaaaccctttagtctcatttttcttatagagtttgcctaaattatagaaaattattttagtatgttgaaagtagtattattacacatgttgggttgtgcaaagatgtgaattcctgagttcacattgtatttgcgttcttccttgctctaatattatactaagggtttacaataatcatttgcaatataaaagagactgaagatttgctagcctgcttcaaaatatcagtttttgagtggcttttattggaggtgaaaattagtcaattttgtacatgttcttgatacttccaagaacaaaccaattggtaaaacacagcctactagaaaaataggtaaagtgtatatataattccctgaaaaaaaaattaaggccacaaacaccaaaaactctgtagtgttactaccagtcaaaaaatgaaaaaacacgtctgtaccattttttaaaaacctatcacattggggaaagtatttttttttaaattaatcttttagggcatttcttccctgtttgatattttttatatgtaaatcttttttttcttatcaaactaatcatggacataacataacattgcaatgtactgaaactgagtgtgttttgggggagagaattctgtgccatggtagaccaatatcaaggatgattgaaagcctctggcctctttctgaaatgctgatacttggttagccttacactcatcacccaatactagaaggtattgtgtctggccacagagcggctctcttttcttgataggtttgaggtgtatgtgcaaccactgagcacctgtttgcgaggctattgcccttgaaaggagggaaggggtggctatgtaaagagtatcttagctgctggacataaacgattcttcattattcagaggttattgatcatgttgctggattgcagtgcttctctgtatcaggaggtaaatcaaaggaagggaaagttggttctttggtgacagcagcttttatggggaaatatttttcacctttgaagactataggagatgggagttatttctgtgttttaaatattgatggtatcctcatttcctttctactaattagttaattattgctctattgataattattggctctatttttgttcttcactttggtaattccatttgtctgttttaccgggttctcaattgtagtcattagtccagcctcttcattttagatatttccccggtattttttagtgcaaaattctgaggtctgggagtccagagacctggttttcatttttattttttggttgcaggttctgctacttcctaactgtgactgtacaataaacatttacctgctttgaatctccatttcctgatctgtaaaatgagagggttggattaattaatccccatggtcttttgaattttgtgagtctgacagagattttgtccaatgatttgtgttacaaacatgacctaggtataaacacctttctattatattctgtctccgtattcttcacagcagtggttaaatcattggaagttttcattctcattcaaaacagcatcatttgttaatcattgaagtgtttgtgttttgcttattggaggcacagattaccttgatattgtaattccgattagctgggaagatgccttaggagtaattagacaacatggagttaaagaacataaaaaggcagtgcaaacgagtgctttctcttcttgcagaaggggttattctatttcctgatgcctgagatgatctaaacaaagagattcgttttattagtggtgtggtttctttagcccagtaccatgaccgtatcctgttcaaagaagccgccacagggtgcttaagtagaaacatacagtatgatttagcatgcagttcagaggggccaggttctcacattgcatgtaagaaagttcccttttcgtttgtctgtctgggctacttattcatctgtattggaagagaggagaaaaatgctagtcttcctgtgttgcgggaggatggcttgccctcgtacataggtgttgggatggggtgtgtgtgggggatgtgtggatgtgagatcagtcttttttttagccatctgtggtcattgagaaacacagaaactttctgtgtttctttcagcttttcatagttgtggaattttaggtagttgtcatactgtagtcaaaacatgattctgtgaatttctggaattggtctttaatttttacataactctgtctggaacatttctgagtacttcatgaaaagtgagggtccatcccctcggaagaacaggataggcgtcaggaacactgaaacctggccccatgggaccctggtgccctgccctttggccccaaagctggacctacaaccaccagcaatctaaatccacctccaaacaacactgaacaactgcatgggcagtgccagtcccccaaaaacccagaccgggaaaatctcaggtgctgtatcctttctccctcctctgagctctggagtgttctaaaattacatgacttctctgcatttgggtcacttgattagaactggaagcactgtttcatccataaaataccctgtaatggaaaatgactacatcaacttggtttgaaaatgtatcttttatggtctcttattattttgttgggttttgacatgttttggtgccaggtagaggagtgggaggaaggagattattttctacttcaaaacagtgggtggctaggattctagtcctggctttgtctgtaactagtgtgatattagaaaagttggctaacccccctgtgcctcagttacccgagatgccaaatatctgcccaccttcctagcttagttcttgcgagagtaggatgggtggctcacacctataatcccagcactttgagaggctgaggcaggtggatcacctgaggtcaggggtttgagaacagcctggccaacatggtgaaacctgtctctactaaaaatacaaaaaattagctgggtgtggtggtgggcacctgtaatctgagttactcaggaggctcaggcaggagaatcactggaacctgtgagatggaggttgcagtgagccgagattgcactatcgcactccagcctgggcaacaagagtgaaattctgtctcaaaaaaaaaaaaaaaggaaaatatttctgtgtcttgaaaatgttaaagccatggtgattgctcaaaatagtatggcatttaatataaaatagatacccttaatagcccacgtgtaaaattaaacttaaaagggtcatattgggacattatctttacaactaaagagttttctgtaacaaggattgaacctaggcaggactttataccagaataattgtgttcatactgaatgagttacagatttagtctgtttgttccttgtttcagaggagtcaagcgtcagaacttaatggtggttgtaggttctcatttgctgtgacatttcagtcattagtctgattggagcattctttatcagctctgtgcttcaagaggaggcggaaaccaccatcctgttggcttggcggacgtctgcctgctcagataccacgtctctcctggagtcccccaggggcctggggaaaggacgagggggcggccagctgggccccctgggctggggaccaggagccctcgctcggctcgtttcccactcattgtgcggcccaggccctatcactcgagaggcctggcaaggaagtgaggaggaagccggtgccactactggttcagaatgttccagtgtggttggaaagtctgagaagcagcctgggtgagaagaacaagaccttattgacagggttcagtcctggtcaggtctgtttcacatcagctctctaaataatcacagctcttgccacctcagggatctctagcacgtttacctctggcttttttttttttaaacatttaatgtagctatggtagaacacaaagcattcaaactttttattccaagagaatgattagaagtatagtgttgcctgcttcaaaacaataatagcaaaacaaagtccaaacttcatactttacagggctttccaacctactgccaaattattagtcttattgcaaatatttttctattaagctgttttctcattgattgatttatagggatattgattatcctataataacattttcagtggttgtgtagcccgacttggcttgtcatggtctgaattggtcagtgtcattatctaacttagataatggtcagtgtcattatctgacatatattttagatatgtaaaaacggtaagaattgtaagaatgggattaaaaaagaatatgccaaacattttctcttctgcacatgaatctataaactagaatatttacctcaagaagtcagaagaaaatctgctggagattttagccctggcatggtggctaacgcctgaatctcagcctttgggaggcccaggcaggcagatcacgtgaggtctagagttccagatcagcctggccaacatggtgaaaacccgtctctactaaaaatatgaatattagctaggggtggtggcacgcacctgtaatcccagctatttgggaggctgaggcacgagaatcgcttgaacccggaggcagaggttgcagtgagccacgataacagcactgcactccggcctgggtgaaagagcgagactccatcttaaaaaagaagaagaagaagaaaatctgctctaggttttaatgaaccacagaatgtgtcccttgtatgctttgccttgtcattctgcctgaatttatgcatgacttctgcattaatgtagtaaacacacacttggcagtcctttcattttcaggacccatagggtgtttccaattccagcttttggtcaagtaataagaaaaaggttttttgtttttttttccccctggaatatctggtaggagcttttgaagctctaagggatatttaaagcctgttcaaattgaagaaaccgaagaaaacccaaacgtccccaaccacttctgaggacacgaatttccagtggttggagcttcccatttttatcttttcgtctgaatgagatggatggggaccctctagttgggcagaaagcagaggagcagttatgggatcgactgcaaaatgtctaaccaatttattttctgagagaggctggtgactttttatagcacctacagaatggtgatttttgaacttttgacctattaaatagtttaattatatgtctctcatactttccctctaaaagtggcacatgaaatattttaggtcaaatgaagacccctacccagaaattttaaaaataattattaagaaccagttgagaatctctgtattttgtcagacaccttcattttaaggcaggaattagctatatgatttaagattaatacaaaggaaatacgattttataaaaaaagagaatatcttctttttttaaaagttcatttgtatgtgtgcataataatacaaatctgatccccatccctgctccctgccaccttaaaaccttttcaagccttcagtgattttccagaacctttagggttagcagccagctgtggccattgcctggaaaggccagccctccaaaggtactcaccttcctccacatccccctggccttctttattctaccatggagtcttttcctctccacactagcccttctatatccccaacccacctagttcccatcttatccccttccccagtgattttttttttctttccctctggagacaatgtctccctctgccacccaggctggagtgcagttttgcaatcatggcttactccagcctcgaactcccaggttcaagtgatcctcccacctcagcttcccaagtagctggtaccataggcacgagccaccaagactggctaatttttaaagatgttttgggctgggcatggtggctcacacctgtaatacaacagtttgggaggccacggtgggaagatcacttgtgtccaggagtttgacaccagcctgggcaacatagtgagaccccatctccaccaattttttgttttgttttgttttgttttgttttaacagtgctaaggtctcactgtgttgctcaggctattctccaactcttggatgcaagtaatcctcctgccttgacctcccaaagtaccaggattataggtgtgagcaactgtgcctgacccccagtgatcttgtttaatgaccccccagaattactaagatttctgctttatgttgctatgacaccaaggcattctgcccccatattctgcatgtttcacacaactggtaagtggcaaaacctaaacccaaatccatctgattctggaacttcatgctgtctgttgatgcatatcactttcctggatttcattttcatcctctgtcttctgtggagctcaaatgaatactgtttgtgaaaatgctttgtgtatagtggaacaccatgtggtatttattgacattattggtgttatttttattttaggttgccattgtccttaagttaggtagccttttaaatgcttttctcaaaactcttcatctagaccacctttctataccactatgagactgacgttttgcaattttttctttctccccaggatggttcctacctggctgagttcctgctggagaaaggctatgaggtgggtgactcaatgggaagcgggcgcaggctggtggggttgctcgcatgcagcggccacatgcttcctctgctgccgtcctcctgagtgtgttttccactgaaacgcagataacaaatcagaatccggggaagaatgtgtctttgggcttgtgagcctgccaacccattgtgctgtttatctgctggtgagcactggtggctcccctgcactcacagtgttcagctgtggtgcacacttcccacattctccgataacgcagcagcctgtgcaagcgaagctgtaacatgattcgggttaatttatgatgtaatgtgtttcataagaaagtcctactcaccatgaagtcacttaattcagaaattacagagaacaataaaaaccaagctgattgttggcaaacttgaatgaaaaatttatacctggaggttttcctttctaataggcaaccatatattttatggagctgaaacttttaggtttgctgcttttgtcgttgtcttcaccatttctcctttccttaaaagaaacaatagttttatatattaattttgatgtgctaagtatgtacaacttaattttttaaagaacgtttttcagatatatacatgtatataaattcatgctatacagaaaaaaaaaaaaacctttacagtggcccgtatgctctgatctgttttatgaatgtttacattaatactttaggattatctgtttattctaattgttggtacgttgttttaaaaatgtgtaattggggcaaatggaaacacaacaggaaagaatttggcatctaaatgccaacattatttgaagaaaaaaagttaattttcttttaactcataatctgagagccttgacttttagacttgaagaagtaacagtagatatgtttagcaccttctgtacccttatccaagagctaatgctacattttgtaattatatgaaaataaatggaattatgaaagtacatatgtatacgtatgtccatatgcataagctgctgtaataatcgagaaagaaatgcatattctacggagcagagagttttagagtaggttatgtatagtacaaagtgttggttttagagaaagacctatatttattcaggctagattaacctaacgccttaatatctgttaaaaggaatagcttggcagagagatgcccatactgtgtttcagatatttgggatgagctgagagatgtttggtggctagagaggaattagtgatgttgttgtgtatcgagtgaacctagaaaatgagctagctgagcagaaatcgctgcacttgtgaagagtgaggtggcgtgtcaggcatgtcagaagtgatgctcaaaaccacgcaagtgttgcgatccactcttagggggacaaggtgggctgagactggaggtgagggtggtgttaacaggcagcatctgtgtctagtccagaggaggagggagcacggctatgcgctgcagtgatggtggacccagtgacagtgacagggcgagtttggatgtgtagatggcaaccattctcaagcacctggtactgttagtgttactggaaaaggcagagaagcagatctccatttaggtgtcccttgttaaggaactagcagacttcagaagacaagaaggatgagagatttgcaaatcgatgcaacaagaacctaggactgccagataagctgcagatgtttttgtggtatttgaaattgtaagagcagattttattatgacacaaaaagacaatagaaggcccacttggcaaatcatagttaatgggaggaatttatcattgaaacaatgtttgagagagaaaacaggtttaggagagagatccgtgaactgatagaaggaaacatggttgacactatagcgggaaagtacacagccacaaagcataatcagaaattagttctcttcctagtccaggggaaatgtgagctctctgcatattgtgggactgtaagtgtgtttatccttactgtattcaactttaataggctgctgtcctcaattttaagagattcgtataattcgagaataaaccattaggaggaatctgatggtggcacaggccttatgtttttatgcttaggtcaaagtaaatgttagagtaatttttcaaattggctgcattggaaaatttcccaaattatcagctgcagtccctgattattgaaggccatgagtaaaagaataggattagtagattgcatgaagtaggatgagagagggacgtattttattacgtgtgaactcggggtggggggcagtggtggtggtcaacatcagcaattttggatgcttacagacttcagactctcagcctttagtgtgcatcagaatcactcaggccctgttaagacacagaaggctggttcagggatctgggaattgttctttctaacacgaccccagtcagtgtgacattgcttgcctgggtactacagatagagaaaccaccacaactaaaggtttagatgagatcaggtgattgattgaatcatatgatgaagttgaacacggtaccctaagacattttaaatccgtgaggccttgcttctctgggttgccatattattttgaatctagcctttgtatgaggtatactactaaggtcaggaacagctggaaacaacctacttagggatagcagaggacaaaccaggaacagataaacactgtgaagaagagcttgatgctgaggctgagttgttctttctagaaaagaaaggcacactggttggttagcagtggtaaggccagctgtgcattttgaaactgggaagcatgggcagtgtggagaggccacagtcacctggaggggagcatgcaggagagcagggccaggttggtggggtagtgatggtgggtggtgtaggcaaaaacaaaccctgtgtatggaattcatgtagcacagttagacgcactcctttactttttctcccatcagaaaagcaaaatgaaagtataaataacttagctagccttaaagcaaaaataggcatttgcagatgacttgaaaagcaatagcgtgtactaacagattgattagttgtggttaatcactttgtgtcacctcacgcacatttagactcctgaagccgtggggccttgccatcaaatgtggccactgaaatccacacatctgatcatgctctgaatgaaccgtttgaaatgaaaaagtgaagggttacttctcactgagaagtgactcaatttaaaagtttaaagggacagtttttaatgttgtttgtttcttgaattttgctcaggattaaatgttaaggagagcatgaggagaatggatgtaacactctttcattctttattacctacaggggtcatctcataatgaggaaacctaagaattcttgggttttatggacaatcgctctttgattatgctatacacttaattctacacattgctgaagtgcagaggatcattctcctttatccctgttgaccagtacagagccagaggggtggacaaagtggttagctcgctgtggcaaaggagcctcaggctgggcactggacacctgtgtctcactcttcctctgccactttcaggctccgtgaccctgggcaagtcactcaacccctctgagacttagttgccttttctgtaaatggggatgataagcacacctatctcccaaggtggttgtgaaggttagataagacagtatatggaaaatacttagcccaatggagctctgtgggactcatgggcttattgatctggaggtggcagagtgacatggggtctaatgtggacaagccagtggacacagatctttaataggctctttagttggattcattaatgagtattcctgagtagcaggcatgttctgttgcctaggaagctggagctgtttgcatttcttcctgtcataagggaaaacggaggattgacagaaatgaagctttttatgaaagcgcattctagttctaagtgtgtttccagcaccactgttagcagataaaccaacacacttttgtacccattttgcactaagtacagaggaaaaccagagaagtaaagacaatgttgaaccctttaaaagctaaaatctgggactatatgaaaatatattaaataacttggtaacagctacaacacaatgtatcagaatttaaaataaagaataggtaaattgtgacatgaagtatcagcatagaaaagaaatggatataaggttagtcccattgttatctctgggagattttttgttagaacatggagatactttctttcttaatctgtgagaatccttgaactggttttcttctgggttgttatcccagaagcctttatactttgattaaaaaaaaggctaagcttttatggatttcatgttgaaactatactgagtgttggcagggctgaccaagtctatgtcctttaacgttgccacttactagctgtgttatctcaggcaacatcctcattcatggaatgggaccagtaatattatagtaagggtgttgtgatgattaagtgatttgatacatacagagaacggtgtccagtacatgatcattgctgtgtaagtgttagctattgatattacttaaataatctatacttttcaaaaggtgagtgacattaaccatccctgggagtcgtccttgcctccaagagaaatctagacactaagaatttgaaattcagtgataataattttccattttcttgatcataattaataaataataaagcatttctgttatgttacctgatctgactgtggattttgaagttaaatcaactttgttttaaatggaaagaacttgaaattttccattttatcaccttgttaagtgggacatgaaatttgtcaaaaaactcattttcatttattgtaagacctcagtgtttcagaattatattttgtttttgaactactataactttgtaatgattttgattaagtttatataaagccaaattcagctcttttatcttttcagtttggttcctaacacctcatatctttttctcccaaaatccttataaaaacaaacaaaaagctctacctacatcccttctgtaaagagaaagccgctaatctcaaattcttaactagattgtgcagtttgcacacattttggcttgtcttgaagtttgtatttcacctgtctcagaagcagacagacccagctttcattagttcttagaataatacctgctgtcatggattaagcatttggcaggtctttctttccctgtgtacacataccaaatgttgggagttagaggaaattaaaacacttgatttaaaaaaaaagcaaccagtgcttaatgcttttgatttttaatgtgacagtaaagtcttggttatgattggcttgactttgtatagttgtctgcattttagatggaatgcatcaaaatcatttaatatttttgtcaaagctttttatgtttatatgtaatgaatatatattaataaatggcatgtctctatattttgggctgttggaatatgtgacttccccagaatccagcaatctagagaagatagccgaaataacactattgttattcttttcattgtcaaacttaaattactctttttagtatatagactttttttatttaataaaacagagaatttacatctgagaaatctatttcataagtaactttgatagtaaacacaagttttgctatgtataagtatatatgtgaaatatatactttttgttaaaattaagtttatagagcagttcaactttacaattaagtagcaacctgaaaaattggagatcatgaagtagaacagataagcttaaaattagtgttttctccacgtttaaattaagaagtggatatgtatagccaaatctcaatttaatgcttcctagggttgaatgtttgcctcctaaaatgtgaaaccaagtttgcgaagttcctttcctaaaatattttcgtgtttaccaacttttcttgggtttcgttcttttggaaaataatgttgatgagtgcttttcttccaaagcaactaaccaacagaaatattaactgtgggtgtgttgtatccttcgcagaagtcaatttctcatgtatgccatttaaaatgatgacatttctttctgtttgaaagaaagtcttatattcttataatttacctccgtatttggaatatttgagtcataccaaggattaattttggtttgaaatagaaatgattgagttaaaatatagaagtatattcagctgcaaatgaacttttcagcataagaaggaacacttctaaaataagtcaaggattaaaactgccaccagtagaactggaacttgggcagctggtgacaagctggtgttagcattggcagcacaaagggagcaatctgacatgagaaggaagtgggaccaggtctggaacaatttctcctgtgtgtcagacacaaatagtcttttcttcaatatcaggcaagtatgcattacattcctgttttatcaactgtccccccaccccccacctatggttaagtcaagataaaacaattttaagaatcctctcttcgtttgagttttctttaggtcttaaatcgagtagtacataagtgctgtctcttacccatgctctttagctttccgacttttctacttagctgcatagtaacatctgctctctgatgatgtctgtggctccagaaatacatacagtagatgcaaagtgcaagctctgaggccactgagaagctgtgatggcctggtgctctgtggtgagcaggccacaaaggctgttttaccgacacggcctcgaatggtctgtcttcagtttcaaatggaaaagatatttttgtcagcagttaggctgtaagtgtgtgtgtttggaaaaggagacatttgagtatctacaactaagcatgaagtcacataattacctgattacgtttgttgagattggcagtaaaatcgctggggaaagacagaggtaggatgttcgtagctggtggacagtggttggggagaaagtaagcagtgggactatttctaataatttaaaataatgcttacaaatcatttttttcataaagctaaacattagctaaagaagttgtttattagtcctcattgcacatttatctttccacactgtaaaaactcaggtccatggaattgtacggcggtccagttcatttaatacgggtcgaattgagcatctgtataagaatccccaggctcacattgaaggaagtaagtcattttctttttctagaatctctttctataaggtgttttcagatgttcctatgttcagataaggtgttttcaaatgtcatttttgtcaaagcccaacaagtcacaattacttacccatgaattactgcactgaatacgatttacatgccttgaaaaccttccctgctcactgccctaggccgtagtgtcatgatggtttggctgttagaaggctatgaagtagatggcttggagagaccaagaaagggcatgcctttgatcaccgctctgcaggtgtccttatcccctcaagtaagagcagttccacactggcagtgcaccgacccgctttttatattcagtccaatttaatcaatttaaacaatctttgtacatttaattatttttaaaaataatttgtgaagataggcccaaataaatggcaatcaaaactgttctaaatgactgatcattgtcagcatttgcagttgttttgctgcttttattaatttgtctgtatgcagctgtacagtttatatagcacaagcagactgttttcttgtttgagcttatggtaactcctgaggtggatagggagacccagagagcacattatagttgaggaaatggagacagagaggttatgagttttctgaggttgcgcactgtgaagaaggcagagctgtcaccaggacacagggattttaactccaagttcagcctgcattatgtggccagtttttccagccagcaaggacgatacagtcagcttgtaaaccatatgtggttttgtattcacccctgacccctgcatatttgaaggtttgggctacttgtataggtagtgacagcatcaggaagatgatgcagttgtccacagtaaaaggctttccactttaagtcatgaagtgtgttgtctttgaaaatcattattgtttttgtgcaaagttcagaacagtcctgccactggatgtagatatagatcaatattatgtaaaaatgatgaaaagatcaagttagtacatcacccatccacatgtatcaaattcttatgctaatgaagtcagtgtaaggatctgtttagatttaggagttgtccttcaatcaattatgtcaccacatcgggcattcagtcagggcctaaggttgatgtttataaagtacttgaaaattactagataaaagtatctaaagaaaagagagctgtcttcatcatcatcagtgttatggattgctttagatggtatacatgttattacaaggttttctttttctgaatctcattcttgcagaacacatcttacaaccacctggagccctaagatatgttattgtataacatgttcgtgatactgtgctttaaaaaacatttttctgagtttaccaccaaaatcttttacagacataggcattatgtagctatctttctattatttaggtaaaggtgacagttatattctgctactccagaaccatcagtacagcatttccattttgaccctggttttcagactttccaaatatgcatttcaattttgatgtttttaaaaattgagcttatgttgcttttctctatctaatgggatgtttttgtatcctgaagacatgaagttgcactatggcgatctcactgacagtacctgccttgtgaagatcattaatgaagtaaagcccacagagatctacaaccttggagcccagagccacgtcaaagtaagcattttcattgggatttctctggccgtgtttctgtggcgttctgtattttacttgtgtctgctgcttctcagtgtagtaatataatcactggtcttagtcttcaagttgaattgtcagtgttagtttaagtattaatcctaattgaagtactcatagattttttaaaagtctcttgtctgttattaaacaatataataaaaccttaccactaatattggaatagcagtatttgtttattttgggttgttccctgtagccatgaggcccatggatgtgttttctgccatttcaaataacagattgtgaattaaatgttttgttaaaatgttggaagatgtaactaagtaaaacctttatgttaatatcaatttttggtagcggctaaattactggctgagagaatatttttgagtcccaataatatgttaaaattagctgaattaactttttaattgtgaatggtaaaaatcattggaagaaagctttttagtctccctcctcctcagtgtgatatagccagtgtggattttcccctctattcgcattctggaaggaatcacggtaaacatcacaggcccatccttagggttctagtggtctgcttaattcaagtttttgttgccgtgtcctcctgctcacatgaataagtgaaatctgaagccatgaatgataggagttctatttagatacttgttcagacaggatggttagtggacctgagaaataaaagcaagtaactcttaagttataaaagcccctcaaaagtccagaaaatgtatgaggtttttttttgtttgtttgtttgtttgtttgttttgctatttaatgaacaagtacaggagtcttatttcagaaagtttttcttaggtgattggctatttttctgtatccccatgtttgcatagaatggaagctaaatgcctattctatatacctctgcttgtttaaggaagaaatcatgaactagataaaatgaaaccaagtggagaacatggtgagagaaacatagcaataaactcaatcttataactgattgccagtcttcattatatgtatttctttcaaatgttaaccttgaaggatggctacatatcgatgaatgatgatacctcatatctgcctgtgctgtctatgaagaaacatttttcttttcttaatctgtgatgattctgttctatatccagactttcaccaaagtctgtgaaaggtatcagggtctttaggttacagcttagctatttttctaaatgattctccatgtgttttttcattttggaaagtctcttatgcatactgtgtgcttgagaaattacatcccttctttcctatagagaagcggtgactttttatcattccaggaatgaagactttatttttccctaattgaggtagtcagtctatcttccacattataagtcatctggctgcttcttgaccttcctgaccagccatgagagtatcttccagacaaaacagaatgttttggaatgaacattctgttattcagtttcctttagattaagaagtttcctttgtaatcatagatagtttatcacctctaggagctgaaaattgtaatgaaagatgcagaaaatttttataaaggtttatttatagaagaccttccccttgtcatttagtattaaatgggctgattctttcctttccccaaaacatatttatagttcagaaatatgttatagttggttttcttagttgtagtgatcatgatagtgttttgttatcgttctggtgtggttgtactgtaagtaatagaaatcataggctattgagttggttccctctacattgctacacatgtgaagtttatctttttttatggtattttggctgcttttcttaatggttagttaatgggcggaaatggcactcttcagtgagaattttggtttgtaaggtcatttaatcttccaacaaatatttgttgagtgcatacctcatgcaaggtgtcatgcatggtacagtacgaaaagctgtgtcagatacacctctgctgtgggggtttcaactctaggaggggtgattggcacaagtgtctgactctttagaggagggtaagagagaacttccgtctgggggtagatggatagtgcgaggcggaaccgacactggctctggtgttgaggtatagagaggacagttacagagttacagacgtagcgggaaactaatagttgaaacgggggtaataatatgaggcaaagagaagtgggaaaacttggtacatgtttgcagcatcatgagcattcgagatgagctgagcagaaccagtatgaggagaagtgtgaggtaaggtcaggtaggaagctgggctgtgcctgggcagctacccatgttttgaacgggggaagatatattcagtgatgacttctagaggtaagagtctagaggtagggcttaagaagagctaggaagttgctggatgaggatggtgtcactagaaatgggggtgggagtgaggaatgaaacaggatgccaggtggggctgatttctctatgcactgatgtggtcactagagaagagggaaacccagggctccagtgcccaggggaccagaaggtcaatagaaccagtactagaaaccgacattcaaggaggaacttttggagtggggttggagaaataagttcccttttggaaacattttactggcgttacttgaaggacattcaagggaagcaggctataaggtagcttcaaatatgctgtgagttttgagagagatctagggtacagagctgtatattcagctcttgaggtcttaaagatgccaagtagtaactggagaaagacgggtagaggactgaagattgaatcttggaaacaggttgatagtgagagggtgggatgaggacaagtagggctgatgactgaagtggaggaggcagagggtgggattgtgccatggcagtcaagaaattgggtcattgcaagcaagaggggatgaggctaggagaatgaggaccaggaaaagtcaccggccttgccagttaggccagcgaggatttgtgacgttttaaagaaacattttagtgatgtgacagaagaacttggccagcgtgcaaggggtttagaagttgagaggttataagggaaatgcaaattgaatgcatttttttccagaaatttttatgtagagggacaagagagaatatgatgggtaaagcttgtagcatcatttgtgggttgccaggcctctcttcagaatccttgattctttaggtctagggtggggtcttcgaacttgcatttttagggtgtgtccagatgatgctgtccctggtctgggaaccgcactttgagaacccttgttctagtgtttcaggtttcttggtttatccaaatagaatatgttccttaaatgctttcttcttagacctttgcctttaatatataggtttttgagtttgatgtaaaataatcctattacttactagttaatgacttaatgagcttttaaagcccaaaactacgtctgcagtcaggagttataagaatggaaagcgaatatgatatatgtttgtatcaaagttcttgatattcagaaacctctttttctgaattgtacatagtctgagataataaatacttctcaagtacttagtatgaacagctcctcttagaatgtccttcgaaatccctgttccataccactgtttatgctgtgatctgtggacaggcttcgtcatggccagagcgggcgtggggaaggggcctgggatgatggcgccatgtgatcacagactgctcatctgtcaggttgctggcagcatgctgctgtgttccctcacctctccagggctctccatggtgggttgcaattgtttgtttgttttctagtagcttgttagggaaggaattaggatgaaaaaatacatattttgtttcttatagttaatttctctatattaatcagctttgtagaatttattgtattcatagatatatttagacaaaaaaagttacttctgacagtgtaatgtttgccataagattaattaaatttcttgttatttggtttggtgtccttttgaaaaaaggtcctaatattagcacacatttgcatttaattttgcacccgtgacttctagactgggtgttgtttgtgttggcttctgtttgtatggaataaagtctcctaccgctctcacttccagttaacttgatgtgggctagggtatgctaaaagtaaggaaaataaaataataggaagttgctctggtttcctgtaggaaaccagcgaagatgaaattggttcttggaataaacccacagaagtctgggaaatactgactgaagacatttttctgaatcataaacagaaaaattatgactcatgaagtaggtcattgaaaggctggtttgatcttatgtgggagaaagtgagagatgactgaaatgtactagttattaaaagaagttaaacctagcatgatgacatcatccaagtaggaacaaattatccaatgcgtagtcctgcccatttgatggagaaaatgttttaggaaactgctttttttgttgtggttgtgcggttggttggtttgtgtattttttgctgtgtaagtaatagtgttgcttaattgtttaactttaattgctgtccggattttcgattcgtcccccatgtcttggagcttctttaataatcttaatgtcattttcaaagtagtggtgttggtgagatctttctacagtgaacctagtgcagtatttctttcctttgcctcacaatgccatgttggaattgccttgatttttctcaaagaaacaacagttattccattgtggaatgtgtctttagtggagacagaaagtcacttagtcttttttttagttttgaaaaggattttcaaattctttctcagcgttacaaaccatgagtgtgtctttctttcactttctcttactcagattgaataacccatactttctactccttttctaaccctttaaatatctgtattactttccttttcaagtctctgtgtaagttatttgtttaattttgtttcaggactgctaggaggcatgagtgcctgggaggtacactgggtcatgaccatgtggcaggagctgagatttcctcacagagttgtgcgggacaagttagcagattctgactgtggaagccccagggggttgagtctgaacactcctccacgtgggacttcaagcttgggatgccagtcaggaggcagagttgactgtgagtcaaggggccagtgcgttagtgacctggcacgaagttagaatctaggagggatgagacagaaaagctagttaaaggaatggaggtgggaataaaaatagccataggaattaaatctgtggcccctgggaaagggcccaagaaactgaattacctaagctaaagaactgtcatctccagtgacattttcctggtggttctgagagttgaaatccgtaccttaatagctgacccccatattcgtccccaggaagcctgaacctcttggggctgttctaattgagggaggggggtgggtgaacaaatacattgggagaattgcattatgggggggaagggcggttggtgaaaggtgggagtctatagttgaacatctggttagtgcctggctaacccaattatagaacaaaacaaaattgcaacagcgtggccctttaccgtgtaattacagtaaggatagggggtagcctattaaaaacccagagcaaacagcagagagggactgttcttctgtgttcttgctcattcatttatttattttggaccctggggagcctgacagggaggtgtgagtagagcaggaaagtaaggagcaggcagggagcgtagctattgctgttagaaggaaagagaagctgttagaacatcctgaaatgtggatgagggcctggcctgtggcccatacaattgcatgttagcattcagtaagttaacatgtgtgaatacagccatcggccctttacaggccctgtgcccagaggatgcagcggggagacattatgtccactactggaacagacgactgccatggggcagaagagaggaatgttctcacaagaaactatggtccaggcaaggttatcaaatcaggggtgcatatcacggttcctgggacacactctaaaacttcatatccaggtccacaccagaccctgggtcttggacttttctgtggcttaaaatcctggtcacgtcacatgctcactacatgaccctaagagggcacttagcctttttatgcttctgtttttctcatccatgcagcaagcacctgccttaggctgtgtttccttaagatgtgattctacctgtgggcctatgtatgtggacttgactgtaactctttttccctagatatctacttgtctcattcccttaactacactcgaacttaagcatcagcttctccgtgaggccccctgaccatcctgtctccaataatatctctcctgggattggaccctcaccaccccaagtcctgatgaaggaggcaagcagtgaatgcagtgggcatgggggaaaggaaatatgcattggccgctgtgtgtcctccttcacttcagtcccagtgtgctgcctgctcacagttcagtctaacttgaggcaaattatctagagaaatggatgggctcaggttacatagtcaacatatccgtctttgctgtttctgcctgggactgaggcctgtcatttgccttagctgctgttcgaaatgattgcaagaatgtcttcctcattcaaataactgtatttcctgccaccaaaatgttaacttgttatgatgtattctaaaggaaaaagtgatgttttggatcctttgttttttaataaatgggctctagaattctaaagtggcaaagattttggcacagagccagctcaagcacttatttcacaggtgcccacctggacgtgcggttcataagcagccacacgctacctagtctccagcccagatatgatgccactcagtcttcctgtcacactactaagctgagaataccgaggtgggcagtatcgttgaactgtgaggggaagataccgcaggactctgatactttatatcggacctcttgtcattcccactgtttactacggtgaaatgaagttttggtgcatttgagtttgagtttaaaacattgttctttccttgctggagggaactggttttaattaataccatatgaaagagtatttgaatagctagaagatccccaaattcaacaatgccaggtgcaatgttagcacatcagtgatactaacataaaattaatatatataatatatacagacaacagaaatccacggtactaactcatcaggaatgataatcatctttttggttagggtagtacaatttaattcaatataaaatttaaaattttgaatatctacaccatggtggtttgtaagttagcttccctaaaagctatgggaggcaaataatatttgctacaatttcttaatgaagacgttgttagaatgagcagcttgttcctattcatacaattatttttaaatgaaattgtcaagtcagttatataagtataatgtgaattaacctattttctaagatctaaaaataaatatttctgctttagcactgaaaatacatttttgtccatatattagtatacacaaactgtaacttcatattgggtctctgaagataacttattttgcttagtatatttatgaatcgatatagtttattatgatgttatatgagttttaaaactcattgttttcttgtcttatgtaatttttagatgtgctcagagcaacataaatcactctagtttgttagcaaattatgaatgttcaaataataaagattccttatgagcagaatgctttacttgttaaagagcagtgagtactttgaaagcctgaggattaataaggtatgtttgcatttagacctaatatccctgcatactatagtgccttttgtgtctagaagaattagctctcttacaggtacagtgagtaggtgcttggagcaaagactggatacttttaatctctgtgaataggtgatgtggatggaacaaacctctacggtcaagtaatgttacggttttgtttgtttttgttctacaagctcccatttctttctgatcagtcctgttgtcccttcacctgtgtggacacagcccccgtgataacttaatacagtttgtaaccacttttatttgttacagcgcaaaattgcaatacgaaacctttttcattttataatttcatgtttaggtttataatgaataaacaccacgattgtaaatatgactagtttattcccatggttcttaggaagaagttgagcatgtttgactttgtattcatcagggtaggcaggagtgtatgctgttggtgggtgcctgtgtgtcatctggctcagattcttcttggaagcctgttgtagatttgagcaattgaattcaaatctaaaaccacttaaaaagtcctttatagtccattaagaatttatatgagagagaacactctatgaaagttctcctctccctgttcaaacagattgttatgttttattagagctaggtggtattgtaattttgataacagctaataatgtttggaattttgctcataattaattagtggaccacacaaagctatgcttgttgggtttttcacccttaatgtgtttataaatagtggcttgtttactaaataaaatccagagtagcattattttagtattgcaacattattttatatatattaagctaaaattaatacaaatagctaaatgaacatatttaccacaatattaatttctagatgctatttataaaaatggtgggtaaagagtaagttagtaaatacactgtgagtaaaacttttccttttttttttctttttttgagacagagtctcgctctgtcgcccaggctggagtgcagtggcaccatattggctcactgcaatctctgtctcctgagttgaagcaattctcctgcctcagcctcccgagtagctgtgattacaggtgcccaccaccacgctcagctaatttttgtatttttagtagagacagggtttcaccatgttggccaggccggtctccatctcctgacctcaggtgatccacctgccttggcctcccaaagtgctaggattacaggtatgagccaccttgcccagccaggattcttgattagattacagtatgtaatttacataaattaaggtgaagacataaatgatactttgtttaataccataatgtatctcccccgcccccaaaatttgtatgtatatttaaaaaaattagacttaatacctcttttaaaatacatagtaaagcttgatattaaatatgatttctactttatccttacatatggcggagtttataaaatttgccttgttaaagttggatccttaaagttagtacggtaaaataaaatgaaatcttttctagttcaaaaaatgtaatgcgtaagaattttttctgctactttgtactgtaaatcattaattggataccttaccagtgccagcaagaaataaatcatatgaaaatggtttgaatgtatcagatttctattttttgaaaaatgtctaagatcgaagatgagtgattagtaggtatcacttttactctttgaaaaatggcagagtatgttcctagtttggaaatgttaatttaaagtgtaatccacagcgaatttagatttgctttatttataagaaaccgcacatcaagccttggtttggcatgttacagctccgttaacagtttatcgttaagagactgattctttagaaaatgttgcaccctgaaaggttagctcaacttgtgtacggttctagtgttgataattaaagtgaaatgtttgccagagaagaggagtattgtgttgatagcaattatgcagttattctaaatgggagctgatagagaagaggcagcagtttcgcacttcttatgctgtttggtatatcagggtaaaaaaacctgttcctgagtttcttttctactcccattccatatatttcattggtgccaggtttttatttttttagtatataacagtaaagtcttttagaaattagtggtattgacaaaataaaccttttaggacattcttcaagactgtcaacccacattattagtactgatggtaaataaccagtctttaccctgagtgcatggattaattgttacatggtgtaggggacagggtttttttgtttgttgtaacattcccatatggctcacactagagtgcctttctatttgtttgtttgacactaacttatcttaggacaattcagagccagtatggtcagtcctaaaggggaggctgagaggctctttagtgtggtctgatacatttctccatcttccctagagaagaagtgtttgaatatttgacagaagttagtcgattattatgtcacaatatttgagttattggttgtttacataatgtgtgtaaataattttttcatctgtttgctttgcatttgctttatattaaatattaggaaagtgttttggtttagtgatcatttctttttttttttttttttttttttgagacggagtctcgctctgtcacccaggctggagtgcagtggcgtgatctccgctcactgcaagctccgcctcccgggttcacgccattctccagcctcagcctcccgagtcgctgggactacaggtgcctgccaccacacctggctaattttttgtgtttttggtagagacggggtttcaccatgttagccaggatggtctcgatctcctgactttgtgatctgcccgcctcagcctcccaaagtgctgggattataggcgtgagccaccgcacccggttaggtttagtgatcatttcactctatcatttggcaagatatttagattgcaatttagcaaaaattaatttatcttattggaattatttacttaagtgacttaaaatttcaacttttgtttttcaagcataagttcatcaaatttgccaaattaaaatttatcagcagcaataatggaaaaaatctattggttatgttcaataatattatgttaaataatgtaacttcagtcatttttcagttttataaatttgcttcacagagaaagaaatggaaatttccaataagctttacgtttgtgtagggaagcaaattatccctaaagcttccttcttcatccctctagattagagacatgattgtttttgaaactgaggaagtttctggtgtgtttaagaatgttgtgctcttttatacacatagatggcagcaaagaattagacaaaggaagtgaaccttgcagttgtagtgaaagatgagtgacagtacaaactgactccatcagcatagctgcctgtgtctcatacttaaacataaaataagaaagaaagctactattgataacacaagaatataggagaacgaagaaggctctgagaagctgtaatacactgaatttctggacaaatcccaggtggggaagcttaatcttttaaggtatgtcatccactcctgtaagatgattgaaatcagctaagataatatgcatgtcaaaataaagagacagtgaagggctgaggggcagtagggccagagggaagtaaaagagaaaccacgcacaagttgcagcggcaagcaatagcctgctgcctgcgggcactgtggagtttggcctgcatgtctcctctttagttaagcaagttacaaagaggaaatgtcagtccacgaatcaggcaaacattccctgggaacgtttgctcaaatgtcagcattttagaaaatagaactgtagtctattatggttcagtccccatactgggtttgctgttaagtgcacaagcacaaatatattgcttaagaatgcatttgctattaacaagtcattttatgtcttaattaacattcctaaataatgacataatcactataaaagatgacagtcatcattataattaatatttaatatgtgtgtgcttccgaggacctttctgtggcttctcacaaatttccaaggtaattttcaagttttagaattgcatttggtgagatcacagtcatgaggatctaatgaagtagaatcatatttagtagaaactgagattcggaagtgagttgtagaaaagcaatttgtaacatgtccttaacaatcccatcacctcagtatcttactaattataaacgaaataagggcttcttaatgccactagagtaatgctaacattgtttaggaaaacatttctcctaccctctattttttttctggtctactctcaggaattttagtaccacagactaatctctgggtcacaaaatttattctaaaggtgtgtataacaacgtgcttaaaagcagtatctggcaagtctctcttgtgacagcaacgttatttctgacataattattttcttagtaaatttgatatcttaacaaccccttccctcatttctgagttcaaaaaataacacttaatataatttatttctcatacttaataaaagcttacttgagagcatattgccattcatcctctagctgcttcccccaaatgaggttagaagggaatgcggtttgcgagggtataaggtggtttccagcatcgtacgctgtgtactgtaatgggcctcaatgttgttttaatgaagcattaaacatattctggctgttgcttgttacttattaatgattaattggttatactctgtcatatcagtagaaaaagaagatatgtatgtagtttttctgttttaagcagtctactgtgttaacttcagtttgtatgcacagatattatctgtgttaccctaatatttttagtagtgtaggcggtttgaaaacaaggacaaagaaaattctgatgtctaaacacataatcttgcaattttgtgaatttttaatttaattaaatggaattttataagttgaactttcattatcatatatttcttaaaaccagggtgtaagataattgaattagtcacaattacataaacatttctttataggtcatttttgagatagcaaatgggttttagattaaaaggttgtttaaaaacagcttttaatcagaatataatatgttttgcaggtgactgcgtactttttcttttacacttttagcccctctttggcaggcattagatttagactgtgactttcttaatgcaataacatcgtgcagattatttatgtgaccttttcactgccacggttttcattaaacggacagtattgcaacaccatttccttcaattgcttggtttcaaaagaatcgtgtctcaagcaggcaaatctaagtgatttgtgttgcttactaactgaagaatattgttttaaaactttttttaaaaaccagcatattaattttcttcatattagcactagaacatttattttccttgacaatattttataaatattttgcatgaataattaaatgttggataattaataacatttttttcaatttgcttataatttttaaatgggcttttaaaaatgatacactttatagtttttgatgccctttttaaagtctaaaaacagattttgtatgaattataggggacttcaatgttttattggcattttataaccaattttaatttatgatggctttacatttgtttacgtgactacatcttacaaaatcttagatatttgaaaaatttccagtgtagtataataatagcttaagtaatacttgccttgtttgtctttcttacttactttaactttcacatggttaattaagtagcattcctgttgattaataaactagagcgcacactgttgtttgaggttaaaataccaaagttttgtgcttatgatacttagattttcctttatgtccaaattgtcctttcttttatctgatgtaaaatatttaaacatatatagatactttgaaaattatttaaattgatagatgattgcatgtaatcacgaagtatgttttctcatgtggccattgtttttcaatgaagtgttaatggttagtggaaaaatttgtgtaatataaatgccctaaagttcaattttggcgctaaatttaattgccttttttcccccacagtttgtgtctttattttagataaacacataagttcataaatgtattgctcatatttcgtctttcttgaggaatggtttcagatagatttgatatactttctctcatttcgtgggagattcttttctctttctctcagtttctaactggggattccacttatcaggttgaaccatcttacatgatgatgattcttggtggtgcaactttgttggcacaggatccagagactaatccataaagcagttactggatttccaatgtgtgaaatattagtttgtccctttttcttgtgttttttcttctgaaaagctttactgaaatttcattttttattttctctcttttttttgttttttgtttttttagtgtttttttaccatgctacttatgaaagaatttcctaagaactttcccaagttctatcacttgggaaaagatgtgttttaactacaacagaaacatcccggttaaacccttatctggtcagagatttttagttcctagccagtaaaaaactgttttttataatgtaacataaattacatactaaattagtactttcagtaaaaacttttcagtaaaattttgacacttaaatgctcactttttaaaaaaaaaatctcagtaatgtcaggtcataggcacatgaaatgtttaatacaaaaattgcaatatctttcataataacatagaagttaacagagttttgactaatcttactcattttcttgcattcttacagaaaatactagtacaattgtaacctttagtgaaattagttctttgtaagaattacatttctatatgtaaaacaactataaaaagagtgccaagatttaatgcgtgccttcacttttcggggacgttttattttttccactgtaagtaatcttaattccagatgttagcacatgacattttgtgtagtgcccctatcacatgtttgagtttttttaacattagctctatgatctgatgctatgtatactatcttgactcgtcagtgatatagattttgttgctgtcatttagtttttattaatagtcttccatttgtattagtcaaacttaaaggcatatgtttgttgccacatacaaaatattttacggaataatctgtagtttatttacattgtattgtgacgttagacctttctagtacagctttataaaataaaatagttggttgcatatagaggtatcttattgaaacatcagtgtaatgataaaaatattaattgttgtaatgtttaggacattagaagaacacagatgtggccaccttttgaaaacttagaagttatttatctcataggaatttgtaataaatccaaaagataactatagggttaacacatggaatgacgatttcactatattggcaatttatttacatttctttaacccaattttaattgtaattctgtgatttaagcctcattgatttatatttttgattggtatattgaaatataaaaccttctaaattctaactagcacagggtactttttctttgtcatgtgaaattaagggaattaatcttgtcagaatttttataatcatgtaaaacaaacctgtgaggaagacacatagtctctctgggcctcagttttcccatctgtaaaataggatgtgaggctttgggaaacaggtaagagttatgctgtatgttctccaagatctcctacaaccccaaaatttcatgattgtccaatttgtttttgaagtggtattgtgcttatcaatataaattacatgtcctgtctaatgaaaacatcagtgttaataaaacctaaggatgaaaagttcagtttcttttaaaaatcatactttttgggagaaacaattgtcagatattagcatataatggtttttctcaagaaatatttaaaactttatataaagttatcttgcacctttttaaaaacttaatgcagaatagtggaaattctgggatggaaaaggcattatattctattttgtcagaaagtataaattaaagttaaatgctgtataagcttttggtcatactgttaatatggggatatcttatctagagaaaattagtatgtgaatattttctataaaatagaaatctgaatgaagaagttgatttgttttcttacaggtaaataaatatacatgaacttccatgaaatgattctgaggcatgtaaataaatttaggtgccagtgttaattttccacatttagctttggtatttattataatttacagacaattacagtagaacctgttgtgccccaaaattgctcaccagggaaaaatacaaacaaacctatttcatgccgtaactatattgactgtataggatgtgattatgaaaactaagcttcttaatactgtactttcactcaagtacaactttgcagaaatttctatttaacgaattgatgcttttttgtggggaaggggaagtagctgtttggagaagtagttaagtttaaaacacatatttgatttgtataataatagaccattattggccactgtagtaaatgtatgctaaatgagagtttataatgtaaaaatagtggttaaacgtagatgacttagagaacaaaaagtaaatgttttaaaaatgtgtctttataagcgacagtattgtagtatcccaagcacagcacaaattccacctatagcagaaaaaaaatagttaaaagttttaattttcaaagcgtccttttttgttaattttttacttgaataagggatttctgttgatttgtagagtttctaaaagtcaaagaaaaatacttatataataataaaacttttcatcttaactgtcattgtatttaaaccttggattcccaagtaaaagattccaggatttatagctagcatagattcaattattttaaagccatccagattccattttcaatttagtggcatttcatactgtcaaggtggcaaacttgttcctaagttagtttttttaagcttattatcagccatagtttaaccccaatcaagacattcctaagaggtttactccgagcttttataagtttatttatatgtcttgtggaaattttcagttcagtgcagggtttgctttaagtgtttctcaactaagcgtataaaaattagactttttctaccttttatgaaattaccataaggatttaagattttgtttctaaataaagttataaactacgtacaaattcttagattggtgtttatccttgttaatctatgatagctaaaaatatttcaagtagattactttctttattactaaattttccttatttgaagagtaattataaaaataatttatgtggctgggcgcggtggcttacgcctgtaatcccagcactttgggaagctgaggcaggtggatcgactgaggtcaggagtttgagacctgcctggccaacatggcgaaacaccatctctactaaaatataaaaattagccgggtgtggtggtgggcacctgtaatcccagctacagggaggctgaggcaggagaatcacctgaacctgggagacggaggttgcagtgagcgagccgagatcgtgccactgcacaccagcctgggcgataaagagatttcgtctcaaaaaaataataataataatattatgtgtaattttcttattgtcccagtttagtttttttttttttcttaaaacataagggagcattgaaacagctttatagtttgttttcacatgctttggtagtttgaaagttgttttgttttgtttgtttttatagtcgtactaaatttagaaagtacctgcaaataaattctatttaatggtaaccatttatttatttgacatgtttcttttgtttgtcactatcctaaccatgtagactggtaattgccttgctacgagaagatcctagtcttttctacagtcaaacagctaggttttagggcggaactggagcctagagtaaaggctcactttcttaactcttcactgggagctaaagctcttcttcccgtggcctctcccttgctttgtcaaagtatgacatggatggattgcttggaattctttcaaagcctttcctgtgtaataatgatggcaaagatttcaggcatttgtcaagggccactagcatgtgtgtgacagcagtttaaggggggaaaacagtggatttattactaataaaatattaaaactcttatatttaaagccaggcataatttacattcagtttcacccctcgtcgttttagctgtccattttctacttaagctgcaccctctttctcttcccagaagccttcatcctccttttagccacccccgcaccaccatctccttccctagataggtgataatgctcagtcgccgaggggctttgactagagccatctgttctactctctctcaagaacaacagacaaggcattattctgtgggggcttgtgtatacaattatctacaataataaaatataaaactacagagtttttagattccaaaaattcagtgatctgtaacagcttccattgggtttctgggtgttcttgtaattcattttttcatttattacctggaatttgcaaactttttttttcttttcaaatatattttctttatatttttgtacagcatgatatcattaaaatgatacctgttgaattcacattgtctgttagtatatatacatattatatatctgtctttagtgactatataaaaaagacaactattctttgactcttaaatatatgggcatttttatatataaaatttacagtcactaacttaattagtctctagatgtgtctgtgtacacatacatgtaatatacgtacacacaactaaaatataaagtcatgtgttcattgtgacttgtttggaattttagtgagataactgtacttggagcttttatccatctgtttgaatggagaacctccctttttggcataggtcaaataggttttcactgaccccaagctagtgagaattgtttttttctatttgcttttgattagtcctagaattactgagtaatatgtggacttcccagctaaagaacctatttaaatgttttttggaactaactatgccgattgaattgtgtttgacctactgacagctgttacttagcttgtcatgctccttaaaatggcaaatcattaatgtagtcctttccactacattagttaacataaagtgtcttatttctgaaatagacacggtgaatgtttccctgactaggttgtgcttaaacagtgttcaagtttgtaaatatgttgttttctgaaacaaaaacaaattctagtaataaaaacaaattaaatatatatgtttttacttggaaatcataaaatatagtttatttctctgtacaggtccctgctttaagacactggatgtataacaacaaatcacatggatatttacttctttcatttcacgcctctttttaataaactttctgtttcacatcattaaaattaagatctacccttttactctgcaaactggaggagagttatataatgtcatagctgtacctctaattaataatggggttgaactcactttatagatttagaaattctggcgtttctttctgtcaaatgcctcttcctatcctttgtccattcagtttttattgctaatttgtaggaattcctattaactttttatcaggtatatatgttgcagatatattcttccagttgtcacttctatgcttgctctatctgtgatgtccttcacagaacgtaaatcttaaatttcattgaggtcaaacctctctcccccttttttgaggggacttgagaattcttcttttggatagcatactttccacaattggtggatgtctttcagcttctttaaaagttgtcatccagcacattagatatatcattgaaagggtttatatgctagattgagtttatgttcaaatgacttccaaggtttcatccaactctgcaattctaagattcccgtatattaaagagagattaaaaataaagtgctctgtctatgaaatctacatcacatttgcaagaaacactctgtatttcactgattctgcaacaccgattttcagatgcatcattattttatgtaccattaggaaagcacaagctcttctgattaaactatgactcaactctttctcaccactgagattcttaatattttatacttattgataagcttatttagatttattgagacatggatttgtatcattttactcttgtgtatatgtctaaaacaaatagcaaaatgaattgattactttgcaggaaaatacagaattgtagacatccgtcaagtggcagatgttcttaagttaatacgagtttgtgccccactgagtattttagttactttctatgtttaactttttattactgaactatagtgtcattaagcttaagatgtgtaatacctgaagcatgcactatttaactcaagtaactggcattaacagtgatgatcaggtgtgcacgtgatcaggcaaggacaactacaccactgcaacctggccgactgcgattgtaaggtaccacctgattttggggataatagaatatgagaatatgtacggcattctgtgctatattgtaaacctgggtgcacgtgtttagtgttttgggggagtgtggcatctgctccacagtttctagagaaaataaccattcatttgattcttagtgagaaaatttcatagagaatcatttcattttcagtgttggtatagttgtgcttcccatactgtgcctccgttggtttaacacatcaagaaatgtagcagctggaagagattttgcaggtgtctatgcttatcttttatatagtgcaggggtcttttctgtagcttccctgaccacatgtaagagttaatgtgtgcttccgtatgactgcctttgctaggagcctgatctgtatttgggctgctttctggtgagaaaagtcttccttatattgaacccaaatctgcttctttccagtctctgtaccattgattctaactcccctcaacccctaaactgcaccaaatatgcctacccacttcttaggtaagttctcctttaaaatgtgaatgttattcttaaatctgctccgttttttccaagtacttaggtcatgactgtccttatagaatgtggtactgaacacggtacatggcacgaccgtcttctcttttcagcagtctagaattgtatttgctttattggcagtcatgccatgctgttgagtgacaattaaaatgcctgtgttttcctcagatatttggtctcttagctatatttccttgtgccccacttatacagttaatatttggacctagtagaggactttagatttatctttgttaagttgcaatcttgtagatctagctcaaatttttctagtctatacaaattaaacaaaaaatcttagtctgttatacagtgtctaattgtaatcatttctagtactttctaacgtgtgcaacatgtttctcagtgtgtgtctgcctcactgtcacatgtagtgcacaggacagtcttgtgaagagagctcttgtgtccagtagaatcttatcgacattggtcttcagctcccttgggagtggtcatttagccagttgagaatctccctgtttccgcacaaaggcccacatttcattatccagtcatgaataactggatgtcatgaagaacttcattgaggcttcaagattgttgggaaattatcacaggattgtttcttgagaaatctgtctcccaccataagcactgttttccaggtcttcctaacaaatttcaaatgaaattttaataatacaaaagtgacataatattagcacaaatttggaaaaccaaaaaaagttacctaaaatcttaacaccagacctatgtttttttctttttttttttgctgcttttctttctagtctgttatcagatatttctgacatacacacagtcatgatatgcatttaatttgtatcttttttagaatttaatttttataagatcatcttctttttgcaataagcaacatttcattggctgtgtaattgtatgagtctttcaccttgaagaataatgcagaataatgatttttaacctcatatttatattgagcattataattaaaatgctatcttatgcatttttctcatttgtttggatcctctccctggttatctataattggtactattgcagtcattaacaactattactagttttttaggggattaagttgaatctttgctgatcatttgaaacaccctgaatgtttcttttaaagtcaaatttatatttttgttttctcatcattcatcttttacgagaaacagaatgcataatgcaaaaaacaaaggtttttggcttatttgtacttatttgtgttttttcaagtgttttcgctgcttcttttaaatatgagaaataatgtttcatggtcttgtagacctgtttttctttaaaagtagagatttctcaaaactcaataagaatggcttaaggtaaatatgtttggacttaattcacagtccgtgtagttggacgtggaaagactggtcacaatggaaatatttgacttggtggtgagactataggtttcctgctttgtcttacttttatagttttggcatatgtcaatgagtaagttcaaaatagagcccagaaaaagaggataatgaataatttttgttttatggatttgtaatctggtaactactggctgaatacacatactccttcatatttcttgacaacctcctattatctttctgtatctatcattctgttttatttagaatatcatttatattgctattcaattaaaggttgttttttggatatctaaaatgtccaacttatacctatggagtttttgcatgaattttttgtttttactgttggaagaaatgtactggattctgagtctttctagttctgtttaagggtacatgtgtagcacttttttaggcatgtcggtgttagagaatcttctgtgttcactgctaaaagtccttaaacgtgtctctacattttctagtaccatagaatctcagtgtcttaaagtcatctaggttgactctgcatctattatttgtatattatctacatttccaaacaaatctgttacgtacaataaatgcgctaaaattatgccagacacaacacatttaccaagaatataattacaatagtctatatgttttgttatactttagtgtaggtatatactgtaatagaaaacacaaaaagtgctgcataagctgggatgaggtgatgattaattctaaggatgggaaggtttaggggaaagagtgatgtcagggaaaattgtagaaagggcaatgtgtgagtagaatgattgaagttatattttgccaggtagtcacagaaggggactggttcagggaacagcacagcttaggcaagattgtgtgatggtgcatggatacttagtgtggattaacaagtataccctgaaggagtagtttagttcactactactaaccggtcgtagcagttcattccatccacaaacaactctagttgaaagtctctctccatagcttattttacacatattatttctaatttctttccttgggaatccatgtaaaattcattgtttttgtatatttctatttttaatatttagaaagggttgttcccatgaatccactcttccctgagtcctggcccaaaccaggtcatatagccctatccttgtagttgctctttttgttatgtagattcatggtctgtaactctcctgattttttttttcctttttctgagatagggtcttgctctgtcgcccaggttggagtgcagtggtgccataacagctcactcagcttctcaggctcaaaggatcctcccacctcagtctcccgagtagctgggaccacagctgtgcatcactatacctggctaattaaaaaaaaaatttttttctttgcagagatgtccaggctggttgtgaattccttgggctccagttatcctcccaccttgccctcccttataggcgtgagctgttgtgccagcctcctgattcttatctgccaagcacatcccacttgtctttatccttcttaaggtataatgctcagaattaagcatcttatactaggtgtggcctgactggtttggaaagaaataagactgtcattttctttgttctagtgactaaacttatgtttttcagactaaaagtatgagtctgtattggtgaccgtatcaaactgttccattgtccagtcacattaaattacttacactgtccttgtagctcattatcacttaacatttattgagatcctgatagtccaaagaggatggatagaatttgagttcctagtaatggaaaatggaagaactaagttcatttcccctgaagagttttaatgtgttttgatccattgaagttgttaaatgtatgagcctatgtattatacagctaatggtagtttggatctccttttgatatgtgttggtttcacatctatccaaacatctggtgaggatatttcaaaccacactgggttttctatcagcgtactttaaaagtaagcaattccaactaaacattatgaagtcttccatactataaaccaagaagcaatttagttggcaactcaaaagtggaatgtagaatgaaaatgaaatgagataaactccccccacgaggcagtccacagtgtacaccctaaagggatgaatgctgatacagtacataaagtgtgcttttataaaagcttggaatttccaaatatttatcatggcagtgttttatgcttaaatcacataatgaatatagtgtcatttttctttttagttctgttatgctgatagtttgaactaataagtgatgagactcgaaacttcagctaaatccttcttcaatactctaaagcatatattccacttcagttgcagaagagtcgttcaaattatttaatgccactatagacacagtaagagtatcagtataaaacatagcaccattccaaaaacttttggtttttattccactgtaattaagattgagaaacaaggatttgtcgttgttgttctagcttatgattggaatcctagaaagcaattttaaacaggtcgttttataagcttaagagtttaaaaaatctatttctgtttattcaggttgaattttgctttgaaaatgtaagagatttgttgatacttagaatatacatcattgtgagtattttctatgtactgttggttgatggcctaataacagtttttagtggtgtataaatgtgtttataactatcgtcagataaacttgttaacctcagtttttcagatactgatttctttccgaagtataggaatttcttatacatgtttcctactctttaccatcggatttgggaccaggtatttccatggctgaccacaacactttttgtgtagagatttgaatttattgttttgtttcacatccaggaatttggtaggctagattatttggatcaaatcttctattgaaaacaactaaaatgcagaatataaaattctttaaaatctccttaaaataattgaagaactaactacatggtaagccattatcaggctgatacttgtgggaaagtagaggaggtaagctacaaatttaggctgttttgatcttgaggacatttgcccatttggcaaactggaacttcattttgacagtcctatgtgatcaaaggcacagaaatcaaagggtcacattcttagatttatggtgaattatgcctaaaccctctctccacatggccccagcgtgttccacaggaaaagtacttttgtgctacgcagagcaggagtggagggggattcctaagaaggtgtaaccacaagtagaccctcaagcatactgtaatccaaagacgtactgcttgggtagtccagaacattttaaactcaggatttagttttaggagtttgggaacttgtgtaagtcctaggttcctgacacaagccaacagaatttctctctggaggaagttaccacaaataagacccaagaataagttttcaaaagcagtgaacaacacatagtaaaaaataaccaggcactcaaggaaaaagtctgatgagacctctcctcttacatctccttttctcttttactttgggtgctgcttctctttttccttctgcttctcttttctttcttattatctattctcccttcttcaacttttgtagctgttttatttgcattgaaaatcatcctctactttgtggcctcttgaagcatttattttattttgttctcggttctgttgctctggttaagtccttccttgtcatctcacaaatagtctattgttagaaccttttagttgactttaattttattttttcttcctaaattcaatagtaaatcaggttcaggctaattaagtctcttctcacaatccttcagtagtttctctgtgaaaattcctgagcatgacttttgatttccttgtaatctggccccagataaaagaactaaaaagtattggaagctgggggaatgattgagcaccatttattcatgacattcatttccatactggataacagtattttaaatgaatctatacgctgtttgagaaattagttttttttgttttgttttagtattaccattggcttttcgtgtagtgatttacacataatagctgcccaataaatgttcactggatgaattaatgactaaagagagaacagataaaactgttcagtcacctgcctcccttggcacatgttgcctctatcaaggataaagggacaaggaccagctctgacatgcttgttgtcacactgtggattgtcctttgtgctctcagtttctcagtgtatccccaatacccattgagttatgcatcttatctgagcttcagctctcttggtggtgggatatagggaaagagtggtgccaacataaaccatgcttagggcatgacatgaggcctggattttcctctcttgccaggtggagtatttcatctctaggatcaagattgtgatcagaaagaaccagtgttctctaatttacagagccagtaacaatgtcattcattttaagtaaagtatgcatagaaaatttctatctcaataaaaaagagagatcaggaaactatttattttgtacaacccaaagacttaaggaatttcgagactggaagaatgtgtgagttatcaggcaagatgaggttgataggaggaacctgcattcactggtggttcattatagtttgcaggtctttccacgtattatctctttttgtctttataccaatcctatgatacaggcaaagcagattcctattattaccattttacagacaagttaatgtctagctagcctttctttttgcaaacgaatcacttagatcatttctggaagcattagctgaatacctcccatatcccccacactctgctcttgattgcattttttttctgatctccgctatcactaattaagctttgtaatctcagcaaaacactgactgttttcttccataacattcttgtttgtaaaatctgtactctatatcacagcattttttttttttactttctacatctcattttaacctttctagccacctttctttcctccactccagcatatgagcatattactttgtagacaaataaaataagtaaatgctgaattaattgttaagtcaaaagcttctctttcagcccttttaggttaggaaaaacaaagatcctacttggcataaacaaaatgtcaacagaagatgcgcaataatgtctataaaaatctgaggacacaaaacttgggcaatgcagataatctaccttgattatagggacttcactcaatctaacattctggcaaactaaaaacttctttgatgttgataatatttgagagcaaataggcacactgtgttaggtcttgggataactaaacgtccaagacttatttttcaggttcataagcaagtgaacaacattcaagcaatactaaaattgcgtgtggctaagtgctaaaacatgaagtttacttaccacagcagtcattgagtgcctactttttctgggtactgagaataaacacagaaatctgtccttaaatttgaatagtgaagatgaaattgtgggcctgagtgcaaattgtctcttctgttagagattttcttaatgagaatatttctgttaagattgagttcagagagaattcatgaatactcaaagattattgatgttactgatgttgggctcacttcctttctgatagattattatcactaattaatttgttacattttgaggccaaatttttcaacttaagtaaataaatctacatttaggatgacaggaagaaagaaaaagtattttcatatacaaaagaagtaatcatcatttcttcaaataaaattgtaagaactgactattggtttactaagtgtccatctaatcaagaaatgaatcatgacagctttccttgtccatctaatctatcctgtcagaacttctgaggatccccaaagcaattcgttctggttggtggcatctatgttgtgtgagaacaataccaaacatgtgcctgtggtgggagtggaaaggcccttaggaggtgaaggcactcatatcctcataaattacagctgtggtcataattctttagtattttagctcaacatttcaacaagttttttatgttaatattttatttggagcaatattgtgattttccaagtgatttctcttatggaaactcttgggtctatggaggacacagacaaatatttcagagcttttttattgctccagacagcagcaaacacatggcaacaataatacactaaaaggaaaactattatagtcggcctgaacattcttcgtcaaagcccttctttcataatcttggccataaagggcctggaaaggcatactatcacctcttcattgtgttattctctgccagcacgtagcccagaagggaaataaaacacatttaactgatgtgcacaggcagaagaaaatctatcagcaactttctgtgaaatgtctattatatgaattgaaaagtatgtaaaagctgggagcagcctttgtcactactgaagttgtttcgaagtccccgagtcagctgcagaacggcagctttggggaggagcagcagcatgctggttactcatggttggctgttcccttctgatttaagtggagatgctgcctggccagtgtgccttgaaaggtctggattttaacagagtagctctctgtatcgtattagaatgatgggaattctaggtgtgtgagccacaattttctattgtgtaagatcaatgtctttgacttgtgtgttagcacaaaagtgttgcttctagtagagggatgaaaagaagaaaggggaggcagggtttcattgaaactgccagcctctaggtcagtgcacatagatagttactgcctcaggaggcacaattgctgggtgaatggtaccacagagattgatttagagtcatggctagtgggggtgttctacatgtcatgtctggaagaaaatcaggtgtgtttttgagacagtgtgttttcatgtggagcaaacaatcaaaaccagtgagtgagagcaaccccagcatgaccattgtttcctcacctgtgccacactctctgtgaagagttgtgtccacactttagtttatttaataatttgatgtaatctgtattgtatccctcattttattcagaaaataagctcagagaatttttatatcttaaggccacagaattaatgaatgacaggagagcctggattaatgaatgactagagagttcaggtatgcctgactttagtaatgtctacatttcatggttggccaggtgtggtgactcacgcctgtaatccagcactttgggaagccgaggcaggtggattgcttaagctcaggagtttgagaccagcctgggaaacatagtgagaccctgtttctacaaaaaatacaaaaattagccggtgtggtggtgagcgcctgtagtcccagttacttggaggctgaagtgagaggatcacttgagcccaaaatgttgaggctacagtgagctgagatagtgacactgcactccagcctggatgacagagtgagaccctgtttaaaaaaaaatagttagatttttctcttccgaggagactgatgtgcaaaaaagtcagagaaactggaaggaagtgcatatgactgctaaatgtgtaaggtaaggtgcacagacaattaagaataatgttaattcaagatgaaatattataatcagagttatttacttagtgagaaaagaaacccgatttttttatttagcctaacatatttgctatactaaaaagccacaggtgattcacaagaaaaaaataagtgagaaaataatgaaaataaccatgttacagatacctagggagaaagaaaggaataaaaaagataaggtcacgagagtggacctgggtttgccttaaagatttctaagctaagaaaaataatttttttttttgcttctttcatggaagagaaaatactttcataaacttaaggatctcatgacattggttaaataggactgtagaagagtagacttttctaaatgtgaacatgttcaggtattttcctaggcttcatttgctttgtctagtaaaaactggtacaaccttgaaaaatgatagggttgctaaatttggtactgacttctgaatttggttgtggttttatgtaactaattgcaagactggttctttcactttaatagtgtcagaaagtttctgatgaaggggatagtcctctctggtttgctcaaattatatgtaaacccactcttttacttttgagaagttgaattaaagagttttatttaggccgggcatggtggctcacacctgtaatcccagcactttgggaagctgaggcgggcggatcacaaggtcaggagatcgagaccatcctggctaacacggtgaaaccccatctctatttaaaaatacaaaaaattagccgggcgtggtggcgggcgcctgtagtcccagctacacgggaggctgaggcaggagaatggtgtgaacccgggaggcggagcttgcagtgagtcaagatcgcgccactgcactccagcctgggtgacagagcaagactccgtctcaaaaaaaagaaaaaaaaagagttttatttagattattttattagagctgcttgctgtgaaatgaagggtaattgagtaatctagaatctgggagctattttagagattggaaagtttgatcatcatctgctacttgaacaaataagcagcttgtcaaatgtgagtccaaccacttgatgaaaaagggtatgtttatggggtggccacttgttcatttgtttttaaagtttatatgatttttaaaatctcttttctccctcaaacctctcaaacgcagatgcctctacattataggtatagtacttggaaatacataaattgatatgaagagtatctatgaggaggaaggaaaaggttaattaagttttatgtaatcaattgtaatttttataatctgacccaagactttagccaggaaagtaagttacttgcatttacctaaaatataaagtgtagcacggtattttgcatatagagggcatttgattaagtatttgttaatttggttttctctgcccagaactgtccttgagacatataatttgactgatttatgatttattataacttaaatattatatattttagctttagctgtttcttcttattcaagttgaataatttctgttaatgtgggccattgtaataccccccaattaactggaatattttgttagaaataaacctccacttgagtatatctgtcaggatataggatatcaatagcaaatgataaatataccataatttgcagattagttgatgatggacttacccaataagctgtagttatattaagactcaaattgcatgaaggtttgtgagaaatcagagacttgattgtaaaatgaaggcaaaattagctttctgagggtataggcataaccttcaactcttgattatctagaagatgtttgggtcaatctttcaaagtagttagaattaaccaaaatatcagaagaggtgtctgtattctgtattcagtgtggcattttcatttgaatgatttgatttttccttcttaagtggttgttttgaatcttgtttttctgtccacttcatttaattttacaacccattagagtaagtcaggatgtatttatggtttttgtgttttcttggggctgccttagatacttgacgagttgcagattacttaataatggtaatactatggttgggtagctggattagatggaagatttgctgttgttggatggtctgggctccatccaggctcaagctgtatggatgtgaaagtgcaggaagtatgattaaggaagatactagcgtttactaagtgctcgacatcgtgctaaagtgttaaaggtatctaatcttgtattgattaaaagccacagtgccgtgtttctaatcccactgtctgattttaccctgagaacctacatttgccaagtgacttggagaaattgtttaagttgtttatactcaattctctgaaaaatttgcagatacctgcttctgtgttttataaatgatgatgtttagtgggacttttaagaattgtagaaatgggattgtggtttttcttaaaaagacatcttgtgatgaagaatgaataggtttgaatccttgtcagtaccaaggtgtgtaacttactttaaccacctttacccactttggggttcggttttgtcatccagtgaggatattgaattagataaatattttgaaggcttttgtttaaatgagtgcaacccacagtaagaaatatgttttataaaacattatagcacagacacatgttgaaaacagaaattttacaaaccagtatatgttcttacagtgtgcaatatttctttattttttaaaagtgtcattaactaaattgattttgtgacccataaccattactttcagtttgaaaaacactgttttagatgctctcagacagctctttcagtgttaggatttataagtgagatttaggatttaattttgttatttttgatcaaagaaatgcactttgagtttttagcaatgttgagctgtaatcctcattgtaacatggaggggacatgataggagcccatgcctgcaattttatgaggggacctgccagatagactgctgtgggatatgtggggccctgggccgctggcctggccagcagcagtgacactcttctctttttgtctccttctgttgactgtctccctgtcgcagtacctcattctttgtgctgccttactttcctgattactaaaagaaaatacttgaagtgcatcgagggaatgaccagtgagccctgtggtaaatgtcatcagctgatgggttcttgaaaagtccatggattttgtttgagtgtgtgtttgtgtgtgtgtgcgcacacgtgtgtgtaaagtagggaacacgtatcatgtgtcttttatctcattactttcttcatcttgaatgttattactatgcatataattgtttgtatagctgggatgaacgtagaaatagtgttccatcatgtaagaacaatgagggtatttcctattgtggctaaatcgcctgaactttttggcagtggtgagattgagctgggcattgggtttgttacaccacattctgcttgcttacacgctcctggaagtcagacagttttgaagtgggtggtaattgagaggccaccttcgttgatatctttttgcttgagagagggagaggggagatctcagcaataaacatatctattctggaattccaaagacctcattagaacagaaatgatgggtcattcacctacgctgaatttttcattgtgaatattctctaaaacagagagaagggctccagatcaaacccatactgtaaggaggcctacaaaagcaaatcggtacactgtggtagcatagagtgtggcttgtggcctgtgactttcagggttgtggttaatcttattgctaaaatgcaaacattggctttttttttccccctcaaagtcagcctaggtcaggggagcaagctgcagaactgggtaatgtaagttcaaatgatgaggtgatggaagggctctaggacaaggacattccagagcagagggatgtggacagacaagcagaaggttgtctggaggaatccggaggggaagtcctgatgaaagactttgtgtggtccttcataaggctgttgggtgttcagggaaagaaggccgagccatcctactgagctgcacagagagggcatagagcagccctctgggactgagccattagcagtgtgcagactctttgtgtgtagccagagaaaaccatccggagttcctagggcatatttttctgtcctgattgttttgttttgtttttttttccaccacagaagtgctgattttaccatatctttttcatctttcaaaagtttaaaatatagaacatgggtttctcactaagaatctgacattttacgtttactaacacattttaaaacaaacctttgataaaaatatttaaagagtttttgtgagactattgtatgagcccatacaatggccttgttaagttgggggatattttctcagttttacagaaaattgaggctactataattattcagttgggccatatgaaattgcgatcttgtagcacccaaatacagtagttgaatatcagcagtattaggttgttcaacctaataacttacctgagatgaaatacccaggaagtgacaggaatggtattgtaattcagctctgatgacaccagaattaatcttcgcatttttatactttccaagaattggcctgcttggacctgtaacaccagtgccagtgtacactgccttggggcccaaggaaatgcatgctcaacccactgctgctatcatggggcctgaagactgacttacctgccaccccaggccctagcaaaacgttaccacagcctccactaataactgcaccataagctactgaggaaatcacagataactggtgctgtgtacagctgaagaaatcttacagagactacactactgcatacatctagaatcatagctaaagtgccctacccaaccaacaccatagatacatgttcaaaacaatgccctcccctgttaaagtaaattcaaaaaattgaaggcagtgactgacaccagatgcccaagtagcaacataaggatgcaggaaacatcaaaaagcaaggaaatatgacatctccaggggaacacaataattcttcagcaatgattccgatcaaaaagaaattcacgaaatcctgaacaaataattcacattcttgattgtgaagaagctcagtgagataccagggaattatgaaaaataatacatagaaatcagaaaaacagtgcaggatatgaatgaaaaatttgccaaagagatagttatcataaaaaagaaccatacagaaatcctgaaactgaagaattcattgaatgaaataaaaaatgttagattcaacaatagtctagattaagcagaagaaggaatctgacaactcaaagacagaagacaggtctttcaaaataacctaatcagacagaaataatgttaaaagaataaaaaagaataattgaagccttcgagacatatgggatactataaagccaccacatatttgaatcatttgggtcccagaagacagagaacaaaaggattggaaaactcatctatttttttgttattaaataatagatgaaaacttcccaaatctatcaaatgatttagatatccagaaacaggaggctccaagatccgcaaacatatacaatgcaagaaagtcttctccttggcacattatagtcaaactatctaaagtcaaagacagaattctgaaaaaggcaagagaaaagtgcctagtcagttgtaaagaaaaccttatcaggctaatagtgaatttctcagcagaaaccttacaagccaggaaagaatgatacattcaaagtactgaatgaaaaaaatgctatccaagggatactatatctagcaaaaatattctttgtaactgaaggagaaataaagtcttccccagaaattgcttaagggagtcctaatcctgggagcaaaatgactacatttaccatcatgaaaacttatgaatgtgtaaaacctgctaataaagcaatcacacaaaggaataagggaaagtaattaaatggtacctgtacggaaaaccaccaaaccaaaattagaaaaaataagtgaaaaagaaaggaatgaagagtatataaaaccagaaaacaataacaatataataggaacaaaacctcacatgttaataataatcttgaatgtggaaggattgaattttccacttagaagctacagcctggcagaatggattaaaaattaagatccagctatatattacctgcaagaaacacactttacctataatggcacatgtagactaaaaataaaggaatggaaaaaattactccacacgaacagaaaccaaaagtgagtaggagtagctatacttatgtcagataaaacagactttaagtcaaacacagtaaaaaaaaaaaaaaaaaaaaaaaaaagacaaggtcattatgcaatgacaaaggaatcaattcagcaacagaatattatggctctaaatatatatgtgtccaacactggagcaacaagattcataggataaatattactagatttaaggagagagactacaatacaataatagtggggaactccaaccccattctcagcatgagacaaatcatttagacagaaagttaacaaacatttataaacttttatttaaactggattttagactacctggactcaacagatatttacagaacattttatccaaaaactacagaatataaagtcttctcatcagcacatggaatattctccagaatagactgttaggccacaaaataggtaacaacaattttttaaaacgcaagatcatatcaactatgtcctcagaacacaatggaataaaactagaaatatcaagaggatctttggaaactatacggatgtatggaattaaacaacatgttcctgaatgacgattagatcaattaagaaattaagaaggaagttaaaaaatttcttgaaacgaatgaaagtggaaacacaacataccaaaacctgtgggatacagcaaaagcagtactaacatgaagtttatagcaataaatgcccacatcaaaacagtagagtttaaataaacaatctaatgatgcacctcaagaaactagaaaagcaagaacaaaacaaatccaagattaggagaaagaaagaaataatgtagatcagggcagagataagcaaaatagagactaaagtaacagttcaaaggatcagttaaacgaaaagttgattctttgaaaagacacaaaattgataaatcactagcttgactaaccaagaaaaggagagatgacccacataaatcagaaataaaaaagaaattacatctgataccacagaaatacaaaggttcatcagagactatcatgaacagctacacactaacagactggaaaatctagaggaaatggataatttcctggacacctaccatctaccaagcttgaatctggaaaaaacagaaagcctgaacaaaccaataaccagtaacaaagtcatatcagtaataaaaagtctctcagcaaagaaagggctaggagcagattgattcttggccgaattctaccatatgtataaagaagaactgatactaatcctcttgaaactattccaaaaaattgaagagaaaggaattctccctaactcattctatgagggcagcatcacccttataccaaaaccagacaaggacacacaaaaaaagaaaagtacaggtcattattcttgatgaatatggattcaaaaatcctcgacagaatactggcaaactgattcctactgcacattgaaaagataatacaccacaatcaagtgggctttataccagggctacaaggatggttcaacatatgcaaattaacaaatgtgatacatcacgtaagcagaatgaatgataaaaaacatacgatcatctcaatagttgtagaaaaagcatttgataaaattcagcatcccttcatgataaaaaactctcagcaaatatggcatagaagaaacatacctcaaaatcataaaggacatatatggcaaactcacagctaacatcatactgaatggggaaaagttgaaagtctttgctttaggaacagaaacaataccaggatgcccattttcaccactcctattctacatggcactggaaatcctagcaaatcacacaagattaaaaaataaaatgcatttaaattggtagaaaggaagtcagactgtttacctttgagatgacgtgatcttattagaaaaaaacaagactaccacaaaaaactcttagaactgataaacaaattcagccaagttgcagaatacaaaatgaacatgtaaaaatcagtagtgttcctatacaagtataatgaaatagccaccaaagatatcaagaaggcaattctatttacactagctattaaaaaaacataggaataaatttaaccaaggaggtaaagatttcgacaaagcaaactacaaaagatggatgaacgaaatagaagacaaacaaatgaaaagatatcccatgctcatgaatcaaaagaatttatagcatttgtcaattttggcttttgttgccattgcttttggtgttttagacatgaagtccttgcccatgcgtatgtcctgaatggtattgcctaggttttcttctagggtttttatggctttaggtctaacatttaagtctttaatccatcttgaattaatttttgtataaggtgtaaggaagggatccagtttcagctttctacatacagctagccagttttcccagcaccatttattaaatagggaatcctttccccattgcttatttttgtcaggtttgtcaaagatcagatagttgtagatatgtggcattatttctgagggctctgttctgttccattggtctatatctctgttttggtaccagtaccatgctgttttggttactgtagccttgtagtacagtttgaagtcaggtagcgtgatgcctccagcattattcttttggcttaggattggcttggcaatgtgggctctcttttggttccatatgaactttaaagtagtttttttccaattctgtgaagaaagtcattggtagcttgatggggatggcattgaatctataaattaccttgggcagtatggccattttcacgatattgattcttcctacccatgagcatggaaagttcttccatttgtatgggatctaattaatctaaagagcttctgcacagcaaaagaaactaccatcagagtgaacaggcaacctacagaatgggagaaaatttttgcaatctacgcatctgacaaagggctaatatccagaatctacaaagaactcagacaaatttagaagaaaaaacaaccccatcaacaagtgggcgaaggatatgaacagacacttctcaaaagaagacatttatgcagccaaaagacacatgaaaaaatgctcatcatcactggccatcagagaaatgcaaatcaaaaccacagtgagataccatctcacaccagttagaatggcaatcattaaaaagtcaggaaacaacaggtgctggagaggatgtggagaaataggaacacttttacactgttggtgggactgtgaactagttcaaccattgtggaagtcagtgtggcgatccctcagggatctagaattagaaataccatttgacccagccatcccattactgggtatatacccaaagaattataaatcatgctgctataaagacacatgcacacgtatgtttattgcagcactattcacaatagcaaagacttggaaccaacccaaatgtccaacaatgatagactggattaagaaaatgtggcacatatacaccatggaaaactatgtagccataaaaaatgatgagttcatgtcctttgtaggaacatggatgaagatggaaaccatcattctcagcaaactttcgcaaggacaaaaaccaaacatcgcgtgttctcactcataggtgggaattgaacaatgagaacacttggacacaggaagaggaacatcacacaccagggcctgttgtggggagggatagcattaggaggtatgcctaatgttaaatgacgagttaacgggtgcagcacaccaacatggcacatgtatacatatgtaacaaacctgcacattgtgcacatgtaccctaaaacttaaagtataatttaaaaaatccactttcctgtaaaaaaaaaaaatttatagcattaacatgacaatactgctcaaaggcatctactatatcagtgcagtccctatcaaaatagcaatgtcatttctcacagaaatagaaaaaataattctaatgttgttatggaaccaaagagaacagccaaagaaatcctgagcaaaaggaataaagctggaagcatcacactctctgacctcaaaatatatttcaagactatagtaatcaaaatatcatcatatagctataaaaagttatatagaacagtggaacagaatagagaacccagaaataaatctacatacttataacaactgatttttgacaaagacaccaagagcatacgttagggaaagtacaccctcttcaataaatggttctggggaaaattggatatccacatgcagaagaatgaaactggacctgactttctcccagtataggaagacttaaatgtggtcaggcatggtggctcatgcttgtaatcccagcactttgagaggctgaatcaggagaatttcttgaggccaggagttcaagacccaccttggcaacatagtgagaccctacctttgttaaaaataaataattaattttttaaaagacttaaacgtaagacccaaagctgtaaaactactagaataaaacatagggaaaacacttaaggatgttgttctagacaaagattttatggttaagatctcaaagcacagagaactaaaacaaaaatagacaaatggcactatattaaactaaaaagcatctgcacagcaaaggaaacagtcaaaagaatgaagaaacaacctattgagcggaaaaaaatatttgcaaactattcatccaacaatggactgatatccaaaatgtgcagggtactcaaatagctcaacaataaaaaaaatcccattgaaaagtaggcaaagcccataaatggacaattctccaaagccatgcaagtggccaacaggtatttgaaaagatgctcaagatcactaagtgtcagggaaatgtaaatcaatacaaggatgatatatcatcttaccccagttagaatggttatcattaaaaaggcaaaaaatagcagatgttggcaaggatatagaggaaagggaactcttgtacactggttgtgggaaggtgaattaatacaaccacttatggaaaacagtatggatatttcttagaaaactaaaaatagaactgtcatactgtccatcaattctactattgggcatctatccaaaggaaaggaaattagtatttcaaaggcatacctgcacttgcatgtttattgcagcagtattcacaataggaaagtgaattatggaatcaacctaactgttcatcggtggacaaatgtataaagaaaatgtggtatatatacatgatggaatattatttggccgtaaaacataatgaaagaatgaaatcatattatttgcagccacatgtatggaactggaggtcattatataacccaggcacagaaagataaattccacatgttgtcactgatatgtgtgagctaaaaaacttacccttgtggcagtaaagagtagaacgatagatgccagagagtgggaaggatgtgtgggtggcaggggttggaggggaacagataaagagagtttggtcaatgagtacaaacatacagttagaagatgtaagttctaatatttggtagcagggtagggtgactgtagttagtgacaatgtgttgtatatttcagagcagctagaagagaggacttgaaatgttcccaacacatagaaatgataaatacccaaggtgatgaataccccaaacaccctaacttgatcattacacattctatacatgtagcaaaatatcacatgtgctctgaaaatatgtaaaatatgtatcaacaaaagtttttgtttgtttttaaagcagcctataaacagagtgtcattttctgaatactaaagatattccttttttatgcatctggtaagtggcttctttttattctgcagactgatgctctgcctttccaggatgccacgatgatgaagagtaaccagatacatttagaaaaggtgcctctccggggcccagagctgttgccaaggcgcactggtgcattcggcacaaagcggtgcgggcagaaattaacatggtctgcatcaggtggaggctgtgttaattttccctgtgcactgactgtctaacctaaacatcccatggtggaaacagaaccattagttggtatttctagggaagggacattgagcctcagatgggttaaaacaatatttgcaaaaagaaaatagtctattaatgaagattatctgaacctgagacagagaaaggtcacacactcagcttatttaagcaaatagaaattcacaaatgtgtttgtgattttaccagttatagcaatttcaagtattgaaatggcatttggaacaagaagatggggttcaggttagagcacagtgaataacaaagtgaaaatgttgttattcttgcagcttatagatacctcattgtgtttgcttctgctaaatgctgatgaaatggtcttgaaagagcaatgcctgttgttcttggcttctattgattttgttccatgcagtgtgaaggatctactgcttgtcctaaaatgatgaaattgtaagaagattggttttggatgacagccagtatctttccttaacttcagtttgcagaaattggtcacccaaaaacaaaactgtaactcccagaatccactccctactcctatgaaactaaaacttagagttcatgctcctaatagctttgagagaattggaaattccagcatattttggagcaataatccatgtttgatcagttttatttaaaatgaaaaggataggcaggctgccttcagacatcctaagcctttgtagatatcttacttttcttcaaatattcacgaggagtaactgttggaaccttcatgaattatggtattgaaggtaaaggagatttgctcccctttcttttagaattttgaacattttactggatctcaattgtagaaacaaaagtttttaaatgtaaattaatagtggctttgttctaaggcatacatttcctactgtgtaaaggaaaagttaagcatgtaaattgtatccatggccaaacacctacacagacaaacacagacaagcaacacacagacatgcaatacacacacacatgcacacacgcccctgcctggcaagaaccctcttactcacatgtgggtttcttcgctaataaagaattgttctacgaatgcaaagaaggctttttcatcacttttactcttttttccccccttcgttgctttaatcaaagtgtttccattttagacataaagaaagtgaggtataggtatgtgctgtgaacttcccaagatcacattcaaagtaagaaacattggcataagcagctcgagcttggaccgtcttggaattggtattcagtcttcgcaatcatttgcctttttgctatcttagacacttcaactatggcactacaggtccgtgaatggaggtttggggtttgagggtttagaatttttgttctttttttttttttttaaatgtgaagtatcccgtatgtcattgtttttcatagctttttcagttgttaaatgttgaggaagatgcaatgctttttctttgctagagatgctgcctttgggtacatttttagtgtctttactttgttgttcttgtacacctgtagcatttattgagctcctgttaattaagaggtagccatgtgggatatacaaatgtgtacagcattgtctttgttctcaagaaatttattatctagtacgtcacatgggctcatggaaaggaataaaggagtgtctcacacaggacaaactcttgtcaccccttatgctaatgggataaaaggaacatttgtgatttcttagttgagaccaattcatcaggataagaagtagaaaaggtatgtagaaagaaaaataaagacagctgaaatgccctgtgcactttatcttaaaaatttctgatttgggtttcgtaggtaatttaacagggaatttaggatttgacgtttattattctggttttgatccagttaacatctgggatgtgggttcagtagggaatgcttggtggcaactcatgttcttcagaacagatgtgtatgtggacaagagacagagcaagccattggaaaaagagcactttccctctgcttggtgggaatctcttctgttgtttagggtttctgggtgtcatttctggagcaagggcatgtcttctgtgggtagacaagagtgaggaaatatcactaagagtaaatgtggtgtgtggtagtggcagataaagaccaggagagccagtcaggaatttactaagcagtgttccacaggatactggttttatgatatacactctgatgggaatcctttggacatatctgtgttcaggaattggaagaactgcagaaggaacagaaatggaaaagtaggagttgcaggtaagcgtgggttcttaggagccatgggtgaggacgtcctgggaccctggagtttcagtgaggtcaagtgcactgggactgaagaaagcttctggatcaggagtatttagagccatcttttgagacatctgacttttgctatatggtggtcttagtattgataatgcctttaaacatatataacatatataaagaagtgttttcagttcatatattttatgacatttccagccccagctcttgtgacctcatccatcagattgctagatcttaaaggatatgtattactatatcataaatttgcttttcagaatattttgataatggtttttcttttttttattattattatactttaggttttacggtacatgtgcacaatgtgcaggttagttacatatgtatacatgtgccatgctggtgcactgcacccactaactcgtcatctagcattaggtatatctcccaatgctatccctcccccctccccccaccccacaacaggccccagagtgtgatgttccccttcttgtgtccatgtgttctcattgttcaattgccacctatgagtgagaatatgtggtgttttgttttttgttcttgcgatagtttactgagaatgatgatttccaatttcatccatgtccctacaaaggacatgaactcatcatttattatggctgcatagtattccatggtgtatatgtgccacattttcttaatccagtctatcattgttggacatttgggttggttccaagtctttgctattgtgaataatgctgcaataaacatacgtgtgcatgtgtctttatagcagcatgatttataattctttgggtatatacccagtaatgggatggctgggtcaaatggtatttctaattctagatacctgagggatcgccacactgacttccacaatggttgaactagtttacagtcccaccagcagtgtaaaagtgttcctatttctccacatcctctccagcacctgttgtttcttgactttttaatgattgccattctaactggtgtgagatggtatctcattgtggttttgatttgcatttctctgatggccagtgatggtgagcatttcttcatgtgttttttggctgcataaatgtcttcttttgagaagtgtctgttcatgtccttcgcccactttttgatgggattgtttgtttttttcttgtaaatttgtttgagttcattgtagattctggatattagccctttgtcagatgagtaggttgcgaaaattttctcccattctgtaggttgcctgttcactctgatggtagtttcttttgctgtgcagaagctctttagtttaatgagatcccatttgtcaattttggcttttgttgccattgcttttggtgttttagacatgaagtccttgcccatgcctatgtcctgaatggtaaagcctaggttttcttctagggtttttatcgttttagatctaacgtttaagtctttaatccatcttgaattgatttttgtataaggtgtaaggaagggatccagtttcagctttctacatagggctagccagttttcccagcaccatttattaaatagggaatcctttccccattgcttgtttttctcaggtttgtcaaagatcagatagttttagatacgcgacgttattcctgagggctctgttctgttccattgatctatatctctgttttggtaccagtaccatgctgttttggttactgtagccttatagtatagtttgaagtcaggtagtgtgatgcctccagctttgttcttttgacttaggcttgacttggcgatgcaggctgttttttggttccatatgaactttaaagcagttttttccatttctgtgaagagagtcattggtagcttgatggggatggcattgaatctgtaaattaccttgggcagtatggccattttcacgatattgattcttcctacccatgagcatggaatgttcttccatttgtttgtatcctcttttatttccttgagcagtggcttgtagttttccttgaagaggtccttcacatcccttgtaagttggattcctaggtattttattctctttgaagcaattgtgaatgggagttcacccatgatttggctctctgtttgtctgttgttggtgtataagaatgcttgtgatttttgcacattgattttgtatcctgagactttgctgaagttgcttatcagcttaaggagattttgggctgagacaatggggttttctaggtatacaatcatgtcatctgcaaacagggccaatttgacttcctcttttcctaattgaataccctttatttccttctcctgcctaattgccctggtcagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgggagtttttagcatgaagcgttgttgagttttgtcaaaggccttttctgcatctattgagataatcatgtggtttttgtctttggttctgtttatatgctggattacatttattgatttgtgtatattgaaccagccttgcatcccagggatgaagcccacttgatcatggtggataagctttttgatgtgctgctggattcgttttgccagtattttattgaggatttttgcatcaatgttcatcaaggatattggtctaaaattctctttttttgttgtgtctctgcccggctttggtatcaggatgatgctggcctcataaaatgagttagggaggattccctctttttctattgattgaaatagtttcagaaggaatggtagcagttcctcctcgtacctctggtagaattcggctgtgaatccatctggtcctggacactttttggttggtaagctattgattattgccacaatttcggatcctgttattggtctattcagagattcaacttcttcctggtttagtcttgggagagtgtatgtgtcgaggaatttatctgtttcttctagattttctagtttatttgcgtagaggtgtttatagtattctctgatggtagtttgtatttctgtgggatcggtggtgatatcccctttatcattttttattgtgtctatttgattcttctctctttttttctttattagtcttgctagcggtttatcaattttgttgatcctttcaaaaaagcagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacatactgctttgcatgcgtcccagagattctggtatgttgtgtctttgttctcattggtttcaaagaacatctttatttctgccttcatttcgttatgtacccagtagtcattcaggagcaggttgttcagtttccatgtagttgagcggttttgagtgagattcttaatcctgagttctaatttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagggttctgtagatgtgtattaggtccgcttggtgcagagctgagttcaattcctgggtatccttgttgactttctgtctcgttgatctgtctaatgttgacagtggggtgttaaagtctcccattattaatgtgtgggagtctaagtctctttgtagttcactcaggacttgctttatgaatctgggtgctcctgtattgggcgcatatatatttaggatagttagctcttcttgttgaattgatccctttaccattaagtaatggcattctttgtctcttttgatctttgttggtttaaagtctgttttatcagagactaggattgcaacccctgcctttttttgttttccatttgcttggtagatcttcatccttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcattagttgatgcagtttcttcctagtctcaatggtctttacattttggcatgattttgcagtggctggtaccggttgttcctttccatgtttagcgctttcttcaggagctcttttagggcaggcctggtggtgacaaaatctcagcatttgcttgtctgtaaagtattttatttctccttcacttatgaagcttagtttggctggatatgaaattctgggttgaaaattcttttctttaagaatgttgaatattggcccccactctcttctggctggtagagtttctgccgagagatccgcttagtctgatgggcttccctttgagggtaacctgacctttctctctgactgtccttaacattttttccttcatttcaactttggtgaatctgacaattatgtgtcttggagttgctcttcttgagcagtatctttgtggcattctctgtatttcctgaacctgaatgttggcctgccttgctagattggggaagttcttctggataatatcctgcagagtgttttccaacttggttccattctccccgtgactttcaggtacaccaatcagacgtagatttggtcttttcacatagtcccatatttcttggaggctttgctcgtttctttttattcttttttctctaaacttcccttctcgcttcatttcattcatttcatcttccattgctgataccctttcttccagttgatcgcatcagctcctgaggcttctgcattcttcacgtagttctcgagccttggttttcagctccatcagctcctttaagcacttctctgtattggtttattctagttatacattcttctaaatttttttcaaagttttcaacttctttgcctttggtttgaatgtcctcttgtaactcggagtaatttgatcgtctgaagccttctctcagctcgtcaaagtcattctccatccagctttgttccattgctggtgaggaactgtgttcctttggaggaggagaggcgctctgctttttagagtttccagtttttctgctgtgttttttccccgtctttgtggttttatctacttttggtctttgatgatggtgatgtacagatgggtttttggtgtggatgtcctttcagtttgttagttttccctctaacagacaggaccctcagctgcaggtctgttggagtaccaggctgtgtgaggtgtcagtctgcccctgctggggggtgcctcccagttaggctgctcaggggtcaggggtcagggatccacttgaggaggcagtctgcctgtcctcagatctccagctgcatgctgggagaaccactgctctcttcaaagctgtcagacagtaacatttaagtctgcagaggttactgctgtctttttgagccctttctgtgccacatgctgatttttgtgaccttgagcaagctgcttaacttttttgttcccagcttccttatccataacagtactattgggttattgtgaactttataggaatataagtgaaatgcttagaatgacatctccctccccaaaagcactctgtaagtggtctattgtggcatccccaaagaatcagctcatacgaaatcagcctaggttttctgaaaagggcttcctttcttctccccatgccagcttcattaactgaccaggctgccctcacctcaacatcaggccttgtgtcgggaagtgtaactgtcagcaacagggctgcaagagcctgggtgacttggccagagtgggatgaaggggcatgggtaatatagaagaaattgtagggaatcggggaggaggtcctttgggatcctaggtgggggaaaaaacaggttttcccttcacatggacacaatgtctctgtcagcaagccccagggacaaaaacaatgggaaagtattcagtcaagaaggattttgcatcaagtatgtaagcatgattggtcagaatatactttttctctccctctgctcttcctcctcccacacttcggttttttgtaaaccttctattggccttatttcttattctgatttccaaaataattttactaaatttgataaactgaaaaatatagtaattacatgtataatttgtgattattaacaaagtttaatttttaaaaattctgaagtacttctctaaacttttagtatcacttggatcaatgaaaacataacttatgcagggtctacttttcaggtgatgaaaatatgagatctactctttgtattctgaaagccgttttattgggtgccttttgttggtgttttaaatgtgtgagatctcttttccacatggtctgttattaattattcattcttcctatctttatttgtagatcacctatttagataactcaatttgcccgacacttgggcatgtagttatactagtaacatctgttaattcatgactatttttgactagcagtgttaggggcattaacaagttttatttattgctgttcttttaaactgctcatagtacttctaaccttcaaacagctttttctggctcgttctcactccacatttgacatgcaacaaaagtgacttttgtcttgttatggaagtgggccaaattgtttgacataatgacaggtgggatattatttagggctgccgagaccttgggctccacgaatgctttgttccctctagattgtgttttgacttgcatgtttctgacagccattgtggcattcacctcttttattgagtttggaacatgcctgtgagagctagcctcataaaggttttaactgtagtgttagcagtttcttaaacattttacatattaacatttattatagtttcattttggtgttaatattatacttaccatttattatggtttggtttggtttgtttttacatagtttcccattatgaggaatacagccactgtgtttatggctgtgaatatttgtgctttgtgatttcttggccttttggacacacacagaatgtcttgacatgtatttacttacaaattgaaaaaatacaacagatcttaccgtttcaggtaaatgaattccttaagaaattaaaacttttgctgattagatatcttcagtaccagaagtaccagagtatactattacaacaggaagtgataggccaatcccaaatttgagatttattataatactccacaggggtagtgatttatctttttttcttacttttcaataaaaatatctttatttgatacctttaaagtttcaggcactgtgccatgcatgggggaggtagcaatgaagcagacaaacagaaaccttgtcctgggcttgtgtgccacaatttgtatctctggctcatcatagcaaatgccctgtctataggatctcaccaaaagcaaattctaacacagattggtagcagtaatgctgtagctactgttcactgagagctagatgctttgtgtatgatattgccaacccttacaagtgagaaagagctgttactagcttcattttataggtaaatgaactgaggctcagaaacattaattaatttgtcccaaatcacaggtagtcatgagaattttaaaactccagtctttttgttgccagttgttcctttctattatgatttatctctgaatacaggttttagactaatgctattaacttctttttaagataaaatcaaggcattgacatttaaaacttggtggtttggatcaacaaagaaaatggctatttttgtatcttgacttttgtttttttgaatgaatgaaggaagaatgattggccttaaaattttaccagccacatatttttggatacagtttatgtatatatacattatggcatgaggatttttttttctaattttattgcagagtgacaatatatctgtcacggttcttcttggcatcttcacaaatatccacgtcagtcccagtgatcttaagtgtatgggatccctcttcctagtttttgtcacaaggcacagatgtttcaggtcagcaatgcagaacgatcccttatgcagtctgaattttgtttttgagttggacctacttgtagcgttctgtgagattttgcagtagatagatctatttattgaagggagacaatgccccagaagagcgactgctgcatgcaaccatgcaggactctcaggtgcccatccagcgcctcaggtagatgcttctcttgggccactaagaagcttcccctcctgtgaccacagatgggaaaattgcctcaggacctgctgcagggaatattgctggcaggctttctttggtttcttgtgctgatctaggcataattgtggtcaagaaaatattgagtgaatgattaacatatagttctcaattttattcagctgccgaacttgtagcactaggatataatccaggccaactaccttgctgtggcttaggatttcaggttttaaagtcaaaattcaaagctgtaaaaacatttgaatccttttaatgtattgtaaagataaataatgactaatgagataaaatttatgtcaacacacatatttcttcctctaccctctagtctcctattgttttatttggggctgtaataagcatctgtaatgatcattccaactgaggtagtttcaaataatgagggttggtaaccacttcagatttttttttttttttttttttttttgagacagagtcttgcactgtcacccaggctggagtgcagtgacacaatctcggctcactgcaacctccgtctccgaggttcaagcatttcttgtgcctctgtctcctgagtagttggggttacaagcgtgcaccaccatgcccggctagtttttttgtatttttagtagagatagggttttgccatgttggccaagttggtctccaagtcctggcctcaagtgatccgaccgcctcaacctcccaaagtgttgggattacgggcatgagccaccatgcctggcccacctcagatctttaatactgattttcatacacctgaggatagatttggggaaactgccaattcatggaaaaatgctttcctctttttttcaaaataccataatgacttcttacttgatttcatctcatctcagatgtgtgaggttcagggagacagggtgtgagtgaggatggtgggtggtaaaggcggtgaacaagcagctggtctgtttgcaagggtttccagggtctggttccaccttcgtttcccgtccttttcctctatgacctcgggtgcagggtgtcagccacactggccttcttgcagacccaggacacagcaaccgtgctcctgcctcacggccttctgctcccagacgccttcacaacttgcttcttttcttttctttccctttccctttcttttttttttttgtttttttagatggagtcttgctctgttgccaggctggagtggcgcgatcttggctcaccgcaacctccatgtcccaggttcaagcgattctcctgcctcagcctcccaggtagctgggattaaaggcgcctgccactacgcccggctaatttttgtatttttggtagagacagggtttcaccatgttggccaggatgttcttgatctcgtgatccacccacctcggcctcccaaagtgctgggattacaggtgtgagtcaccgcgcccggcccccttctttctttttggtcacctctcagtgacgtgttccctcaccttgtttgacatgcagtctgctcatacctcatccttttctctgcttttacatttctccatagcatttatcactatctaacgtactctacatatttcacttatctgttgtttattcttcccacactaaagtataagaggtccattaaggcagagatttttatctgtgtagcacctcctagaatggataagctagaatggtgtctcaaatggtggtggcccatcgtaggtgcccagtcatcatgatttgaatgaatggaaggagattttctgtgtaatcacagcacttcaaagctagcttcattttgttttgctgttttcaagaactttaaaataaaatatgaatattcaagctgtgcttcctgttgtgtatttaaggaaaaaagaaaacaaaaaaacgaaaaacgagcatcatggaggcctcttctggagtcaaagcagcaaggcagtcgtgatgagcagtgtggagcagaggggcagagaatgcagggacccgggaacagtacgccagggtcgccttgcttgggaggctggacaagtgatcccagtcagtttttcacctatcaaacatgggtgtttgtgtcactgatgtcccttctgtggtttaatgactacagagaacagttttgaagaaaggaaaacgtagcttagtgaaaaaatgagggaggtttattatttgcttatgtattttttttaattttgaaaatgtggttatattatttgttgtcatttcgttaataaagcttatttcataaatgtaaagaaattcaaaaggtagattctaataccaatgttgagaatggggcagtcctactttcatttagaagactatatttattactatgcaaatttttgggggccagtgtctctgagcttcgccctgtcagaattatttattatatatttggggttggtaagtttaaaaagtatttaaggattaaatacatttttttttctttaggagttgaacagtagtgcattttttttttttttttttttgagacggagtctcgctctgtcgcccaggctggagtgcagtggtgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccacccgcctcggcctcccaaagtgctgggattacaggcgtgagccaccgcgcccggccagtagtgcatttttaagtcttgctaaataagtgaataattttctaaaacatcacttaagcggatgataatgagctctgtaggcaaaactgtgaaatattttctaatattctaatcagatttttaatatgcctcaaattaaaaaaacaatagttcaaataaattacatattttcaaatatacacctcttttgggttcataaagaaacactggacatgatgacttttttttttttttttttttttttttttttgagacagaggatcactctgtcgcccaggctggagtgcagaggcgtgatctcggctcactataacctccacctcccaggttcaagagattctcctggcttagccttccaagtagctgggattacaggcacccgccaccacacccagctaatttttgtgtttttagtagagatggggtttcaccgtgttggccaggctggtgttgaactcctgaactcaggcaatctgctcaccttggccccccaaattgttgggattacaggtgccacccggcctgatgacatgtttaatggacgtcactaccagcaattttagctgaaatctaggaccttttaaacaactttgaagtgtgtgatggatgcccctagtctagtgggcagaatggatcggaggtcggaaggtctggatctccttcgcagccgtcgctctgactcacatgacaatatttagaaaagcagattcttctgtcttgactccgttgatctctgctggacttccacgcttagactttgatggttgctattccacacattgctcccaggctccacatcccttcccaggaatcctgaatatggtagttggagagattcttgaacatcttgggttatatggaactctctacctctcaagatattcttttctaccttcggatagctctacactctcatgagggttttggcttgttttgggggtttggtgttttagtctctttttactcatttttattaaatgtgctagataccgctcgtactggtatcttggcaccagtatcttttttagggacatttttcctccttctaatgcattaacttctcttttcagcttttttttttttttttgagtcttactctgtcacataggctggagtgcagtggtgccatcttggctcactgcaacctctgcctcccaggttcaagtgattctcctcagtagctggaattacaggtacatgccaccacgcctggctgatttttgtatttttagtggagacagggtttcatcatgttggccagaatggtctcggaccctgacctcaagtgatccgcctgccttggccttccaaagtgctgggattataggcatgagccactgtgcctagccccttttcagctttttatcattgaaacacttgatgtgaggtattaatgctaatataaagattgagtgggttgaggctggagatgtttctctgtggtgtaccccgaagtgcctctagacccgtgctgcccaaggtggttgtcatgtgcactattttgatttatattttaattaattaaagccaaatgaaatgaaaaatttagcccttaaacttcactagctacatgttaagtactcattagccacatgtggctattggacagcattgatacagaatatttctattaccacagaaagttctgctggacagtgtggctatagtccgatattgatccccagtactctgaaaaataagaattccatgaattatttctccatacctccctgcatttatttcttcaattttactatagcagatgattaaagtgacactttatttgagggagtcaggcaagtttaaatggaagagatgcagtttaatttgtgttttgaaggaagagtatgattttgagaatagatattggtggaattgttaatttcttggcaagagtgggtaacaaagacatgagtaattcaacattacaggcaattaaagtgtgaggttttcacctagagatgtacttggaaaaagaagaagttggggaaattaagttctattaaaaaatatgtgtgtacatatatgtaaaacagtgatgtaagtgtcaagtatgaattagaggaagaatttgttcattcatttagtaattatttgttgagtttctactctgttctgacactgaactacatgtagaagatattatcatgagacctctccctgggagggtctcatgatagtatcagtgggtgagataaacacagaagaacatcactgtattttgccatgtgctgtggttgagagagggatgatgtccttaggaagtaaggctggtggcctgggaaggcattaccaagcaggcactttcagtgtttgtcaccgaggtggtagtttgacaaacacattgttttattcaaaagcactttgtttcattttcctcatcaggctaggaactgccacattttgatcatttcacagtgtattcatattaaatgggcagtaatgctgtatttatacagaaatggaaattccctttctcagcagtctcaaatataccagtaatacatttttttattttaaaaaatataatgaggttaaattaagatcatattaacatcagaatacttttggttggtgtaaagtgaactttttattacctggttgcagattaatggtagtaagagtaacagagagtataccaatggaaaaaaaattattctaaaacaagattggttggttaagattgattggtcctcaagtccagccatgtggcagagtgacttttggagcattaaagtatgtgcatatctctatattctaatcctggagattttgagttagtaagtctggggttatttcctggcatctgcggtttttttaagcacctgaagtgattctgatgggtagccagggttgaaaaccatggtctcttgtgttgaaatttgtaataaataatagatgtcacattttgtatctcacagcatggaatggccctcttttacatctgtcagagtctgacattattcttgtgcagatttgaggcttatggtattggtgaacattcaaagttaataaaaagatggaactcaagaaaaacagaggtacttacatgtgcagtggctaatagcaagagctctgaaaccagtttgcctgtctttgaatcctgccttactgtttaccacctttgtaatttagggacttacttaactttgtggacctcaatttcttcacttgaaaattagggataatagtatctatcttgtagagcttaatttgtgataattgaaggagttatatgtgtcttatttaataagatgtacttgttattacctctggaatcaggagacatatgtttcttatttggtgacatacaagcagtagaatgttttggttcagttggcaacattctttctttctgtgtggtgcataaaataaaatcttatcttacattgatgatgtcttacattcatttatgacatgctaataattagatgtattaattattaaaaataaagtggaatgctttggtcttttctttaaactgaaaaattacaatgatgagtattaatttcaagcgagtattgggcatttctctgtgccagggacagtgctaagcatttaatcttcataacaggaatcatagtaggtattttggggcatgattttgaggcagctaagaaaatcacaaaactaagatttaaacacacttgactctaaaccccagcctaataaccactgtgctatactgactatcctgatatttaatctacagttctgtgcctaatccgcagagttagttagtcctttttaggtaatgtggcaaggaatataaaccaaggggagtccaatttagtgttttctccgttaaccactcagccctaaatgctaacctatgaggttaagggaaaaattggttaagaaagagaatacagtaatttgacatccttagggcaagattctggactgtacaaataccagaagcatcatggccagacatgatagtaagtaggaagactgtgaatgtcatatagtaaatagtggaccagccaacgattaggtgattttcttcattgttgatggtcatttgactgacatgcctatgtgtggctttctttgtatttatcctgtttgggatttgctgacctttatgaatctgtagatttatgacttatatccttttagggaaatatatgtcttctgcctcattctctctctctctctctttttttttcttctctgggagcccaattacaagaatgttataatattgtcccacaggttcttaagatctcttcattttgtttgatacattttctctctattcctcagattcagtagtttttatcgctctatctttacaggaaagtctttactgactctgtcatcaccaatctgctaaacccatttgctgcttaacaatgtcgattttatatccgtatgatgttgtttagttttagaatttttattagattcttttttacaacagatttttttctgatgatattcctttcattcatcatgggcatatttttctgtataaccttgatgaaacttatagcagctggttgaagatccttctctgctaatttcaacatctgggtctactcagggtcaggggtcagtcttcattgattttcttctgaaaatggatcatgtggttttttttgttttgttttgtttttgttttcctggattctgttacatttgttccaacaatgttttttttttccccccctgggtaaaaaattaattttggtgactcaaactgcaaactcagactcatgggtggtaactgaaatcatacttcgtttgttttagtcttagtctggtttaaatgtcagccagagatttgggcagagtttatacacagaatttatgcatcgtcttctctaggtctgtctctttgctgggattcactgttattgccaacctcatttccaatagctatggttgccttaaactctgtcctttggttcttcaagccagtaagacaatgggttttctattggagattttggtatctgtggagcttgcaaattcataaaaattaggaaattcactagagctattcctttatctttattgcaagtgtcacttcccttccagaatcttcccacttttgatgatctcagatgcccttagctagttttgttattgttgtttgtttgtttttagatgtcattcatggtttatagttactatatgtgggcaatttaaaaataggtcttttaaaatttcttctggagaggactcttctggatatcttcctttttaatacccgcagatgtttcttgtgaagaagacatctataaaggttacatttcgggctgaagaactaatgaaatttctgcttcctaacaccctgcagtggaggtttacaactcttgcttcattttccctgataaatgaatgtattcttttgtaactttagtgtctttcatgaatataatttattctgaattttcagtgagcacatttgatgtggtttttataggaattagaatgctttcttttatatattgaaacatttgacctgctaacaactcttgtgttatataattgtgtatgtaataggaggaaaagtaaactctgcttaatttgcctagagaattgcccaactatttacttagttaacataatgttaacctagttagcaatgcctatccattattagaaatattttatctttattttcttgattatagtttaaaaaatcaaaggtttctgcttgatcatataggaactggaaaaaatttttctcagtgtgtttaatcccttatttctcaaaattatgtactgtgaaattttagtatgttgaataagtaccttattagataatgtatgtctcactcttctacaattttctcatttgaactattatgatgcaaaatttgataggacaactataaaaagttaataagtgtaggtttcaatgtggaaaataatgaaaaatgtaaaaatttaatttctttttatacttgctaatttgtttaaaaatctcagaaaagccataagagctttaattttgaaatgtctcattctaggctgcattgtgtatatgccatttgtgtggttgtttttctgggatttagttaaattcatttttatgtcttatttcttaatttattgtactttccctttgtcaagaccagacatggaaactgtactttcaaatagaatcactgtaagactattaatttttaaggattatagaatggttatatatttgaccatttacaaatcgttatatatttaccatttacattttatataaggcctattttttgataatgtaaaatttacatttctaaatattttgggcaattatgtaatatgcatgtatcaatggatggggaaacagtaaaaatatatattttcttgtgtagattatacaatttgggaaatattcttcagcaatctcttattatttaacattgggaattttaaaaaacaatcaaaaagtggtatgtaaggatcttgcatcagttgcaaggagcagaaaaaacttagctaaaagtttcctaacgatgagaagtttataagcttataaagcagaaagttggacacaggtctaggtcagcagtgttagtgtagacagaggctctttctattgtttgggcctgacagtcttattgtattatcttggtcctagggctagtttcctcattcttataaagtggttgctacagctccagatatctggattttttccccatgatggtattagaggagaaaacctcttttaaaagtttctcctgtattctattccactggctgggggaagagaattcttacaattgtcttgcaaccataataatctatgctcttggtctagaccatgtgtttcctgaccacctggaagagtgaataccagaacaaaattaggactctggctgttaccaaggaaggaatgtaaggtggagactgttgttcttactcacagattttagatggcaaagatatttcagttccatgaaagagccatattctctttgccttcaggaccttgtcaggaccaagcacaccttgctgtgtggaggtttttctctctgtttacccaacagacttcttcccatcctttaactttcagcttagagataacttcttttccgaagtcttaaatatcagaaaatacagggactttaaagctaaaagtactactaccggtaaagaaagatactttgtaatataaaggttcaattcttaggaagagataacaattctaaatttgtctccatttaacctagcatcaaaccatataaagcagaagttgactgaactaaaaggtgaagtagacaaattacaaacatagcaggagattttagcctatttttcttttctgttttttttttttcttttttttttttttgagacagagtcttgctctgtcacccaggctggagtgcagtggtgcaatcttggctcactgcaacctccacctcccaggttcaagcgattctcctgcctcagcctcccatgtagctgggattacaggtgcttgccaccacgcccgactaatttttgtatttttagtagggatggggtttcaccgtgttggccaggctggtcttgaactcctgacctcgtgatctgcccgcctaggcctcccaaagtgctggcattacaggcgtgagccactgcacccagccagcccacttttcttaatacctgctagaagcagatggaaaagaaggaagatttaaacaacacaattatcactttagctaagggccaaatcatgtggtttaatatatgcttagattagggtatatggcaccagacttaaacatattcttccaaagaatacaaaaatagggaatacttctcaacttcctttataaagtggtacaacttagtgagaatagttagagaaaggaacattacagaccaatctcacttatgaaccttcataccaaaaaaccccacaaaaaatcctgcaaataaaagccagttatatataataagcctaacataatattagccaattgagtttattcccggaatatatagatggtttaacattttaaaatcaattagtgtattttaccatgttatctaaataaagatgaaaaattatatggtgcttttaccagaagcagaaaattgataataaaggaacttaaaaaatctgccatatctatgttttctactgctgctctaccaaataactacaaacctagtggcttaaaacaacaaaaacttactgtcttatggttcttacaggagacctgaagccaacataggtgacactggcaggcggtgtccttctagaggctccaggggagaatgtatttcattgcctattgaagctttagaggctgcctacattcctcggctcatggcccctgcatcactctaaccttttttgttttttttaaattgtattttaagttctagggtacatgtgtacaacgtacaggtttgttacctaggtatacatgtgccatgttggtttgttacacccatcaactcattatttacattagatatttctcctaatactatccctcccccagccccacaccccctgacaggctccggtgtgtgatgttccccgccctgtgtccaagtgttctcattcatttcccacctatgagtgagaaaatgcagtgttttccatcaatacctagtttattgatagtttttaggatgaagggatgttcaattttgttgaaggccttttttgcatctattgagataatcatgtggtttttgttgttggttctgtttatgtgatggattacgtttattgatttgcgtatgttgaaccagccttgcatcccagggatgaagccgacttgattgtggtggataaactttttgatgtgctactggattcggtttgccagtattttattgaggtttttcacatcgatgttcatcagggatattggtctaaaattctcttttttcgttgtgtctctgctatgctttggtattaggatgatgctggcctcataaaatgagttagggaggattccctctttttctaatcattggaatagtttcagaaggaatggtaccagctcctccttgtacctctggtagaattcggctgtgaatctatctggtcctggactttttttggttggtagtctattaattattgcctcaatttcagagcctgttattggtctattcagagattcaacttcttcctggtttggtcttaggagggtgtatgtgtccaggaatttatgctatttcttctacatgttccagtttatttgtgtagaggtgttgatagtattctctgatggtagtttgtatttctgtgagatcggtggtgatatcccctctatcatttttttattgcgtctattcgattcttctctcttttcttctttattagccttgctagcagtctatcaattttgatcttttccaaaaaccagctcctggttttagtgattttttaaagggttttttgtgtctctatgtctttcagttttgctctgatcttagttatttcttgctttctgctagcttttgaatttgtttgctcttgcttctctagttctgttaattgtgatgttagggtgttgattttagatgttttctgctttctcttgtgggcatttagtgctataaatttccctctacacactgctttacatgtgtcccagagattctggtacattgtgtctttgttctcattggtttcaaagaacatctttatttctgccttcatttcgttatgtacccagtggtcattcaggagcaggttgttcagtctccatgttgttgtgcggttttgaggcatcgctctaacctttttatctgtcatcacagcatcttccctgactctggccctactacctccctcttttccttaaaaggaccctagtgattccactgggcccatctgggtaataatccagggcaagctcaccatcttaagatccttaccttgatcacatatgtagagtcccttttgctttgaggtataacatagtcacaggttctgaggactagaacatgaacatttgtgttgggggagattattctgcttagtactgcagtgctaagaatgtgtgtaaagaatattctacttaattataaaaatctttctgatacagcaaatgagacagcgttgccctctaacaccatatgtatttgacattggaatggaggacatacccaatacatttaggcatataagtaaacaaaatatgatctcaggaagaaatctctcatatttgcagataaatatgattgtaaacaaaggaaattcctaatgaatctatagataaattactggaataatacataatttttggcattaatcttagctcaggttgccataacaaaatactgcacactgggtgtcttcaacaacagaagtttttacttttgcagttctggaggccgggaagtcacaagatcaaggcaaattcagttcttgttgagggctcgcttccttccttgtcgtgtccccatgtggcagggagagagagggagtaagctctctggtgtgtcttctcataagggcacgaatcccatgtggagtcccccaccctcatgcctcatctaaccctgcttacctcccaaaggcccatctccatccccatattggtattttgggaggggaaacaaacattcagtccttaatagaaatattgctggatgcaaagtcaatacagtggataaaatcagttgtatttctatagaataacaacaaacagaaaagaaaaatttgaaaatatgctgtttatgatagcataaaatatcaattagaagcagtaaaaaatatgcaagatcacaagaagaaaaacattattgagaggaaattatagaagacttaagagaaagtaggtaatatgatggtgatcagtgggaagactcaatatcactaatatgtagctcccctaattcatctgtagatttataagcagttcagcagatgcatatgtgaatatgtaaattgataagttgattacaaaatatatatgtaaatgcaaagggacaagaattgtcaatacagtcttgaaggaaaacatagcatgggggaagaactgctcaggtggttagtaaaatttattttaagtcatattaattaaaacagtgaggcattggcctgagagtaacatatagaccagtggaacagagtattaaggactttgtgtagtgccttgggaaggacttatctttttaataattgatgctggccatatggaaaaaattcttataccatctataacatttctacatggattatagaatgtgaaagaaaaaataattagccttctaaaacatgatagagtagaatattttcataaccttaaggtagggaaagatctctcatacaggacataaaaagcttaaccagttttttgatctttgcagtttgaatgatgaggttcctcttggtcatcagagactgttagcacgtgagaatgtgtacacatgaataatggctgttgacttcttgaacgctagttttcagagtgattgcaccatacattttttagtgctgttactcagtatgaacccaggggtatagcattatggaaacattgatatagcttcatctaaaagtatctggaatccaaaatctagttatcaaactttgccaagttttctaacactacatgtaatttccttgtggaatttcctttaaatggtgacagtgcatttaaaaaaatatttaatatgtttattctttatgtaattttatgcttaaaaattgtgtgaacgggctgagtgcagtggctcatgcctgtaatcccagcactttgggagactgaggctggtggatcacctgaggtcaggagtttgagaccagcctggctaacatggcgagaccccatctctactaaaatgacgaaaattagatggggaaggtggtgcacacctgtaatcccagctactcaggaggctgaggcaggagaatcgctggaacccaggaggcggaggttgcagcgagctgagatcacaccactgcactgcccagcctgggcaacaagagcgaaactccgtctcaaaaaaaagaaaaaacaaaattatgtgaattatttgaatataattcaggttttagaagtcatgtgactttctcaggaggaattccgtactaaatttgctttgcacagccacagactcctcagtgaccccagtagtcacactttcttttccactgcccttgttcgttgttaaggtaaaattacattggtgaatccacttcacaaggatattgccagagttgtgtgctcacaactcttaatataacttgaactatgcagggcagtacaaagagaatggccaaaagatttgtgttccagtggattatatcaagtgtcagctacaatacaactataatctagaatgtgaattgggtattgactttagtatatagtcaagctgcttctgattttttagtgtctggaatttttccaaacaaaactaaaaagtaaaatttgtactcaatatagtcagaatttctagtaattgctttgtgtgtatgaatctgcttctgtgctgcacaaattcatgagtatacatgagtagaaaaagaaaactaattcctgaattcaccatttcatgtaaggattatgatggagttgggggatacttttagtcttccaatcactgcccatatttctttatcgctgcccccaacagtttgaaaaatgtgtcagaaaatgagcaaattaatgttactttattcaagtaatatataaatataggaaacctggacattggtttagccagggaacatggatgatgtgcaaattcaagaaacattgtagcttgtaatcccagcacactgggaggccaggcaggtggattgcatgagctcagcagtttgagatcagtctgggcaacgtgacaaaacctcatctccacaaaaaaatacaaaaaattaaccgggggtagtggcacctgcttgtagtcccagctactctggaggctgaggtgggaggatcacttgagcctgagacgtgaaggttgcagtgagcaaagatcgcataactgccctccaacctaggtgacagagtgagaccctgtgtccaaaaaagaaaaaacaaaaggaaacatcatagaaggaaggttttgcctgtgtaattaatactgtgatttgtaaatgtgttactttttaggtttgattaatgggtatttcctatgataatctagttatttcatatgaggaccaaaaaagagatttcactaaacaatgtgctttcagaaatctgtcagcttttgaatcctataaagttttacaaaacacattggtttgtctaattttctttagtctatgattttattttacttttttgagacaggctcttgctctgttgcccaggctggagtgcagtggcatgatcttggctcactgtagactctgctccctgggctcaagcgatcctcccacctcagcctcctgagtagctgggactacaggtgtgtgtgtgtgaccactcctggcttgtttttacatttttgtagagacaggtcttgctatattgcctaggctggtcttgaattcctgagctcaagtgatcctcctgccttggcctcccaaaattctgggattacaggtgtaagccactgcacccagctgagcttatgattttaaaaactaagctgtctcatatatgcatattgtttttagtgacccgtagccttcatccatgtctagtggtgttatagttattacttacaaatgggattgttgaaattaagctcatagtaaaatatatttaatttgattttttttttgactggggctagctcttttttatttcagtgctagtttaagaactccattgtcatgacatttaggattactccaggaaaggttgataatctcctccctgcacccttaccaccactgtcaccatgcaaccctacctcttgtagaaacaagcaaacatacaaacaaaacccccaaaaccaattatggtgaaatataaaacacaacaacatgatgccttttaactttttgtattaaaaaaataaactgaaactttgagaatggattattttgaccttagcaatagtattacaattataaatcatgttgaaattttgtccttaagcaagaaagaaaaaaacagctaattattcaattctttctcaggaaaaaaaaaagaacctgaaaaaatagaggaaggaattaataaatataagaacattaagcagtaatatataaacaatataattaatgaatttaaaatatggttattgattgccagtgctaatcaagaataaaggagagaagaaagacacgcctaaaaatgtaagaaatgagagatgaaatatcttttagagaggagatttttccttaaatttaagactttttaacatgataaaagatatgggaaaaataatgaaatgaattttataggaaaatataaattattaaaattaattcaagaaaatctaaataggctagtgaccacagaaataacagttacaaaacattagtaacaattgtgaaaacaaagttctgaaaggctctttttcttcatcattttataagcctttagtgaatggatgatttttgtgccatttaattttcggagtgctttgaaaaaggtgagatagttcctaatcgaattgtaaagttatcaaaggcctgaaaaaaacacacacacacacacacagaaaagaaaaaattatagattgaacaagtgccaggcattaataaaattctacctggaaccattaacagacatatttagctgtgaaacacttgaagtgttccaattaataatggcatttcctgtattcactttgaaactatgctgtacttaaaaacattttttttaacttttaaaagttcaggggtacacgtgcaggtttgttatatgggtgaactcacgccacggggtttgttgttcggattatttcatcatccaggtattaagcctagtacccatgagttatttttcctgatcttctccctcctctcaccctccaccctctgggaagccccagtgtctgttgttttcctctgtatgtccatgtgttctcatcatttagcttgcactttcaagtgagaacatgcagtatttggttttcctgttcctccagtagtttgctaaggataatggccttcagctccatccatgtccccaccaagaatatgatcttgttcttttttacggctgcatagtattccacggtgtatacatagcacatttttaaaaacccagtctactattgatggacatttaggttgatttcatgtcttctattgcgaatagtgctgcagtgaacatatgcgtgcatgtgtctttatgatagagttatttacatttctttgggtatataccctgtaatgggattgctgggttgaatgttagttctgtttttagttctttgaggaattgccatactgcttttcacagtgtttgaacaatttatatgcccaccagcagtgtgtaagcattcttttttctccacaaccttgccagcatgttttattttgactttttaataatagccattctgactggtgtgagatgatatctcactgtattttgatgtgcatttctctaatgatcagtgatgttgagcttttttctcatatgcttgttggccacacgtatgtcttcttttataaagtgtctgttcatgtcctttgcccacttttaatggggttgttgttgtttttttttctgcaaatttgtagatttaagttactaatatgtgttggatattagaccattgttagatgtatagtttgcaaaaactttctcccatcctgtaagtttgtctgtctactctgttgatagtttattttgctgtgcagaagctcaaaaacaagtttattttttatctcacaggtaagagtgcaagctagcactgtctcacagaaatatagtgtgagtatcacgtgcactttcaaattttataatagccacatttaaaaaacttaaacagataaattagtgttaataatatgttttatttaattcaaaatatccaaatgagtgcttaccatatggtagtggccctcttccaagtgtttctgtgccaggggctgctgtggtcagacaggtgggagctgtggagacagggctgtgctgctggctctgcccgctgtggctcccagtgctctggctttgcttctctctagctccatccagcttatgaaggtgttgagactgctgagatgaaatcaggaaagcaactaggatcttatgaggtatattcgagtgcttttcctacaagattgcttgaatagtaaagatttgcaggagccctgttaagggacaggaaaactgaggatttttcaacagtgatgtaaccttgctttgaacagagaggtctgacttgtgaagccatgtaagctagctgcagaggacagctgtcactgtgggcaaaccatctctgcctcctcgagctgaggtgctgagtgacggcaggaaccttctgcttgctgcaggacccctttgtcttcacatcactcttttagactcatgaggcttgatgaaaccccagagacgtccacagatgtctttctagccatagtgctgtctttattagtactttattagaaccaagggaactttagaaagtgtcatatggatgcttatgaatatttaggtcatagtcagtcttcactttacctaaacattttggagggtgtttgtgaatcataccataatttatttagtgtcttaatttaaggaaacgagtccgagtggaaagtaattatagtcatcagcaggctttgttagttgttactgggtctttaaaaaatattaagtttcatgtgtttttgatttcttttgaaaatgataaagggtttgaatctaataagagcacttctcaagataggttctaaagactacatacatcaaaattgtctggactccatgttgaaaattcaggttccttggtactaagccacaacttaaaaaaaattttttaagctacaactttttaaattggaatttaaaaattggactgtcaatagatgagccctgtaaatgtgttttggaacaattttcccatgtaattctttcgctgtaagctttggagagaggtgtatagcctgtaaaggtgactctggccacactacggagggtgcccagggtatggggtggggacgagtttgagtgcaggtggggttgggaggaagtgaatttgagagatactgggaagtagaacagaggagacctgctgatgggtcagccattgggcattaggagaagaaaagaggccaggaaatttccttagccgttgtggataatttttaatagtctttcctttttcttaactgttgaatactttaaggtattcactgttaaaggcaatgcttgttaaagttaagtacaatcagtggaacacccgtaaatgcaagttcatgtagctttcaagcaagcaaacttaaaatgtttttctttactgccttttctaaaattatatgtcattttgtcatgatttcccacagttatctcagggttatctccttcagacccaaagtctcacttattgatcagggcgtttgacccaaattttaagtgatatcttttccattaaagcgatttccttggatgggatggaatattacacagtccatgtgcataggcatgtgggaaatggtcacatttgtgggtggcattgtcacctctgctcttggacacatatcttctttttaaaaaggtatttgtttactttatctccacttctgtccatgctgctatttgtaatagactttctaccatttttacctgaaacttttctaggagtttccaaatttatgtgtttttacaatgtcatatggtataaaattgatgtttaaaaaatgtatcaagcagtatgttcagcagacacccctgagccctactgcactcctgacctccacctccccatgaccccacctccccttgaccctcacctcagcctgctccccacctcttcttcaggcccaggatgggagggtgaggatcagggattaggtcagctgtctgtagcacatgttagtggataatgttttaaaagtcgaaacagttcaatggtttgttttctttaagcccagtcaaaatggccttggtgtcagaatggctctgtaaaaaatgtctcatgccatatagtttaattaaatggtctgagataaatgtcatgggtgttactatcattacctgtggtccattagtgaacacaccactctccaggtgactgaaatagtcacattctcttgcatttcagttttttcatttattaccattttttgggcatacctataacaagtactgccttaggcatttatttatctaatctttttttcaccttttactgcaggctttgcagttattagaaattctgtttatatatatgtcggcatatgtgcatttttgtatacatatttacatgcatttgtacatggatgtaatatccttttgagtattagttagctttctaccttagaaccacagagcaagaattctgcaagtaaagttgtctctgtaggggagaaaaagtaatgtcctttctcatctattacaaggttcattgctaaggcccctaaaataaaagattaataaaagaaaagtgtagacgtttatttgctgtcaattttaagttacacggcagtcttcagaaatgaagacccaaagaaacagggaaacctgtgtatttttgtgctgtgtttgatgaagaaatagacagtctacacaagtgtgattggaggataacagggtttgatctctttgatcagagataagggtgttcttttcctctgggtattgggaggacacctctggaaggagagttttatgacctgcttcgggggagaagggtgaggagaaggtgagagtgaccttcctgcttctgctgttttctcaaatgtcagtgtgccatatttttgggcaatgtgtcctaaacctcatcatctcctattgcctctactttctcttcataaagtcctctacagctcttacaggctgatatattttactttaaaaattaatgtacattgctgctggaaaggaacatatgaataatgaatacaaagataatgttattaatgtgctttctataaagagccatcctttctgatagcaagtaagccatgtagatcatataactgtttcctaacccatgttctggatagtaactagcctctaatttcccacagtcactgattctttctctaaaaagcatgatcataaaattgtgttttattacacagggtttaagccaaatttatgatatgcccaccacctggtgctgatcaacattgatgaatgttcttattggcccagtgttgcattgagcccctactttaaatgcatctgtggacatagcagcctacctgccctttgccactcccccttctttgtagagaggtacaagggtggtctggtgtgctctctcacttgggcaatgaggagccattgggcttagaggaagtacagttatgtgctgcataaccgcattttggtcaatgaaggactggatatacagtggcaccataagattatagtggtgctgaaaagtttctatcacctagtgatgttgccattgtaatattgtagcacaacatgttacgcaggtgtttgtgacgctggtgtaaacaaacctactgcactgccagtggtatagaagtctagcgcatacagttatgtactgtacataatacttgataataaatgactatactactagtttatgtgcttattatactttttcatcattattttagactgtgcttctgcttatattaaaagttaactataaaacagctttaggcgggtctttcaaaagggatttcagaagaaggtgttatcataggagacgacagctccttgcatatcactgcccctgaagaccttccagcaggagaagacgtggaggtaacagacagtgatattgatgttcctgaccctatgtaagcctagggtaatgtgtgtgctcgtgtcttcatttctaacaaaaaatctaaaaagttcataaaaattagaaaaaaaaccttatagaataaggatataaagaaagaaaatattttttgtttaactgtatagtgtgtttacattttcagctatgtaatattacaaaggaatcaaaaaattaaaaatactaaaaagtttataaagtaaaaaatttatggtgagctaaggttaattatatttttgtgactttaatatagcctaagtgtacagtgctcataaagtccatattagtccataaagttcatgaagtccatattagtgtggattaatgtcctaggccttcacatcaactcaccactcactcactctcacccagagcaacttccagtcctgcaagctccattcatgggaagtaccttatacggatgtaccatttttcatctcttgtactgtacttttactgtacttttcgtgtttataaacacacatacttaccattgtgtcacagttgcctacagtattcagtacagcagcctgctgtacaggttgggagcctaggagcaataggctctaccatacagcctaggcgtatagtaggctgtaccatccaggtttatgtaaattcactccatgatgtttgcacgatgaaattgcctagtgacacatttctcagaatgtatccccgctgttatgtgatacatggctgtatgttagcggaattcaagcactccagtccacaaatctaaatgagggacatattcccaaagaaaaacattagttaaggttagtgtgccttcacgttgcccctgccttctgccattaatgagcaactatatgtccagagtgcacagcagttgaaactccaaataaccctcatgttttttaacttcaaatttcattttgttaataaaagttggagaaaaaatttatgtgcttatgttactcagcagtcactgatccaaggagcatatttcgggaggaattaatgctttgcttctcataggagtctgaattgggaagaatacttttgagaaaagttatatgaagagctgtttttttttgcagtgttttaaaatatatatttgtttttctgtatgagcaggatattgatttgacatatcaaagaatgggtcttgctgctagctgaaggaacactgaagtgtgcgggcccagtggaggtggggaccaggagtgaaggctaaagtcgacagtgtgaaagcataagctccctcaaaacaagcctgcattcattcttgagcgcggcttttctggcagtctttccagcttttaccagtatagtttgcttatcaaagcactttatcagtggggaagggatgtgggttaaccacttcacttagctctagctagctgtcccagttcgcagtctgtcagcaaacagctgcttttcagcatgtacaccctgtactgtgcagctgatgcaaggctgggacaaaaccagctttgtgtcaggaggtggggatggcaaaggggggcgatcttcaatgaaaagggaccgagcccaacttcaggctttaatttataagggcgctttggtgagctagttttttcaccaccacctcccccccaaccctctttatttcaaggttcaaggttaactttaaaagtatggtgtaccaaggcaggtaaactggagatattgtggcagggaatagttaaaatgtttatctttggaaacaaccattatactagtactacttacagtacttatttatctatttatttatttatttttaccgcttttctctttcccctgctctcttgtcttcatttgctccttgtctttatgtcttcctttcaggctcctttagaaaccatgtgcaggttgccaacacctttgagaccttagtgctaaggaaagtgcggcttgagcggttgtaaacactagagagcagcagaaccaaatcccaagcaaccacttctttctattcacagcatccaggcgctttgttatgttacagcataatttgtagaattttcccctcccaaagacataatttgaggtgaactatgacgtagacattgatgccatcaccgatgtttggtttcttgttctgggcacaagataggattgtacttctcgtctgtttgaactcagacttaccaaaccagagttttctttcctgctactccctcccccattgtgagggacatgtgtcagatgctgcttctctgtcctgggagtccagaatgagcaggacccccatgcacagctgactagtgagggaactgcagtgtgaaccagcgtacttcagtgggaatggtttatttggaggctctggttacaacaacgtcgtgtagttttttgactgattctacagtgtgagaacttaatctagtttacctcctttttggaccatttgtaactctccactaagatttttatctgtttcccaccttcttttacttgtacaagaagcagttctcattgagggtgaagttgaaggggcattgtcagttcacgggagagctccaagtgtatgaagtgttgatacccagacagtttgcctgactgaaccatttcttcagctccctaagtgcagttacctttattagagaaatgtcatttataatcatgatgctaccaagggctccctccttttatctcacaagttcaggctgttcctacctcattacctttcgcctccaaaagataactccaggtacaacaggaatagaaattaggatgtatctactgagcacttatttaaaaccttacttacgaaagtgtgttttatggttcaggatagcataaggtgagctacgccacgttaatttggagaatactgcttaccatgcagatttcacagtacatatcagcatgccataggctctgaagtctttccgtgcagcttgttttatcttgtttatggtttacttttcccatagaatatgcttcgtgaggataactgcttattctcagtatatcctatatttactttctgacatttataggaagagaattatcattaatcagcatatatggtcttactgtttaacactgtcttggcattttgcctggagccccatttatttgggacacacaagtatgataatgggtaacgccaggaatttctatatgccttgtatggattgctaaagcctagaacagttgatgtactaagtgatccctgggacagaccttcctgggaagaagcattgattactaggtgccaacaagcagtaaggctctgaaaatcagtgattttttttttccagttagcaaacctattaatgaatcaataactcagtttattcccgagatctgcgtttatgaaagacaacttcataatctgttatactgatgtgtttagatctttatccagccaagacctaatttatcaacaccttgttatcttaaatactttacacagaagggtcataaatcctccttaaaagggctttatttcaccatttaattaagtctcccgatttccttcattgacttgaaaagggagttcagggttgagttgattttcattaggcacacaaattcttacattaaattaaagttaggtgaaaggagaacactgtcatctaattcttagaggtgcaataaatgacggctgagacagtcgcccaggccaggctgccctgcgacatgagattacttgtggagaggattttaaagtactcttttggctgggcgcggtggctcatacctgtaatcccagcactttaggaggccaaggtggttggatcacttgaggtcagtagttcaagaccagcctggccaacatggtgaaaccccgtttttactaaaaatataaaaattagccgggcatggtggtgcacacctgtaatcctagctgctcaggaggctgaggtgggagaatcacttgaacttgggaggtagaggttgcagtgaattaagattgcaccattgcactccagcctgggtgacagagcgagactccatctcaaaaaataaataaataaataaatataaataaataagttactcttttactctgttgttctgtgttattttctgcttcctaaataacttgaccataggtaataatattgatataattgacacaaatttgagcttttatttaggagagaagtctcttggtatgtatgatgggggatacagaaatgaatgataagacagagaaataggtcaaatgccaaatagaaagtaagtgccatttgagacacaagatgtgggagatgtatagtggtgaatccttggaaaatcagggaagacatatcctgatatcatgaggagctgactcatgagttgggttggccttgaagaatggataagctttgagctctgggaaatggagagaagggcatctaggcaggtcaggcacagcattcaacataccgaggagagaaaacttggcacatgaggggagaacagttaatttgacatctttgttaatgattaacacctttcataatgaagccttccctccacatggtgtagcctggcttgaggccatctgagaggagacagtgttcagggggagggttctgtttatgaattgtggagcaatgtgatgttgtgtgtgtgaagaattttattcagctataagttagaggcctgaaaacagcttaaatcattttttcttatgtggtaagaaggctagagaaggtagactagagatggtgtagcagttccatagggctagcaggggtggcagcttcttctttttccccccaaccatcctcaggctgggtttcttcctcatggtctcaaaagtggttgcttgaccttgggaatgatgcctaccttccaggccagaaacggattggctggcttctcctatctgcttctgcatttggtgtgttttaatacgtatcaggtaagctctggacaacttcactgtatacgtgtgagaatataagaacaaaaaaggcaaatgatgtgtttgtattttttgataatagttttggcttcgcagacaccccagaagtgtcttggacactctctggacttccagaccgtactttgagaactgttgttctagatcactgttggcctgtgagccagttgcaacccagaggtaaaaaggaatgttacgttttttaataacagcgttgttgacattaaaatccacataccataaattcaactatttaaagtacaacattcagtagtttttagtttattcctagagttgcgtaactatcatcacagtgaattttagagcattgtcatcaccccgaacagaaagctcatacccattggcaccaacattccttttctctcctaccgccccagcccctggcaaccacaaatgtactttgtctctgtagatttgctcattctagacgtttcatgtaaatggaataatacagtatgtaatctttttttaataggagttgttacatttttaaatgtttgtaaaagaaaaacagcaaagatgattatacaacagagatgatatgtggcctggaaagtttaaaatagttactgtctgtccgtaaactaaagaagtttactgacccctgttatagaagataagtgcacatatttaatatttttgtacgtgtcccttatatacacacacatatatgcatatacatatatctatttatcattaaatacctttaatcctgtaccagtatattctgtgtgttagaaatcatgtgactaaaaaattgaaatggatgacataacaatgactatgaaagttttaatatttttttcagtatccccatgggttcttttatatgcctccggactggtacacagtctccttcggatctgattccagaatatttacaaataggccatattagaaacattttggcaattgtgaaaagtacagtttcaacacctccatcttagagctactgaaacatgttctctggaggttaaacccaagaatctgcattttagaaagtacctccagtgattctttgtgcaacttagtttaggaacgactcatctgtactgttaggatctaagctcatcacagggcaaaaggggcaataaaagcaatggcggtgaacacctgatagtttaatccttaagtaactaatttccagaagccttcttatattctgaaagcattcttttaagaaataaatttattcttataaatcaaacattgttaattttttccttaggaagttacttacaaaaggtttaagaagacagaagactatttggttcagtgataaagtgaaggatttgtcctatgcctgaccagtttcagtatacaactttttcagaaagtctggaaagatttccttaggcccttggtcaaaaataattgagaaccctcccaatcaattaatatgatagatgtttaagggaaatattgctctagctttttaatttaagagcagtataacatgatactttggaaacttcttgctgccttctttactcctaaccacatgattgggtttgtggtgtctttcagcaattattatgcattggttaatgaatcattgcattattgattcagtgattatgcaattattatttcattggtcatatggtttggctcaaactataaatgaaggaagtatcaatttaaaataatctgggattggaaactacttgaattgcaaagacttcattttccttcatgataattcattcaactgtttgcatgatttaacatactttttcctttgaaaagataatttaactacatgttacatgtttatttgcattttatgctttcaatttagaatttttaaaaatgaaatttgagaagttccagattggtgttagaagttttctttgcatcctctccttagaggaattagtaagttacatggcaaatcagtaagaggaactgtattgtatctatcaccacaggttgtattccaaatgctacctctgttttatatggtgactttctggaagacgttttagctacctgtgaattagcagttttataatgatgaatggagatactactgctaccagttaggttactggttaaatcagactccttgtaagcaaattacctttttgttttatgcctctctctatattttcataagctttctaagggccgacatctttgttttgttttctgatatatacccaagaacctaaaacaatacttgttgtgtagtaggcatcagtaaatatttaataaatgaatggattccagatctcattttgaaagggatttaaggagacttaaggattgtgcaaatacatacaatatgccaagagaaaataaatttaatattgtggtaccaaaaatgagattagtacacatacaaattatatccatgaaattctgtagatttcctgagaaggcttgcagatttggccctgagatttccagctgtataggattccataagaagaagataaaagacaaatttgatttattgtctcttaaggcatccttgacctgggctactttcctttcaaatgcttgacattgattacagagagactgaggaatagctgtatgtctccagttcaaacctatcaccagcaccagaaaaacagttcacagtatatgtcttcccgatgatgaactagcaactgttgatgggcaactggatactatcttttgctgggattttattccaccctttggtcattgagaggttctaacttctacacttgttctttatggatctttgtgtgtgcccattttcaataataagttctgattatacaattataaatttttaatatagtttaagacttaggagaaattaggcagtaataaaaatggctaatgttttcataaggcatttcactaaaatgttaattgtattttcaaacttttaaaactatagaggccagaaagtggtgaccatgggcctaaaatattttctaaagttacaacttagttgttagcatttagaaatcagaagaaagtacaggaaacatttaggctttaaggtacccgccaggcttgcccacagtcactctgctcctcagctgcctggcctctggggcagttcagtttcacacaccaggaatgccctgagcccagatttcctacctctgttttttacttctgtttttgcttctgtttctttccccagatgtcctcatagctttcttcttcactttcttccagggactcaaatatcacattttcagtgagaccatctctggtcaccctatctcagattgtatccccatccccaccctgacacacacacccttttcaacttgatttttttttttttctctaagcacttacactggtctatacattttacttatttatcttgttgggtgtctctcctctcctgttatccaggtaactctgtgagggcatccatttgtagttgtttggttcactgctacatctttagtatctaggatacctagaacacagaagaggttgggaaactgattgaatgagtgaatttccagcttttgagaaatcaccagcaccaagcccagtggcactcctgtgtggaggcctcagcctgggcaaaacagctgaaagggaaaagagctctctagttctttgcttttctgaggagcttgtttgaaattcaaaatccatggctccaccccagaactactgcatcaggatgtgcgtgttaacagggcgatttctgtatgcacattaaagtgtgagaaccattgtttgagtttaccgtagctgcacctggcctgctttatgtatttatactacatgcttgcatttgaatttgtgaccctggtgtagagagtaatgtgatcatctttacgtgtgagagagttgatacagtaataatttattttgtttataaaaggaattggagaaaatccttgttattgtattggtgttgagtcacaaagataatacttgtgttctaggctttttcacattttagtgaaacatatgctatatatcactatgtcccaagcaatacattttgagctacagtatagctacaatttagcgaaccactttataacagttttactatgtttatctagcgcacacggccttgtttggagccaatgcatagtttgtcaactgtactacttaaaaaaaatctgttaccttcaccctcagaaagtaatagttccaaaggaactgttatagagtgagtcttataaattcttctgtgtgcacatgtcattcatccccagaggtcatttagagccctgagacttactgtggccaaatgtgttgtacaaactgctgcaaatccttgggaaatttaaataagaaagggttttatatgcattttatgtagggagcaaggtccatgtaaaatagaagttgggacaacattggaagttgtgtgctccctcttaacctcgtcctacaaattcgcagatgctggagaaagaacagcaaaatttcctccaggtgctttacaaccaccagattcagatttgcctcccttatctttttcttggctctccagcatcacaaatttgacacaggtgttcccatgcaccacccccacacatactttaagaagatgtgggcatatattatctttgtccacttttaatttcgaaatgatcttgcaaagaccaaacccacagactcttgtggaggagatggacagtaaccagcagtgatggatctgtctggttgtgcagagcatgctgtgggaaccacatgggctgtgtgttgatctctgtgtgggcacccgcttccctcctcctccaacctgcccccttctctggactgtcttcatatcactgggagaaaggcagttcacgagttggatgtaatgcatgctatctgtttttattgtagaggtttgactaggaccgagtaaaatccttaggaggcccccagcacagaagatagtattacatgctgctcctgtacaccccaatatataattcaaaatgacacaaaatttaaatttatatttaaattaaagtaccttcttcaaaatatttctttggaatattttgatgtcaaaattttaaataaatttgttaaagataagcttttcttttggggtgacacatggaatccaagcatacacttagtaagacttatgtgatccagcatggggttggccccagatccctccagaacacaattcaagattatttcataatagaagtgatgcctgacacaagtcttgtaaaatgagcaaagtgtttccagcctttttaagtttgccacttatactgggaggagaggttgggctggactgcaggtgcagttggcaaaactgtcctgtcaatgcagacataattctgggaaattaccaataccctggacaatttgcagtaaatttttgccaggtagataatttatctgcttttaatatctcttagttgaggtgttaagaaatagcagaatgccccaaggattactgataggtggtgagaaggaatttgaggggagtcagagacagggcaggttgacaaaccggacagtcacctgctgagtaattaaataaaggttatgatttattttaatgtagttgcaaaatatctggttagggtgtgtgtgtaaatatatgtgtgtgagagacagacacacacagacacaggcagagatggaagaagccaaaaggtgatgtccacaattaaatttagattaatatttgctgggattttgattggatttactttctgtcttgaaagagattaaactttaacaaaatgctttccagttcttaaacatatataattatctattttttaaaaaaggtatggtaaaggtcttaatttctgccatctcattccctctggttaaaaaaaaaagaaagaaagaaaaaaaatcacccagcagagccatctatcttgtataatcatcctcataaacccctaaagtatgctttgctcccaaaacattattggcatggatcctggcatacaatcatcacaccagtaattacagctgttaactggaatatagtcgttagtatttactagcctctattatgaacacataaatcatttcataaaacggtgagtggacacattacttgtcgttttgtttatgttagacattctctgcaggtattctacatgaaagttaaagcattctgaggctctttttgtagactgtgcttatcattaatagaaagcagcatgtgtgcatcctgcaagcccatttccttatttaaagtgggcatccttcctctgctgagatgtgcttcctctttcgttacaagactgaagatcaagcctttgtaaacccttaaaggtacatcccttccaaatgaccttttgtcctgagcgacgaagatgtattgtttagtccactcagaattacatggggtgtcctaagaatttttgttttggttaattaaatttggaaatgtgtcattttttcctattataaagcataaatgaaagtccagtcaaattgattttagagttctggtagatgagataattgcagaagctaaatgatttagggtttaaaaatgtgtttagcttttcttcacttagagaaacttaaaacatatttaacttaagtgaacttgtctgtgcttcttttaatcttataaggtgagtttatatcaatgtcatatgctaagcagtcttatgaattaaactaaatggaatgaggcgctgtttgtgtgaacaaaagtattcattttacacataaagatgtttgttcaaagaagctaaaatggagatctaaatcagaattcattgaaatatgtaagatattgttttacaagctagatttttttaaggcgggccctttaatagtagctttcgccaagagttctgtttttctttaaagttttgaagctttttttaaacctttgttcaaagaactatagacactagaatttttttaagagtccaaaagtgtagaagaacaggactctgcagtggcaatgagtttatatattgtatcatgatagaaagccaatttgattaatatgacaaaacctccattttcttctactgtacatgttcaaattttgcagatcattttgtgaagtttttactttccgttaaaaatatatttttaataaaaacttttcataaactttatgaaatgtaaatttatggcttcttgctgtgtctgtattattacatgctatttaccctgttttctaataactgtcttgtactctgctatttccttacatttgtttctggaagaatcttccttgcctttagctgccatgttcatagagcagtaagttctgctgttgtttctcactcctgccaaatatgcttatcattatgttgatgatttctcttcctattccaaaccctaacacttttctcctggacttgcaagaatttctccctccatctctgcatattttatatattcaaataaaaatctttcaaattccctgctttaaaataaaatcaccttagcccctttctgagcatgctaaactcaaaggaaaagaaaatattaattaagccctgggttgcagagctttctacctgtgaatctctctatatctggctgccttttttctcccattaccttcacttgttctgcccatgcagccagtctcacacagagaatgtccttgcccaaaatgtgttcgctccttcctctggctgtgtccacctgttccacgtttttctccaaggacttcattctccctcgcttcataagatcagaatgctacaacttccagagtaccagccagggtcctcttcttcatggagccatttagacacaatgatcttgtttcaaactatattctctggttcctgttcttagtttaccattatgcttttgattatgtacatgctaaaatgtattccataatttctgggggattttttggtatattttctttgatattattatttcttatatgatctgtgttccttggaaaatgtatttacctcatttcctatttcttggtaacatctcagaattagtacaaaggtcttcatgtgggcaatattcaataaactaatgaagctgtaatagtcaagttacaaagtatataatttcggcttgattaatatgcactgacatcccacttctctattgctctggcagctggctgcctcatccacagacactgggttctatgaagttcactttgctctgtatccatcagcattatccaaaccaggcactgggaggaattcccaggaagttttgagagtggctgtgagcactttaggaaatgttcatgctaaaattaaaacaatttttctgataacatgtacaaattacaaaactgagattcacaacaagtttctgtctatggccagtgacgtagaaaataaaaatgtcgattcagctgctggtggttttgaatatcatgctaagagaaacgatgtgtgcgttaacccttctctttatgtctcgtgtaaattgcaaagatctttctgcatgacttggtgttattattatccttattttccacgtcattaagtccatgacacattctgaagatacttgtgtgaggactgggaaagcagaacaaatggaacctcatgaatggagagtgaaggtgtgtgcttgggaactaagactagatggagctttttgagtttgaagtgagagaagctgggaggctttccacaccttgagataaagagcgagccacatggccagaaagcccagggggtctctggcctaggaccaggtggtggcctttgacctccctttgccttttgagcaccgtttttggtgggtatctgttgaactaaagtaattgttcttagagttaaacctcttacattaaaaatatagtgaaacttgagtatttgagtacaatgtgctaaggaaccttaaaattaatttaaaaagttatttggtaatgtaaaaaagttctaaggactatgtggccatgtagcagttaaaaatcttttttttaacaaaaaagatgtaacatcttagagaaaggcagacatgataatttgccatgtgactgttagaataatctaatttacagagctgattattcaggcaatttcctatgtcggttttttaggattaagaaagaacttgccctctttgtttccattttgtattctgtacatactgagttgagcttgaagcatgtattcagattgctggagaacatactgacttagcagctggctacatggtatatacatctttattcattcatttatagacccaaaggttaaggtacaagtattaggaaatactttctttttattactcatgcagtatgttagtttaatttacttggataataatagctgtataatgttaagtgaatgcttgatttgatttttttttcaattacaaggagaaagaaatcttccactgtgcatgtatgtgtgtgcgtgtgtgcatgtgtattggttctaaatatttattttcttgacatgaacattttatcctgaccatttaataggcacttaataaatatttaccaaaacacacacacacacacacacacacacacacacacacacacacacacacaccccaccatcagatttacagaactaatagttttgatttttgaattattccagtatatttaataatatataagatcttaatggcattaacaacatgtgaatacaaatggaaacaaatttgatgtctttacaaaataaaaataaaaatcaactttaatgtcttctttctttgagttgttttcttctgttccttcttttattgaatgttaggttcatttattttagtatcttttcctaaatgattgcattgaagactataatattcctacaaagtatcaaaatctctcactgccattatagttttatctgtttctccttgttgtatgattatcatatccttttggtggatacttttactagtatatggtatacttttttattcttattagtattagaatttaaaagaagaaaggattaatgctaaatcaactttctttttgtgactagttgcctgagatttctttttctactaatattttcaattaattgtcctttttgctttcagtgtatttgagtgataattaggtattttttttaacttaggagttgtctttcccttttataggtaataatgcacttatacttattgctgttattgatataaagatgagttctatcttgttaatttatgttttgtcctttttctttgcttctcttttctttcttgcttttggctagtctgatagaattttcttcatttccttttccatggctgttggttacaaatttatactttctctttgtattctttttgcttttatagttaactttaacatgcatacttgatgaagtctaaatctaattaatagttcccattgcctactgagaacactttaaccctgaactgctacttcccatgtttcgatttattgctttccagtaatttcattctctcttgtttgcctttctttccaattaatcattgttatttttgttatttttaaataaggctggtaattctttagatgtatccatatgttcaccagtttctttactcactgttatttctgccatcttgctgctgcattgtgagttcatcttccttcttgataaagtctgtcctttgatgatagtttctgtgaaggcgtgtgagttataaactctctgtcttgtctgaaaaaaatctctattttgcttttacttttgaatagtattttggctagttacaaaattctaaactggcagtaattttctcttggcaatatgaaaatatcctattatctcttactatctatttttgctattggtgtaattgttactctttcaagattcttttctcctcaattttttttctttttttgattattagaaagtgaaaagcaattctccctgattgtgtttctcagttgtattacagtatatctggatgtgggttaatcttgtcttttaacctgagaatttgtggttttctttgattattgaaaattctcaaccatgtctccttgcttcactcacatattatctatttctttcctatgtaacctttattaggcacattttggagcatctcagcctctcttccatatctttaagattctctttcatctatttttaactttttggtttttgtgcagcattttggatgatgttctcatctctgtcttttagagcatgatgtctcctactcaccttacccatttggggataatttttgtgaccattttactaaatatatgaaaaatcagtttagtgcttacttcaaatctaccttttcttgcctgtggctttacttccttcttgtacctctttgaacatttcaaatacagttattttagagagtcttttgtattctgtgtttagttcttggcgtgcacatgctcctgtgtgtcacatctctgccctccgtggaatgctgtccacttggcctgcagaagggcccctgaagggggtctcacctttgcttgtgccaagactcctcaggtttcacctgtttcaaacaagttttcttatgttttgaattctgaaaattgtggcacagaacagtttatccaacccatagttgttacgaggaagagacacaagtcctgtccttttgtagcttatggccatcatcattaatgaaagaggttcgagtatatgtaaagatggcaggggaagctttattctgaagtcaaactataaataagtttaatttgacagtacatatctaggtaattactagtgttttaaaagtcagtgtcatttacatgtgaatttgaatatagttttcctatagtgtaaaatgaaattcaagccagctatttgaaaaatgcccagaacatctctggagacacagtttgatgaccatttacctagattctaggtcctacgtcagtattagctgacattatttgccaagaagttccaggatctgtgtatttaatgaaataaattagagaggaaattataagtaattaaaaaaaccctctaattacataaatttagatttaacacacaattcttaaaagacacatgcctgaacagtttttattattcctcagacagagggcttattggagttttggaagttctctgtctgtgttctaaatgttcactattattggctgaggtgctttctaattaactgatttccaactgtgttttacatataaagtaaaatctctgctcttttgggaatgctcttttcctgtttcatcaaatatgcagtcaatagaatgaaattcaaaaatacagattttagtagtctaaaattctgtgcactagaaccttgggtatagataataacaaatcttgtgcagctaagttcagttttgtactgttaaatgtggtggtgctttttatttcataatgtgcattatcgcgagcagattgaacaggtgatctcatttctgatattttccactccttttcttttaaaatttgaattttaaaaatcattgaattcgtgttattttaaatattttgtagcatcactatggtcctcttaatctcatgaatctcacgaatgcaaaaaataccagaaaagtgccacaaaattgtcacttgtctttcagagcatggattttatgccagttagggattaagagctactgcttctatgtgtggatcctatatccacccatttacaattagtaccttgaaggtttgcccttcctaccctggctgatatatttgctttaaatttttctttaccctcctatgagattttctttagattttgctccactttggtttttttagaccctgttccctgtccttctggttttgcatcttctacttttggtacagcttataagagttgcctgtgtcgtctttccataccctgttgccttgttaggcttaggcagcctgtcaggctataaaactcaggcttcaatgaaaagcattccctcatcctcaagtccagcttttctcatcctttggcttattaggattacacaaaggccatttgatgttgggcctgctgtgttagcaatttaatgatgttgagaaagagacagtggccaagtcttaatgagactgccatttcacaacctctaaatcaagactatccagctgaggaagcctggctccttgccaccccaccagctgggtggtgcatgcattgttagtatcgccttacagagcgattggagcccaggagtgcagggtgtgtggtgtggtggagagtcatttccacagttgggtggggacgggaacttggaatgctgtcgttagtggatataactgctatgttttacctgtccaagatgctgcccacttgcaaaactgggattagagttttaggaactgaggttaacacaagacctggagactaagagagccacaaatattttacttattatattaatttttggctttttttccaccttgtatctttacttatgcatttattgtttctagtgattgaatgcttaagtttttggactaagcctttaaacactcactttatgtctctttattattaggaaaaaggcacctagatctcttagtctgttaatcgactatcttaagggtctagagaccactacaactagtgtctcatctgttgatctctgctgtttttatttcagaatcaggtgactatccattctttgtttcattcctaacttctaggttccagtagataaagatgatcagcatttggctccttagaatggctggttataaatagaccagaaaatagcaacaagctgggctgctccttcactaatggcccttttcaaatacttaaaagcaaatgattcatcaaatagaatcactacaggcagaaacctgccaatttgtagaatttgactcctcctaatcagagtaaggcaacaggatgtggagttcctgctctgcacctgattaaagccaaatgcaggagaagcagctgggagaaggaggaagctcaagaccatctcagctgggggtagaactgctgcagaaatttagaggaagatgatgttacaaaacctttcacatttgttttatttttccagtatagtagtagataagcacatatgcagcgctggggtttaaagtttttaaagtaaccctgcatgtgctgtttaagcagaaacaataaatctaatgatgtatggtttaagcaacattcttccttatgagtagctgtattatttttaggtaattctgttgtcctaaatttgcctaatttcctctttcagtgtttattttgactattaacagaatcactgtcttcacttacattaaatattaatttcccccactggatttctatttcagtaagcatttttttttgccattaaggggctctctgattttgattttttaaaaaaaatatgcctctggatgcattgtagtgttttctcatgatgtattaaagcatgcaaaatgtattatctgtagtaattttacaacttttacaaaggtaaactaaaactccgtttccataaaaataaattttaaagaagttggaagcattctgcctctgctaaagtagaaccaataaaatattaagacatttcagattctttttatataatcttagtttctaaatcttgctgtttaggattctctatgtgatctctcataactgatatgtacattgtttttattttttaatttatttaatttattttatttatttatataggcataacatatgcctaagttatgacctttaggcatacatattcaatgttgacaatttcaatttttatgcatacttttattgttctcaaggctagccttaaaatattattttcttggaacaaatatgaatatatgcagcatcagtcatacatatataaactcctaaggctcatagcagttttctggatgtttgacagtttaagactttaggttaaacatatggtttcaaatatcaagaagcagtcaaagacatcacaagaaaacaatatactaatatcttttctgaatagatgcaaaaatccaaaacaaaatattaacagattgaatcaagcaacatataaaaaggattatacaccatgaccaagtgggatttatctcaggaatgcaaggttggtttcatatacaaaatttggctactgtaatatagcatatcagtagaacaaagggcaaacaccacataatggtcttagtagatgctgaaaaatttgacatttgaaaaaataaaacaccctttcatgataatagccaccaaactaggaataaaagaacttctggcaggaagaggtggctcatgcctgtaatctcaggactttgggaggccgaggcaggtggatcacctgaggtcaagggttcgagaccagcctggccaacatggtgaaactccgtctctactaaaaatacaaaaattagccgggcatgatggtgggtgcctgtaatcccaactacttcggaggctgaggcaggagaatcacttgaacctggaagtgagctgagatcatgccattgcactccagcctgggcaacagagtgagactaaaaaaggaaaaggagaacttctgcaacctgaaaaagaggatctagaaaaaactcacaggtaatatcatacttaatagtgaaagataggatgcttgccctctaagatgagtaacaagaggagattatgggctgtctctgcttcattcaacattgcatggaggctggagctagagcagttaggcaagaaaaagaaacaaaagacatccacattggaaaggaagaagttaaactatttctatttggagatgacatcatcttatattgtatatagatgatcctaaggaatccactaaaaattatttcagctgataattcagcaaagattcaggatactagatcaatatataaaaatcatttgtatttctatacactctcagtggtcaataagcacataaaaacattattaaccatcagggaaatgcaaatcaagaccacagtgaggtgacatttcacatctactggggtggctataataaaaaagacagtaccaagcgttgatgaggttgtggaaaaatgggaactttcatacactgctggtgtgaatgtaaagtgatgtagccactttaaaaaatagatgggcagttccttgaaaggttaaatgtcaagttaccatgtaccccagcaattccatccctagatatataccccaaagaaattaaaatgcatattcatagaaaaacctgtacatgaatgttcacagcagcattattcataatagccaaaagatgaaaacaacacaaatgttcatttattgatggataaatggaatgtaatttatctatacaatgaaatattttcagccacttaaagtcaatgaagtacttatgctacaacttggatgaaccttgaaaacattatggtaagtgaaaaagccagttagtaaaaaccaccacgtattatgattccattaatatgaagagtttggaatagataaatctataggcatagaaggctgactagtggttgtctagggttgagggattgggaacaaatggccagtgactgctaaaaggggtgtaaggtttcttttgagagtgttagaaatgttctgaagttgactatgttgatggttgctcaacaaccatcagtgtattactgaaaaccattgaactgtacactttatatgggtgaattacgtggtatgttaattatatctcaacaaaaccactgtctagaacttgacataactccttattgtttcactaagtgaagctatgtatgtttagatacgatttgagtcatagcatcagcgtaattctattctataatcattatagaccttaaagtttaaggcagattatatgtcaggttgttgccagtagatagagaaggttcaaattaatactctgagaaaataaaagttatacagaactgtagctgaagatttcaatgaagaaacaaaaattgtaaaggtttttgtggatgacaagtagggtgaggaagactatggatggcagaatattttgaattaagttgaacattttaaatttaaaaattatttctatttttaaaaaacaagataagcttaattctttaccaagtatacctgcagcgtatgcagctttcttcagtagtgttagaatggtgacctggtgacaatatggcttaattttagatttgacttttttggaaatgtaatgttttttccttctttacaattttcttaacattttcttttctctggcttactttgttgttaagaatgcagtatataatacatataacatatgaaatatatattaatccatgattaagacttcagtcaacagtaagtagttagcaattaagtttcagggcagtaaaaatttataaatggatttttgactgcaatgggggttggcactcctaattcctatgttgttaaaagggtcaattgtgggctggacacggtagctcacacctgtaattccagcactttgggagactgaagcaggcagatcacctgaggtagggagtacgagaccagcctggacaacatggtgaaaccctgtctctactaaaaatacaaaaattagctgggtgcagtggcacgcgcctgtaatcccagttactcaggaggctgaggcaggagaattgctggaacccaggaggcggaggttgcagtgagcggagatagcgccactgcactcctgcctggcaaacagagtgagactctgtctcagggggaaaaaaaaaaataaaaagaatcaactgtggttgtttatggcatttctttttaatatttgtaagatctgcagataatttgctgtctttcattcctggcatgaaaattttgtgtcttgtgtccacgctcctctcctccaccctcgccacccccaccacctttcagtgctacctggaaatatttcttcattttattgatcttttcagcaaattacctttggcttcattgatttttctctgttgttttttcctttccagttcattactttcagcttttatgtttatttcttttcttctgcttacttggggatcgatttgtctttttttttagcttctcaagatgaaatttagattatgtgttttagatctttctgctctttctataagtgtttaaaaccataattagcctcccagcactgcctttgctgactgatttttgatatgttttaattttcaatcaattaaaatacatattctaatttctcttgtgacttctttgacccatgggttatttagaaatatgctctttctaaatatttgcatattttctagaagtcgtttttattgatttatagtttgattctattgttgttgagagtattttctttgttatttcgatccttttaaatttgtggaaacatggttttggtccattttatagtcttattacatgagcattttggaaagaatatataatcatctgctcttagatatagtgttcattaatcgtccattagttcaagttagttgatagtgttatttctcgatttcctgttctctagtttcagcaatcactgataaaactgttgaaatatccaataatagttctgaatttgattctgtctccttttggttgtggtagcttttgagtcatatatcttgtagctctattattgggtccatgtacatttaggatggttatgccttctttattaattgaccacttttttattgcgatagcttcccctttatttctggaagtactccttgattctctgttgtttgtttgttttctggacaattgtctgttttttcatcgtctgctttctgcttttttttttttttgagaccgagccttgctctgttgcctaggctagagtgcagtggcgcaatcacagctcactgcagcctcaacttcccaggctcaagcagtccttccacctcagcctcccaagtagctgggactacagttgtgtgccaccatgcccagataatttttctgttttttttttttttaatttattttttttttttttagaaacagggttttgttgcctaggctggtctctatttcctgggctcaagcaatctgcctgcctcggcctcccaaagtgctgggattacagacctgtgctgctacatctagccttcctttaaggtgaaatctcccaacaaggaaagaaaaaaaccataaactgaggttgctaagaatgaatcttctattcttaaaatgggaaagaaaaagtcatgctagttttgctgttttgctagttttgctgaactgcaaaatttgggccacattgcatgataaatgtccagttaagatggaaaggcattaaatttgtgggtagaagacatgaacaaacgtgtgttccaattcatagtagttggatttggtactgtctgcagtttcaggcatccagtggagatcttggaaaatacaccttacagataagggggactgctctattttctttatttggcttgctttaggtttatattgcccttctttctctagtttcctaagattattgatttgagaactttcctctttcctaatgttgcattcaatactatacattttcctctaagcactgcttttcctgcaccccacacattttgataaattgtagttttacttttattagttaaaaatatttaaacatttatcttgatacttctctgatctattttttatttgaaagtatgctatttaatctccaagtattttctaaatttaattttgttgtgatctgggggcacagtttaatttctgttttttgaattttgttactgtgtgttttatggtcccatccatggtctatcttagtaaatgttttatgtgacagtgaagagaatgtgtactctgaagtaatcagtaaatatcaattaagtctttttagcagattgatggcgtttttcacttcagctatgtccttgctgattttctgccagttggatctgtgaattactgatagagggaggtgtatagtctccatctctaataatggctttatttccccttgcattattagtcatgtctgatgaattttgttgttcttttgtagggtgcttacttcttaaggattattatgttttcttggagaaatgacccctttatcattacataatgtcttccttattcctgataattttctttgttctctctgagattaatatacctattataactttcttttgattagtgttggcatgatatacacttatccatccctttacttttgatctacctgtgactttatacttaaaagtgagtttcttatagacaacatatagtcaggtcttattttttatccactgtgtcactctttgttttctaattagtatatttagactatttacattgcaaataattattgatatggtagaattaatatctgtgatatttgcatcagttttctattttttgcagttatattttattcttcatcttcctctctattcttgccttctctgattttcattaaacattttatattctattttttctcctgtcttaaccaaaaaacttattggaaaaaattttcagtggttgccctaaagtttgggatatacattagtagctaatttaaattcacttttaaataacggtatgctgcttaacagatagttcatgtactttataacagagtattttgaacatctcccttccacctcttataacattgctgtccttcttttcacttatccatatactataatcacccatatgttgtttcgtttctgttatcactttgaacagttatatattaaatcagttaagaataaaaacgatttcattttacccttgtttctttctttttttttatggttgttgtttttgtttcctgagtttttgacctatataattttccttctcgctgaagaatttctttcagcatttcttgccaggcaggtctcctggcaatacattccctcagttttatttgccttagaaagtttttatttttatttttttgggggggggggataattttgttgtatataaaattttagtttgttgggtgtttttcttttaatacttttaaatatttcatacagttgtcttttggcttgcttgttttttgacaagcttctttcaaaatactctctttctctttggttttttgcagttatgatatgcatatatatatatatatatatatatatatatatatggtttttatcctctctggtgttctctgagcttccttgacttttgatttgttatttgttgctagatttgggaaattctcagccatttcttcctttctttgctctttttctggcattctcattacatgttggttacaccttttgtaatggtatcacagttcttggacattgtttcatttcttttattctcttttctctgcattgtagtttgcgatgcatctattgatatatcttcaagctcactgactttttctgtggtcatgccaggggaactcatttctgtcagtgttttcatttctatcattttcttttggttctttttcccacctcttttcttgcattacgcatatcttcttgtatgttgtctactttttccattaagtttcctaaaatattaatcataattattttaacttccctatctgataatttaaaaatctgttatatgtgaatctgtttctaatgctcactttgtttttttagatggtgctttttcttgtttttcttttgtcatgaccttgtcattttttttgttgaaagctggacttgacttgtcaagtaataggaactgagatagtaagcttttagtgtgaggttttatgttaatctgacaatgagctgggttttgtttagtatttgctatagctgtaagtgccacaggttttagttttccatagttgacttgtgatgttgtttcttcactctcttgtctaggataccttgagaactatttcctaaatagagtctgtggcttactgctctctcagttgtaatccactcttactatatggaagccctgttgatgaatgttggtaaggtcctatttttaaaatgaggctgaatttctggcctgtggccagaattgtttcttagcagttttttttctttctctttcaaaggagacaggacagatagatgcggccagagttgagtgtctgcttttcccctaggtcagagaagactttgtcgaagcattttccctgagaaggcaagtttttgttagggagaccagaacacccttggtgtatttcaaaactgttactgcaacaggagggggttttctctgatgttcaccgtaaagactgtcttggagctcttgaaggtaaaattcttaaaagtgtggggactcctctaagttggggctcctgggactttttttaactcccaagctagtgcatattcattctgcaggaattcactgaagttaccattttgattttcctggcggtttctccttcagataagccaatctcaaccgccattctctatattcacctgtctctccagaaaaaaaataaaaaagaataattttaatgtggttgtttgccctgtgacctaaattctcacatggacctaagaaaagtcatcggttttccatttcctcagcatttttcttgttgtgaggactagtggtaaacccaatttctttatattttgtagctgaaaccacccagctttcttttcattagtgtttgcatgataaaactgtccgtccttttaaccaatctgtcttcatacttatatttcacataaaaaacatattattgagtcttacaacaattttatctagtgtgaaaatctctattaattagaatattcagaccatttcacttaatgtaattattcatctaattagattacagtcttttaattttatttcatttgtatttctataaatttagggggtgtgagtgcggtttggatccgtggatatattgtgtggtggcgaaatctgggtttttagtgtaatcatcacccaaatagagtacattatacccaccacgtaatttctcatccctcacccccctcctgcccttccaagtctgtgatatcttttattccactctctatgtccatgtgtacacattatttaactcccatttataagtgaggatatacagtatttgactttctgtttctgagctatttcacttaagataatggcctcttgtttcatacacattgctagaaaagacatgattttgttcttgttttattttactttttatttttgaagacagagtcttgctgtagacaagaatgcaatggcataatcatagctgattgcagcctcaagttctaggctcaggggttttcccatctcagcctcccacgtagccaggactataggtaatgcgcgaccacgcttagctaatttttaatttttaatttttttctagagactgagtgtcattatgttgcccaggatggtcacgaactccttgcctcaggcaaatccttccacctcagcctttcaaagtgttgggattacaggcatgagtcaccgtacccggccctgattttgttcttttttatgactgagtagtattccatggtatatatgccacatttttaatccagtcttccaatgatggacatgtatgttgtttccacatctttactattgtgaatagttccgtgataaacatataattggaggtatcttttttatataattgtttcttttcctctggatagataccaagtagtgggattgctagatcgaatgatagttctattttcagttctttgagaaatctctatactgtttttcatataagttgtattaatttacattcccaccaacagcgtatgtgtttccttctctttgcatcctcaccaacatcttctatttttagactttttagtaatagtcatttggactgttgtaagatgatacttcattgtggttttaatttgcatttccctgattagagatgttgtgatcattttttcttatgctttttggccatttgtatgtcttcttttgaaaaatatctgttcatgtcctttgctgagttaagcccttttaatgttttggtttttatttgtcacatttgttcttggatcctttcccccgtcttttcttgccttatttgggttgaatttggtatttttaaagcattcttttaaatctttatcttatttgtttatacctgtttgattttttaaaaaataatttctctagattttgtaataagcacctgtatcttatctctctctatttgtagacagtattatatcacttcccatataatgtaagaggttgacaataatatacttccatttcctcatttggtctttgttctattgttttcatagattttatttccccatgtttttaaccctgcaatatatttttattattttgactttaaacaatttttaaaacaatttttaaatgaataaaaggcttatttacccacatctttatcacttctgatgttcttcatttctttacatagatggaagtttttatttggtatagtttttgtttagtctgatttacatttcatgtagtttctgtttgctctcagtgaattttttcagctcttgtttgtgtcagccaacatcttcattttaccttattgagtgttattttcatagatatagaatgctagtgacttttagcactttaaaactctttttagattagattctgtttaacattttgacaagtaatctcatcatccttgtgttcatttctctatgggtctttttcactctgtttgcaacatttttgctatatcactagcttagggtaatttgattttgatgtgctatgtgtttttttttttctttctttcttttttttttttttgagatggagtcttgctatgtcacccaggctggagtgcaatggcacgatctcggctccctgcaacctctgcctctcgggttcaagcgattctcttgcctcatcctcccgagtagctgggactacaggtgaccaccaccacacctggctaatttttgtatttttagtggagacggggtttcaccatgttggccaggctggccttgaactcctgatgttgtgatccacccacctcggcctcccaaagtgctgggattacaggtgtgagccaccgtgcccagcctgatgtgctgtgtgtttttcttgtgtttatcctgctcagggttcgttgggtttcttggatcagaaggattacagtctttatcaatttatgacagttttcagccattatatcttcaagtatttttcttgtatttcaatagcatgttagaccactttttccaactggtcattgaggctatgttcaaaataaatataagcaatctgttttggagagtacagtaacgtgttttttgatactttgtagaattctgctgatagagatgaagatcctatttgtcattgacattggcagcttttatcacattctgtaataataatcattttccctttccattttttagtatctttaccagttttcatctcctttgttcctgatgttttgggttcacattaaatctttgctgcttgatttattccttgcttagacttatctgtgctgctttaaacgaaccaaggattgaatggttttctgtgctcagatctaacatatttgtgaaagagaccctcctgccttttaaaaagcatatctttgtggcattgtgaaaagttcccagctgggaatcttggattctagtctgcttttgacagcaattacaggacctaagatctctgaggtgtagtttactaaaccattggttcctgaatctggccatgtacctaaagataacgttctgaattcccattcctcaagtgtctgatatcatagatgtagtatgggatttgggaagctatctgtataaaaagtcacctaaatggagcctgtttcactgttgagagttggttggtcactacttcttcatggtttaaccaaatgtcaatcaggaaatacagaatgtagaggcatcaggatgtgtgaatgttcgtatcttgagtttagtttgggaacaaagagcctaaaatgtgttcccaaatgtgactggtcagtcaagaagtggcactaaatacaaacctagccacttttctcctttaaattagaataaaaatacctagctcattggattgttacaaagattaaatgaaatgctgaatataaaatactgacagtaataacagcacttaacatcttgcttcctgtttttatttttataaactcagttaccaatctagcaacttgcttttcatagagtaattggcaaagtaagtaagagagaaagctgaaacttaaacacaaaaccaaaaaatgaggtatgttacgtacctgctagggcatgtaacaaactaagatcagtgctgtggagcacatgtctacaccaccttgggagcaaaggaacttccagcaggactcacaggacaagtatgaagcactagttaatctctgagattcatttaagatataaaatatttttctaaatgagtcattttctacagtcttggcctattgatatggtttaggtacatgcaagctaagctccttaattgtctgttatctacaagaatgcttctctttttgcccagcaatatagagtatcagcatttctatcagtcatcaacaagcttgatagtgaactgtcagctgctcagctcaggggtagaagagctgagtagttatgaaagaggcagccaagggacacactgctgagtccatccactagatcagccagtcctgacatgtatgccataacagccataacatattaactccacagtcagtgaagaaaaacgcatcatatgtaagtgtgacaagtattggtttaaatatgtataaatcaaagccatatattttgtttttcatcaagaataaataaaagaaacaatcctaacaagaaattttacatttaaaacgatgttaaaaatgctttcctactgaaatttagtgctaagaaaatgttgctgtcttgggaagaactaatatggatactcttaatcaaatgatgagaaagatatgatttttaacctacttatattttatttctaaagtattttgaatgtaaatagactataaattgcaattttagaagtattttggaaataaatggagtagaaaagataaattttaaaatgttctgaaattacacaaaatagtaacatgaggtcatagtatattttctttgtaatacatggtgataagcacttaagttttgatatttagtttacagttgaccctgaaaaaacttgtggaaccaaatactcaagaaaaaagaatataccctttagcactgctgactcaactgctgtgctgagaatccttctattatttgaacatttttcccctgaaatataccactttataatatcagccattcagttttgaagaactataagattgttttcaacagtgcaaaagcccttaagctttggaagccaggaaattaaaacatcaggctcttttatgagaaaaccaagtaaatttgagaacatagtgaggaaacagtgtcaagctatgtaatattcttgaatgtagaagaactggaaggttgcacatgtatcccctgaacgtaaaataaaagttggaaagaaataaaattaaataaactaaaaaaaaaagaaaaaagaaaaaactgaaagtaacaagagaaaactaattaaaggctaaatttcttacagaatttttcgttataaaagcctggacagataatgttctctggaagtgtagacgcttagaattgtgaaagagtggcatgttttaccagaagtgtacatgcttagaattgtgaaagagtggcatgttttaccggaagtgtacacgcttagaattgtgaaagaatggcatgttttaattaggggaatgcttatggtgtgctgtaatggtattacttgcattggtcctgttagttcattcagtaacacactttgtgttacacagatgcacacacacacacagctcctaaagttgtggtttcatgggataattgcatgcctgacagaatctgaggtacttttctgtattttatgccttgaagctacctaaggatgagatctttgtacaattattccacctcatcaaaatctgttcaaaactgtgttttctagagtaatttgttatcttctattgtgtttataagagtactgtatatgaaactttctttaatcttttgtcactttttctctattcctagggaaagttataagaaaagaaattatatgacagatgggcatttttcttctgcataagcatttactaagcgtattgctcaaaacacatctgcatttgagggcaaattatttgccgtgtgtcctgcaaataattctcccagttgctttgaacactgtgtttgcaaaacttcgtatattttgtattcatataaattaatttaaaggtcagaatgttgtgaagtaattttgtgtgattaatttatttaggggaaagctaaatgccttgctagctttttggttacagaatggaaaaggtggtagaaattattgagagggagacacaggaaaatgatgttgaaaagtgtgttttcagctaatatagaaacataaaacaatacacatagtatataaaatattaatttgtaggttttcctagaaattagtaaaaattgtattttgtggcagttgttaagaaatgcatagtaattatgagcagagatttagaacccagcgctttttccttcatgccagaaaccagtggatttgatgatgtctatacttgtcttatctttctttttccttttctggagacaggatcttgctgtgtggttcaggcagaggtgcagtggcatgatcatagctcactgcaacgtcaatatcctaggctcaagcgatcttcccacctcagcctcctgagttgctgggactacagacatgggccactactcttggctatttttttttttttaattgtttgcagagtcaaattctccctgtgtttcccaggccagtctcaaactcctggggtcaagtgatcctcccacctcggcctcctaaagtgctgtgattgcaggcgtgaaccaccgtgcctggccaatttttatgtttctgttggtgccactgagtgaatggaggtgagggcattcaggtggaggaagctggacatgcttgtctggaactcagaaggtgattgaattagaaatgaggatttggaggtcattagtgtataaaatggtaggtgactgtgaggaaatcagtctgacaaaatgagttctgtaggggacagagacagacattgggaacaccaagtgtcaagggtgtcgagtgaaaagagcctggttaggagtgattagaaaagtagcaggagaattaggaggtggtgatatataaagaccaagggaagggaacatatttcaagaagcatggcacagcctccttgagtcaaatgttgtcacctgtcccaggtggtctggagggtctagctgagtctggaagttggatatctgaggtgtgtgccagttggcagacctctgtggttttctctttgaggtcgaacacactgggtgtagaagtggagaagacaaatgggtaggttgtactggattaatggaagatcaagaaggtaagatattggtcctgatagagtgagtcgagtgacagactatggggtctagacttttttctgctgtaccaagatttctgatggaaaatgagccagcagaaacgaaaactgttaaagtagattttacatgtcaaaatgccagttgatttaggatgcaactccaggctctgtccattccaagacacataaatttgtctctgctttcccctgaaagagttgaaatcataaagcggcaattgtttcctgaggggtaaatggccattatgcactggcttcgactaggattttcttacctctagcttggaccatacagttgaattccctgaatcctagtgatacttaacatattgcacgaggccttgtattttgaggtaatttaaaacgttattaatccaggccccattgagtaaggacttgagctattccagacacaagccttattaaaactcacagtaacagtctctgaaaaaagttccactaagcaaactaatagtgcaaacaagattttagcaagaatgtttgaactacttacaacaggactttgtttataagcacccttaagtacttcttaagtacttgagaagctctgacttacctataaactgtctatatactcattgcaaatcacccttatctggttattaaatctgtggattgatactgtgtaagattttattagtttaattccagttgctgtattttatagatttcagccgctaatgtcaaacattcgctcaaataattttctaacgagcattattaaatccaaacatcagaaacccactgaaagctttcttaaaattagggtctgtctttgtactccttgctcctgtatcccacaatccttattttgatcacttctgctgtctcctcacacaattttgggaaatgtcattggatgaagtgttcaggatttctttcctgtttccagaagtctcaagttgtggtatcacccgctaagttcagtgatagttcagaaggcttctgtcagtaagaatattgagccaagcccaggggatgtgtctttgtatcaagctcccctgtgttaagcaactatgagctgtcagacttccctggtataatatctggtatcatctggaaggacttaagaggagaaatacctttaatgtttttaaaattagttaatatcatagtaaattactgagttgtaaaattcaaaaaatggctacattttactctcaaattttgagttgttttgaaatattaatagtaataggtagctatttcatggtgagggataataaatagcggcgtcttgatggcctccataggtcatgatctccacaaagcactatatccagaaaaagtcctttaaagactatgctgctttaaatctgtatcactccttttaggctgtaggcgttgtatgaccaataagtactttcaaattgtcagtctaatggaagggcttgccctagagccatttggcaatgaacatactctaaaagcttgaataaataattttaaatgtagagatatatgtccagatgacttatttcattgatctctgactattttgtatatttcaaagagaagaagagccttgtcacaagctgaatcatagccatggaagagtttaactctgtggcatatagttcaggatgctatgtgaacatgatatcaatcttaatttaatgtgtggtagatgtctaatgccagaatgtaattacctacattggatctttaccagaaatttagtgcaaaatagctgtcttgggcaaagacagcattggaaaagggacataataaacaggagtttggtgcagtagtaacttaatggccctgaccctagctcagggcagttgtttccttgacctttgaaaggtgtcagtttatttctgagacgattttatccttccttattgcacagcaagttgtttcaaaacacaagaatttgctactccaaatttaactgttttgtactccaatttaactgctttgagattgtaaggcaaatactttatgattaaggaaattggtaggtcctgtgcagctcttcagtcgtagcaagtcttactctaggtaatccctttggaatttgatgctggtgctgccacttggacatttctgctttaatttttgtcacagattcttttggggagtgggtgggatataaatgacaagtgcttgctaaatttatggtttaatgggcagattgtttacactagtcatttcgcttggcagtgctttgatttgttggaattttaagtaaattattttacttatggtttcctaatttgcaaaattgaaatacgtggtctctccttacctcaaagagatacaaagaatattaataaggtaacattcccaacctcagtgggattctgatgccacataaatatatggtatcatcatcctcctgctcgttatcatccattagcaacattgtcgtcaaggttttctctgtatctagattaattatgactaaggagtaaattattccatatatggaatctgattttcactctgacactcttttacaagtatgttagcttaggtaacatatactttattatcaggtactctattatagaagatgatcttgtggtagccagtgttctatatgttcaaacagggattcttcatgttaaatgtatttttttttctgacttttggtagttggaaaaaaggtttataaaagctcaaattttcaaaataacctgtccacaagaacttttccacacccatgtaagagtggtagatatttctggcatgattttaaagtacatctaatttgtgaagataagaatactctattaagtatgggattttttacaggtgtaacactttgaaggtactagagatttaacagtagatgttgaatttatttctaggggtagtatttgtgatttctgttacagtgtctttaaaaagttgtctcatgcatggattttcagctcagaagtctatcatgcttatctctgatgtggtttgaaattattatgaaatggagctgtatggcctagaaccttcttcaatatttaagttcttgaaattagcacagggtaggatttcatagaagcatattttcagtttaaggaataaatagtgacattgaaagaactcctcaacttcagattaattccttttcattagattaatatttgacattagttcctaaaagatcctcaacagtaaaggtaagaaaggattatgaaaaacagaagttgacacattttttgacagtatgtttacatttataattcagtctctaactatatccctcattcatcctgccttatctctgtagtgtttgccaccacctgatacataacttttgttgattatttccttccaataggataaaggagccctgagggcagagacactgtctttcgccactaccgtctgacatgcggtaggcacgcaacaatgtttgttaaatgaataaatgaatgaataagttcttggtcttagaagatggtggaacaaaggaaatgtgattccagaactttatataaatccaattttcccttcaagaccattttaaaacaaacttttaaaaacgaatattaaacaattgtgattattcagcacctatgcacttctacttggaaaccatctgagagtataattcagccagcaaattgatgaagcaaaataaaattggaatagtaaagccacagtaaaaggaattggtggcaaatagtgaatgtatttaaatataaaactgagactgctacatttaggtcttagatccatttgagttaagttttatatatgctatgaagtaagggcaaacttcattcttttacatgtagctctccagttgtccgtgcaccatttgttgaaaagactactctttcccactgaatggtcctagcaactcttgtcgaaatcagtcgatcctagacacatgggtttttttctggactcatgtttctagtccattgatttgtgcatctattcttatgccagtacagcactttctttattactgttgcttgtattataagtttggaatttaggaagtgtgagtcctccaactttgttctttttctggttattctggatcctttgctatttcatatggtttttaaaatcagtgcatcagtttcaaaaacctaatgtaagagctaaaagcataaaactcttaaaagaaaaaaattagaaacctttgtgtttcaaaagataccatgaagaaagagaatggcaacccacagaatgagagaaactatttgcaaatcatgtatctgataagggatagagatttagaatatctaaaaactcttacaactcagtaataaaaagacaacccaattaaaaagtgggcaaaggaactgagtaaacatttctccaaaaaagatttacaaatgaccaataagcatgtgaaaagatgcttgacatcattagtcattagggaaatgcaaatcaaaaccataatgaaataccagtccatatctattatgatgagtggaatcaaaagtcagatcataacaggtgttggtgaagaaattagagaattggaaatctcgtacactactgatgaaaatgtaaattagtgtagccacttctgcaaacagtctgtagttcttcacattgttaaccgtagaactaccacttgatgatctagcaattctactctacccaagagaaatgaaagcataggtccacacaaaaacttaaacaagaatgtttatagcagtgctactcatagcagctaaaatatagaaacaatccgaatgtccatcggctggttaatggataaacaaatgtattatacattgggtatacaaaggaatagtatttcttagaaaggaatgaaggctgggcatggtggtgtatgcctatagttccagttacttgggaggctaaggtgggagaaccacttgagcccatgagttccaggctgcagtaagctatgattgtgccactgcacttcaacctgagcaaaagagcgagaccctgtctctcaaagaaccactaaaacaaaaaaagagacttcatacacaagtgagattgacagtttctttttaaggtaataaagtagtgatacatgctccaatatagatgaaccttaaaaatattatgctaatcgaaagaggtagcttacaaaagaccacatttacatgaaatgtccaaaataggtaatagagacataaaatagttgagtgggttttagggattggggagggttgaagggacaggggttggggaggtgactgctaatgaatacatagtttcttttggaatgattaaaatgctctgaaatggactatggtgatagttgtagaaaccagttaatatagtaaatactgtccgggagtggtggctcacgcctgtaatcccagcattttgggaggccaaggcgggtggatcacaaggtcaggagatggagaccatcctggctaacacggtgaaaccccatctctaccaaaaatacaaaaaattagccgggcatggtggcgggcgcctgtagtcccagctacttggggaggctgaggcaggagaatggcgtgaacctgggaagtggagcttgcagtgagctgagatcatgccactgcactccagcctgggcgacagaatgagactccatctcaaaaaaaaaaaaaaaaagatatagatatatatatatataaaaaatatatatatataatatatatatataaaatatatatataatatatatataatatacatattatatattatatataataatatataatatgtatataatatatatattatatatatcgttatgtctcaataaaactggtatttttgaaaagtaagaccaaacagctgtgtgaactatggcaacagataagaatgtcagtgttaactatgtttttaagaaaggggagtaatatcatctagcaaaattgggagaggagatttccttatctttcacagcatattacccttgtcctaattcctgtcattcatttttgtttgtttttaaaatttatgttctcattttatttttttttatgtttctgatgtctctaatggatctaatttttttaaaactatattctacctccagttgagtccaactatattttgttggttgttcctcattagaatatttgaacttgtaaattccaagactgtagcaaaatcttcatgccactgtatccttgccaaggatcaaaggaaatcttgtgcaaacttttaagctagtctgccatcttctacctgaaattctaggttttgtagaaataacttatattttaaatactagatcagcttgtttttacatcttttaatatctttctgaacaattgcagttaattcattatctgcagttttttttttttttttttttgagacagagtctcgctctgtcaccaggctgtagtacagtggtgcagtctcggctcactgcagcctccaactccctggttcaagcgattctcctgcctcagcctcccaagtagctggaattacaggcatgcaccaccacgccctgctaatttttgtatttttagtagagacggggtttcaccatgttggccaggctggtctcgatttcctgacctcatgatatggccgccttggcctcccaaagtgctgggattacaggcgtgagccaccgcacctggcctattatctgcattatttaaaatggtttgggataattagaattattatctttattacttattgcttgttgcatgtcttatctatttgtacttttttggctgaagtatttcccaagtaatatcttgcattggttgtataatttctgagtctttttgttttaaaaaaaacagttttcctttatttttatgcttaatacagctgtcccttggcatccatgggggattgcttccaggagccttcttggataccaaaatccatggatgcccaagttgcttatgtaaaatgatgtgatatttgcaaacagcatatatacatcctgctgtatttttcaaatcgtcttagataacttataatacctaatacattataaatgctatgtaaataattggtacactgtagttttaaaaagtaatactttttattcttgtatgttattaaaatttttttctgaatattttgaattgtggttgattgaatctgcagctgctgaacctatggatacgaagggctgactgttaatattttgtttccattctggggttataatccttttcctcagatttgtgtaattattgctctatactttttagcatttagaattgccttccctgtccctttcttcctcttcttttcttccctccttttccttcctttccttatttcttactagggagctcatagtgactttctttttattattttatttagaaactctaccaggagtttgtgcgtagatgatctgtcaatattcttatctggtatttcatgggctgtttatcctcttggaagtttttcgttaggttgatgattctttctctttcattcaattgttttcacagctatgataactcctggatatgacatttatgtttctcatttgttctttcattatttttcctttacattctggaaggtcactttcagatcattttctaaatcaagatttgatcttccccgatgtttatttgtttgcctaaggtctccagtgagtagcttccctaagtaactggtttttcatttcctggagctctttcttggtactcatttgctcttccttcttcataggcttcttgtactgcctctgagaggcagtatctttgcatttcccagaagatacagaggaaaggccgtttcccctgcctactcagcttggctcctatcccatttttggtcttcttccagtgttcattgacccttcatagcctgcttgtttttatagagaggtataaactgatcaatgtgggtagttggcaggtgcccctcgatgcacttgtggaagtctctgtttgctgtctcccaggggtctctgctcaccaaattggccagtggagatgaacctcactagggtccacaggccaaaagttggccttcccttccaggtgtatttcctgggaacagacaagaatcatgatccctttaggaagccaccacaggggttgaggaggagttttctgcacactgatgatttctgtccaaagcagaggtcttagagatgtgatgtgaagtcctcacatcttttttttttttttttttttgagacagagtctcactctgtctcccaggctggagtgcagtggcgcgatctcagctcactacagcctccgcctcccaggttcaaacaaatctcctgcctcagcctcctgagtagctgggactacaggcgtgtgccaccacgcctggctaatttttgtatttttagtagagatggtgtttcaccatgttggccaggatggtttccgtctcctgacctcgtgatttgcccaccttggcctcccaaagtgctgtgattacaggcatgagccaccgtgcccagccagtcttcactttctcaagaaaaccatcaataactgagacctattccttcctcaggtcttaagaagcagttatcagaaccaactttgctatctgccagcaccttccctctttaccccatcccttcctctgcctggctgtcagagcacattgagtagaaggagggggctgagaatcatcagcccactaggaaataccatggccgttccctcctctcaccaagctaagtgaggtgggcatcagaagacttacttggaaaattcgatggtgctttaaaaacaaaaaaaaagactagggtcttactccttagttggaaatctgtttaggtagtatggaaaacactgttggttgtctgtcaatttctgtttttctcttctgagtagtggaattctcaatttttgtctgagtacatgtcctcagacatgaagaactacattttttagctccccttatacctaggtgtggtcatgtgacccccttctaagaaatcacttttaggtagaaatgatgtgtgcagcttcctagaagaatccataaagtagaagggaaataatcctcttgatgggaaggtgcatgtgatggcaggaattctgccaaccattttgtaccaagagttggaagccatatgatgcagagagtggagaaatatatagaaaaaaataacgtccctagtaattgttaggatactacgctagcccttcctgtctaccagcagacttatgtaagtgaaagagaaataaaccttcatcttatttaaacttctctagcttttctatcactgttacatgagcttagttctaatagaggtagtctactaaagcagggaagaagagaatgggaagagaaatggcagggcagagagaaaggacagcagtggaatagccaccccctgtctcttaaaaaggtacactacccagaagatgcactcccagtgaggaaaccccagcagctggacactgtaagctgtggtgttgttggctgtgcttgaagcagttgttgggggcagggagtgtgtgagaagaggctgtcccttggtaccatagttatagaagaatgagaaagaggaaggaggaaggaagaggaaggaggaagaagaggaaggaggaaggaggaggaaggagaaggagaaggaagaaggagaagaagaaaagaaggaaagaaagaaaagaaaagaagaggctatcccaaagccatgtttctccctccctcagggaactgtgcagtggtatagccttcccctccacccccaggcttttgcagatccaacttcagcaaagcatgcttgagttagcatgtgtctatttgccacctagcgacccagctgggcattgttaaacaaagaagtagagatcaccaaaaagaaggaaatgtaacctcaggcagttaagcaggaccagaaagagggaggtgttcccagaaccaggttcagcttctcttcccagtcagtggagagcctggcccttcccaagccacgtgccctgagccataggactggcttgcattagagtggtgatgtcagaaagtaaccaggaatgtcttggatctgcctgcatgtggttgaaggttcttcttaggagaaagagtatttgacagtgcagctgggggcagtggtggaagattaaatgcttcatgtgtttatctccctaagtgcaggatctctagtaaacctaacgcaggtacccatggaaatgttagtgcggatggagttgattttgttgttgttgatgttctctctgagacaacacagggatggaatactgtggacagccactctctattggagtttttgatagaatccctaagtgtgttggtttgcttcccatcttctccttcttccttactctttttggtagagcccgtgcactggttagggctggggtcacaggcagcctgtgtccagtcagagctgtagctagcagaggagtagacctggaggtgtggtgcaagactggtcttcccattccctctctgtcactgtggtcctcccttgtaccccactgtaaacgatctgtggcacaacacctaccctcccaattacatggtgagccgtgttctccaggcattgccatggtggcccctcagtttctgctgccccatttctccctggctgtggtgtacagccaggttgctgcttacggcttgcaggtttttaggggtttgtaaggtgccttcgtataaggttactgcctctgtgttgtgttgatgctaactaagcatggattatttttgtgtgatccaatcatacatgctttatagtgttcaaaaaagttctttagtttttcctttgttgggtgttcccttttctgtttcctagagctgctattgatatttttcttaattttatattgctttagtgatttccatatgacttttttaagtaggagaaataaatgtgagttatcagtttttcttcttaaaagtgggactatgttgtgtctttgcaggccatgtatcccctgtgtgcccttcctcccaacctatccagtgaaactcagcttaatgccacctccttctggaggccccaggctcccagagcatatatacacatacttgctaaagtcctttttctctgcgtaccatatgcccatacttctgattgtgcagtaaacagattttaatgttattattgctttgcatctatgagacccagatatatcatgggttcctcaatgacaaagtttgcgcctcatttatctttctgttcccaaactcagcacagtgcctggcctgagtaaatggttcataaatgtttgctgaagggttatttatggcctgccttcttgatgctttgtgaaaattaaaagcttgcaaattatggaatatagcatatcatttccctcatgggaaaactgaaatactaagaattagtttcaggagtgatgttaatatcacctaagagtgtagccttctactttcacatactaactttctatcatgattgtatatttgttttggttgagagaattggaaaggggtttgtgtctgtgtgttttgttgataaaatattctaaatgttttttagcataaaaagaacaagaaaataaaggagacaatgtgactttatcttgggagccacatctaagtacaaatacaaggaataagaaaattattcagattcttaactattctatgaacttataaaaccagttcttaaatgcctcctttgcaggcttccttgtaagtcactacaccaaagcagttgctgtaatggaacatgttaaaggctactgtcttcacttccttcaagcactagaaaagtgtggtgggaggtgtggagtgggtgagcagaggtgggcagagccccatggagtgggagacctctcatcaccgtcccgtggcactgggagaatataggaaatttgcagctagagctagctttttaggcaagaatccactcacattccatacgtggctgatgataagtctttgtctggatttttaagtttcttttgaacttatataaatctttactttttctgccttttttttttttagagaaggagtcattaaagattgagggctggagagtaaatgttaggattaacttaaagctctgcaaacatttataaaatagagctttgtgaggaattggagaatgaggaaataataatgaagcacggccctgaagagatagaaacagagcttccgtcgcacttttttgtttcttgcctgaggatcatcttttactttccgtagtaagattttcttttttcttttagcagctgccttcggcagaggtttattgagcatctagcagctgccaggccctctgcagaggtgttgtccatacacatgtggaataatcacagaccttgctctcaggagtccacaagtcagaagtgtagggtcttctattgcagctgataatgtaatgttgaaagtgatagaggaaaagttacctaattcaggattgagggattaaaaagaaggatgaattggtcaggaattcccccacatgactaaggcagcaatgaaactaacaaaaccacgagccagcatagaagcgagaatacccataccctccgagaaggaagagaagtttggtggactggatatacagtgcagtgtgggctgggcaaggctggggcaagggagaggagatgggactgcatccaggtgacagagcactgtgagcgttcccgagagaatctagtatttattctgtaggaaaagcagctggacgatctactcacatctgtggtgctgcatcattttccctttaatagttctttcttttcattcataaactatttcaaatatagtcctattgaaatgtcactgtgctttttgtgggaagtgcaggggatgtgttggttgggacagagctggtcattggaataccagaggaagcctgttcatctcctgtagatcaacacactcagcaggaaagtaaagagcagcttctctttgccaggcactggccctcagtgtttgggacctgttggggaacaaggtaagccctggtggggagtacattcatgactgaagacagtaatactgagtaaataagccaacaggccagcaagttatatattcttttagaagatgatgaatcctgtaggccaaggattgggagtgctagggcggaggcagtgtgggcatgggtcacagagacctcatgtggaaggcaacatttgagtgaaaagctgagtaaagttgggggtggtagccatgcagatttctaggggaaacattttaggcagtaggaacaggtgctgcaaagcccctaggtcgggaacatgcctggtgtgttgaggaacagcctggacgctgatgtgggtgaataggcaagaggattggcctgggaaaatggcagtggagcagagaagacctgaggttagcctgaagaaggggagggaggagtggatgatcaccagccttgcttcaggtgaggtggtggccatgaacagcgaaggccagagagatcaccaggttagtgaggagattttagacagggtgagatggagaggctcgcagagtgcccagttaagggccaattcgttgtgtagtgtgagtctggagctcagcgggggtactgggctagaaataccccttggggaatactcagaaactcagaatatatgctcaggtacagctgccctaacaaaggcccacacactgtgtggcttaaacaaaaggcatttattgtctcaccattctggaggctaatgtccaaaactaaggtgtcagcagggctgtgctccctttgaagcaggtgggggactccttccatgcctcttcctcgcatctagggatttgcagcgatttggccttccttgccgtggagctgcgtaactccgatctgtcctcatcatcacacgacatctccctgtgtctttgtgtctgtgtcttctctcctcacaaggacaccagtcacggtggactgtgtgccaaccctacccctgtatgacttcatcttatcaaattacatcggcaggtactctaattacaaatgagatcacattctgagttgccagggattaggacttacacatgtcttttctggggggacactgttcaatcccacactaggcaacatgaacgaagccctggatccagaaaagccagtaaagaaaacagagaaagaacaaccatagggatcagaggagaatttgggcaaaatgaagtgatcaaagtcctggggagagagagaagtcaacactcaggaaagtcaggagcacatagtcctagaaagggtattggacttggcagtcaagcctatcattggccaccctcctaagagcctggtcacaggagaccagcggttactggtggtaaagaagggaagcagccaagcaggctgttctttctaaggtgtttgacaatgaagtgaagtggggtgggtgacgatgtggggagtaggccaggtgcgggaaaggagatggagctttttaggggggcccttgagcacttatatgagaccagaagaagaagttgaaaatgccggagctgtggaagagcctgggagtcggggcctgggagaagattggtcctggaaaggaatagggacatctctcccactaagaggcagaaagaagggaagactggtggagttatccaagtacagcatttgagaaaacttacactccagtgacttgtctgttttctgggtgaggtaaggggatagtctgctggagaataagaggaataggaaggggtaggaacattgagaggaggggtagagaacccaaaagggagctaattaaaaatatgtgacatgactgaacactatactgactaatattacaacatccttactaatattaacatccacaagttgataatgcccacttaacacccattttttggcagccagagagttagagtagaaggaaaaacaaacagttggccgggcacggaggcttatgcctgtaatctcagcactttgggaggccaagatggaaggatcacttgaacccaggagttcgagaccaacttgggcagcaacatggtgaaaccctgcctctacccccccaaaaaaaaaaaaaattagctgggtgtgctgatctgcgcctgtagtcccagctactctggaggctaaggtgggaggattgctttagcctgggaggcggagattagaatgagccgaggttgtgtcactgcactggagcctaggtgacaagagaccctgtctcaacaaaaaaagaataaaacagaaacaattgataaggggttgacatttgtcagggggtatgttccactatgtattagtaagaatacaggttaattgactgatcaacagagaaccagccagattactgaaagaaagtggagacaacatctgagcagaaggtgaagtcaatggagaatttcctttacaccagaatgtggctttaagaggtcacagtggaaggccaaagggacagggacttgttaggatgggatggtggtggtggtggcgctggctaacatttctttctttctttctttttcttttgagacagtctcgctctgtctcccaggctggagtgcagtggtgccatctcggctcactgcaaactccgcctcccgggttcaagcgattctcctgcctcagtctcctgggtagctgggactacaggcacgtgccaccatgcctggctaattttttatatttttagtagagacggggtttcactgtattagccaagatggtctcgatctcctgacctcatgatccacccgccttggcctcccaaagtgctgggattacaggcgtgagccattgcgcccagcctatggctaacatttcttaagcacctacgtggaaaatcttcacagttgccttgtagggtgaataatatttgtatccatcttctacatatgaagaaaccaaagtactaaaaggttcagtaccatgtccaaaattgcactcctgctaaaaagtagagctgggcctggccccaagggcgtatcttcagcccctcacattggatgtgctccagaccagggaaggcagggccaggctggacaggggtcacagagagcagctagccaggagtgtgattgtgaatctccagatgagggtcaggccgaggggtagcatcagagaggagtgtttggaagggagtgtaccagtcttggtttgttgtggcaggggaccctaggaggagttagtcatctagtgcccacagtgttctaggtactcagagcttttttgcgtttcaaagattaaacaaagtcttttggatttttccttacaaatctgcagagtgaattttctgcctcttgaatttaaatgtgaagtgtcacgctgggtgaaaatatgaacatgtgaacacaaagcctttcttagcctttcttctttggggatctcagggttaccctctcccctcagagcaaactctttatctctctctcttttttccctgaccttgaccacataccagcctagctgttctgatgtaggaatttgcacatgtaaccttctcttccattaacagcctttttaccaactctctgcttctcttcctcacaccaagagtatgcccatttcttagctctcggattctaaagtacttagccctatctacttcttttcttggccttaaatgtcttggaaagtattgcattaaccaccagattgtaacttgtaggactttcctaaattcccatacccccatgaccttccactatgccagttctgtcatgtggaataaacttgtgtcaacgttctccgttcccattgtcaggatcattactgtaagaaaaaatgagcatgggctcatgccccctgcagctctgagtccttgctgactcttggaagtcctctgtaatccaagagggccagcctttctgctcttactgctcactgctcccggcataactcttgacaagtgcagcttgcccagatcaacctggggttttcttaagctttttttttttggttctcacctgtgtttttttccaaaccatttatctatatcctattcatctctcaaagctagctaacaaacattcaaaatatttcaaaatccacttctcattttaaaatattgatttattttcttttgttattttttaaaaacactgtttttaaatattgtttttaaacattgacaatacttaagcctatcaggccctgattgcctgtttctacagttcaaaataattctttcttgttaaatacacaggacatggcattattacagatggcatgcatgttccaaaattcacatggagggttattctaccgggaagaacgtgcagttggggtgagctggatagggagcccaaattggagcacactctggagcaccctgggtttggagcccccctcgcccccaccgccaagaaggagctctttcatcccaaagggaggagatgagggtgggattgggctggagaaggggtacagttgcagggaggatatattatcacattcttttttttttttaacttgtatatttatttagcttcagcctgaatcacgtaggcttatatgaagttaagccactatttactatattgtatctaagagaaaatatactctgaattatgaaaaaccatcatgaaaatatactcttagaggcaacctgattctaaatcacaaccaccttgtttttagaaaaagtgaagcatcatcttggtgttaaattgcacagaaaattaggctaccaattctgtatctagcttgtagttaaagaaaatagtatatgttatagaaaatagtaaagaatgcatatgggggctgtgcatatgcatgtatgtgtatgtgttgttggtggtttggttgttttccttatgttattattttttccttggtgttaatcccagttctgttgcttactaactgtgaccataagcaagctccttaattgctctgagctttagttttttttcgagaggtaaaataaatataatagtagtccctgactcacagacttgtcataatacttaaatggcagagtgcatgtaaagcacttggcctagtgcctggcacatggcaaatttcaaacttaaattactatgaagtagactacaactgcttcttcagtgcctactacatttccatttttatgtttcattcttttgcttagaaaagctttaccatatttaaaagtacaacccaacgtcctctccctttccagcttttttcccccatagttcttatcactattgaacttactatatatttcacctctttatattgtcagttttcttctcctctcactagaatgtaagctctaaaaggcagggatttttgcttgttcccttcacgattgtgtcctggtgcctagaacagttccagggccttaggtgttgcgctataaatatttgttgaatgaacaaaaatacgactgtcaagtgatagttttgcaaatactcaatgtgtcttaagcaaaaactgaaaagagtaaaatgagagaaaattccataccaattgagagacacagcaattttcagtagattttaaacttcgagtgtgttttaaatgtatgtatataaatagaaaggaagaaaaaaaaagttgaaaaaaggttttaaaaattcctttcccacatttagactcagtcttttttcccttgacacaaataaggaaaatatgaatgggctatctttttacatcttcatactaatgttctctggtggtttctcaagtcccttttctgcccctaacttctgtgtagtagggaagcttctagcacagctggctctggcttgtgtaagcaaactcacagagcactaccatgtcactcatcacagagggtacaacgttgcctcaaacaacaaaacctcttctggctcaactactggtttattgtgcttttgcagtgtgaaataaagagaatagtgtttacaatatctcctttgaaaaaatgttgtctcttgcttcttagcttatttaccatccttcttacctcccttccctacccagcccccttactctcattctgtgtagcttaaagctaaaaaaattttgaataatgggctggagattatcctggaagagaaattgctcttaccaaatatccctgacagctccccagaccattaaattaatagcaatgagtggagagataagcaaaactaatggcatgcttaaagctttgtgacagaggtttggagtcatcatgattctcagggtctcctgagatcactcctacagccctcctttcattttcatactgtagtgtttgattatgtaaagtctgccttcacagagaagtctgaagattagctattaatacagctttgtgataatgtagcaccacattcttagaaacttaagacaactttcttaggtatttaattcttaatatattttctgccctctttaaggtagtgaaagactaggtttcatagggaattcacagatgcaagttctgggtctttgttgatggtaagtttagaagccttatcagttttttccctgccgttgtaccacgtatcagcctccagcattgagggaagcacactgttttcgtattatacttgtccagacggcactggtacttccctggatagttaacctggaaagaagcaagagtaatttgaggtagggaaagcaggtaacatctcacctgactttagaaaactcccctgggaagctccttttctcatttgtttttaagaacacgtttacagattacctgtgattcaagaccttgtcttattaaaataaatcttcaaggaaagcaatgttattttgagtaaaagaaatgttgaaacttaaaattatggtccctcactagttttctaggtcatccatttttcaaagggtcataaatatgccagtgtaccaagctaaggtttgtgcatcttgaagctgtggaaaaataaagtggttcttgtattatggaaatgaaccatttcccaaataccactagtgccaggggcaaattctgacttgcccattttcctctaagctagattttaagaccagtaaacttctgccacctttcagttcttgaagatctcggttttagtagcccgcctcttccttgtgtggtcaccaatcacccttctcttgctccctcttttcactgaactgggatgttttctgcctgtgtgtcttcttgtggtgtctgttcttgctatgagttttctaggtgtattttccaaaggcttgcacctttctatatttttagttttgttgtttgaatgttttatttccagaattttgattccttttcaaatctgttgtttcattttagcctgcttataaaaatgctttcttgtttttagctgattttttttcttggtttaagatatatttaaaagtcattgttaaagagagatgtttcaaagtcattttcagaatgctatcttattttcatgttctctgtagtaaatgttctcttcagttacattaaatagttcttattggttctttcttgacattaatgttctttttaaaaaaaaatcggtttgcaagcctgtattgaataggacccctacccctcttgtattcttatcccgtatggttaatggttgtgtggctgccaccattcagcctctaggatgctctggtccagaactagttctatattggtggcatagagcttcatccagctctgatattggaaatctaacagctctgttcagtggaaaagccagcaggcatctggagcagacccttgtgtaaagctttgtctgttgccatgtgcctctttttttagacacttaactttatgttaaataaaaaagaaacaacttctttgatctttttttcatgggctggaaaattctgcctctgcattggattttaagcaacaagcctgactgaattccctcttcactaggtgcttttagctgttaccctgttactcatgggggctgaaatcccacctttgccttgaactcccaacagacttgcagcttcagccttactttctgctttgtttttcagtagctttgtgttgttttgggccattcctacccagtcatgcctttttaattttctaatttaaaatttcatcattgctgtacagagagtggcagcagtgggaattgtggcctactggaattatttaagctaagctgttgaacttcacccgaaagctctgggagccattatactttagaagggtgtgacctgagtaggttttacaatttagaaagataattttggtagcatggaggatggattgtagaaatgccagatagagaccaggaaacctgtttgaagaattttgcctataggccaatgagtcatgagagatccaaggtgttaagggggtagatttataaaggacattagggtcactaggagcagctgtagtgtactggcctggatattcagtgatgcccagatgtcttgttttcaccctcagggccagccctgtttcttaattatacctctcattagattactcactggctatttctcttgtttttggaggcgggggcggggatttctaacttttattttaagttcagaggtacatgtgcaggatgtgcaggtttgttacatatgtaaacatatgccatggtggttgtctgcagagatcatctcatcatctaggtattaagcccagaattcattagctattcttcccgatgctctccctcctctcattctccaccctctgacaggccccagtgtgtgttagtccctgcagtgtgtccatatgttctcatcattcacctcccacttataagtgagaacacacagtatttggttttctgttctgttctgttagtttgctgaagataatggcttccagctccatccatgtcccacaaaggacattatctcattccttttcatggctgcatagtatcccatggtgtatatgtaccacattttttaattcagtctatcattgatgagcatttaggttgattccatgcctttactaatatgaatagtgctgcactgaacatacgcatgcatgtatcttcataatagaatgatttatattcttttgaatgtatacccagtaatgggattgctggataaaatggtatttctgcctctgggtctttgaggaattaccacactgtcttccacaatggttgaactaatttacactccaaccaacagtgtaaaaccatttctttttctccacaaccttgccagcatctgttgttttttgacattttaaatagccttttggactggcatgagatggtatctcattgtggttttgatttgcatttttctaatgatcagtgatgttgagcttttttttcaaatgcttgttggccacatgtgtgtcttctttagagaaatgtctgttcatgttctttgcccactttttaatggtttatttttttcttgtagatttaagttcctaatggatgatggatgttagacctttgtcagatggatagattggaaaaatttttttccattctgtaggttgtctgtttactctgttgatcgtttcttttgctgtacagaagctcttctgtttaattagatacaatttctcaacttttgcttttgttgcaattgcttttggtgccttggtcatgaaatctttacctgtgcctatgtcctgaatggtattgcctagattttcttctagggattttttagttttgggttttacatttaagtctttagtccgtgttgagttgatgtttgtatatggtgtaaggaaggaatccagtttcagttttctgcatacggctagcaagttctctcatcaccatttattaactaaggaatcctttccccattgcttgtttttgtcaggtttgtcaaagatcagttggttgtgggtgtgcggtctcatttttgggttctctattctgtttcattggtctatgtgtctgttcttataccagtaccatgctgttttgattactgtagccttgtagtgtagtttgaattcaggtagcatgatgcctccagttttgttctttttgcttaacattgtcttggctgtttggaatctttttttggttccatatgaattttaaagtagtctttttctaattccattaagaatgtcaatggtagtttaatgggaatagcattgaatatataaattgctttgggcaatgtggccattttcatgatattgattcttcctatccatgagcatttgatgtttttccatttgtttttgtcatctctgatttctttgagcagtggtttgtagttctccttgaaggggtcctttacttcccttgttagctgtattcctgggtattttattttttttgtggcaattgtgaatgggagttcattcatgattttgctctcagcctgcgtgtggttggtgtacaggaatgctagtagtttttgcacagtgatcctgagacttggccaaagttgcttatcaacttcagaagtttttgggctgagacaatggggttttctagatacaggatcatgtcatctgcaaacaaagatagtttgatttcatctcttcctgtttgaataccttatatttctttcccttgcctgattgtcctggccagaacttccaatatatgttgaataggagtggtgagagagggcatccttgtcttgtgctggttttcaaggggaatgcttccagcttttgctcattcagtatgataatggctgtgagtttatcatattcactgcaacctctgcctcccagattcaagtgattctcctgcctcagcctaccaagtagctaggattacagacacctaccaccacgcctggctaatttttgtatttttagtagagatggggtttcaccatgtcagccaggctggtcttgggactcctgacctcaggtgatccacccgcctcagcctcccaaagtgcctggattacaggtgtgagccaccgcacctggccaaagtattttctgttaatacctagtttactgagagtttttacatgaggggatgttgaattttatggaaggccttttctcatctattgagataatcatgtgttttgtgtctttagttctgtttatgtgatgaatcacatttattgatttgtgtatgttaaaccaaccttgcatcctgggcatgaagccaacttgattgtagtggataaactttctgatgtgctgccagattcggtttgccagtatttggttgaggatttttgcactgatgttcatcaaggatattggcctgaagtttttcttttttttgttgtacctctgctaggttttggtgtcagcatgatgctggtttcatagaatgagttaggaaggagtccctcatcctcaattttttggaatagtttcagtaaaaatggtaccagctcctctttgtacctctggtagaattcaactgtgaatctatctggtcctgggctttctttggtttgacctcctcaatttcagactcattattggtctattcagggattcagttgcttcctggttcagtcttgggagagtgtatgtgtccaggaatttatccatttcttgtagattttctagtttatgtgcttataggtgtttgtagtattctttgatggttgcttgtatttctgtgggaacagtggtgatatcccccttatcatttctgattgtgtttatttgaatcttctctcttttcttcttgattagtctagctagcagtctattttattaatttttttccaaaaaccagcctgaattttttttttttgcaggttttttcatgtctctgtcttctttagttcagctctgatcttggttatttcttgtcttctgctagctttggggtttgtttgctcttggttctctagttctattaattctgatgttaggttgttaatttgagatctttctagctttttgatgtgggcatttagtgctatgaatttttcttttaacacagctttagccgtgtcccagagattgtggtatgttgtctctttgttctgattagtttcaaagaacttcttgatttctgtcttcatttcattatttatccaagagtcattaaggagcaggtgttcaatttccatgtattaatagttgtgtagttttgagtgagtttattagtcttgagttctaatttgattgggctgtagtctgagaaactgttatgatttcagttcttttacatttcctgaggagtgtttttcctctgattatgtgattaattttagagtaagtctcacgtggctatgagaagaatgtttctgggtggacagttctgtaaatatctatcagatcctcttgatccagagctgagttcaggtccaaaatatcttggttaattttctgttttgatgatctgtctaatattatcagtggagtgttaaagtctcccactattattgttgggagtctaagtctttttttgaaggtctctaagaacttgctttatgaacttggcagtgcttttttattgagtgtttgtatatgtaagacagttagctcttcttgttgaattgagccctttaccattatgtatgcccttctttgtcttttttttttttaatctttgttggtttaaagtctgttttgtcagaaactaggattgcaacccctgcttttttctgttttccatttgcttggtaacttttctttcatttctttattttgagcctatgtgtgtccttgcatgtgagatgagtctcttgaacacagcataccaatgggtcttgtttttttatccagcttgccattctgtgtcttttaattggagcatttagcccatttacatttaaggttagtattgttatgtgtggattaaatcctgtcatgatactagctggttattgtgcagacttgtttatgtggttacttcatagtgtcactggtctgtgtacttcagtatgtctttgtagtgactggtaacaggttttccttttcatatttagtgcttccttcaggagctcttgcaagacaggtctggtggtgaccaattttctcagcatttgtttgtctgaaaaggatcttaaatctccttcacttatgaagcttagtttggacagatatgaaattctagataggaaattcttttctttaagaatgttgaatattggccaccaatctcttccagctggtagggtttccactgagaggtctgctgttagtctgacgtgcttccctttgtaggtgatctggcctttctctctggctgccctcaacattttttcttttatttcgaccttggagaatctgatgattatgtgtcttggggatcatcttcttatgaagtatttcacagggattctctgcatttcctgaatttgaatgttggcctatcttgctaggctgaggaagttctcctagatgataacctgaagtatattttccaacttggttccattctccccatattgttcaagtatcccagtcagttgtagattcattctctttacataatcccatatttctcagaggttttgtttatttcttttcattcttttttctctattcttttttgcctgtcttatttcagaaagacagtcttcaagctctaagattcttttctccacttggtctattctgctgttaatatttgtgattgcattgtaaagttcttgtagcatgttttttagcttagctctatcaggttggttctgttcctctagactggctattttggctgtcagctcccatatgtattgttttagcttcttcgctttgggttacaacatgctcccttagctcagcaaagttcattattacccacattctgaagtctccttctgttatttcagccatctcatcctcaacccagttctgagcccttgctggagttactgcagtcatttggaggaaaaggggcactccagattattgagttttcagagtttttgtgttgattttttttctcatctttgtgggcttatttacaaatgagttgctgacctttggatggagttcttgtggttttgtttttgttgttttgtgtttgtatgtttgtttgtttttaatagtctggccactccagaccctagttgcctcagtttttccagtacctatcaccagtgaaggctgtgatatagcaaagatggcagcttgccccttcctctggaagcttcatcccacaagggtactgacctattgctggcctgaacgcacctggaggaggtggctggagaccctggttggaagtcacacccactcaggaggaacaagatcagagacccacttaaaaaaacaatctggctgctttttggtagagcagctatgctgtgttggggatcccttcagcccctgattggtttgggctctccatggcccacaggcagcccaaacaggcaaggtgatgacctgccccaccactcaggcgctctgccccagggtgaaattagagctctttaggccccaaagaacatggggtgggagggggtggctggaggccccagctgggaggacccgccccacaaggaggagtataacggagtcctgcttaaagaagcagtctggccacacctctacaaaacagccttcatggtggggaaccccctttgcctcagtcggctaggactctccaaagctggcaggctggaatggctgagttatccaaccaacccaggtggtggccctttcctcttccaggcactccatcccagggagacatcagagctctgtccctaatacatgcgcttgggcatggctggtgggcccaccaggtaggtcccgtccagtgaggaggaatggattgatgtcctgcctaaagtagcagtctggcctttaactgacaaagctgctttggttcactgctggggggacccttcctcgttgggaccctttggactctccaaagcccgcaggttggaacagctgagttatccagcaatccaggtggcagcctgcccctctctccgtgggctccgtctggtctcaggcagtctccactctgttgctggtggccagctggaattccaagacagtaggtcttatcttgtgaagtgcagtggaagtggggcccgcagaatgatgctgcctggttccctggattcagcccctttcctagggtatgtgcagacctcttgccttgcctgagctgtagacatatttgctggatatcctggggctggagtatgtaaagcttctgggtctgtgtctgtgcctgagcagctgttctgccaagactccacacagctctgtgtgtcagactcaaggccctggtagcatgggctcacgaggggatctcctgatccgtgggttgcaaagatctgtgggagaagcatgctttcccagtgtcacacaatcactcatcacttcccttggctgggggtgggggttcccttgcctccatgatgcccctaggtgggccattgccccaccctgcttttcttcattctccatgggttgagttgttttcctagtccgttccaatgcgataacctaggtatttcagctaagggtgctgtattcactcacccctttcactcctctccatgagtgccatggactgcagctgcttctaattggtgcctctccctcactggctattttgaattgaacattgaatgttggttttccttgcttcttctgaacttcaaatttatgtttgctagatacttgtgtggcatcctgaattccatagaagagtcagggtatggtatttaggagaaagaagctgaggcttagagaggctcatttatttgcctgttggttattggcaaaatatggatttttagttaattgtcataagtaactttctatgtcaatttcttcttgtttctcattcatcattcatacatacacaagcatcttttcacttacccaatggaattacttttcatagcaaattagtatttttcttcctctgctttgtgattcttttgctgaactccaacttggatagtgatttttttcccctttactttgaactaatttctatttctcaattcctctgctttcctacagtaccataggtacaggcatcattctcttccagcctcttgtcttcaggtgctttgcttgtttctcatcagcccgcagatcccaaggaaacagacattgacctgcgttgtagtagaataatcatgagcaatattcaaaagaaaataagatatatctcctgttcagtgtagggtgtgttttcccataaaatctaaatactgtattgcacagcaatttaaatatgaaaaagttgaaaacacagcattcatgtttttccattttggaaactatgtggtgaataccttttgtttctattagaaagatgctagttttaaagtaatgtttaatactactaaacattaataccagaagtattaataccagtatactattatcattaattttttcctcttatagtatctgttgctgaatttcctaatcatatgcttatatcaggtttgttacatcattgttattattgaaattattctccattagaagcttaaacatggaatttagaaaaaggcatctacagaggaagaagccttttggaaatactgtcttctctgaggatctttgccatattggatgatattggaacaccctgctcctattcattcattccctcaagaaacattgctgtgttcccgttatgtgccaggcactgggttaggcacatactggtgaacaagacagaggtagttcctgttattaaatttgcctctaaaattcatggttttatgtatgtatgatttgcttctcaagagattggcctcctccaaatggagcagaataagcacattgttcttcaaatattggtcagttgaagacaaccttcttttctattaatttaatcagacttaaacaaagagtataccctcattcaggtcttctggactcataatgggctgatctatgatctctatccatattctttattattttacaaagcctaaatcattgtactacttcctgacctagagttcacaagccaaagaagtctaatttttttggtgacattcttcatatactagccactgtatttcctggaacatttttcttgagttgtgtagatatttttcgagttccaggtgaccatctcaaagtgtggttaccaggacttcacagcctcctaggggtgcaggaacctcaggcttctgcagagggactctgctttctactctgcttattctttgttgagactacattttcttggcttgttagtgtcaaaccaaagcctggtgtctttaggaaactgaggatattcagtactctgagactatgggtacagttttctttgttcccctcctgtttgaaatgcattgtcttcaaatggtccaatttgaatgttcttcccatttttcaagtcctttaggtagccccaagagatcttgcagtttcctattcctaatgtgactttctacttttctggaaaaacattagagccttaggagattttcatagtgtattccctttcctagattgtttttaaaacattaagtaagaataatctctaaactggccattgacaggatctactttgtatattttgctttttcagcttgtatgttttactcctacttttagttttctgtccgaagtttcctgattatagtggggtgggaggtgctggagatgcagcagagtctgctgttggtgactgggagctggaacattctcccagtcccagagtcagtgttactgctttctgaaatgcactttgttacagtatttgtcaaggcctatgacagtctaggtgaattatgtccatgggtttccccctcattcttccttgcccatatgcttatttatcccttaaagaattttgtaaaaatcgtgaggcggtattgattctcacaaagccactttactttctgccatgggattatctttattcctttatgtggtgtgctgccatagacgttgctagatttttcactatgaaaatgatatctaacaatatcctggcagtttgagttcatctgcagtgtgaccattggttaccctgttttgttttgttttttttttgagacagagtctcactctgttgcccaggctggagtgcagtggcataatctcagctcactgcaacctctgcctcctgggttcaagcaattctcctgcctcagcctcccaagtagctaggattacaggcgcccaccatcgtgcctggctaatttttttttcttttttttttaatagagacgggatttcaccatgttggccaggctggtcttgaactcctgacctcaggtgatctgcccgcctcggcctcccaaagtgctgggattgcaggcatgagccaccgtgcccagcccattggttacctttttatgggcattagtaatctgttggcattttcatcatagtgcatgtagttctacagtatcactcctgacttcttgaatgccagtcattcttagcaatttgtcgacattttagtttgtctgttagatcaagaggctccttgatatttaccagtgttcctacctgcctgtctcaaacatcagtttgagacttggaacctgccttgtgtcttccacagcaaatagagagaaaacgtgtggctgttcctttcccggacctctgcatccctcctgtgcctacttctctagcagccttctctctgtatctggttgctgttcttatttattttgcatttctgtgcttgaaccccactctgttctttcttgagcattattttaattttactccattttgttaaaggcaccttttcccattttccttttgcttgccagtgtatcacacagttcttgttggttttgagcttctggccctcctttccaagtctttcaataaaatgtttctagtgaaacatgtaggtatctcatgagggcttacttattttaaaaaggctcttttacatttctctcacagcttaggttttttttttttaatattccttctaaaattaatttactatctgctatttttggaggagagaggtcaagagaaatcgaggtgaggaaggagggaaaacagcttattatccacataatatgatgttgctttggcctctcttgttttgtgacttacaaagacttggatataccacttgccagtgggattgaaggctcccaacactgagttatttgtcctgcctagaagccttagctctacttcttgtcttaaatgaactctcccatatggatagttgagacttacattgttgtaaccacaggccatgttgtggcgtctcagtcattgaagcatttcagtaagttctcttttttttgttgttgttctgtcattttatctattaactaaagaattattagctatttagatgccaaggttattgctctcttcctactttaatgttatagtagtgaccattttaaatgtaattatagtattcataaaaggaaagtaaaactttataataatattataataatgaagactgtatgttgtttactgtgtttcagtctctttatatgcagctgaagtgacttttcattatttgtccccaaattactataatctgggtggtaactggcagcaaacattaaatcttctatttatctcttgattatcttccaacaaatatttttaatcccctgatttttaatccccaggggtacaggccattggctaaatacccctcatataatcagtccctttattcactcctgtgctatcactctctgccaacagagcttggggatgttaactcatcttggtagatatatgatcaaaataactcagattaaagttataaacattacaaaatgcattcaaaagctaatgtaattgtttaatttttgattgtgtgtacatctctagtgtcatgttaatgccttagtgtatttatgtacttttggagctttgtcattgaggtcaggaacctattgaatgacccaaaccattgagcaattggttatgtagcaatgatgcttttaggtcacacacgtgcagatttcaaaatggctgatgagagcttatttatctggctggatataggtggtaagagagatttagtgactttttttctttaagcacattctaaaatactgaaattttgtcactaccacttgatttacaggggacgttttaacctttcttacgccatggactccttcagcaatctggtgaagtgtatggatattctcagaataatgtttttagaggtataaaaccaaatgtgtagaattgccaaggaaactgactcttaatctgttaatatacttaaaaaccaggtttgtgattatagcacaagacctggcagtgggcctggtaaacattggaacttaagcagtgatgggcagaagtgatgcctccaggcatctgcggcgactgtatagtcgtgttgaaatggctgttgtccctattgatggaaaggtcacaagtactattactactgaggattgtggcttacattcaaaatagaagggaactctaaatttcagatagaatttagtgaaaataaagacatgcattttaaaattttttaatccaaatctgtgtgctctcctgagttttatccatggaccctgtgaatccttggttaagtattcctgctataataaattccattaagtaagttgatttgttatttctgtttatctgtaaagaatctcagtgagtttttctctagaaaagacccggatagttacttctggtgccattttcttatacagaaatcatgacagatttttctgtatttatcagcagctgataaactgtaaaatgacagagaaaaggcatctaatatggctaatttctgataattggggtcacaaagtatttttaaattaagattttctaaaaaaaaaaaaaaaacaaaaacccaggagacttagtttaatatttgttttaaataattttaactaattagaacaaattagaatttattttaaaattatatattttttaattgaaaaagaatgaaaggctttcaggaatggcaccagaggttctcagaggttgtggaagtggcaaagaattgtgaccacggagttataactgaagtcagggtgcggggtgcagaactcaacattttagaaatgaagattctcaaactcaaggaatgttgctggggcagctgttcttcgttttggagtaagtcagaagagctggcagacttggtgaggttgttaaagcacggtcagtcttccagagcagtggctgagtccttagaaaaaaagcaagagctggagggtgctgtgagaacagagccctgcatatgctttctactctgacttgtgagagctccaattcgcctctgtggctaaaatgtaaacacatgacaaaaatcaataccattatttcaacaaatattttccagccctcctgtgtgctaagcagtaggggtgagagatggaaagccatggcccccacagtgtggagagtggacggacagacagaagcagtgtgtgcagccttgcctctcatcagagtcactgggagcagggtgcgtttggggattgttaccttgtcatgtgtaatcagtgttctgattccctgtgagagcccttagtctactttgagcatttcaaaactctagtggaactataccttaatatgccttgagcatacaaaggcaaacaaagatgtcacatttgtttagtctggttagcatttgtcactctggagtaacaaccctgtgactgtatgatgttccaaattgtaattataaacatttttgaagaaaaatataattgcaacagaataaggaaaaatcatacaaaattggggttatgagtgtgaggaagaatagtttctgaactatagagctgggccttgggctgggctggaggcaaatagaagaggctgggagtatagcactggtgaaagggcccagataaagtgatgctgtcctctgctccagagccactgctggctccccagtgcccactgaacaaactatagactggcatatataatttgctccagaatagcttctacttacattacataaatatagcactttattccccaaacattgccggtgcatttatctctccttttgctcatgctgatgatcactgccccctttagaatgtctcatcctcacctttccaaacccccactcccccagtccctatcccccacccctgcccacccccatggaccctactttttctctttaagtctgggatacgtgtgtaggacatgcaggtatgttacacaggtaaacacgtgccatgctggttggctgcacctatcatcccatcacctaggtattaagccctgcatggattagctatttatcctgatgctctccctccttccacctccctgacaggtcccagtgtgtgttgttcccctccctgtgcctgcggaccctactttgatctgtccatgtcatctgtccctcctttggatctctatcctcccaccccacactttgtaaccatctcaggatgcctttcttaatccctgtggcctcccttttgtagcctcttcaaacctctgtctactcgacacccataaggcaggctacaggctacaggagggcaaggcaaggccctgtctctgtcgcctttggatttcctggaatcacagcctgcggcctgctcctggtcgggtagcgccttctctccattccttccctgcccactgagccgcagtgcttctaggtctgcacctgcctgactcctatccagctctggagcggggcgggggcgggggaaagatctgcatctggccccagctgctaagtcaatgtcagctctgctgagctgctaactgggaaaaactggttcatgatggaacgtaaggttttattgttgctgtccttgattaataactttcacttacagagaagcagtaaacagtgcagctgcttgtgtggtcttaggcatttccagctcactggtatcatgagcctcctcttgtgtctgtgaaatcaaatgttagaggaaaagatttcctgttctctggttatcttttaccacatgtagttcttttgcagacagatctctttttccgacaccacatttgtagtcaggaaactttggctcattcattgagattttttaaatggaatttgctccatatataaagtttgttccattcttaattgtgtactgaaatcattggggaattatatgcctaaacttcagactgaatgttgtcttatttattcaagtaatattcctgagtactctccatgtggcaggtattctttaagtggtgggagcaatgagaaaaaacaaacagagcccttaacctcatggagcttacaagctcactaaaccagtgaagatgctttctctgtacttagagtccaatggactgagaactccgaggtgaagcacgccaggggaggatgaggtgaaggtagagatggccaggtccaggaaggcctcttgggggaaggaagggaggagtgaaccctggggaaaatgttctgagtagagggaaagggcaacacccagactctgagatgggaggaagtcaaactggaaaggacaaatcacttggaacttagaggccgccccactgaaccatacgggactgaagaggcaaacaacgtatgttacaagcaattttgcctgtcttcacattcctacatatattcttcttcttgtttcagctgaaaagcctgtaatgtgttcagccttactcattaatgtgttatggacttctcttctgctgtgtttgaaatgtttttccttactaaaattgttattcaaataccttcccttaattcatttacactttagaagataatagttctattaacatttacaggataattaaatatataaatatatatttcatctaatttctttttttctttctttctctttttttttttttttttttttttttttttgagatggagcctcactctgtcacccaggctggagtgcagtggcacaatctcagctcactgcaagcgccgcctcccgggttcacaccattctcctgcctcagcctcccaagcagctgggactacaggcacctgccaccatgcccagctaatttttttgtatttttagtagagatggggtttcaccgtgttagccaggatggtcttgatctcctgacctcgtgatccgcccgcctcggcctcccaaagtgctgggattacaggtgtgagccaccgcaccaggccaatttcttataaataaatgaactttctcttcacgtggctttctgttttaaaattacagatatatttttacctctgtatgattcttggggatttaatggtgaacagagtcaagggccctgctgctgtagagtttacagtctagtggggtaggggctgtttgtgatctttttcatttaccccagcttttgcgttcagtagatttcagaattttaaaaatgtgtgctctttaattgtattaatattttgaagtaagagtacagtatgtggggaggaaatatgagggagatgcagtgggtcagtgttggcagaccactcacactagactcctgatgactatagccgcctctctccctgaacctgaaatttacccctcccagactaccatttgaggaagagagctagtccattatgagagactcaggaccaaggcgaggaattggaacactgtaaaccccgcaagaggggagtgggccttgcagagagttccagaatagtgcctgatcagcagtgtctcaggatcatcaaagatcctggcttcaggagctggaatgttacttgctgtgcttcttggaaaaagagtcacaatgtgtgacatttctgacctcaaggattcagttttggtggtcattttaaatatgtaaaattgtgagcactgtagttaccaacacatgacaaccactccactaatcagacacactgtattttctcttgtaatcatctaatataagtgatagtttgtcattattatgactagtcaatatattatatgtgaatagtggcatttatcttatcctacttggttagcatgccctctttcatctctgttcagtttcacatagttataaaattaacatttagttataatgagtttggaggggtaaaagggcttcagtgatcctggaatgattgttgtcatttgttttatttgctgtgaggtctagcacagtgaactcaggccttccctgatgcagctttaaaagcacatgggatttacattccattttgtagactacagaattgacacgtgaactttcagcatctatatctggtccctttcagcccatttaaaggactaattctaattttctgtttcctttaagaaaggctatgatttaccactcacaaataaatgtggacaattctttgggtatctgtttgtatctttgaatgttgataaattaactttatgtttgaacttaaatttcctgcttcctatgactttaaatctttctctcatttctctggctttgctactcgcccctgaggctgccctgactgcgccttaagaatgatatcccatcgcagtgtctttgcgcattttcctaactatctcctcctgcctgcacttcgagtatgtctaagattcttcttctgcactctgagttctgactctttatatagcgtaactgtgaaaactattgttattgttatgctagagctttggaatttatagagagttttatctgtcttgccctttgaaattttaccttttatttcagtaatattaaattatcaaacttgttttatcattctcatagctcattttctttcctactggtttttgtgtttttgtgttgatgtttgtatatttgacatttagatttctcattagtttactcactgtcttcattcactcagcaaatactgtgccaaggcgtgcttccggcatgggagacactgcggagaacaagatgaaacccagctctcatggagcttaccttttaattggggagatagatcataaataagtaaacagataaaagtttaaagttaacgtgaaatgaagcaggataaagacgggtggataaggatagaatggcaaggacgggatgtttttagcgagggaggcagggcagtggtgaggggcacagcatacagaggggtcagcagcgtgaaggctccaggcaggaccagctgacgccagactaggacagcagggtggccggagaggctgcatcgtcgtagtgggggataagtgtggtaggttatgaggtcaagtgccagggtgccaggtgggggaggactcaaattgaactagttagaggttcctgcagtggttcccatgaaaggtgatgccagactaaattaaggtgtgggctaagtggtgggaactggttaaatttcagtgaactgtgcagggaaggaagtgttagggaagatttctaggttttgcttggaatgggtgctatttacagacagggaggggccatgggaaagaagagctttggagacagcttcaggaaccctgtttggggccatctcagtgtgacatgtgaacatatgagaggctgttgctccaagaggtgccctggaggtgggcctttgggcccatttggacagatggtgaattgagacctcggactgagtgatgacacagctggagggtgggtcggggagaaaaccctcagcactgagcccagggctagagtcggggtgcaggggacctggtagacctgcaggcactggcacaagaaagagcctggagacttgatgccaatcgagtggaaagaaaattggaagaatatgcgatgtgggagcccactgaagaaaatctttcaagaaagcgagtttgggcagtattttgtaggcttggttttttttttttttcatcagtctgattttttgttctccttattaggtgaaataagatttttactgttaacttggtctgcatgcctctgaaaatgcaactctctttgtgattggatgcatacttcataatcatcccatagtattgagaagatagagaaaaagataatgatagaaaccaaccacaaccaaaaccctactcattttggctcccagttataactatggtttagttttgggggtttggaagcttcttctgtaaaggtccagatcgtaaatattttctgcttcatgggaaataactctgttgcagctattcaagcctgctgtcatagtgtggaaacaagcatagaagacctgtaaacaaatgaatgtttatagggctatgacctataaaacttaattacaaaagcagatggtaggtcggatttggcctgtgggctgtagctctctggaccttccatgttttcgtgtgtttcagaatcacacttctaacctttagttttacttaaaaataatctctctctctctctttctttttttaacctacgtttcattttgagacagtcttgctctgttgcccaggctggagtgcagtgtcatgatcatggctcactggagcctcaacctcctgggttcgagtaatccttctgcttcagcctcttgagtagctgggaccactggtatgtgccaccacagccggctaattttttttacttttaattttttttgtagacataggaccttgctgtgtttcccaggctggtcttgctctctggggctcaactgatcctctggcctcagcctcccaaagtgtcgggaccacaggtgtgagccactgtgcctggccaacacttctaagctttaggaattgatcagccacaatgtactgttcagattttctttttttaaggaaaccacttaatttgttactttatattgtaaaacactttgtaaccaattagattttatcagctaatcttatcctgtagcatgttgaatatcaaacacatatgcttaattttctctgcagttacctaaaaatctgcaaacacacaaccatcctttcccccatgctcccctatcttatttactatctttagtctaacagtgcttaattcttttccatgagttatgtgctctaggcgattcctcagggatctagaactagaaataccatttgacccagccatcccattactgggtatatacccaaaggattataaatcatgctgctataaagacacatgcacacatatgtttattgcagcactattcacaatagcaaagacctggaactaacccaaagacctggaacaacgatagactggattaagaaaatgtggcacatatacaccatggaatactatgcagccataaaaaatgatgagttcatgtcctttgtagggacatggatgaagctggaaaccatcattctcagcaaactattacaaggacaaaaaaccaaacaccacatgttctcattcataggtggcaattgaacaatgagaacacatggacacaggaaggggaacatcacacaccggggcctgttgtggggtagggggagggatagctttaggagatatacctaatgctaaatgacgagttactgggtgcagcacaccaacatggcacatgtatacatatgtaacctgcgcactgtgcacatgtaccccaaaacttaaagtataataaaaaaattaataatgacctattagtgatctaaattggattccctagcataagtgaaaactttcatgttgtacagcttccttattctatgttctaatggttaaggtgcttatgcaaggatgtgtggttcacggtgaatgtaacatatccacatataatctattcaatgtatatagaacgttcaccacgaatataacatttagtgccaccacttgctgtagcttctctgtgtcagtggaaatacttacctgttcttaggattaaataatatatactcgcaaaatgcctaggatgatatgcatgtgtctggtactgagtacttaacaaatactagctattccttcttggagctgtttaggcggcatgtctataaatgaaaaactagtcaaggaaagagaaaaaactcacaacattctcattgttgttcaaaattgactggtcccttgaaaaagactgcaaataccatgggataagaacttatacctaaaaatattttgagtacagacacttgatgtcagagaagatcttcagaaagatctagtttaaggtttcttaatctgcaatccacaaatctctggaaagcgtaggcaattgtttgtgtctgtgtgtgcgtatgtgtttctcctcagagcatctggcttttatgagaccctcacggagggagtggctgaatcctgcttttgtggtgagcctcatccagggactcacttggagtcctggttctgctgctcctaggcagtgtggcttttagcacctccatctttctgaacctcagtacctagtttctgtttctcctaggattgttacaaagcttgaacaaaagcacttttgaattgtaaagtgtcaaataaattacagttgtggccctgctgtggtgaggaaactacggccaggggaagtggttgagtgatctgctcagtggccactaccagtggtcccagagccctgacacccgctctcccaaggccttctcaatgcactgtttcctcaaaataaggccatggcttttcctgataacaaaaagacccagtgcaaaaaccattcaacagggaaaaactggccttttcaacaaatggtgctgggacaactagatatccatctgcaaaaaatgaagttggacccctaaccatacacaaaatttaactcaaaatggatcatagaattaagtacatgaaacaaaactataaaactcttggaataaaacattaggagtaaatcttcctgatcttgggttaagtaaagtattcttagatataacattgaaagcacacacaacaaaagaaaaagtagataaatgggacttctgtgcttcataagacacctgtaagaagtgaaaagacattagcccagcactgtaccacatgcctgtattcccagctattcagcaagaggctgaggtaggagaatcacttgagcaggttttgaggctatagtttgctatgattatgcctgtgaatagccactgcactccagcctgggcaacatagtgagaccctgtctttaaaaaaaaaaaaggaagtaggctgggcgtggtggctcatgtctgtaattccagcactttgggaggctgaggtgggtggatcatgagatcaggagtttgagaccaccctagtcaacatggtgaaaccacgtctctactaagaatacaaaaattagctgggcgtggtggtgcatgcctgtaatcccagctactcaggaggctgaggcaggaaaatcacttgaacccgggaggcagaggttgcagtgagtccagatcgcgccattgcactccagcctgggtgacagagcaagactccatcttaaaaaaaaaaaaaagaaagaaaaaaaagaaaagaaaaagacaaccctgataatgggaggaaagattgcaagtcatatatttgataagggacttgtattcagaatatatatatatgtatgtatatgcatatgtatatatatataaacttttacagctcaacaaatgacccaatttaaaaatggctaacggattcaaatacacatttctacaaaaacaagatacaaatggctgataagcatatgaaaagatgctgaacattatttattaggaaaaagaaaaaccacaacaagatagcacttcacaccactaggatggatataacaaaaaagaccacagcaagtctatgtaggatgtggagaaattggaactcttgttcattgatggtgagaaggtgaaatgacgcaggcattttggaaaatggtctggtagttcttcaaaatgttaaatatagtgttactgtatgacccagcaactacattcctaggtatatactcaaccaaagtgaaaacatggtaagcgaaggaagccagtcactaaaaaccacctattgtatgattccatttgtatgaaacatccacagtaggcaaatatatagtgacagggctgttggggtcagagtgagagttggggaccagagagtggctgctgatactaggttctgaggtactgagtactaggtacggagtttctttttggggtgatgaaaatgttctgggcttagatggtgatgatggcatctactgctgtgaatgtactagaaaccactgaactgtaaactgttaaaagggtgaattttatgggtgtgaattatatcttaatgaactgttattagaaaagaataaaaataacagacttccaaatttgctttcttacctttgaaagactgtggatgaaacatactttttttcttttgatttcccggcagccacatgacctttactcacaggcctaaatgacatgagtttagtggtctaaatagggtccctggtgagcagttgcctgaataccatttgcatgtgccaggggacagcttctgctccagggcacacatgcaggacccagcagtgacgaagaccagtgaccttacccctcaaaggggtttttccagttgaggattcacgaggcagcaggggaagcctgtttgcactgtgcccagctatattagcctacgaataaaccagtgacaaagattttgagccttattattttaggggacttaatattagattattttgttcattatgcataaatagaataatttcagaaagcatatcagtcacacttgtttttaaaaagtgctctaaagaactgcaaaatatcgaattattcctcagcattcgcttagaaattggttcatatatacattagcatcttgctgtatgctctgtgtctcaaattaaaaaaagattatgcattcgtgtaatagattacaaatttattattgtacctttagaatagaaaataaaacaaccctttttaaattcagctgtgttctaaagcacatgttccaaaacttctctgtacataaaaatcaactggggctcattaaaaatgtaaatttcctaggtccctaccccccaaagagattggttcagactgaatttttaaggaagatcccagataattctgaggaatagggtttgccctataataacccatgccctaggaactccagcctagaattacgagtagtagaagggcggttaaagtgttcttcacattaccataggtaattaataggaattaagatatttttagcaatttgatactgtatgtagatgacatccacgttcttattgtgctgttagaaaataatattttctcaccaacatttcacagtgtgtgaaattgtagtctttgttcctgctgacagcacctttgtgctatgaagctattaatgcagccctgtctccgcctgctttttccagatttcctttgacctcgctgagtacactgcggacgttgacggagttggcactctacgacttctagatgcagttaagacttgtggccttatcaactctgtgaagttctaccaagcctcaacaagtgaactttatgggaaagtgcaggaaataccccagaaggagaccacccctttctatccccggtcaccctatggtgagaacatgcgtgcacaccggagcacatgtgtggcgttatctgtgggtgtggggggtgtgtgtttttcctttcattctgttcatgtctcacagctgaagtcatttgggtgtgaggttaacattaaggtagactaaagtgactgaacttgttgagaagcatacctttatacgttgctaactacaagtatttgctgccattgccttcggggtgaaattaccacctcacttcaccaacccatgttcattcagcccttccatacagatcacttgaaatggaaaatcagacccaatgtgattctttttctaaactgttatgagattatactgaagtgataaggtttcatgtttttttttattttccatgaaatttccttgagctcaaaaccttcaaaaaaaaagactattgtgtctaatatgtttgtaaggagaatattaatgaaagacttcagtgataaaatttcaaagcagttggaatgttaagatcctcatttttttccattctaattcctcaaaagttagagagagagaatgagagagaaaaagatctaagaaagattcaatcaattcgattgtcaaataatgcactgttggcattacaaaagtaagaaattcttaaaatatttcctggtgaacatgattgacaggtgtaataacctttatttcgtctttgggttttgatacttttttgtatttggatgcattacaagttattatttcggccaagatgttactgttgaagatggtgagaatcactgtcttttacaacaaacttcattgcttaaaaaaaattattccaacaggggcagcaaaactctatgcctattggattgtggtgaacttccgtgaggcgtataatctctttgcagtgaacggcattctcttcaatcatgagagtcccagaagaggtcagtaaatatattaactgaaaagagaatttcagacttgaacaacaacaacaagttgcatgtctatttggtgtatgtactacagagactgaaaaatttcctatctgtatctaattatgatgaatgtcagagcagcaaatgaagaaatgtatacccagccttagttttttgtaattttattttgagtttgtgggattttaaattttaacattaaaaactggacagtgttccagttttaccattttaattagtagatcttatcaagcttgttttcaacctgagtattaggaagctactatatgaatgcaaaggaataagtagtaaactaatgattgtttttagaaattactcctattcaaatagactcaatctgtaggatctatgttattttttgactttgaatggttagatatttggtattctttctttacatttcattaaatagacgtccagaaattactatgcttctaaattattttaaaataaagttgaaatcagttttttaacaagattttaaaaaattgacacatttttatggagtacatagtaatgttttgaaacaatgtgtagtgatcaaatcagagtaattagcatatctgtcacctcagacatttattgtatgtttgtgttaggaacatttaaaaacctcttttctagctaattgagaaatacttaatatgataaactatagagcactccacagaacactagaatttaatgtgtctgtctagctataattttatattctttaagaaatctccccttattccccactcccttgaagtcagctcttaatttagaagtattatcaggtatttttggaaaactgtatttgtttgtattggcttgttgccttttcagagttgttgatgagactgtagcaacgtgctagttctcttgttcccagtattaagttttaagtaagaaaatgtgtacccccatcattacttctgatttactgaagcatgagaaagctttacaaagcatgcacatgctttacaaagtaaaaattatctgtaagccttccaagaagttttattaaatttcgctatcatttagatttttagtctgagaataaacgtgaagtccaatgttataagttgtttcatgaccaacaactagtaagcatataatttttccgtgaaattttatgtgactatatagctgcctaattacaccaacaagtcatgaagaaagattaaagcgacaggtttataaatgaatctttagcgtcagtacatttttattttataattgcttaagttaaaaattcccatgatgggctgttaaagcataagaacctagcctgtcatcacattgcctgaaaggaaaacaaattcacaagcagtgagaaacatttctttaatgaattttgtggtcctgggtgccagcggtaagggagaaaggaaaaggaagatcctagctgtggttgcctgcagcatgtggtatgagggcgcccacagagtctgctcagtcgtggtaatccctgcctctttctcacaaacatgttcatacacattgtttgggtttctgtgttcttcctccctcaacttttccacctgcaaaaaaaaaataaaagttaattgttgtgaatcaggtcaggatagggaaaaacattcctgggttgcaaagtaaaaaaagataaatttgaatataactccccctaattctctctttgtgtacctcctaatgagaacttattttttgtctttgtagatgttaaccactaactaaaaaaaaaaaaaaaaaaacatattttaaggccaggcacagtgccccacatctgtaatcccagaactctgggaagctaagttcgggggatcacttgagcccaggagtttgggaccagcctgggcaacatagtaagatcctgtctctcaaaaaaataaaaaacgaatcagccaggtgtggtcatgggtgcctgaagtcctagctactcgggaagctgagttgggaagattctttgagcccaggagttcgaggctgcagtgggttataattgtgccactgcactctagcctgggcaacatagtgagacccctgtctctaaaaaaattgttttaaagtaataaaaaatgttctaaaagtaacacgtcttcatttaaaataaaattttaaagtaaaagttcccaccctcgtgataactgccagccctatcctcagacccactgttaacattccttcagaaaagttctctctttaaacatacaaagagggttctgctctacatattgttctgcagcgtcaggcttctattaaatctctttaggaacttgacctcaactgtagcatacaccattttgttttgttttattatatgcctggaaatcagtggtaccacatttttaactatatgatcaaataatgagaaaaagagatgtacgtgaaaatgatattaatactttgatatgtaatgcctactatttacagcatttcttaaaacttgatcattaattttcagattaaattaatctgacagtaatgttgttttccaaggagatttctttcccagactgaaaattccataatggcaggactgtgttgtattcatacatctccagcttccaggcaatgcctaattgctaataagcattcagtaaatatttttaaatgaatgaataagttaatatctcatgtttcaggaacagcttactgacttgaaagctaggtggtctgaattacagaaaagtagaaattatatcgatatttataaatatatacatattgttgattttactcatatagtaattaaagctaataaatgggccgggcgcgatggctcatgcctgtaattccagcactttgggaggccgaggcaggtgaatcacttaaggtcaggagtttgagaccagcctggccaacatggtgaaaccccgtctctactaaaaatacaaaaaattagctgagtgtggtggtgggtgcctgtaatcccagctactcgggaggctgaggcaggagaatggtgtgaacccaggaggcagaggttgcaatgagccgagattgtgccagcccaggcgacagtgcgagactccatctcaaaaaaaaaaaagctaataaatgattttgaagtaaagattcaatctgatatacattaataaacagataaaatttgttttttgttaataatctttgtaaacctagaatttcctgtggtactttaagtgagtttattttcttaagttggttgaacatttactcatcagtcttcttgttccctgttattacagggaacaaacccttttttttctacatggtgtagaaaaaccttggtaaacctcaatctagtcctaggtatccagtcacccatgctgaatttgtagagcccaagttgatgcagtttttgggggccatatactttttctctaacaaagtgtaattgtcaaaggtgccctctcactgcatgaataacatttcatgagaatttctgactttcaaaagtggggaaaagtattttttaatctaacaataggctaaaccagaagttgacaatctaggactcatgggccaaatctggcctaccagcatagttttgaaaataaagttttattgtaacacaggcagatgcacttgtttatatatcatctatggctgctttcatctatggagtcttgtagtgtgcagagcctaaaatatttgttgtctgggcctctaagaaaacatttgctggccccagctgtagacagatcctcaacattcgagaaaactttcacttgggttgattgtgggtttctcctatggtagcaaggtagtcttttagaaagatttcctataaatgttaaagagcatagtgagccagtccttaagcagaattctgaagtgctttggcaggttggggttctgttgtacttcactgctgtatgcaggtaaccaagtgctccaaaggatcaagcactatgaccaagtgctctaaaggaaagctagttgtcagtgatgtatgaaaccaaataagctagtaactgatgatatacatgtagcatagtttgtccaacaaccacaactcctgagcttggacacgtgctcattacggttttgactgccttctgtgtcttttctccatcccaaccatttttggttttctttctttttcttttttttttttgaagacttcatttatttatttaggttttctttctaaatatatttgttttgagaaccgtgtaatacatctagagatgtaagaatcacctatgctagcatcagatcaacagttggaaatcactgatttagggaatagagccaataatctgcgactttgcatccctcagtcagccttccagtcactccgttggtgaaagcaagagggtggatggcacttgtgctatagacttgcttcttatgaaatgggagcactttagtaatatttactacaaattaataagaataacagaattttagaattaaatgtctataagtcatgaaaatgtatatagtagtatatgttttatgaataactattactatgtattatatactgatattcacagacattaaccaggtgctttctttcatatgtactcagttttttaaaataaaaaagtaggcaatcataacctgcataacaaattttggtaaatgatggactgcagtggtcccataagattatcatactgtattataattaaaaagtcacatttttactgtactttttctgtttgggtacacttaaatacacgagtttaggcatatgttattttattgcttcgtagatattgcttttttcttcttttcatactgaaggtgtgtggcaaccctgcattaagcaaatctgtaggtactattttttcaggtgttcacctcctgtctctgtgtcgcattttgagaattctcctaatatttcaaacttctgattattattatatctgttacggtgatctgtgatcagtgatctttggttttgctgttgtgattgttttcaggcaccatgaactgcacccataaaagacagtgaatttaatccgtaaatattgtgtgtgttctggctgctccaccaactggccattaccaccccctgccaccgccgccccgttccctgagacacaacaatattgaaattaggccacttaatagccctccattggcctccaagtggaggaagtagttgcagatgtgggggaaatagcaagagagctagaattaaaagtagaatctgaagatgtgactgcttttatcgtgtgcaatctcataataaagttttcactgatgaggagctgcttcttatggatcaacaaagaatgtattttcttaagatggaatctattcctggtgaagatgctgtgaatgttgtcaaaataacaaaagaagggtttataatactacataggtttagttgttaaagcagcagcagggtttgagagattgactccaattctgaaacaaattctactgcgggtaaatgctgttacacagcactggatgctacagagaaatctttcctgaaaggaagagtcagtgattgcagcagacttcattgttgtcttattgtaagaaatggccacagccgctccagcctttagcaaccaccatcctgatcagttagcagccatcgacactgaggcaagccctctaccagcaaaaggcacagatggtcattaacggttttcagtgataaagtaatttttagttaaggttgtacagggcttttaaaaacatactattattacacacttaataaactgctttttccttttgtattgtttcttcaaacctgaaattgtgtatctccctggctgttccattacatatctttatttttatatttacatacatacagtattctttttgccacaaatgtggatataatgatagctttctactggaaatacagcttcacattatctgtaatagagaatagactctctagggaaaaaggttttgtttattatctcaaactgtttaatatctatgaggaaatagacatgtacaaaaattttcttgccttattacatttctttgaaaaactaaacaatcagacttgtcataaagatattaattattatataagttgtgaactatggggaaaatattgagaggtttttttaattatttaaaaatagttcataaataagtatattagtttcttttcaaatatgttatttaccagtaataaaatctactcttaaagattatgctataaattggaacatgggaagcaagcctatttagtaaagctaacaatatttctagttttgactgtttattacattaggaggtaaataagaagaataactactgttcatcacatatgtaatgtaaccagttggggctaattatgtcttaattcttaacattggcagagtactttggcatgccataaatacaaatatggtgacctttacaaaactataaataacactaatatgagtgtattctaaattaagaaaaaacattttgcatgataattaagagggaacaaaaaatacattctaccttctacttttggaaggttaaaaaatttaatgattagattatccctgatttcctaattttgatgacagtagctattgtgaataaagggtgaaacacacataatattcagcattctttttttttaaatgtgatttttcagttttcagtatgagtgtagaattagccgctttgatttcctacactaagaacagcagcctcggtttctgtgagacttcctagggtccacgtcctggaggagaaagccctgacccaggggtgtgacggagaaagttgttctgtgctgccggctgttggcaggcctgcctctcatacccagcagccctttgctttccgcaggagatcagttgaagatttccgtctttcgatgaggatatttttcttatgttgactcattttagtctttcgatcattaggaaagtttgggcaatgtagtaacctctacttccaggactgactgaggaggtgatgtttggttacatgagcctacctcgtgggccgttggttaccagccgtgagtcactcatagggattggcttcatccctggatacctttagcctgagtaagaaatcacgttccctgttgacagcgtatttcttccattctcctcccactctttcttctctcagtgtttaagaatgggacatttactcagtctgggtaaagcattctctctccctgtggatcttcttttctcttcctttccatatttgcctaacgcctaactgagcctctcttctacttgccatatgtaactttgctcctctgtctctgaccatggggccttgcaacagatccatcactaccttcttcccccaggagcgcttccgttgctaaactgtctgttcagaatttcatgagatcctagtaaatacttccagaaagctggtttattttgtatttcattctgagtcacgaagaactttttttaatcatctcccagctgaggaatcagaggggtttggctatcatcatcatcatcatccttactgtgaaaaatgcacgctcattagctcttcgtgttgcgtttgacatagtgatttaatactccacaggtactttcagagacattttgactaacttgtttaacttacaaattttttatctgtatgtggaaatgaaattcatgtgtacttctatttttctctattttttaattttaaaaatgtgtattaagccattagatactattttttccttgaaagagcttctagggagcagccagttaacatccacctgtaggtattctcccaaaataccctcagaatttgtgaaataggaatttaaagcttctttcatctcccttttttcagcaatgaggaaacagaagcagcatgagattgagttgtccaaggtcgtgaagccaataaatgctaacacggagaccagaaataatcctaggagaagtcatgtaaatattgtacatatttgtggaaataacatatatacgaattttagagttgaacttgagcaaagaaacccctgtgacactgagtgggccacctcagcttggcagtgaagcaagtggacaagttggaaacggaatgtctcagctgctcttatctttgtaaaagaccattagtttgcttaaaggcaatattcctttaagatgtttgacagaaataattacaataaacatagttttataatattagaatataaatgtgatatgaaataaataacttctcttgcctgttatcaagaagttggtaataggaagaactaatataaaagacattaaaaatcaggccgggcatggtggtcatgcttgtaattccagcactttgggaggctaagacaggaggataacttgaggccaggagttgtagaccagcctgagcaatatagtgaaacctcatccctaccacaaaataaaaaataaaacattaaaaatcatgtggcaatgggaagctataaagtactttaaatatacccataattaaccgtgtgagattgccacaaatggatggtgtactagcactgtttagatactgagccatttctagatgagataggacattcctttaaatatgggcttcataagaaatcatatacatcagtctaaacacagtattcacctgactgaaagaatctggcatttttaaggttcatgaacttgtggttttgagttttcgtcttgagcatttttttagctgccaagtactttgctttataaaatgtctgactgtatttatctttataaattaatcttcagaatttttaaaataattcatgtaaaaattacttgtcaaaatttaagtaaaatttggggtaattttccttttgatttgttttttaaagattgtctttatttgttgctgtaaagataagattaatgctctagaatagtggttctcaactaggggtggggaatggggagagagtggctctttcctccagaggacgtctggcagtgtctggagatatttttcttgtcccaacggaggagggggctactattggtgtctggtaggtagaggccagggatgctgctgaacatcctacagtgcacgggatggctctataacaaacgcctgtcctgtccagatggttcatagtggtgtgcacgggatggctctataacaaacgcctgtcctgtccagatggttcatggtggtgaggataagaaactctgccctaggatgtcatccttccaaatgtgcttgcagaatctgtgtgaatgccacctgtaacagatgagatgaatgccatctcatttttcgttacacttcagttttactttacagtaaattcttcatagaacaacagtagggtctcatttttctttaggtatcactttcactttacagtaaattcttcatagaactttagcaaacatttacgtgaacaccaaagaaaacattcggattcaaatagctccagggccttaagtattatggtctgctgcaggtcagacccaactcaaacccaggactcttctaatcattggaggctgaaccctcacctcagtgacccactgattcacgagccaagtcaagatgggtttgggaccctcccaagcctccaaaatcaatgaacatgtttactttttgttattagttataagaataacacatttttcatttgagaataagttgtagagtccatgatctggctttgatataaaacaacagttagaactgattcaagattatctttcaatgcataggattatactaatattagtgtgaagggttcactgcatatgagaattttcctttaaaactattagaattcatagatgttttagtgctttagggaataatataatgcatgatagaaattaggtaactgggacttgttttcagttaatcacaataggcagaaaacactttctctctgtgtaaatactacatataacatgtctaaataaaataatctttaaaaaattactgaatattggccagtttggcaaattcaaatcatgcactgtagaagtatcaaacaggcaaaccaatagcaaataccttaatattttgtttgtatttctagctataaaaggtgctttgtggcttttgtagatgagcatcagagacttaatttattgcaaaaaattttagcagcccattgtgaaatcaggggatgaagtaatctcctgttggagttcagtagagcattataggttttacacaataccatttgtctgtccataaatggttagattgttggccgctactcttggacccaccaggttctgggtagcctttctggttggggcacaaagtgacatcatctggtttaccattgcatttgtagactatgatacttcatagatgacatgtacacttggcgatcacaaagctgtctggcccatgttattctttgtggagagatgaggtgtaattgcttaaacataaaagacttttgaagcaatacttggtctaatgcaggtgctgattaccaccaaacaaaatgaaatccctcccatctcctgaggtgagatttctggaattgttaaattgaattcaaggggttgtttttcagtgttttgtaatgtctgtgacatttatgtttgaaaccaaactgataactgtctgatgacatgtagcacagttccctgcaatatagccacgcagtatatatacacagagaatttggccactcatcatcagctgtgtgcatttgggcacgtcacttactcagatctcagtttctgcatctgcacatggagaggttaataacgcccacctgatggagcaaagtgcagctctgtcatttcagctcactgtgaaggtgatggggaaaacttacagggaaaagattaatacagtgcatagtagattttgaagatttatttcatatttcctttctcttttcttccctgttcctgtattttcaatgctgaaagctagagaattagtttttttactccttcccttccaaagtgaaagaccctgttggaggcagctctgttagtgggattgctgtggctactggcataagaggacagtgagaaatgtgaacgctgcagtgccagccaacagaagatggtcctgaaccaaaagccaagaatctttcagtggtgttgacagataaaacagagtagttcggcgagacacccgtgaattgcaaaaaaataaaatgtaagtagtattgaagaattgctggaatcacaggaaaagccattcaaaacgagattttggcaggtaaaccagttaacatttgaattaggaaagtcaagaaaagacgatgatgaatgaaaggcttatggataaatatcaaggacgtgtgaaagattcttaagaaaattagtgaaactgtcaagtattttttttttaatagagacacagcctcactgtgttgtacagtgctcaggctggagtacagcggtgatcatagttcactgcagcctcggactcctgggctcgagagatcctcctgccattgcctcctgagcagctgggtcgacaggtgtacactaccacaccaggctaattttttcaagtatttttttaagtgatacatgtatttttttaatggtcctgtaaaaatcttacatgaaatgtatatggttgtgtcaattacaagaagaaaaccttactttactttgtgactagactaacaaaaattacatagatgcagttgtaatttaaattttgttaattgtaagtggaaatttttcttcaaaataacattcttaagtttttgaaatttagtttgagtcaaaactttcttttccactatttgttatggaatattgttcccctttttaagtggttcacgtaaggatatagaagtgttcaactacttggactcagtctaggttctactacatactagaacaactctggccagtttctcaatctctctgagtctcagttttctcatctctaaaatggggtaatcatagtgttcacttaaggttgttataagcattaaaggaaatcgtggaagtgaagttattagcacgtcattattattaccatcactgctgctaatgtcccacctagagaagtaagctcagtttgtgccacctcgcaacttaaaattaataaacagaaggaataaaggggaaaatgcataaaggaacatatgactttgttttctctgaacaagttaaaaaagttaaggtttcagagcttagtaagtgataagtaaagtaggtaagatctggtaaagtaacttgtgggatattgaatattaaatgctagaagaataatggtctttgcttctgttgtttatgggctaattcccagatattgttattagatgtttctggtgtggacaaactctaatgattcctagagtaaaaaattcccagattaagccagattttatgtttcagaaggtttgcgtctgccttctatttctgttggtaagtttaagattcctgaaaggctgctaaagcaggatgtacgtgaggataaccagcccatgagggtatgcaagtaaggaagtgaacatcagtgcggtcacagagaaaccctcctggcagcaagaaaggtgggttttcagcacaattgtatcagaggaataagggaggccctaatgcccacacagtgtaaagaaggcttggtagaggtacccaggaaagagctcaaccctggccccagtgcctcttatgaccctaacagttaatttgtacataagaaataaaccttgttttaaggaggatgaaggtgtttctcagaggaacactgataaatgttttttgaggaagacaaaataggttggtgagaaccttagtaccagcatatccccattctggctggcagacgactgtgtggtcccaagttcacagagaacatttaattgggagtgctggacattgaggaatgtttcataaatctgcaagcacagggaaatatttccctataggaagcaaatattaagacagggaactgaaaatataggaaaagaagttcatctactcttctactcccagcactaaaatgagctaatataccatatgcgaaaaatgatctatctacttctttccaaaaaatgtgcagaactcgctagacaccattgaattctgctatattaattaagattgatggttattaaaatgaaatcgcttttctgagccagatttgggggatggggattgcaatagttgagtgctccttgtgaaacatgcctagagagcttcttggcactcctgcccaaaggagggctgccagcacatgcccactggtagctattgtgcccattcactttgagtcttggtgcaggggctgtacctgacacacgctcctccttttctgcagccaagggctgagcatgccctgtgatcacttcctggaaagccttccgtacctgcttgatgttttcagcatatccccctttctttggctgaattctaagtgcatctgatactggaatttttaaacacaaattcttattgagaagtgtaaagtgctcttgagctaatatattagaattttgaaaagtttcaacttacgggactgttagtgatgttagtaatgataatgatagcatagcaggtaacacttatttagttctgaccatgtgccagatgctctgtcactcatctcttttaatccccataataaaacgatgaagtagttgtagttatatccattttacaggtaaggtgacaggagtttagagaagtgaaattactttcccatagtagtgaaggatataggatttggactcatgtggtttgaccctggaactgtgtgactgtccattaccttgtgcggctcctttggtggcctgccccttccatcacatttcattgccccagtgagtatttttccagttacattagctgcctttcctggccctctagtttttcctcaagaccattcttcctgtttgactttttgttgcttctttcctttccttatttttcattttaggtttgctaaattctaaatttaattagtgagaaaaggaagtgatgaagtaaaatatggaagcaaatctttcacctgaaattttgccacatgggtgacatagaaactgggactaaactgttaagctgtcttgtaactcagtctattaactttaaaaaaaactgtttcatggtgtttagtttatagacactatcctgggaataccatgtcagggatactgctgaatgacagataccttcggttttagaattatttgtagtttacatgttttacatggttgttaagtccgcttttctgtgattctcttcacagtatttgttcctgagtgatttgaagaatgttggggatttttgttggtggtgtttgttgtttagaaaacagggtttcacgatgtttcccaagctgaaatctaactcctaggcttaagcaatcttcctgcctcagcctcccgagtggctggatctacgggtgcaggccatgaccccaggcgtgaagaatattgggttcacagacattactgtcatgcaaatctatcaagggcctctgtaaccgtatgtgcatactctaaatttcaagccaacccgactataaccaaccacaagaaaaaaaagtgtgaaactttatctccttgcgtattatggtctgttgtcagtatgtgttaaaaacatctcatctagtactgaccaaatgctttttttgctcattacctaatttccagaaagtgtaccttgggccacactcctgttgccacacaggctcagtctctgctgctgctctggtgagcttgagaggcacgctattgcctcctgcatgcccattcatctcattaggcttgtggctgagaaccccacagttataaagaacctcaaaaagttatagatatgattcaagcagagaggctaagtcactagtaagaaagccataatttctcttccttgcatttttcattccttagtattactttatattgtatgtcgacaactaagacagtgttttctgactggcacacaattcttagaagtcatcctttatttctaattgtgcttgttcttggagtctgacccttcttgaaaaactgcttgaagtccaaatcaataattagcaatagttattacagaggaggcaatgttacttattttccttgggtgaataagtatcttttgtatgtatttgttttcagggtattgcctatatttacttttctgtgacagaagagaataacagaaactgtcattagagccaactaagattcttgtggaaggagacatgattgcatcattttatggacatttatcttgtcccaattttctatcagatcaagaatttgaatcaaaggtcttttgaagatttcgttactttgcagtctttatgctgggtggctataagccaatactatttttgttaagttacttcgaacgtgaaatttttttttttttttttttttttttgagacggagtctcgctctgtcacccaggctggagtgcagtggcacgatctcggctcactgcaagctccgcttcctgggttcacgccattctcctgcctcagcctcccgagtagctgggactacaggcgcccgccaccacgcctggctaatatatatatatttttttagacgcaatctggctctgtcgcccaggctagcgtgcagtggcgccatctcggctcactgcaagctctgcctcccagattcacgccattctcctgcctcagcctcccgagcagctgggactacaggcgcccgccaccacgcctgtctaatttttgtatttttagtagagacggggtttcactgtgttagccaggatggtctcgaactcctgatctcgtgatccgtccgcctcggcctcccaaggtgctgggattacaggcatgagccccaacgcccagctgagtgtgaaattttaggaagtggctctgccttacttcttaaatgtcactacacttccgagtcgagatgggagctaaagagaaattgtaatccaagaggtttcagtatgagtgtcctcaaacagaagtatgaacattatccttctgtgaaatagctctatcaattctgaagtaaagcccaaacatgatgtggaacgatgtgggataagtcatttttaatgcaaataagtcatttctgcaaaaaggagttgatttcagaagatgatatacatatctctatattgttccagtgtttttcattcttacatagactgaatatattgaatttgatactctctctgtcacaacagaaagtttttatccttctcacatccctcctctatttgctacagctctgattatagaggtaaaagtgtatacagaggtccctacaaacatgaaggcagagaagaaccctaatacgtgtcagaagagagacaagctgcctagtgtgaccagataatttctttgttctgaactggcatctgtggtattacctttattcttattagtatgcaagtccttgaaaaataaatgtatcagtggaagcatttaatcattcctgagactctggaattatggcagaagcaataagagaatcaggttcattatgtcctacatgtgtaaatgtaaagataccttcctgtttaaactgtggaatagccctgctcccctccctctccctgcagaaaatgttgattgaacacctatcatgtgttatatactgtgttagacactggcgagacactagagagacagaatagaatgcttgtctttaagaagctcacagttgaggtgagtaaactgaagattgcagtggagtgtaatgagagcaggtagcttgtgcaagggtgatggaggagcacagaagagggacagcccccaccaggggaggagtcaggaaacccttccactgagatgacacttggagtgccaggcagttgggaactagctgtggatacagatgtttctcagagaaggggccgtccagagaaggagaagacacctgtgcatgctggggggtctgcacacagtaggatgtcactggagagagctgtgagggggacagggcaggaggagatgctggggacggggccggtgacagggcacacaggagcttccggcccataggcagtttatagccattgaagaaagaggcttgtggttgcatttgcatttggaagtcatgagttttcaggacaggtgcagagcaggaagagagtcagggcaaagagagtacctggtagcagtgacagcaatccagtaaagaaaatgataagggcctgggccagatggaattattcgctgagtttgtgcttgtgcgtctatcaggactctggctttagaaatggcaaaaagcgaacctcacgctaagcttaagtgaaataattgaagatagcgctgtatgggtgttacccaagtatgggaatggcaggaacgtccgatttcagggacagctggaaccagtaactcagatatcttcaggattctccctttttatcttctgtctccatttttctttctgtcttggcctcatcttttcagtccagttttttctatgaaactagaactaggatcactgcccctttcagtcttgccacttggaggaaaactgttttctctttcaactccatctggaatggcctggggtagggccttggtcaggtttccactccctcaaccagtcccagtagccagtgagtggtgctttgggccagcttgggccaggatcttaccttgaataaatcagtgcagtcaggatggcagggttaggctactcccattagaaccatgtgaagtaggaaagagcaccaaagcatgctttggggaatctgcattgagcagccacctcatttgtggcctactagaggctgggatggggaattatttaggactgctgaagaaacagactcagaaggacttgatgagcagttgactaatggaagagtgagaaaggaatcaaagaggactcccgggctactgggtgcagggtgagaccattcaccatgcagggccatccagaaagttgtgttagcttggggtaaaaggagaagcgaactagagttaatggtaatgtctcctgaggtgaacaggaggaagatccgaccaggaagttgcaggtcatcatgaccaggcagcacgagcttagctctcgctggagagcgcagtcagcataggtgtgcgaaggttctccctccgactcagttcacggcgtaggagcagagacagtgggagaggtgagcgaggcggggttgagtcgtgtagtcaggatggggtgtgtgtttaagatttgagcaggaagaaaagtcctcagaacatctgaactctgccttcctgcgtttgtgttctccctacctgctctcctgtgccctggaggagctgtctgtctggagctcctgtctgctaccacctccttgaagacttggcatcagcaattctcacctctctcctggatcagtttctccgtcatcactaggatctttccctcagcatgcaaagaggctgctttcatgcccatcttgaagtgcagtcctcccagtctcacccctttctctcactgacagcagaagttttcagaagctgtttgtgctccttgtctacgaaatctcacccccattctttcttgagccctctccttccttggacttttgtccacctctttcagaagctctcccatcaaggtcacgtttctgtctttgtccttctgacctgcagtcatggtgatcactccctcctggatacagactatccagactgttaggatactcccgtgtccttgcttcccctcactgcttcctcctcatctggcctgtaaacattatagcatcagtgtatttggttctctgaccatttatgttttgttgctaacattcctttcttggtggtctcagctggcctcaggacttgaaatatcatccatacataaatagttcccaaatgtgtgccctcagcctagaccctcgttggaaggccaggcttatagattcactgcagtgttaaatgaagactcacccttgtctcatcctgatttaaatatttcatgtttattagttccccgatagttttgttagtgtatcgaatgaatagaggtacttaaaagctatacatttttttttttattttggggattttgtctttgtggggttgttttatttgactaaggccatggttctcaaccagggcagttttgtccccccagggggaagttggcaacacctgtgaacataattgagggggtgctcctggcatctactgggtaaaggccagtgacgctcctaaacactgcaaagcacagcacaaccagcaataaaaaggacttattcctccttaaatgtcaatagtaccaaactggagaaaacctgaaaggaagacttacaaatttgaattatctcactgtcagtggaaaatgcattgaacatttgatacaaatagcaaagtagtttgaacatttctctttatacacatattttaaatagttgccaaaaggtggtagctatctcagacaaatgcacattgtgaattgtcctcttttaagcctgagattcctttaaacgtgcctattggattttgagtacctgcagttaaatagtgttgctcttggcaggacttagtgagcaaatgaggtatgatctctctgatctcagtcatctgctcagtcagccatgaccttctcagtgtctcttctttccacaccctgtctccactgagccatggcccaggcagttcacagtggggtggccagagattaccacaggggaaaaatgcagggccccaaggcggaggttcatgtggggttcaggataaattggaatgatttctgttttccaatgaatattgtccaaactgtcattgtactttatctaactccaaaaaaatctttaaatcaaaagcttttggatgaagtattgagcaatggaatagaatttttattagacaaattttggttacttcaagtaccatttggatatggatggataatgtttagatatgtatgtatgcatgcatgcatgcacatatacaatcgtgtatctgtagacacacaaacaataaaaattgccacagggccataggaaatatacatttgaaaaagaagtaattttgtatagtgtgataagtagaattgtccctagtaggacttagtgaacctcctgtagggtttcttccttacgtctacggcatcatcagagggtgtcaaaaagaagtaattttgtgtagtgtggtaagtagaactgtccctagtaggacttagtgaacctcccatagggtttcttccttacgtctacggcatcatcagagggcgcccaaggttgcattttgtttttaaaaataaatctctattgaagtaatacattgtggaaaagattgtgacctaatatgcaatcaaattctttaataaattggctattattcatgtcttaaaggcaattccattgttttcagtttaatgctggcaatttaaagtgtgttttccaaattttgtcagtttttttcctttaatgtttgttatagaagatagagatgttatgttggtatgctttataatataatagaaactttaacatggactctgtgtgtgtgtatgtgtatatgtgtgtgtgtgtgtgtatatatatgtatataggtatatatatgtatatatatgtatatatgtgtatatatatgtgtgtgtatatatatatgcatgtgtgtatatgtatatccttgggtctttagggaacacccagcctctttaatcagtagatagcagtcaaggggaagagcagaaccttgttaacctgtgcattctggaaggggatgagcatcccaggtgttagtatctcctggcccccaggagaaacaaacagtgactgtctcaggaggaagccgtcatttgcgttgatgtcctctggtctccagcaaattaaggttactaaacatgaactctcactaaatgcacaaggaaagaaaccaccatcagtcaaagtcagcataaataacaagtaataaataagtccccccaaaacttcagatactggaattatctaattcagaatataaaattacaaaaacatgtgtaaataaagatgtcaaatcagaaaaaataagcaagcaagaacagaatgtaaaaatgcccaggcaggtttgaaaaagaaccaaagagaactttggatgtgccaaaaaagaaagagagagagagagaagagaagaggagaggagaggagagaggaggggaggggaggggaggggaggggaggaaagaagggaggaaggaagggaagaaggaagggttaaatggccgacttagattagattgctgaaggacaattagatggctatacggaaattaacccagactattacagataagagcaaagagatgaaaattaccaaaaaaaagaaattaagagagtagaaagtaaaagtagtagtctaatatcctttcccagaagaaaatagagtgaaaagaggcaatatctaaagagatagttgctgagaaatttctagacttgattaaagagtcacagatgcaggaagcaccatggaccccaagcagaaagccatgcgtagacacattggagtgaaaccccagaataccaaagaaaacaggaatatctttacattaacaggagaaaaaaagacattacattacctacaaaggaatgacaattagaccggaaacacacttcttcctagcagaaactgcaaaccagaagacagtgggaaaatactgtcagcatggaagagaagataattttcaaccttgaactgtgcacttagcaaaacttctttcaaatacgagctagttaatttttccacattaagggaacttctaaaaatgcattttaagaagggaatttatgccacaagaaagatgcaagaaagaatgatgacaaaggaaattggtagacacaggaattcacacagaattttcagtctgaaattataagaagatgtatattcccctgaagaaggagacccagggagctatttaaattaactgaggaaaacttgcagagctgaaacagaggggaaacttactttatcacctctaaattaatcttctacaaatggagaccctatttggctattatgctcacgaaaggaatgtagttacccttaaaatgatgtttaagtgaggaaacaatgcccctctcatgttttatcatgtatttcaagtatccccctttttttttcttttaaattagtagagaaggggtcttgctatgttgcccaggctgatctcaaactcctcgtctgaagtgatcctcccacctcccaatgtgctgggattataggcatgagccaccgcacctagcctcaaatattctaaaccttcgttcttatagtgggttgggtggtagcccccagaaagatatgtccacatcctaatatctgaacctgttgatgtgaccttatttggaaatgaggtctttgcagttataattagttaaggatcttgagatgaagggatcatcctggattaccaaggtgggccctaaatctaatgacaagtgtccacataataaaaagaagagccagagacatagacacacattggagaaagcactattcatatggtgtgaatatgggggcagagattggaccacaagccaaggaatgccatcacatgctgagacagcatcagggttctcctgtagatattctcgaaggagcatggccctgttggatattaaccttcaagcctccagagctgtgagacaggaaattttggttgttcgaagccacccagtgtgtgggagtttgttatggcagccctaggaactaatatagtccttaacagttaatttatacttgtttttcaaaaacagcaaattaaaatttaaaagaaagttcagtgtctgctattaatgtaacagaatgttgaagcttttttctaggcgtgctttcttttcttgtttctgttcaggatggcatctacctacagtcatgcgtcacggaaccacagggatttgttctgagaaatgcatcattaggcagtgtcattgtgtgacggttgtagacgtagagtgttccacaagcctggatggtatatcttcctgcacacctatcgctgctaggctacaaactgggacagcagattactgaacactgtaggcagttgcaacacaatgtgtattggtgtatctaaacatagaaaaggtaaagtaaaaataccatataaaggacaaaagatatgcctgtattgggcagctctattgtaatttttttttttttttttttgagacagagtctcactctgtcattcaggctggattgcagtggggtgatctcagctcactgcaacctccacctcccaggttcaaatgattttcgtgcctcagcctcctgagtagctaggattatatgctcgcaccaccacacctggctaatttttgtatttttagtagagatgaggttttaccacgttggccaggctggtctcaaactcctgacctcagttgatctgcccacctcagcctcccaaagtgttgggattacaggcgtgagccactgtgcctggcctctattgtaatcttacgggaccattgtcatataagcggtccatgcttgacctaaacgttgtggtgtggcgtgtggtgctatatgggacgtagatgtggcttatttgacctagtgttggaaaaggggcaggtggtgtcttcaggtgtttgtggtacattctgaatgcctcctggtctcagctgatgacttgctggtctgagctattattcccttgccttgtggccacagaggaggtgggattagtcccacttctggctgtgcctggtgtctgctgctggtaaaattcacaggcttcactttccctaggttcatggaaggagtgagctttactcttaagtagtcttagccttcaagtctcaatgcaccatttcagcgactgccttagggtccatgcaggcctgctggccctcttgccactgctcacattgagccttgcttcactgcttcctgtagcatgatattttattcttagtgtggattgtgatcccattttattggtaagagaactgagaaattaaaacacttgcttaagataatagcactgacaaaagtagcaagcagaattatgcataactaacatagtgtgttagacacggttctagtaatctaccctgaaaattttgtcctttgtcacagatagatattaaagctgaacctgtttccagggcatgagatggccttccattttcacttccagcccagactcctcagtgcccacccatgatctgtgctctggagatcccccttcacctggggattttctttcatttctttgaggctcagctttgtatttaacaaaataggaatagtaatattttacccagcatatactggtttttaatgtggcagtttttgttgtctactgcattgcgtgaacagaagttctgttctcattctatcaatgctggcaaaactcattatctcaatccaacgagtgtttaggctaaaaaccttattagttgttctcggtcttatggatatacttttacttgcatactctctttcctaggttaatgagttaatattgaaagccaaagtcattcaagaaatgtttattattgcttcctgtgtaggcccacatgcctggctgtttattttgatttttcctcaatctcagactttcaaaatcagagaattaagagatgtagtcatctattaataaaagaactaagaaatcttaactttccattgagacttaattgtagataccattaacattgtaatgtaatcattataataatgtctaacagttactgagtacttactgataaccagaaaacctagattttctcctttaaacatcaaagcttttaggtactattactatccttattttacaaacaaggacatagtgatgttcttacatttctgtaagaaatgccatttaacctacattagtgtacccagtgatttggcatggcaaatgttaatatgcaagtagtacacagaggagactatgacttcagagtggttaaatggtttgtgtaagatatcacagctggttactaacagagctggctttccctccattcattgagctaacttttcttagtcctctttctaacgagaatcttatagtttaaggctttataaatcaagtatgtatttaagttaattataggggttccattatccacatgtgctataataattcacaaacacttaggtcatctcatcgcagaagagattcctcctgcattgcactgtggcttagcaaaacagcacaaggctagaaagccagtgagacaggcctgggtccggctcggctacttgtcctgactcaggacaggtgtgcagcctctgtgcgtttctctttcttcacctctcacttgggatagtctcagccctcatgttctatgcttttatatagtttcttccttaaaagagcattcttctgtaacatggagtaaaaatgaggagagcaaatttaaaaaaaaaatcattttaagcctttcttgagaattaagtagtaaaacatgtggttacaaaaatgtttaaaattaatccaaaactttttcttgaaatcaagaaaacaattgtatttataataaaataaaaaagaataaagtgtttaggaacaaatttagcagaagtgtaaaaattattctctgaaaactattaaacattgttgaaagaaattttaaaagaccaaaataaaggagaaagacatcctatattcatgtatcggaaggcacaataatgttagcatgggcatagcctccattttgatctacagattcaacatgatccctttcagaatccctgttggtgtttttgcagaaatcaacaagctgatcctaaagttcatatggaaattcaagggacagagaatagctaaaataaccttaaaaaagaacaaagttggagaactcatacttcctaatttttaaacttgccacagagctacagtaaccaggactgtgtggtactgtcataaggatagacatagagtaagtacatcaatgaaatcgaattgaaagtcagaaattgtctcccacatttttcattaattaattgatttttgaggaaaatgctattgaatgggaaaaataacctttctaacaaataatactgagacagctggatgtcaacatgcaaatgaatgaagttagaccctttcatcacaccatatataaaaatttactaaaaattgatcaaaaattcaaatgtaagaagaaaaactataaaactcataaaaatatataggaataaatcttcatgaccttggattaacgaagccttctcgaatatgacaccaaaagcatctgccacacaagcgaatgtagacaaattggacttcatcaaaattaaaagataaaaaagcttttatgcttcagagagcacaaccaagaaagtgaaaagtcagcctacagaatgagagaaaatctttgcaaattatatagctgataagggacttggatccagaatgtataaagaattcttacaactctataataaaaagataagtaatccgatttaaaaatggacaaaggatctgaatagacatgtctccaaaattgatatacaagtggccagtaggcacatgaaaaggtagttgcttcatatgattagttattgagaaggacacatcggaaccacaataagataccactcggtgccaactagcatgactacagtttaacagaccataacaagtactggggagaatgggaagaaatcagagccctgttaccctgctggtgggaatgtaaagtggtgcagccacattggaaaagtctacagttcctcaattggtaaaacagagttctcatatgacccagcaattccacccctaggtatatacctaaaagaaattaaagcatacgttcacaaaaaggcatgaacgctcatggtagcattattcacaaaaggcaaaggatggaggcaccacagatagtcatctcgtggacggttaaataaaatttggtatatacatataatagaatattatttggccataaaaaaggaacaatgtactgattcaagctacagtatggatgaaccttgaaaatgttatgctaactaaaagaaaccagaaacaaagaccagacattaatataattccatttataggaagtgtccagaataggcaaatctagagataaaaggtagattatctgtatgccagggctagggtactaggagaaaactggtgagtgactgctaaatgatacagggtttctttttgggatgatgaaagtgttctgaaattgattgtgatgatggttgtacatttctatgaatataagaaaagccattgaagcatatgctttaaatgaatgaattgtatgctatgtgaattatatctcaaaatagctgttctaaataatagttaaaattacattttgagcgggcgcggtggctcatgcctgtaatcccagtgctttcggaggccaaggcaggtggatcacgaggtcaggagatcgagaccatcctgactaacacggtgaaaccccgtctctactaaaaaatacaaaaaattagctgggcgtggtgacgggcacctgtagtcccagcttttcgggaggctgaggcaggagaatggcgtgaacccgggaggcggagcttgcagtgagccgagatcgcgccactgcactccagcctgggtgacagagtgagactccatctcaaaaaaaaaaaaaaaaaagaattagaaattatagttaattttggctagttatccaagataactttaggaaccagataagaaaagatccacctttctagcacgacatgaaagttctggtaatataagaacttggtagtcatatagctctcgatttgaatgctgttttagaatagttaatttatatagcttccctgaatctcagcttcttcatgtacaaaatgggggtaatattagcacatgggttgctcggaaaattaaatgagttaccccatctaaagagctcagcacagtgctatcagcgatagccctcattggaggtgccataaccatcataaggttgtggtaagagttggaagagaaaggcccttcctcatctttgcaagtgccgttcctcctgcctggagtaccaccctgtctcacagcttgatgagtcccttcatgacctcactggtagactccattcaagctccatttctggtaggcatttctcacgtgcgttgcgcctggcagccatgctacaaccccaaaggctttccccccttgcagacctggcattttactaggttcagcactggtttattggcccacctgaccctctctgtgatacctgagagcaggggctgctgcttctctcccagatccccagtgcctagctcagtgcttagtgattggtgggtgcgtagtcaacactgggtaaaagaatcaataaattgtatgaatagggtcaaatacttccattggactcccaaacattactttactggtaaacaggttaatctgaaatgttttatgttggaatcttcatttaatagtttgccatcattggtttcttagtatactttgagaaaatagtatagtcctgacattgaaataatgataaacatcaaaaaacctaaatttaattcttacaagtcaatagaaaaatttttaaaattactaattagccactaattacttactggctaataagtagtttttcatttcgaaaggcacttttttttgaaggacctctatgtgctatataaacctctgtggaaagttgaaactttgtatttcttaacataccatctgaattgacaaggggaattgaaaatttggatttccacggtagtcccattgtatttcttaatgataatggtgtaggtataaatgtacgtatcaagtttgtggagtaagtgaatctggtgtatgtttgaacttgcgctaagccacgttcttgccaaaatttggaaaacctatttagaaatattccccttatccctgtgccagctctccagaagccaaacactttgatcataatatttgcctccctgcttcatctgcaaaagaacatagttaaagtcattggtatgtgataaatcatgatattcacatatctaaactgtatgaatccattattaactagctaatatgagtattattaccttgagaatttggtattaaatggtgttttctcataaccttacctagataacaaggtaaaactgtctcagaagtgccttttaactttgtgatctttgaaaaagcagatagagttttcattaaagaccagagaacattaaaacaatttcagtgctttcatcaagatatggcccctttcaaccaatcatttcaaaatattacacaaaatttaggagccctttctgtaaataacactgaaatgaatttggaaagtggcattgccttaagtatagtacagagaaacttttgcccaggggccatatcatatcatttggatggctgtgcaggtttctaaataagagccatcaccacttattttgttaagagaaaggcagcctaaataaattcctttcttgtttcctttaactagttaccctgtgaactaagctatgtttctttctctccccatgagtcccaaagtagctttattaataggaatatatgatgtttgtgttcttaaaaaaaatcagggtggtcttagatgtctgtcgtccattctggcatttccctttatacaacccttttgaattttctgtttaaaaactggcattccaacagcttttctttggcctaatgcctgggttgcatattgaagcaacaaattaggaatgttaagatgtcccccaaagaaaaacgtttgttctgaaagtagagctgatgtgacacatggaattagggcttcttaacttgtctaaatgacagttaatgatcttttctctttttcttttcttttattgttttaacagggtggctgggagtgtagaatgaaagaaatgcccagaggccgaaatcgggtttggttcaccaaactgttaaatgtgtcaagtgcacttgactgatactacatcttttgcctctttttaggagctaatttcgttactcgaaaaattagccggtcagtagctaagatttaccttggacaactggaatgtttcagtttgggaaatctggatgccaaacgagattggggccatgccaaggactatgtggaggtaggaactgacacattacattcttgaaaatacccgtatccattgatattctaaatgccaagcgtacagtgaaaaagtgtgacctagaggtgggggcatacaaacctttgccaaggcaggtatgtttacactcatgctgctttcacttcagggatcagtcgttcagggattggtggttcagacgtacaggtagcttacactgaatggtacttgaatgaggaaaactttcacaaatactcttccaattatttgtgctggatgatggatagatagatggaaaaagtgtttgaatggtgctcctctttattttgggggtataaaagtactagttctcagatcttctagaaatactgcctcatttcaatgtatataattcaagattcttggacttacattattctactaagtcccgccaagagtaatattcttatggaactctgctttctgctgctgaagagtctggttattacatcacacacttcttaacatgttatattgcatgtcgttgagctttacctattaaagagagatagagaaagatgttaataatgattctattgtgaaataatggatattgttaaagggaaattcagattttcattcttggcattcctagacatgctgttttgggtttgcatatattacatacgcaagtagtatgatttttcttttataaacaaatggttaccttttactttgccctgatctccctgcttttaaatatccatgttggttctgtggtcagacatgagcaagcatggtagagacattgtcctttccctggagtagcctgtccttgttcaagtgctcacagatttcctgtgctcatgagcctatttctgtcctgaatgatgtctctctaggaaactggacccagctttcttgttcatttatgcaattcaaaaagaaactttaatgcctacaaaagaaagcaaacaattagtttgtttgctagtgcagagatgaggctcacctgccatcttgtttttggtcataacaataaaaaatgtgtgtgtgtttgaacagctaatactgatttctgttatgcacaaaataattagctttgactttagattttgaatagtgcaacatttagatctatttatttatttatttatttatttatttatttttgagacagagtctctctctgttgctcaggctagagtgcagtggcatgatttcgcctcactacaacctcggcctcccaggttcaagcgattctcctgcctcagcctcctgcgtaggtgggactataggcatgcgccaccacacccgactaatttttgtttttttagcagagatggggtttcaccattttgaccaggcgggtctcaaactcctgacctcaggtgatccacccgccttagcctcccaaagtgctgggattacagggatgagccaccgtgcccagcctaaatcttttaaatatgtgcttctaagctataattacaaagaagcattttatgacattaatccttagatttattttcagaacatcacatcaaaaaatatataggttcacgcttagaaattatgagaaagtagatactggcaagagaagccaaaactttcttttgtctaacctaaatgaccttacctactgaaaaatatgaggcttgttatgtaaaaatacattattttctcaataatatctatttattgtttagccttctagccatcagcatctgcatagagctacatagtaagctataggtattcttttttttttttttcttaaggcagagtctcgctctgttgccagtctggaatgcagtggcacaatcttggctcactgcaacctctgcctcccgggttcaagcgattctcctgcctcagactcatgagtagctgggactacaggcgcgtaccacgacgcccagctaatttttatatttttagtagagacggggtttcactgtgttgaccaggatggtctccatctgttgacctcatgatccacccaccttggcctcccaaagtgccgggattacaggcttgagccactgcacctggccctatataggtattatttatccaaactcttctccaagttcaaggaaccaaatcgattaaatttcattcaattttattattttgcacgtaggtgaaaaaggattcggaaatctaatagattttgatagtgagggaaacagtataccataatgttgatagtgctttttacaggttgtgtttattttcttctttatactgtctttattttccatagattttaaatgaacatgtgtaaacctttgtaattggccggggtaggaggtgacatttcagaaacaggccaaaaagtctcatgaaaatgaatgagagtgttaagtaagtaaggaggaagtcttgtgtcaacgagtagatctgaaagaaggacgctgctgtcatctcacttcccaaatgccaagctagctccactgtgagtgtagtccacatctgggcacaacacttcccaaatgccaagctagcgctgctgcgagtgtagtccacatctgggcacaacaggcccacgtttgaattagcataaaataaaaatattttatatacattttggctccagtaggggttggtgcaaaaaggtcgtgttcagtgaagtcatttatgattgtttgacaaggcggtgtcattacagcctttcacaagccagcatgtgcacacagcacgctaccctctgagtaaaaacacagcaacacgctaccctctgaataaaaatacaccaacacgctaccctctgaataaaaatacaccaacacgctaccctccgaataaaaatacaccaacacgctaccctctgaataaaaatacaccaacacgctaccctccgaataaaaatacaccaacacgctaccctctgaataaaaatacaccaacacgctaccctctgaataaaaatacatcaacacgctaccctctgaataaaaatacaccaacacgctaccctctgaataaaaatacatcaacacgctaccctctgaataaaaatacaccaacacgctaccctctgaataaaaatacaccaacacgctaccctctgaataaaaatacatcaacacgctaccctctgaataaaaatacatcaacacgctaccctctgaataaaaatacatcaacacgctaccctctgaataaaaatttgaaatggtcagattccatggagagacagatagaaagttaggtcattctccttgccatccaagccttgatttgttctataatacaagtgggtcttgtgtattaaggactctcctgggtttctaatatgttgatgatgtaggaagcattttatagttctcatttatgtgttctgaacaaagtctaaattacgtttattcagtaagaatttatagcttggtaccctccgttttaagaaatatgatcattccttgcaattttaagtgtattaacataagattacttcagagatttatgactaaaggtaaatttgttgccaaaattaaagtcagcaatcataaaaatgaaaaaggagaggtattgtttgtttaaaacacacatgcaccctgacactgaaatcaactttagaataaagaagtgtttgcaaatgtaggtcaaacaagtcataataccatctcatttacacacacgttttaattatacagctgaaatgggaaaggttcccttatccccctcgcagagcgtgtgatggtggtatgggttgcttcctcagtgccccactgctcagacctcttggaggagcatgcagatgggcaggttgtggggctcaaccccacagcagtatctaggggtgaatgtttacagctgaagcctctgtgcgcatgtgttacagggtgctctttcagtttagccatccataggtggcttgtgttagctcagttagacccctttccttatctccaggacagagggctttctgtatcctgaggttcttgctttggtatactggaagaatcagatcacacgtgggcttggagaatgagtgcaaggttttattgagtggaagtagctctcagcagatgggggaaccagaagagagatggtgtgggaaggtggttttcccctggagtcgggtctctcagtggctggagctctcctctctccgccccagccaaactcggcatagttccacccgtctgtggcctgccggtgtgctggtgcctgttggtatgctctcgacattctctcaatatccagctgctggtgtgttcctcttgatgttcagctgcttgtgtcttggggtttttataggcacagcatgggggtgtggtgggccagggtggtcttgggaaatgcagcatttgggcgtgaaggcaggagtgcctgtcctcacctagtccgtgggcataggcctgggggtggagccctcaccagggacctgcccttctcctcccggcacttccctgcccctcttccgtatcacaacctctctcttttatatgcaaaaattttagtaaaccttcagatgaagtgactgacacttttttacttgtcagtgaatttccatcatgaagagcagagagcattttctcctcgtgttgtgaggtgggtgctggttatccctgctgtgcaagtacattgtttctcagcttagacaagctgttttatcttgatttttccatctgtgtaaaggacagaatataaaccctgtaaaaaattagcatcagtgtgctatacatacatacatgaataaagtttacctctgacttgtaaaaattttcacaatgatttataaaaagtccttacttgttgctgattccaatttattttcatccatctgtagtcttgcttcctagatcaagatgttttcaaagttatttaaatgagtgagaagtatttcaacttgaagaaaaaaatatatacagctatattaaattatattgtacttctgaataaagtcataggcagttagatctcttccagtattttattataaaactttttaaacatacagaataactgaataaattttacctcaaacacctgcgtaccacccagattctgtaattaatgtctacaattactgttgcattttgaacaaaaattagtatttaagtaattactgtagtgctaatggcttacagctacaaatattcaatttgcacaaacacaagctactaaaaatttgcattttatggggtatagatagcagttcaaacttttttttttttgagacggagtctcgccgtcgcccgggctggagtgcagtggtgcgatttcggccagttcaaacttttaaaatatttttatcttaagtatttacctgacccctctacaacctgcttttatgcccacctctctccatataggctcaagcagcttcacgagaacactctagtggcaatgcgccattttcaaccaatgtccagcagtcaggattatagcagtggtggcagaaaacactaagggagagaacctctgacttctcagggtggcactgttcattcaacatgtattctattgagttcctgccatggtcacagttctggttgctacaaatggcagtatatggtcccaatgagatcccactttgatataaatatgtgaaacacaactatagccagaacatattgactgataagctaaatggtaggagctgggccagagtatcttcaggcttttaccacccacaaaaaaggccccttgctcttgggagacagggttaatcaagagacctaagtccagcctctttccaggactcagtaaaagccatgtataaagtggcaagaggttttcctgctacagctaatcccacagatgctccagaagggtcctactggtaacccagaggacgtgaggatcgttaggggtgagcgttgaaattcatcagaatttaacgtcatatacctgcatccttttttgtgtggaggtggcaggggacagtgagcacagactgaatcataacaaaactacttttagaaataaacgtaattgccaaatgttaagcacttattatatgccagaaacttttgaagacttcttataggttttaaatgtaagaaagagtctggctgagacagctgtcagatcttgccgaacctatgctattggctgtatcaggtaaagaagtaaagggtgtgtttggggaaaatatgtagtcaggtctccagccccctctatcccttgtcctctgaatgaatttaccttcattccagctctcagttctcagctaatacagagacctggggaaggtgaggagcctctggaagggtacataggttacagacagagctgggagaactgcccactgctgcccagtcctttctttcctatctgtccatcttctactagcattttgtatcctatgttacacaaatctggaaggaagagacgtcatttaaactttgagatcttatttaagggaagtttgcttgttgcaacatcaccattgatgtcggatttttcacgaccctttcactggacttgtgacagggtgctccgtttacttggcccaccatgctcaaccgcttgtaggagggagcgcgtgagtgagcgagtgcgggatccggctggctgctgctctgtgcgctggcaggaacaagctccatttactcagcctgctgcgctcaaccccttgtgggagggagcacgtgagagagcaagaccagctgctctggtcaccagcaggagcaatcttcgtgtgagtgttgctgtggtacacaggtgggggtgcctgtgaccctgaagccccagagggtgtgttacagtgctctcttagctctgccgtctgtggacagcagtgtgttatcaactcggttggtcctttgcctcgtcacgtggagcagctgccctctgccagcgaaggcaaagggccagtgtgacagctttttttgggtacccgcactcagtgggtcctgagctcttgttgggagtccaagaagaatgaggtagtgtggacacttgaaggatggtgaaggtggatgtattagtccgttctcatgctgctgataaagacatactggagactgggtgtttataaagacaaagaggtttaatggactcacagttccacgtggctggggaggcctcacagtcatggtggaaggcgaaaggcacgtcttacatggcagcagggaagagagagaatgagagccaagtgaaaggggttccccttttaaagccaacagctcttgtgagacttactaccatgagaacaggatgggggaaccgcccccatgattcagttatctcccaccaggtccctcccacaacacgtgggaattatgggagctacaattcaagatgagatttgaaaggggacgcagctgaactgtattagtggaggattttatttagcaacggaaatggctctcagcagagacgggagctagctgtagatgggacgggacaagtcttcccctgacgtccagccggctcttccctgagtcaagccatctctcttccaaagtccagctgctctctgaagtcaagttttccctctccagtcaaaccacgtttctctcttctactgactgagtctggggtctttataggcagaggatggggtacaggacgggctatcggtagttttgaaaaaggcaacatttgatgggcaaaaaggcattattccgaaggaaccattcaggagagagtgggcaaacaggagtagagttgtcgccttgggccgtgagtttcaggctttttggtttgaaggtggagcttcaccagggacctgcccctgtctgcctcctgcctctgtcaccatcagtagaccatgtttgttcatatgcaggagagtagcatatagcagtagtatctttttgtgtttccattgtctaaagtgttagtggtgcctgaatccatttgttagtaaggccttacttaacagaaagcaacggtgaggttgtatctgtctcataaagtgacagtggtctggaaaaaccagggatctgctgagagctctctatcttaacaacatcgttcctgtcttcctagcagaggggaaggcattgtgtaactacgtgcagaggatatttacctggggagtttcctagaaaacctattctattagaatctttgtcaagtgactgtttgttaggtaataaggtcagcaattgaatttctactcactgtgggagtctaattccatattattacttaggagcctaaggtgttctttcttggaagggaaatatgtcagtggcctcctcactgaatgtgttgtaatactcatcgattttttattttgactttttatattgattagtgaggtattgctattgttttccattgtgggaaaaaatcttctagccttctgtggagctatttaatatactctctttgaaaaatattccaagaaatacaaatgaaaataactaaataaatagtctctcctttatctgtatttagaagaacgtggtttctgtgttgtttctaacaaaccaaacatttaagaaaggcaattcaagggccttgattaataaagaaaaaagaacagctttatttataggaaaagaaaagcttgtaacagtttcctgcatctttgaaacataaaatgtttagattaagcaaaaaaccattttcctgatctggctatggaaaactctgtataacaaattcagcttgccatttctctttttttctcttcttcatcctgtgcagtaaacttttcagtgtattatttaaaataagttaagaaaaatgtagaaaatcaattgcctgttttatctggctaggtcttgcttgattggaatgacatcccagaagctgctgtgtccccaaataagaacctgtagagcccgttttaaattgttgtttaatgaaagacacctgtatcacccatatttctagtatgaattgagttttcatttacagatagtttagaaacatgagactgggtgcattcttagatcacattttcagtttgatttaaaccacataaaattgagcatatgtcattaaatcagaaaagcagttattggccagggtatgtatggagagaggatgcaaatgcatagagaataaagttgcatgttcatataaaatgggttaggtatagtgcctgtggacgtggattatgagggttatgaaacttcatgtaagtgctgcttaagttctaatgggtagcaattaaccacattaagatggaagcttgtactccaccctttagtcacgctcattgatgtgaagggtcattataccattgcagatcatgaagtgacccattgtacttaagaaagtcatggtgctagtcttgagagcaaaactcctaggaaaatagtgtaagaaaattcttacactaaagaactgttcacacttaggttagctattcactttcacacttaccaagtccatgagattccttgagctttctcagtccaccccagcctgttctgcccttcctctttccctgccctgctccccacctgtctcttctttcactgacgtctcccacttttttgtgacttctgtgaaagtctggaaaatctgaaaatatgaactaaactgactgtttaattttaataacaagactgtccacaggaaatagatgtaaatatctctcacaagatgtgacatcatctaaatttagtgatgattttgcttatatcttcaatattcagtgcttcatctttatactcatgcactctggagagggcaaaacgtatttgcaatcaaggcagtcttttgcacacataccatacgttaatcactctatctctcttgctctgtctctttcctatacacacacaagctagaagtcaaatctctgtttttgaatgcatgctaaagtactgtttggctttatcctacttattagcacctttattgcaggaaataattgactaaaattacatgttttgtctttgcagagctctggtggagaagcctgggggctctgctctgtccttttttgggccacctgaatgcccaagcccaagctccaggttcccaggctcatcctcaggggaccctctaatacaagcatgttaatcttgcctttgtatccaaagacacaaaacaaaaccttttttaagttgaatgttcccgaaagcaaagaaacacattttattttcagccccgttcacttcatgctggaaaacatctcttctgcttattccgtgggaaggaattatagcagtaatgccacaaagattctccttatcctttttctcaggtaaagaagaaagttcaatcctctctgtgagtgttgggtcatttgtatctgttatttcagttttctacctgttgacttcaatacagctgggataattgatggctttgtagtgctgatttgatcctgaaatccctgtgactctgattgatggcccagggcatcaacggtaagacctggcaacacggaatggatactgtaggaaatgggccagatctcgtgtaagaataagatgtttaacactgacttgctggagaaataagtttaatataggctggggacttggttccatgtgcttctactctatgccttattgaaggtgaagaatattcaaaagccattgtactcttgggatcaaatttccagaggatttttgacttgttagagttgcttcagaaactatgctgcatatgccccaaacagataaatttgaggtatagttaagtgaaagtctccttttccttttagaagagaaaaacaattggacttctactagggccagttagttacaggtacagtttacagaagccgaattatgtaaaggcaaaattgagaaatcctttgagaaattgtctttacattgttggcctaagcctcatatggaaattattagtagagttctcaaagaaagggatgaaattactccataggatagcttccctaagtacctctcagagttatgtaaaatatttgagatcacttttaccattttttctcatagagagaatggttgggctctcactatagagagaaaagtgagggagacctctgaggagcagtcaggactttgttagctatctcatgtcggtctctcttggggaagctccttgaaggcaggacctggatcctatccctctttatctttaatcatccctcccaacatgcctggcacataacagatgcccagtaaatacctgaattggatctccctgcccatcatttctttataaaattataaaaatgaaatctgtatatatgaaatgtgttccatttctcttactattaaaagatgctttctttagctagcacaagacattgcccccagaatatgatcttaccacacttaggttgagttgtgctagatttacttgatatcagcaaaatgtttgcaagcacctttctttctggttgagtgcagatcataaatgaaaggaagtaacgtctatatgttctcacacagtggccagtttcctgattatctctagattctactattattagactttattcctagctttatttttacttttgatttacttatttattttgaggtaggtctcactctgtcacccatactggagtgcagtggcatgattttggctcactgcagccttgatctcccaggctcaagtgatcctcccacctcagcctcctgagtagctgggactacaggcatgtaccaccatgcccggctgaatttttttttctttttagtagagatgaggcctccctatgttgcccaggctggtcttgaactccagagctcaaatgatctgtccacctcggccccccaaaggactggattataggtatgagccaccatgcccggccttattcttatttttaaaggaagaatatctgagcagatagaaaaatggaaaggcagaaggataaactggccctgttttacaaaataatatttaaaaatcactaatataccattagcttataagaccaagtacccatgggagtacttgatgatattgacatcagctcattcagaaacctttttgtgtgatcatcactctatttcctctcagttttcaaggatctcatttgttagaggattcttctagagagccagagttccaaggagggctctattattatggaaaaccgtcacactctcccatcccttctcttctcccctctctatcctctctctcagtctgtacccatcaccaacacatgcaaattagaagcaggtcatgttgtaataataggactttatttttaaatacatatagaatttaaagattcttatgtatttatttgacagtggctctgggaatatctgtggaaacagtgcagtaagaagaaaagaaaagccttctgcagtaccattttctgtccctcgtgagtgtgatttcatttcctccctggtcgcacatcacccacatgctcagacgacatatccctgttcttgggtccgtcctccagcttctgactcacagagcagagcgatagtctgtgggtgcctgtgttggagggtacaggttgcattccaggaaggtgactcggctggcatcctgcctctcggggcattctgtcaccaagtccacaggatacagataccccattcaaggtagcagagctgcgcctactttgtctcaacagaaaaaggcagagatgaggatttcaagggctgcatagtttcatgtgctttttcttacagtgtgtcctttagtcaagaattacttgctggttttgcctgggtctcaaatttcaagtttgaaaataaaatataaagatctatcactagaacttattttaaaccctggaagattgtcctattctattcctgtagtgctttgtcatttacatctttgtatttgattctcccaacacatatttgaccatggttaggagagcacggattgttttttgtcattttcataggaaaaggctgacattgaaaggagaaacccttgtttgatgtcttctcttggtatcaggcagtgggttccagccctgctctgccaactcctcagtgcagtgacttaccatgatactgtgccatgtttctgggctgatttttggtatatttagtcattcttgtgagatttttaaagtcatttttttttagtgacttcaagtgttgattgtgtagcaaacgtattcctctcgctaggtattacatataaactagcatctctactgctggcctaatacctctaatcatcctgtgaaaccactccagtgtgaggaactgagtgtgaaggaaactgtagaacatctgaggagccacatgtgaaaaggccagtccctgtgtcctaaacagacttcctctacattaagcagtcctttaatagttgtacaatcatataatttgaagaagatatccattctgtacaggaaatacaagtttaacagaagtcgtttcatttgatccttatcttcaaaaaaaaaaaaacctgaagaagcttgaagacgtggcatgggtggtttagattccattgccttttgtcagtggcagtagaagcctcattgtagttaagcatctgcctgggcctctgggaaaacaaagcatcattaactggctggctaatgagtcatctattaaaattatccctaatgaattgtgggtttgcttgtttaattgcgcgtggtattgtgctctcaaatgttagcagtccagtggggctcaaagaaattacactggctttattgagcatttcagtaggattcttcctaagtcactgtgccacgattggctctctctctttctctccctccctttttcgtctctctctctttctttcactctcctttccctctgttcatccctacctctctttttccctcttccctttccctcctttcccttcccctcccttcagctcatctcctctctctctccctttctttcacagattgtggggtaggaatacaatatgaaaactcttactttggagaatctgcgctaatggcatcttgagtatgaacagccccccacccccgcacgtgaagggttgatagagcctggtgagcagctggcagacgccccattttccttcagctgcaccctcacgtttcatcagcgctggtcactgtgggcgtgctaccttgtaactaggtggctgctggtcttcctttccctacagccatgttgtcagtctagaatggggtagcaaaaacatcataggaataaagggctaaactacgtaaaaaccatgattgtatattgaaaaatgcttaatgacagtttttacaccagtaagaatgccaagatcttcaggtacagcttagcttccacctgcgaagcctgcgtgagcagtggctgggcgggacatgtctgaatggtgaaggtgttgccacctcccaatatggccctttctttatgaacagctctaatggtcagttgttattttaaagtcaaagccttccttgagcctgaaaccatgaattaaaatatccagttagtctttattttcaagttcaaaaccttattgcgtactgaaaatgcatgaactactggacacttttacaagcttactttcacaggagtctggtaagatacgtgctattctcatatttttctcactagagggaaaacataaggcatagagagagaggcttgctgagtctggcccagatcaggcgcgttcattcggccgacccttgtgctggctgtaccctgcactgtgatgctctctctgcctcccacatggctgccagagtcgcctttctgagatacagatactgtcatatttcaacttaaaaccatcactgtctccaccatggaataaaggccgctgtctggagcatgcattctcggccttgggcagggccccagcgtcctcctccggagctgggagctgctggccctgcaccgtgccggccctgggctgcccctgctgcttgcccttggagtcctgccctgctcaggctcagcactcagctgcctctgcagatgccctcctcaggggccctactctcctggccacttcactgaagaattggccatttcccgccttgtctgcaatgctttattctcagccctgtgagcctctgccagggcctggctgacaatgcttgcatctggcccctagcatctctcacagcgtcttgaaccccggtgctcaactgcctgagattgaactcagtcaaaccaactcagcctcaaatccaagtgtccagcttctttatgggaaaagcaaaaccactggttctgtggggacacatattctctgcagatacagtggatggttcgaggtctaagggcatgcgaggcctccgtgctgctctccctttagtggatgccagccacctgctgtagctggagcccagggtgggcaatggctggccactgcctgacttgcagacctcccaaggtatcctcaccatcccaaggtcatgacaacctcgcacacttctgcccaggcctaagcaggaggggggcctgtgtgggagagagggcctagcacctcactcatcagagctgtgtacatgaccacactgctgtgcttcagggaggcccagtggctggatgttgagctttgcagacaccagtcaagaatgatgggtagttgggcgcgacaggagaggattcagaatttgccatccaaagccctgtgagacacaagactaaggcccagtgcctggtgcagttctgcctttgacattgtgaggggcgcaccttgggaacttggagcacagggatcttccctggaaatagtctcaggtgtcacttgtcaccctgcattgggacttcatgagactgtgaataactacagtaaaccagatgtgcaagaagccagagtctaggttatagttacttcagactctgtatttaaagattctctcttttttttcttttttttttttttgagacagagtcttgctctgttgcccaggctggagtgcagtggtgcgatctcggctcactttaagctccacctcctgggttcacgccattctcctcaactggaggattctacgcctcccaagtagctgggaatgcaggcgcccaccaccacgccaggctaactttttgtatttttagtagagatggggtttcaccgtgttagccaggatggtcttaatctcctgacctcatgataccccggcctcagcctcccaaagtgctgggattacaggcgtgagccaccgcgcctagcccaaaagttctcttaattaaaaaaaaaaaaaaaaaaaaaaaaaacaaacaaaaaacgctttcatgataattgacacacgttctatgtaacacaaatcatatgctggcttttggctcccacagtttagcagcagtgcctaaatgggattgctagtagcatttctcccatcagcagaaagatctataggatggatatactgtattattttttcctttccccccgtacatccactcactgatgtagatgggaacataatgcaaacttaagcttgccttatttacataaatcttcctgttagctttccgctttaccatatctgcatttttatgtttgacctattagtacttttttggttttataaagaaaaaaaagtgcttccctcagcagaaccatctggcttcgtttcctgttcctcagcaactatatgtgtattctagcagggccacccctgtggttttctgagtggtgctgtttcactggtggtcttagaattcaactggagtgatggaaaacttatactatgggcttctttcaagtctaaagtttccaaggtgaaaaagtgcatattattgtcatttttgacatagcctttttttccctgtgactggaatatggtcttttaaaacaaatcacacccttctattctttgaggaagaaaactcacttctaaaaatgtcttttagatagtttgctaccaaatttccttggcagcaaactgaggcaactgagaatataatccagacatttttaccacatgcaaactttctttttttttttttttttttttgtttgtttgagacggagtctcgctctgtcgcccaggctggagtgcagtggcaggatctcggctcactgcaagctccgcctcccgggttcacgccattctcctgcctcagcctcccgagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcctggcccacatgcaaactttcttaaagggtcagttattaataactagttttcttgatcaaataacaataaatgagcaagttaacaataaacaatgagcaaattacataactaaagggtgtggcattcagtttatagtttgtgtggcagaggtaaggtcagtctcatccagaagggcaatgtgtaatgctgctttgggcttgtggtacacacagagaatcccagctggtcactgggcacattttcagaggggtgtgtgcatgaggttgaaattctgtatttttatgttgtaatattctacagattttgaaaattttctgaccaagtgtgcacttatttttcactttgtgaaatactgctttctaaatctttgtttttagaaacagtcaccaaaaggttttgtttgtatatatatatttcattttttctctttttctgtttttggtctgtgcacatcccacgggtagttgagatccacaagctatggagagaggaagaccccacagtattttctttttctttttttaagggaaggtggggtatcacattcacccagtaggcactacatttcacatttggataagactttgttttataactgtttgtatttaaagctttcaaattttactgtgtaaggtaatgcaaagtgtttaacctgttacctatcacatagaaagaactctaaaaagttggagtgctccccacagtcctttgattagatcactttttaaaaaattttttttagacaaagtctcactctgttgcccaggctggagtgcagtggcgtgatcttggttcactgcaacctctgcctcctgggatcaagccattgtcgtgcctcagcctcccaagtagctaggattacaggcgcccgccaccgcacctggctaatttttgtatttttagtagagacagagtttcactgttttggccaggctggtctcaaactcctgacctcaggtgatccacccgcctcagcctcccaaagtgctgggattggagaagtgagccaccatgcccagccaagatcacttatttttagtgatcagaaatggtcgattctaaaatgataagattatgaaatctttattcttctccttagtttgaaaaagtcttcaaatgtagcctcagacctattattttttatgaagagtttagagacattgaaaaaaactctgtactagaggatttggtttttggaggtgttttttccctacagagtagttcgtggtccctcaaagaccttgcttagtcagaatgttgcttgaaggtgtgcaaagttgaagggaatgctcatttttaattttaagaggaaggaaaaaagttaaaaattgaggctaataaaagttaatgaggaacatttaaatccttcaatggttcaatttatgttgcaagtcagaatggttcatgccgttattatatgtgtgtggcaacatcctctctctgctgtaattcttttcccttgaaaactagcccatgcagcgtggaaggcatatcatactctcatgattgctgttcattcttttgacaaattccacggctttttttttttttaataggggaaagaacaggcacaaggaaattaaaatataaacgtctgttttttctgccatttttttcctgtttgacagattactgaataaagcatggttatcagcagagtgaccatttctaactgtctctttgtgcttaaaaatttattttgggatgggaaacattccccaaacccagagggtacacttaatatgccagttttcatttgagaagaattacttttcagttgtaggtgttttgggatgtagcctgactcaacatccagtattaatggtccaaagatagaacagctgaactttctgactgcccttctttgggagacattagcatgtccctggagacagtttccccagctctggttacgcggatcagtatgtagggaaagcttattacttttagaaacgttcctcttggagggccctgtctattacccacatcaaatatatggtacacgttgctgttttctttgctttcgaaatgcttcagaactagcccctccatctttccctgactgtagggtccaggctgtgggaacagattttccatcagaccaccttgggaaatgaagtgaactttttagtggtacatttaattcattaattgccctgtctccagagcttccagagatttttcttaaaaacacaatgccagttttttaatagcaatgtttaaaaagtcaatgcttaactcattcagagaaaaactcctgtgacacatttcctggagggcattggcctcaccacttgtttttattaacaatctatatatacttgtggaatttatctctagatggaatattcagtcttatccctacactttcctcagactgaggcttttcatggtgaggttggtgactgcacgccagaatcaaaagaccctcgtgtatgtgcaaagcgtctgctgtgctgtatgttgggtcctcagcctcttcctgctgctgcctggcctcctacaatcacttcaccgttccaaatcttactttccttctattcaaagggagggggctggagttcaacacaggttaagatttagaaactgagaatatggaatcatcttttgaacactttttccgtacagcagtatttaccatctagtataaactttatgttgtttttaaatatatctgctaacagaacgtagtgttctgtgacacagattatgattttgtgttttaacattgtacaatccctcagtgaaacaaattatttataaagcccagtatcatcttcttttttttttcagtttcatttattattctgagcttaagctaagctaacatctttttttttttttaaacataccaggacaaaaaatactatagaaagtgctacctgatagaaataaaattcaagctatacatgcatgccatatgttatataattttaaattttcagtgattattacactataaaaagtaaaaatgtaacattaattttaagaatatttttaagtcaataaatcccaaatattaagcatgtaaaaaatattaaaaaattattgagacattttacattcctttttctgtacgacgtcttcaaaatccagtgtacattttatacttcacagcacacctcatctcagatgagccacagttcaggcctctggatcttgatcgggagtttgctttcttatacacggaatcccatatttaaaaaccactgttcttaactacggttatggaatcctgaagaggggcagcggtgagaaaagaaaatctggatgcttctgtgatgccatcttgatggataagcactgtatcactttcattgtggtgatcatgtgaccctcgccttgtgcctactgactcacccatggggccatagccatgccgtccctgcatgtggaaggagtaagcagaagactcttctcagtcttctccccagagggagagtcttcagggaggttttggagtggctgtagccagcatcacacacggatggacacattttaccttctagaatacagattgtccttggagaaaagcaaccacacaagaatcaccctcagtgactactgggccccactcaaaaggagggcagcttacactcacagcaagatcctgttgcaacccggagaatcccaggatttctaaagtaaaggacctaagaaagcatctggttgttgacataggattaaccaaagaacatagtctatacttttgggtctttgatttgtactaggcagagtctttgtacctgttcttttaagcaggtaattcacaagtaggcagaacctaaattgtcaagtgggaattttgaaaaaactttactcaagtgcctcggcttcagactaagaattaatttcatcatggagagcagtttagctgcacctttctctggggtttatctcacttaattcaccaaactttacttgttccaaaaaccgtaaagtctttgtttgaaaggcatttcatcaagatgtatgatatgctctttttattcctagtggcagcaatacaaataaattaaacgtttataacttgaccggtgtgactaatatcctgcgttttctggtggataccctgtcattctttcatctacgtagccttttttcccctgggaatctcaaagtctttttgtctgaactggttggttataggcatgctaattacagagatgtggatggtgtaacccccctccagctaaaatggcttgcctttagggtcagccgtgagtcaggtgcagacctgggatcttaacgcagaactcttgattttttaatttctgctctaatctttagctacataaacatatgaagaaactgactacagcagattattccaatacatgtccagctgtctgagcaaacagccgtagggaagagcttacctctcacctctcttggaatcatcaagccttcgagcagcagttcctgccttatggtgccatgtgtgtgtctgaggatcagaggaatgataagaagtcaagaggaagggaggatggctgagtagagtgatgcactttctatgcctctttattaactggaatgatgaaattaaaattatgccacttttattgaggtttgtagcatagcccaaatttaaagaaaattttgattcaagaaaatatcttttgccaagagactttcagaacaaaattggtctacatttgtaaactacttgggacagagaaacattagtttaagcttttaagtgaaaaatataagaaaaggaacctacaaagaatggtacggtagccccctcctatccgcagtttcactctccacggtttcacctgtccgcagtcaaccgtgatctgaaaatattaaatgggaaattacagaaataattcataagttttaaatcgtgcacctttctgagtagcatgatgaaatctcacaccatcccacttcgttctgcccggacgtgaaccattcctttgtccggtggatccccactgtcgatgttccccacccattagtctcttagtagcctccttggttatcagattgactgttgaagtattgtagtgtttgtgttcactgaatccttactttacctaataatggccccatggtgcaagcgttttgatgctggcatattgttatcattgttctattattagttcttgttgttaagctcttactgtgtctaatttttaaacgatttatcgtggatatgtatgcatgggaaaaaacatcgtgtgtgtacggtttggtatttgcaatttcaggtatccaccggggactttggaacatctcccacagataagaggggagaactgtatagttcatttattggccagttattgtctcttttatatggacatgcaacttatgtttataaccctatattcccttaaaattctgtgcttttgtaaaatgtgtaccagctcaggaggctcacctgcctcccatggaagcaggctttcatgcttgctctgtgtccgactgacttcgtaacattaaatgtgtcactgatggttgctttaggaaattatttgcctgggaaaagaaatacaccatgtcataaaacagagagttcacctatgttagtgagatgataccttcaaaggtggaacatttctagaagggttcctgtcctgtcacttcccttgtttcaatactgtattggcccaaggtaggtattggtttgggatttcttaaacaaaacttctttttaaatatttttagaaagttgcttttattcagaggtctcagtatcttgctttgtgccaagtttgttttgttggcttaaattatgttaaaattcagctttgaaaatcagtacatgggaccgtggggtgcttgatttgctgaaacccatccaccagtttctcatcttcccctcatctgtcatgtggagctttagagtatcagagtctatgcgtgttgagttcaagttgatacacatacactgacacgtgcatgccaagccatcttccccataagccagttgtcaaatgggtagagagattacacatgcgaaacagcaaataatgttagagtgtgtgcttgcagacacaaatatatatgcctgtgagacaatgacagaaaaataaggaatcctggaagcatacagactgacagttttgcagtgcatctgagttctcaccctccatggtctgggagaggaacatgtgccatccacccttgcctcctctcggaggctggggctgtgtgcagggagcccctacggtgggttctctgcccatttcctgctatgtaaagtgttattagggaatgaatggctggtgaaaaggaccttgcagcctgtgctttgagtagcctgggaccgttgggaacagccgcttctgtctgtgtgatccgaagatagctcccagatgggagagctcctactcctttccttgtcctccctccctgccctctagcacaaaagcttttggaactgcaggaaaccccctggcttgcaaacccaggacccgtaggcttcacaggtcttgtgaatggccagcattttgggcttcacaccccactaacctcttgagaatttctttgaaaaactagagtatcatagagatgtgaaaagagtttgatttctaaaatcagtgagtgcatgtattcagataacctaggtttaaaaaaggcaataaaaattaaaatctgctgactgcaatgacagaataattgcattttattgtgcaaatatctaatttgacccaggttattttacttaacagcaattagtgttttggtgtgggctaaatagtacctgagaatccctaggattgtgttagtttcatggtgcaaaggctcactgcacatttggaactggcttactgagtcctggcaccccagctctcaatgctggcacttgactatttgcaggaatggggaactgaccacccacagaatggcttatatgcatatgtaggatggcttatatacatatatacatatgccatgcagccagctttgaaatgtgatagcacttctctgaggtccctaatgtgctgctcaacctttaagactaatcaacaaagctaacagttacagtaatacttgtcacaagcatcacttatttggtagtttcatgtaaagatcattgtatcgttttttggaacagctgttctgtgtggatctgtgaagaaagtctcggtgggtactttccatttccatttgagcatgtcagatggcttggactcaacagccacctgggcgctccttctcagggacacctgcatacgtgttcccagatggcctatggggttattgtcacatgccagcacccacagctatgtgctggccccacatgcagatgcacaggtacctttgaggtcccacctacaagccagcacccacagctatgtgctggccccacatgcagatgcacaggtacctttgaggtcccacctacacgccagcacccatagctatgtgctggccccacatgcagatgcacaggtacctttgaggccccacctacacgccagcacccacagctatgtgctggccccacatgcagatgcacaggtacctttgaggtcccacctacacaccaacacccacagctatgtgctggccccacatgcagatgcacaggcacctttgaggtccaacctacacgccagcacccacagctatgtgctggccccacatgcagatgcacaggcaccttttaggccccacctacacgccagcacccatagctatgtgctggccccacatgcagatgcacaggcacctttgaggtcccacctacacgccagcacccacagctatgtgctggccccacatgcagatgcacaggcacctttgaggtcccacctacacgccagcacccacagctatgtgctggccccacatgcagatgcacaggcacctttgaggccccacctctaatgacaccggccagtgccctcggcaccaggggtgaggcccagtgtggaagagctttgcaaggctttcccctggacctcacagctgccctgagaataagtgctcgctgcccaaaggaggcatcgcttggttaagtagcttgcacagagcacatgcaggtaagtcgctgggatggagtttggatctcatgtcatggatgccagagcttgtgctgttcttacttgcttgggccatgctacctctatccatcttttctgcccttatcccctttcttctgcttcccctcttctttgttttgcaacacatttttcctaccattatctcccttttaaggaacttaacgttgcctctgagaattgttgacgttgccctttgtcaaccatgtgacactggggacaggtccatctcatgcactccttctgccacccccaaggagggaacagggctttgtcagcagtcaaagctgctgtgctgggggctcctggctatgtgcgaggcatcatgctaggcccagtgaagcctgcagtgaggtattaagtgggcaccaccctgagccctaacttggccaacaggaaggtactgcgcattgctggtgtgggagccggcgagtcactgttctgacaacccacgctcaaggacacagcagtgagcacagcactctactatcggctctgtcaggaaagcctggccggaaaggaaacaaattcgttcgttaaatggactgacccttttgtctttgcttaatggagtaactttgccttcttttgacttattctgtctgcctgcaaaaaggaaatctgctctcatttaatggactatcagttgttggtgttgccgaggagggggcagtcctcctggcctttgctctcaggaaggacagacggccacacagagcagcccccgaatgcaaatgagagtcctgattaacagtaaggcccccagggtttcctccttttcccagagataaggctggggcttcctaccctgccacaatcagccaactgtttcaggagccattttctctcctctgtgattacatttattttgtctggtacaatttcgtgttatttaaatcttagggttttaaaatggctttctcagaagccattctcttctgaaccgcttgtcccgtgcccctggaagtctggagggcctgtcctgacatcacgtgctcaacattcaacagcgcttttctgttccaagcttgccttcctcccctaagctgaaataaatcaaagttggttgggactcagtcgcaataaatcaagacctgtccagaactggagcctgcccagtcaaaatgtcatagcttggctttcactgaggattaattaaaggcctaatataaagcccagatgtgcttcaggagagtagcaagctgcctggtggctgcatctccccaggttcctgcccacccaagaatatggaggaggacagaaaggcatccagggttgggagggcactgaggggagggaggcgcccgtaagcacatctgagtgaactttatctagtttggagaaaacaggacaagctttccagcaaggcaagaagaaaaatctatgtcagactgtgtgtgtacagtatttaaagggaaggaacatgtaatatatcagaaggtgtgctttaattgaggagacaaaagaaaatgaaccaagtaaagaggtttcattgttttaaaaaaatgcagtgagatttatgcctggttcctgctgaacctgtaaattgtttagagcagagaagctgtgtagatgaaatgcttttgagatatttttattcacagaaagttgaattagacgagaatagcttttggattaggacttatccaggtcttcctttagttccacacaattccatgtactcaacaaaagggtgcctaattaaattccgattgaagaaattcatatgaaaagcaatgtgcaacattaattctccgtatgtgcaaagtactgcatttgaagtaggaaacaagaaagtgtataattcaaaaccctatatcgtgatcatattatatgactttaaagttaaattttaccactatttgtagaaatttgattctgaagttgggaaaagaagacatcatcaaagactaataaatccacaatctttttttgtggtaatgtgtatactttccttccctgaatatctgtaaatcagctatgtagaaactttgtaaataaaacaaagtgaatctcctgattgctgtgcaatttataatagacacatttgatgcaaataattggaatcttttgatagatataaataggctttttgtgactaggagggcttgctattatacagcctatctttatattaacattaagcttttatccatggaaaattcaactttccccagaagatgttacttcctcacaatgttatattgatgtttaaattctagacctgaaaattttgttaataaacaatagtttatgtgctgaacagatttaagaaaaatattatggtttaatttgagtgatcagagtgtttttacctgttatttgacccagatatttaaatgtacaatcatatttacttgtaaggaatttttagaagtccactggccttttaatagtgacattgtgagtcgtcatatatagcgtcttactatttttttatcctatattcaccttatcttgtggttgaagtatcaatttaaatgaattttaacatagctgtgcgatatcccagaaacaggaatttcacctattttccagatgtgctacacatttctattgagattactgaggactggtagatcattttgggttattaaggatctagcagcatgatactttgttttttaaggcctttcctctaggaccctttacttattttagtcagtaatctagaaaaaataatttactacaaatttacatttccattagttcagataatttatgtttttagaagggtttctgtgtcatgctttattacttagtccataaataacttttgtatttaccattgccttttattctatattttagttttaataacatcaagtgagaatgaatggcctaggacaatgtgtctccagaatgaggactagattttaagagcaaggaaatttagataaataagcttgccccattgccgattttaaatactcttgcatacttaattctcaatgtgcagaattaattacacacttctagaactttgagccagttggcatttggtaaatggcacagcgtatgtgatatttcaccccagattttcgcatccattaggttgttcttttgtattttaattttgaagtattttcgtgtttaaataaagctgtatcctttaccattgcgcagaagtcatctgagcacccacagtagcccttttccctgtctcccctctgtgtgtgtggtctccatagcagtaactgattacttattgtttatgtgtttccctattcagatggatgactggtttgttaagggcaagaatgcatgtttcattttgtttcttcagcgtctaacttagtaacaagcacataggatgagctcagtatacactgaatgagcaaaggctggcctgtgtcttttcagactagttagggacagtttggtgagtcattgccatgacatatcaaaggccacagtagagttctctgagcttcaaaaaaaaagccttgtgggaaagagcaacaaaattctcctagcatataagaatttttggaaaatgtgttaactctttgtatttggatcccttttattttgtggaaaccataatatggggtcttcaactgatctgaaggagttactgcaattccttaaaataggtggcctgacctcctaatagaatctttttcattatatattttttcttttctatgttttttttgttacaatgggatgaaaagctgacttaacagacctaatgtagttttgatcaatgtgagcaagaacatctcgttaccaagcccaagtagtaacacgttgttaaaattcagaaaaggctgactttaagagcttgccatagtcaacatcagaattatgttccacggtcgtggagagaaacgtatcgtaattagcacaggccatctctgtagcccggaatattgggcaccatgtggcgactccaggcatgcttgcccccaggagctgagagccgggagccacggaaccagggagccacatctaaaaggctcactggaaagcaggtgcaggcacccaagggctgcttacgctctgctaccagcgcttcgccgttctctgacgtggatggttgctgaagacatgcctttcttgctagtaaatgtattaggaagtggcctgggaaggaaaaagttgcagcataactactttctcccttgcgtggtagtgagttagcgcgacatgttggcataactgagtcgtctgaaacactgtgagtgatatcatcgagagtgcttttttgcagttaagggaacatacattttcaaagtataacattttagactagaaggtacacttagaaattgtctactctgattagatgtggaaatgaagactgaaataagtcactgatttatccagtgtcggagagccagaatgaagtaaaatgacccagcagcttctctggctactggtttttccttttcactatgccaaactgtctcttcttgtcacattatttgaaagattagtagaagttggccataaaacttcatgactagtttctgaaaatacatcaagccatgtgcttgtgatatgtgtactttttaatttgtatattatacttcagtagaagttatcttaaaaacttcatgatttatgaaatttgacatcagacttaacagcaggggctctttatcaacacatttttaatcgtaataaaggcttaggtcttaaagttgaagtggttataaaaagatggatttcattggtgcttgtgtgttatgtgctagcatatcagacattttaaaattttttcctgcacgcattgttgacggtgttcactgtagactctgcatgataacgcctcagattgtgaaattttagcagcatctgctcaggagctgcctctacctgcgtggccatccacacctacctctatgttggaactccatggaggtcaccccacaaccctagtttctccccgtccaatgaagaaggctccagagcgatgcctctgacccagataaggctccctgctcctccaagcttgactttctagggaagggacagttcatgtagaaaatagagtgacttaagccttgaacgttgactcagagtgtgtaggcagatgtgtggacttttcagcagctaacaacacggtgccctgtggaaggtctccacgtggccttagagtggcgactgtgttctctttagtgtgtaggcagatgtgtggactttcttcagcagctaacgacagggtgccctgtcgcaggtctccacgtggccttagagtggcgactgtgttctctttagtgtgtaggcagatgtgtggactttcttcagcagctaacgacagggtgccctgttgcaggtctccacggggccttagagtggcgactgtgttctctttgctctactccttcactgccaaattccaaatgatgcagcgtttcataaagattaggtcatgtttacaaaacagtgtgagctaagtttccactgaagccttaggagattgttttttggctttgaaatgtaatattttttatagtgaacttattaaaactactactttcttccataatctcctggaatggcccaccggctttctctcttggttcattgcagctatagcaccaggctttcttgacgaaggtcttctctcttgaacggagtctactccttaaaaagttccatgggtcacctttattccactttgccatatcaagcattgtaactgctactcactttagtccccttagccaggacgcgtggggaccacggtcttacattttctcctagtaataaagttagatattactaattatgccagtgcattctgatggatcaaagcatgcaggaaaaaaaaaaaacacaaatcaaaacaaacactgataacatttaaatctgacattctaagtaagattggagaagaaaaataacaccataaatgactatctaattatttaccatgtgcctggtgtgttcacaagagatatcttaccagctccccagacagacgggcaggatggatggagaaaaggaggaagagggagagaggaaagcaggaagaaaggaagctttctttctaactttattctcccattgccacttctattattcttagcacagaggagcatttataaggcaggcgaaagctcatgaagcactgttatgtacattatttcatttccttttatgacatttatcgccgttgtaattaattcattatttgtgtaatccatgatgttctttattgttggctgtaagttccgttagggcaggagccccgtcagtcctgttcattggaaatccccagccactggcacactttctggcccagcataggtgggaaggaatatctcttagatcaatacacgctgggatttgattctcacagcaccttcctttagagtgtcatctccccgcaggaagttgttctgatcccccatattacattggcatctcattcccaagcttgcattggatcctgttttttattttgtaactgacaggacacttgtggttagttgttcaaagtctttcttccatgctagactgtgaggtcaggagggcttgactggtgtgcaatttttcactgctgcgcccctacagacttaggaactggtaaatgccctccaaacaaggagggtggaaactattattttgcccatattatagaaaaggaggttggaccctaggaagcgaatgggctgactgtaatcacatcacttgtatgaaacatactggcaccagagctgtctatacctgcaagcatgagtttcctcatcttaaagagactcaactaggcagtttctaaggtatcttgcaattctgatttttaaattgccaaataattttatttagaaggtgattttctttagcaaaatttagtaagttttatgatggcctgaagccaggggaaaggcctccagggtctcttccggggtgggatttgccacccagtggagaaccctgagcagaagagggtaagggaggccagggtaggtgtccaggatggcaagggaggccagggtaggtgtccaggatggcaagggaggccaggataggtgtccaggatggcaagggaggccagggtaggtgtccaggatggcaagggaggccagggtaggtgtccaggatggcaagggaggccagggtaggtgtccaggatggcaagggaggccagggtaggtgtccaggatggcaagggtggccaggataggtgtccaggatggcaagggtggccgtggagtagatccagcctgtgggactcattagataacctcagttatcaggagcttcttttgcatgaaaggctgtctagggatcattcagcattggacaggtcatgtcgagggatgaaaagaggttggttaatgagtacgtacatagaggtagctagaagaaataagttctagtgtttgattgcacagtagaataactattgttaagaataatttatcgtgtatttcaaagtagctaaaagagaaatgagatgctcccaactcagagaactgataaatgtttgaggtaaagaacattcttggccactcattttcagtctttattacaaactttgtttcttcagattgtcccttaaatattggcaagatatacaatttgtccaggtcccaaagctagaggagacagaacctggactccacgcaatttaaccatgctctcaaccccacattaagctccctttccaggatgccatcctcagcctctgctatgggctgaattttgccacctaaccccaaccaaaattcagatgttgaaatgctaacccccagtacctcagaatgtgaccgtatttggagataagttatttaaacaggtgattaatttaaaatgaccattagggtagggacctatccaataggactggtgtcctcatgagaagaggaagagaccccaggagtacgtgcacactgaggaaaggccatgtgaggacacagggaaaaggcagccatcaggcagccaagatgaggcttcaggagaaaccaaacctgtggcgtcttgatcttggatttccagtctgtggtgcagcaggtacagcagccctaaccagctaagcagccttcgcctcccttgtccagacctctttgttcacctgctgctcctcccgaatctcccacctttgttgatatgagctccatgtacattgttgtctttgccccaaaactgggaaatcagcctagagtcctgccctcgtcttccctacaacaccaacagtgagccctgtccttcccagagacatcagtcaaatccctgtctccctgttcatccctattatatcacctgtgatttgtaaccttgttatcttaaccggaaaaagactcccagtcagtctgtctgcagtgtagacgcttgatggcacttgtgtttgtcaatcacactttgatgggacagagtctacaccaccatccagaaggtaatcctgcccatgtattcctttgttcagatttcttcacgatgaaatctaactttgatacaacccctgcagcacaccaacaccttcatgatctgactctgctcccgcctcacatgggtcctgcctcacatggccctcacctgacaccccctctcctcccagcaccgagcccccttccccgctgtcagattccccggatttgtcagtcgtctatactttcttacatgctttccccacgttctgaagtcaccttctcctttgcccatttgtccactctagttcccgccagactttgaggtccttcgtgtgaggactttgtccttccctcttgttattctcaccacttgtttgcagtaagttcctcaagaatgttatggagtaaataaacaaacatgtcccaaaggccttagctcagtgcttctctaaaggcagcaatcttgcccccagggaacgtttccaatgtctggcgacagtttttagggggagtgcacatatctaatgggttgaggccgaggatgctgctgaacatcctccgatacacagggcaacaatgaatggtccaagctaaaaggccagtagtgccaagtttgagaaactctgccttagctccagcccttacataatcatcctcaagccaagctctctgctcccccaatctgcttgtgcctttattggagcccttaggaaattcctctttttccttttccatattcttcattagattgtgctcctggaggtcaggaacgatgaatcactcagctttgtagcttcagtgcctgcactgtggctcggtaagtaatagttgagtagaagaatggatagggaaagaaaggagtaggagaagaagctgatggcatatttcaccgctttatgttttaaacttaggtcagctctggatctgtctctgtatctggtggttctggttagaaacaaagagaggggccaagtggtgagtaaactgagaactatgtacaaaacctattgggcaggatactagtttcaaactgacagggcataactggcgtgcatgttcattttgttacacatttctatttgataatgaccagagtttacatagaaggtgggaagaataatcatgtaaagcacgtctgttcaataaaagattctttagtgatagaaatgttctttatcagtgctgttcaatacagtatccctggccacacatgtgtattgagcacttgagtgtggcctatgcacatgaagagctcagtttttaattgtatcattttaattgatattatcttaaatggtcatatgtggtcactggttaccttagtgggcaatgcatagctgaagtctgttttttggctgaccccactacacatgatagcttggcagtgttttgttaagcttactatagttcattttgaccagaggaagataacacaaaggtttaaaagaaaatgcagcggagaaacggttcatctttccaagaaaccctagtgttctgagtcacatcatgagtaaatggtggacggaaggcaggtttagctgggcagtcatcaaaaatcatgaagggcaagcaagccaggtaccacaccctcaggcactccccaaactcgttgcccatcggataaagttagtccaagtgccaactcctgccacaacaatgccttataaggactcttaaatcctgtctgacctttgaacaggttcagagtgtgctgtgttcaaatgggaaggaatataaagtaattctagaagatatccaaccggttgataaattgtagaccctaaagggggaaaaagaacatcttttgtctggaatttactttgaggggatgtgatttttgagggtaagattttcagtaggtaataaagtaaaatcccgtacctcaactaataactatttcctaaatgtctgttgctttaatcttagtgtctatagacaatggggccatacctaagagtacttttagatttaacctccaaactccatggagctcagtcttttgtataaaacagaattttttaaaaaaatgattgtattaccatcccatttctctataatgcttttgacaaaatatcctgtggtacttgatttacatttattcccttactggatatctgattgtggaaattaaaaaataggtataacatctcactctctatgtaataagacacatttaggtgaaaatgagataaacgggtgctctcactttgaaactgtaaagaaagcactaaacagcatttaagatatttaataccagtattcattattgttctcttaatgttttaatattatgaaatgttttaatattaaaattaggtggttacttaaggaaggaataattttccataacactgtcctaataaatacccctataatataaaacataaaataaatacctataacacaaaatatgaaatatacgtctagtataaaggactttttgcttgtaactacaccatcattcttccattggaattccccatagcttttcttagagtggcagtaagatcagattagaagtgtgagtaaaatattattgcaatcaattaaagcattaggctcataaattgatcaataactttttgagaacatgataggtcgtgatttcattttgttgaagaaaaatgtgatagctaagatgaaaagacatgtttatttttgtgtcaggtgttctgtgattagttaattaaatattttcatcagttccggtgacctcttgtctctcagctgcatattgactttcccaactgtgccttccatccttctggctgcagtaagagaaaccagattttcctcagcccctccaggctctttcttatctaactcaggagcgcctcctgccagcggggctgggcaaagaacagacccagaggtctccatttttgtaaaaaggttcatggcaggtcggttatttttcagtatattttttaaaggcgtggttgagctaatttaatttcttctgttcattaatttctctcctttcacctccaccccctctgaataaacggcccttcacacgagtccagtgtagcttcaatacaccttattcacactgccttttattgcagctgcattccagccagctggaggtggcctggctgcctcagctttcccgatttagctctggaaatgacttcagcatggcaaaaacgtttcactggccaatttggaaaacaggattcaatttgtgaagaaagctcaaaatggcaactgagaatgaaaaagaggatggagaaggttgcggcagcaaagcagtaagggaacagagatgggccgggtgcagtggctcacacctgtaatcccagcactttgggaggcaggcggatcacctaatgtcaggagttcgagaccagcctggccaacatggtgaaaccctgtctctactaaaaatacaagttagctgggcatggtggtgggcacctgtgatcccagctactcaggaggcagaggcaggagaatggcttgaacccgggaggtggaggtttcagtgagctgacatcgcgccactgcactccagcctgggtgacagagtcagactccgtctcaaaaaaaaaaaaaaaaaagaaaacaaaaaaccagagatgagaaactgttgttctctgctcatgctccttccttcttcccagctgggcccccatttccactctcttaaattgaggtcaggtgggaaggaggtggatggggaagctgcagccgaaagccagttctttgccttgcactttcgttgccctctttgggacttctcttcctggccctggcttaattacgggactgatataaacaaggagctagtgtggaactctgcacaggccgctggagaggaccaggcagcagttgccaggactgggttctgtgcagcggtcttatctgggagcagccataagaagggaaactgcagctgcaagtcagaatgcgtgtccagtcacagtaggccaaggcattggctgttccattgacacagctaggggtaaaaagtggtaacaccttcttttttgcaaacactgtgaacctaaagccaccctgataaatttgtgtctgtctgttagatccaatagttaatttttaagtaattcatatagggagttaaaagcttaattaaggctgggtgtggtggctcatgcctgtaatctcagcactttgggagccaaggcaagtagatcacctgaggtcaggagtttgagaccagcctgaccaatgtggtgaaaccccatttctactaaaaatacaaaaattagccaggcatggtggtgtgcacctgtaatcctgctactcaggatgctgaggtgggagaatcacttgaacctgggtagtggaggttgcagtgagccaagatcataccactgcactccaccctgggcaacagagcgagattccatctaaaaagaaaaaagcttaattaaaagtggatttatggtagtgggttttggtaacagatttgttactgaaatgcattacagacaggcagattccagattcccaaggctgatggatttcaagtctagggaagacatatttctaggtaaaagctgtatgtgtattgtggctttctctttggatatatatttcagtctcccccgagagaaaagaaatgtcatatttaagtaggaacatactttaataataggtgctacttacatctctactatgttgtttctgttatgtgggatttgtggtataaaaataagcaagtatattatttatagtttttttcttaagagaacactaaattttgaataatttcaaaagcctatgctaccttcagaagttaagcatggatcctaacaatttatatggcgtaactactgaatgtttacagtcgatgggatttgtggagttctgtggcctccttggcaatttcagcatgtggaagaggtgttgatattgtcatatgacctcagccctggatcctcatctgtcttctagctcagtggttatcaaacttctagtgtgcataggaatgacctggtagtcttgttaaaacactgattttggtcttcactcccagaggtctcatttagtagatctgggtgggacccacgaatgtgcatttttaacaagttccctggagatactgatgctgctactcttgctcccacattttaagaatgactgccctagcggttcgtcctcttcttgacctaacactaaggaagtggtaaccaagttttaaaaattagcctctcttgttaaattaggagatcaagtacttaatactaagtggcagtttcttttaaataacttggaaatttttgaatcctccaggactgcccctgttttccaaattagcataatctactctggaagttcagggattaggctagaatatgaatgggctgggctcttgttctgacacagccattcatagcaccagcttatttcttatcccagcacattaaactcctcttctctggccactagctgtatagtaggttggatttggacagcacagtatgcccatttagacatgaatttatttctcagcccttctgaagacagcagtagtgaggatttgatttgatataatgacactgaaaatggaaaggaaaggatgagtgaaaacaacctgtagaaatggaaaccacgtggtttgactaatgcctgtgtgggggaggcacaggaaaggaacgaatcaaagatggctttatgtatcagaccaggagaatagatggcaataccagtaaaaatcaggagttggctttgtgaaagaaaataaggttgatttttaaaatataagcccatacatttgtaattggttgattttcaacaatggtacccagacaaatcagtggggaaggaacgtcacaaaaattaactcaaaatggatcctagctggaaatgtaagtgctaaaattgaggcatcaactgttcacattgacacggctggggtaaaaaatagtaacactttcttttgaaaacaccattgaaccttaatccaccctgctaaatttgtgtctgttatttttaagtaattcatatgaagtgttaaaagcttaattaaaagtggatttattgtgggctttggtaaaaggtacattacaggcagattccagatttccaaggctgattgattgaaaacacaggtgagagatactcttcttgaactttaattagacatagccttcttagatatataacacctaaagcacaagcaacaatggaaaaaatagataaaatggactccatcaaagttaaaaactgttctgatagcacaccatcaaaaaagtaaaaaagcagcctaccaaatgggagaaaacatttgcaagtcatatatctgataaggggccagtatccagaatatataaagaactcttacaactcaagaataagaagacagcctaattaaaaataggcacaagacttaaatagacatttccccacagaaaatattcagccgacatgaaaggacatgcacgtgaaaagatgtgccgcaccattagtcattaaggaaatgccgctcaaaaccacagggaaataccacttcacccccactagactggctgtgataaaaaagacagactgtaacaagtattggcgatgacgtggagatgttggaaccctcgtgcattgataatgtaagacagcttagccactttgtaaagcagtttgacagtttctcggtgttcaagaaaggcacatatttaagataaatgaaaacatacttccacatgaaaacttgcacagggatcctagtggcagcattattcacaatagccaaaaagtggaacttttggtagaatgatgtccattaattcataaatggataaataaaatgtaattcatccataatacgtcatattattcaaccataaaaagcactaatggacactgcaatgtggatgaacctggaaaacattatgctaagtaaaagaagatagacccaaaaggcaacatattatatgattccatttatatgaaatgtccagaacacaagaatccatagacactgaaagtacactgtagttgccgtgggctaggtaccagaaatggggaacgactgctaatgggtacagtgtttctttttgggtgatgaagtattctaaacttagatcgtggtaatggttgtgtgactccctgagtatactaaaatcaatctgtttgtatgtgaattatatatcaatgaagatttttttaagtagtaaaaatcttaagaaaccaagaataaatgccagggtaaaatccagtggacgtttggaacttgggagagaggtctgtgccagagggaaacgtgaagttccttgcatggaagagtagtcgaagccgtggaagtgaaccaactgtccagggagaatgtggagggagggagagcagtgaagttgttggaatgcagaacctgggagcacggctctttttttaaggaccaagaagaaggtagaagaatgattgagagataaggaagaaaccaggatggcacagaataacgaaagtgaaggaagagaggcaggtttacagaatgggcagtcacaaagggaaatgctatggaatgactcaacgagccactgagtttgatgtttgggaggtcgctgtttttcatatagatccagtggaggtggaagccacatacaaagttttaatgagtgtgtggagaatgagtgaaggcttaaggaaagtagcatagtcagccctttgtttttacacgttccgcatccatggattctacaataaaaaataacaatacagcaaaatatatacatatatatttttaaatactgaccaggtgcagtggttcatacctataatcccagccctcctttgggaggcctagttgggagtacccaaggccatgggggcccacctcttgcattagtgtgaccttgatgtgagacatgacgtcaaaggagattattttggaacattaaggcttaatgaccacccagctgatttcagacttgaatgggacctgtgtcccctttgttttggccaatttctcccatttagaatgggaacatttacccaatgcctgtaccctcattgcatcttggcagtaactaacttgctttagattttgcaggcttctaggcagaagggacttgccttgtctcatatgagactttggacttggacttttgggttaatgctggaatgaattaagactttgggggattgttgggaaggcatgattggttctgaaatgtgaaagggacctgagatttgggagagaccaggggcagaatgatatggttaggctttgtgttcccacccaaatctcatcttgaattataatccccataatcccctcgtgtaagagagagaccaggtggaggtaactggatgatgggggtcgtttcccccatggtgttctttcgatagtgagtgagttctcacgagatctgatggttttataagtgtctggtcattcctctggcattgtccttcctgccgccttatgaagaaggtgccttgcttccccttcaccttccaccatgattataagtttcctgaggcctccccagccttgctgaactgtgagttgattaaacctctttccattataaattacccagtcttagtaattatagcagtgtgaaaacatactaatatggggaggatagcttgagcccaggagtttgagaccagcctgggcaacacagcaagaccctcatctcttcaaaaaaaaaaaaaaaataataataataataaaaaaatagccaggaatggtggcacatccctgtagtctcaggtacttggtgggctgaggtgggaggatcattttagcccaggcggtcaaggctgcagacagccatgattgcaccgttacactccaggctaggccacagagcctctgtctcaaaacaaaacaaaacaaaacaaaaaaacctaaaaactaaaaatacagtgcaactatttatataacatctacattgtatttagtattatgggtaatctagagatgatttaaggtatataggagaatgcatgtaggttatatgcaattactataccatttcacataagggagttgagcatccttggatttttgtatctgcaggaggtcctggaaccgatcctctgtaaatactgaagaatacctgtatggagtagtttttaagtaatttgggaggaagaagaaaataaattgctgagggttgaagaaaggttttgtttttgctaatgacaatgacattgtttagaagagcaaatcttaagatttaaaggcagaaggaaaggaaccggtagagaaggatgattgataatgaaggcagagcagaagaaaattcataacagaataaaactctggatccagttattataaacacgtggtacctcattctcaccttcatagctctttcttcctgttttggaggtagccgaacataaatatgttcggtgtaaatttggggtttttttacttaatcaaaaatatacctagaaacgttgataacttgcagttttgtaaagtgtttccaaatctatggccttctaacacctggagtctttgtaagatccctcctggtaccctgagctcagaagccagcactgccttttaccagctttggcaaaattttgtaaacctctccaagtatgcgttgtcatctctaaagtggtaatgatatctacttgcaaggtttttattaagattatcaaaaaggtattattgaataatatatatagctgctaagtggtaaagaacagggccctacaacagactttcatgggtttgaatccaagacaagttgcttaccctctctacatgtctgttttctcatctgtgaaatggatctgatagaagtatttatgtcatgtggtggtgaagatgaataaatgagaacatctgtataagtgcagagcctggcacatctgtaagtttgctcagcaattgaaagtagtagcagcagttgccaccacttttactactcagagtaaaaatgctaagagcaaataagaaaaaatctgccaattgttagtgagagctaaccaataagaatgagttctactaatttaatcatttttcaaattaaagcctggagctgctggaaaaaaagtttaatatttgctgaaagagtcaaatctaattcttattataataaccagacattattacctctgacacagaaactttagtgtttgttccctgagtcactggtgttgataaatataagataaatattgtttttattcttgatttaaaaaaatcagtgtaattattaaaattaaataagtaaggtggtcattgttccttacaaaactgctcagtaagatacacttacagtctattttttattgagaatgctattagtaattctagtagtctattttttattgagaatgctgctaataaagtaactattagatttataggcccctgtaaatgaaatgtcttaataatataaaatctacttgcattcacaacaactgggtctctaatttatgttttatttccatctatgatatgtgacattttttgatttatcacagaataaaatttgtgtcatttctggtcattctcattttttattgatatttagttgttagagtaaaattccgacagaattacacaactgagaaagaatgatttgataggtcctaaaagtatatgcccagtggatttctaatggagattgaacttgatggaagtatgctaagttcttcaagttggaaattaatgttatattttaagaggacattcttggcattgcttttaccttttgggaggacgggaggaggaaaatcataacttttcttcttttctcagacaaatgaccaagcaggaaattttttatgaattacagaaacattcagattgaatagcatgctgtgattcccggctcagtcactttactttaccctgcccttcacgtttctacagacagcagtaatcagagcggtctgggaaccactcagtctgtgtcagtgcagcctggtgagttcagaagactcctttgttttgagctgtggaacaagaggaaagggtaaaattggcccctctgcctgcggctggatgcagcatggtatcccaggccagcctgccactgcagtagtttaaacaaggtttgtggtcttcacgttccataccagaggaggagcgatgtcccgtagggaatagcaagtagatggtaacatcagacacttaaacgtgggaagcgggcagcccacagactgacaaggtggactctgccctctaatacttaggcaacctcggagaccaaggaacagtcacgaccttgtcacgtcactttccactgtgatctttataaactaaagcatagtgtcttagcactatgaaaacacttcgttctttgcctttgtagtctccagccaatgtcggtttagatatatccctcccatggtttctcctactcttccttggtgtgagaaagtgaaataaagttcagattaaacatttcacttcttcactggtatttgtggcacattaatttgatatatgataaagataaacaagcagaaccagagagtaagggggagaatccacttattctaagatagcttttctttttcaacttcaaaatgagaaataattatatttatctctgtaacatggagataactaggctgtaaattaatttccatgcaggcttttctaataaattacagagttttactcttttccagaatcaggagtccaaaatggcatctctgggtcaagtgctctgagacttctgaccttgtttctccataacgagggctttatccccttaaattcataaattacttaaaacatccttttaacatctcagaggagaggtgccagattgcttaaatatctcctgttttatcagagtgctacattcatttttcactcatttcaatgtagtttcctcctatagttaaatcaccatttcaaaatttaacattgagttagggagcgtatagataaatgatagaactttgtgactgaaatagataaatcttgggccactgccagtagataaataatgtctattcaagcattttagaagtgatcagctatgaggtcgcgcagctcagggcaccgtagcctaatgcactttttaatgagtaaatcattgctaactggtgtgctcataatttaactcctttttaaatatactgcccatgggttttgcccctaaaatgcaagtgaggtaccctaagggccagaagaggactgggaacatttacaaatgagcatgacactaatgtgaaccaatggattatttgcattccactgcttcagttatcacttaatggctgcaggctctgatggcaggcctgtggactgtgttatgttagcctcaaaaataaatgctaatatctgcgaagttttcacattccccaccatatttggtcaattgtgctagcttagccccttaagggctgccaagagtcttgttggcaaaaatgccactttggtgaagacatagctgaccaccagtcctatttgtagactttccctggttaacgctacatcatttcctccccttagaactctgggatttgtgctttttattaagtgtgatcatttgagttaaatataaattgccctcttatatcatattttcctttgttggcagtgttttggtctttggataattctcccaagggaagttctcaactgtataagtttaatgaatggttgtattgatctgcttttcacatagatatttgattgggtacttgggaccatttggtagaaaagtaagatatatggggagaaaggaaatgactatttcaggttcctatatgtggtttaattgtggctccttttccttacattgaggctctcgctctgattgtaattacattaaatcaaaatctttactagttaaaaattgtataataaatattatatagatggccatgttctgtccatctattctaaatgaactgggattaaaactaggtaataaattttgtaatgattgggaaatgcctagttttgattaaataaatgtgtaataatgtgtttgagtttatgccctttatttggttaatactgaaacaaagtatatggggtcaaaattccttttagatatatttaaatgttaaaatttaaatattcatgttttaatggtgaagctttttcattgcttggctcagcacacaaaataatttgtacatttttaagtaggaggaaatgtctttcagtacgaggggagctgacttgtagtgctgtgtctgctccttaaatatgtatgtgtgtgaaaattagacttacctagatttttttcagcaaaacagggttttagagtgagctcatgtatctgagagtatttctagcttttaaaatctatgattttataatatatgtggaaggttctttttattcaaattgtctttaaggtatttaatttgtttaatttttaaaaatccattaatcaatgtataaaaaagataaatggacaattgtgatttccataaaattattattatcattttattttattttttttgagatggagtctcgctttgtcattaggctggagtgcagtggcacgatcttggctcactgcagcctccgcctcctagggttaagcaattctcctgcctcagcctcccgagtagctgggattgtaggcgtgcctcaccacacccagctaatttttgtatttttagtagagatggggtttcactaagttggccaggatggtctggatctcttgacctcgtgattcttctgcctcagcctcccaaagtgctgggattgccaccgcacccggcccataaaattatatttttaaagaaatcaaagtcctacttatatatttgtttttaatgccacaaattgtacatatgcaaaaagagtaatccttttctctaggaaatggctcatgctagtactgccagcatacctaccatgatatgagttcctatgaggaaccaagctagattacatacacagtttcttctaatcctcacaacaatcactcgtgatagagatttgttctgttttaccaaaggaaaaacctggagctaagcctaaaagttataaagaccggggaattctgaacttggataacccatgagttttctattatgtcatgttgccttatccttataaatccattagataatgacttcaagacaatatgatgtggaatttaaatatcctgtctgtggccacattagtgcttattagataatcagcagtaataattgtgtttggatccttttgctcactgaccctctgctagacactgcttatgacgttgagttcttaagattggatttttttcttttttctttcttaactccctatgcaaagtccttcgttaattatttctctctcttctgtttaattgattctgtgtcatgattattctaattgcaaaatatggaatcttgtaattaacttgtcatactattctaagagcacctctcattacactttggtttatttcattctagccatttattcatatttgagtgtatacagttgtacttatgtacacacacgcatatatccttgtgcatgctcaactaaactgggaattttaaccaatatttgcatttctaagcaatattatatatccattttaaaaagccaattaaatagctctttggtgcagtacactgagagtattgtatgtcagttttctctgcctccagctctgagggaccaagggctatgaagaattctcagaccccagatgcctgctaaatatgcttaatttagacagcataaactgtatgttccagtttgaaaataccacaccatgttttttaagcccatgccttccttcattgatttagaaaagaagttctaaaaataaaatactcaccagaaataaacctacttacatgtgtatttaaaaataatcacttagattatcttttgtggaccaagaattggtgacataggaccttgtcttggaaaaactctgtgagttttactgtagcttgtgagactttgaatcttactgctgtctgtggttctggaaggttttgtctgcctccttctaatggtaattcttaccagatctctcgctgactgttggtcatcttgccagatcttgagtgatgtcttttgcttcatcctgctgtgcatcttgcaggaaagtagatgctcttggtcatttgagtaatccgaatcttgttatttccagtcaactcagttggatttctgggatgagaattagaggagtcccattgaaaaactggaatgagagatgagaagtttgctgaaaacagaacatttttttgtgtgtggattgatttgcctcgtatacctgccttgtactttaaccacatctttgcagtttaaaatagaacacattatttcttcagattcacttattttgactacatcagtaatgctcttacaaggctgcatgacagatttatggtgacatgctttaggcagttcaaaatccttaaacctatattcagctccttttttcctagaaagtaagtcatcttaattttcaatctttctttctttttaatcttttaatgattttttgggggagaggaatcttgtaagttagattcttcaagcttggctacaaatgggttaaaatatagtgtgaaatattatactttctcctatttgattttgtctgctcatttgtttctcccatgttctcagtatacattccaagtttattgtctgtatcacttgttccatttctgcaggaaaggctgcttttctaattgtgtttggtcttttaaatttatcggtgcccccacttccctcctgcctgtttttaaattaatagttgaatgtcttttttactgatgatagaaaaatacctttttctaacattttctcttcatctcagaaacgcagtgctggaatgatcttacttttggtgcagtctattatttttaagatactaggattttcttcttttgtttctttatcctggatttctactttaatatttcatcaacaattcatacccttctttctagtttaatttttctactaagtacctgtctatctagtagtgatattcatttcagtgattacctaaatacaggtggagatattataatgggtaggcagtgtttgacatttccagctggccattgttggaacataaggccattgtttctgctgctgaagttatctttgtttctaaagagttttgaagtatattaatggaggttagttagaattaggaaaatattagggtcaactatattgctcgtctgctttcacagtgaaaggtagcatggaagtgtatacttgctggttaccctggcagaaataccaactctagcagctatttggatgttaaccacaatggctaggaaccaaagcagtaaacttacagtgttagggaaaggaagagtgctcagcagtgttgagttaaacaagagtagtaagccctcaacgtagctcacttacatttttaaaaatttctttgtcgttgttgttttagagacaaaatcttgctgtgtcacccaggctggagttcagtggcacgatcagggcctcctcaccctcaaatgcctgggctcaagaagtccttccacctcaacctcctgagtagctggggcaacaaacgtgcaccaccacacctggtgatttttttttttttttttttttttttgtggaaatgaggtctcgtttcattgttcaggctggtcttaaactcctggcttcaagcagtcctcccatctcagcctcccaaagtgctgggattacaggtgtgagccactgtgcccagcctaaaaatttttataacagtaaaatacttttgtgactttaccttcctcttctttttatttttactgtgtgcctttctactcctgtaatagaaactctatttaagaaatattcatcatcatttatcattattcattcttctcccaaatcaactcagatatacgttgaataataaaatcagtttattgtctctcctatcatctttgttaatttcccttaacatctcatatgtaagacgaggtcatgtgttcttgcagtgtaggtcgtgcctcttatacccttaaatacagtatcagggttcaaaaatgttatcatcctagaaaggctgtactatctctgaggtctcatacacgatatcgagatcagatctcactatatgtgaggaaagtttttagagatgctttagaaatacaacagatgtctgagttggttaatctgaaaagagtcagtggattattctgttagcatgattaccacccagtactacagatttcaatactgctttaacacagaggagtaaaaatcagaaaatctatagtgaaaggcacttctctctatctcaatattctttaaaaaaaaaaaaacctttggtaacataataagaaataagaataggtttctgtcttcaagaaatatttagtttttagcttaacataaaaatgcctatattggcttataattctgttttatttagtataaaagtgcccatattggctcattggcccataggggctctgaagtcacttgaagtttactcacccagcaagcttgactccttagcaggtgaatattcaccctatgcgaggggtgcatttatttcaaaggtttctgagaatgctgataaattccaccacctttcttagtagcgtatttaatgttttttcttcttgtgctcaagtcctcctcacttgtatgtaaatattttgctgtattttatacccaattttaatttttacttaattttaattttgtttaaatagaaaataaccagataattactttattttccatgtctgtaatgaaatttgggaaataattcttgaattcttctttttaatctttatcgcaactttgtataatcatttatttagcaactatttgaaaaataccagccattaggtgaaactgttttttcactctggggatggacaacaggatgaatacagcagagcctctgccttcactgggcccactgtgtaacaaagaaacatgcttgcagaaaccaagtataatcaccagtggtgaggctgatgatagctcagggcccaggtatatttagaaaaggctggggctctttcaaaccctgctttctgtcatttgcttttttcagtatgtatctgctgggaaaatcttcacccttttagagtcttttaaatgatattcttaagtgttattttctgtatatccaatcacttactgtactatatactatagaaaatacactctattcatttatacttcatatttatatttactgataattaatatttttaggtattaaataattgctgtcaggtattaacatgtacatttgcattttgcacctcacacttctgtaaatgttactttcttttttccacacaagcagattcccgcatggccagcagaagtgtctgagcctgccccaccggaatgaatgtcgcatgtctgtgatgtcacatgtctgtgtctgtacactttgggcacatccgtagagccaagaatccccctttggttgtcagcatttctgagggctaacatctcctagaatcttttggaagacccatagttgtaaaactggaaggatgtctttggggaatattttcacatcgattgttttgcctggataacttttttttttttttttttttttttgagatggattctcgctctgtcacccaggctggagtgcagtggtgcaatctcggctcactgcaagctccgcctcccaggttcatgccgttctcctgcctcagcctcccaagtagctgggactacaggtgcccgccaccacgcctggctaattttttgtgtatttttagtagagacggggtttcaccatgttagccaggatggtctcgatctcctgacttcgtgatctgcccacctcggcctcccagagtgctgggatgacaggcgtgagccaccgcgcccagcaggacttcttaaagaatgacatttctacatacagttatatgttacatctcctcataccaaggatgtagccaatcaaatggccaagagggctgaagagagcacataggtgtggctaacctctaaatcttaaaagtttgcttcaaatagcaaaaatattttgcttttagatcatataatttgtataattttactttccaaatgaagcatctctcagaaaatgtgaaattccactgacccccatatcctgggatgtacatatttaagatcccttgtgccaggtggccagagaaacaacgcagctgccaaccttttcattctttaaatgtctcttcagtgtattacaaataacctgtattggacctgtctttttttttttttttttttttttaatttttgagatggggtctcactctgtcatccaggatggaatacagtggtgcagtcatagctcactgcagcctcaaattcctgggctcaagtgatcctccctcctcaacttcccgagttgttgggactaaagggacacaccgtcacgcctggctaatttttattttttgtagacataggatcttgctatgttgcccaggctggtctcgaactcctttcctcaagcaatcctcccaccttggcctctcaaagtactgagattacagaggtgagccaccatgctctgctggatgtatcttaattgtaaatttttcctccaaaatgcactttttaatggatatctaaggtctgaagaggaaaatggaagacttgacagaagaaggtgtaccttcaatccttccctttttttggcctcttttatattttccaccagtggttcaactgaacatctgggaatcaacagcacaccgagacttctgtgcctctggctgttagatggaagaaatgttatgtgaattcattcccttccatcaccgggtgggacgtggtggtcagccccagcaggcagatttccaaggtgacactgaggagggaaaaaagtcttaccctgctgtccaccagcatgtcagagaccagagccagaacttctgagagcaccacagttccaaaacaaaggagatacaggatgtcagatcacactggtgtttcagccataactgttctcagggcattttttaacaatgtggtcactttctcctggtttgtccactgtaggaaggggtaaagatgatcagagaacctctttacataggagaattaattgtcttattttttactagaaatcaaaaaggaaggaaacattttattttatggtatattccaaataaaagttcgttgaactaacaaacagaaatgtcccacatctagcatttatattgtatttatatttatattgagtttccagaaggctttcctatgaataacctcctttcatcagttgtcacaatagcacaagttagtattgttattaccatttgaagtgagggagataaagatcccagaagttcaggaattgtctaagagctaggcatgaaccctcgtctttctactcaaacctcctctcttttctaccagccaaagagcacagcctcctgacaacctgggcataagtttagttctttaacaaatcaccacatttattttcagagcctagttattatatcgtaaggattacatccttaggttaaagaatgtataaatcaataaattatctcttttatgtttcacttcaaacacgtctttttttctcatcaccttcagctcccgagcatagcagaaaacatagttagaaagtgtcctttccggtataacagaattttttttttttgagacagagtttcgctcttgttgcccaggttggagtgcagtggtgcgatctcggctcactgcaacctctgcctgccgggttcaagcgagtctcctgcctcagtctccctagtagctgggattacaggtgccaaccaccacacccagccaatttttttaacataattttttaaaatgaagatatagtagaagactgcattatttatgctcacattttttttcttttcttttcttttttttttttgagatagtgctctctcgttgcccaggctggagtgcaatggcacgatctcggctcaccgcaacctctgccttctgggttcaagggattcttctgccccagagtagctgggattacagccatgtgccaccatgcctggctaattttgtatttttagtagaaacggggtttctccatgttcgtcaggctggtctcaaactcgtgacctcaggtgttgcgctgccctcagcctcccaaagtgctgggattacgggtgtgagccaccacacccagctatgctcacatatttttaaacatgtgattaacaatgtgctattattattttgagtaaatttaatatatgacaatagaaattgtgaaaatatttggcagtattacaaggataaaaacccattgaaaacatcttgacatacaagatagtgactttaagaatagtgataagaatattaaaatctggcaatttcttaagattttgaatctaccaatataattctgatgtttaaaggttttgagacagtaatatatagtgctgtgggttttatttgtgtgtcggcgggggagtgtgctacaatttttctgtaatacatcttgtggcacttatacatgtttgaaattttttttaaattctaacattcagagagtttgttgatacatatctttccagtccgtgtgtgtgtgtgtgtgtgtgtgtgtgtgtgtgtaaatacaaaaaaagacttcaatataaaatgtatttggttaaatcagagttattcaaatatgtgaatatctcaaatcagagatattcaaatattataaacatcaaaattgaggttctcttaatttaaatttattaacttcaaaggacttgtttgaatagaactctattggatattattctttttattttgaattttatatacccaagaataggtaacccaaatagggggcagtcccatgttttccaaatgagaagaaacaaaaaaatattctaagccaactgaatatttaaacttttaagaatgtggacaaaatagtcaagtgactttaaatgtttaatttactgaatagctacgcatacatttgtaaaataacattaaaatatttccaaacattggggttttttcttctcgcattttgaaaaacaattttattcagtatcctttaacacatcctcatcatctgtgtctttattactacgagacactttttggtcatctgttttctagagcacattttcacacagggctttcacatccattgctagtgctgccaaagggaagtccatcccaagccatgagtcttcagcgcatatatgaggacttgtgctgatgtatattatatatacgtattttatatatacacatgtatattaaatattgtcatgcttcccctagcttcctaatgtattgcttttttaaagggttactgacatataactcttataagagcatactcaggataacgacagctacatttttatctcttgttttgaagagattgtcgtgtgtgacccttgaagcatggaaactaggattaattaatgttatttcaaactatcatgtcctctctctccaccactccaacgtagtacttagttcttcaaaataatataattgagaaattgccccataatacatgggattttgatagtacttgagtataaggggaccaactctctttttactaaggagtattagggaggaaaaatggaaagtgtaaaccacaacttaaatgttcacttctccaccgttttttctatactatctgttgattttcacatttctttctaccagcctaacatttctttcattaaacttttctatataatcaaaataacaaacttgaaactccatcaagccacagtgaaaaactaaaagtgaagtcaagaacagagtgactcctagcaccggaggccaagtggccgtgcagtccccgtggggtggcacgcctccaagcaggtcgtctctggaggccggtgccctgttcgaggcagtggtcacccttcctcccactggtccgtctgcctcctgcaagctgtaattacaccacggccctaatacagctgtggcctttggggaacacaaaggcacaatcgattgattgtttcatgtgaataaagcgagtgtgtggtataagaggatttgatgagttgtggtgggtttctggtgctttggtagaggttggcacttgtcttttcttaggaaattgtggccccatccaaacagggtagggtgttgtgttttcctgctgtcaccagcttctcctcttgattaagcttgtctttcaccaagctggcgttactgaagtacttgaaatcacagataaagaggatctttactgcttaaaaatttagtgcactgatatggtatttgggtctcagctttttacatagcaaaatcttcattttcctgtctttttcagtccttcagtcttagtgctagtttcttcagtgctgcctgaatattgtggacaataataaaattaccaagtatgtcagctggcatttcatttctcagtgtctaagcttgttgtgtgccctgtttccagggaaaaagtggccccaatataggcatccttctgggaagctgttgctcaaaattccattcccttattgcacagtttagttgtggcattgcactcttcttccaaaggtggggcaggatggttggcgatggaattaaggatgtggatgtggatccagcccaagtgaaaattttctgaaggagaagcggtgggaggaggtcaaatgcaaacaccgtctgacaggcagcaatgttgcaatgcataatcataatctttaggactggtatagataacccttttctcttcaaagcattttgctaacatttagttcgttaattctaccaacagccctgtagggagataagtttttattataatagcttcacgttgcctttaaagaactgggcgacttgccgaatgccacctgggctgtccctcactgtctaggtgtctctatctttcctgtgaaacagttcacgcagactgacgaaagagtggggatttcagcggttcccagaaacctgtgtgatacaggaatctactgccacttgttgctctagaaaataccatgcctcctgctcctgcagccctgtggctgcttacaacagcaaggcgcagagactgaaaacttgtaaacagctgtcgggggctgggggcgggcagagtgtaacagaataggctgccaaattcctgactgccatatgtgctgtgtaatacttgtcatctcaagtgagtcattaaaaggtttccccttaatggggctttgaagtgctgggacagcttgagcgcatctataaattgccacaaacagccctctgaccgagttagctaattgcttgctctttgacttattaggatcaactgagttaaataatttgtcacatgtgtggctcgtaataaataatgtgactagccagtttgtgggctgtttcagtgatatattgtaccccttttggacgttgtcacaagtagctggcaaatgtgggctattttatccataggactatcatatccctgcaaaaagagttagttctgacagagcgattggggaaaaaatgctaaaaggagtctagttactaacaaatgtgttcagttcttcaacctttccataaagcataactatcatttttcttggctattgggcacatacatcagacatcatgcaagtcataggcaaaagaatagaaattataagtactgaattattctagttcatatagactgaattattacagttaaaatattatctgttccctttgtgaaaacaagcaatccctgctagccagcccggtggatgtgctcggcccagctacgctcagcactgcattccggccagtgtttgtgctgtgggctgtgccaagggcattgttgtctactgccagaagacagggagggtgacaactgggatagagaggaccatggatgagggaaagattaatttgaaagaggggatctgagaaagtaattgtccagtaatagggaaaggaggatgctttgctagccagaagttagaattaagtgcttctcttgcctaataaataatctgttgactgtaggtgctcacagcgtctcacagaaagaggatagtgccagcacatctgggctggctggctttgatagcagtatcttcgtcctcattcacaaaagagaaaagaaaagaaggcaagtaacttgccgtgctgttaatgtgaactatgctcttgtagaaagtattattatgtgagtaacaggaaaataattgagccgtttgtaactgtttttaaaaaatccttacaagaatacatcataattggctttccttactattcacaacagcagcttaggacagaattttgtcgtatttagcatggaacaagtatcaagtatgtttaaaacaaggatcattacgtttttctattataaaattggtagatgaacccttttattatttcatgaaaaaaagtaatttctgtaacaaagaaggatagaaaaattccagtttaccaaaggttgctttcaactcctcatgtcagggaacatcatttattgttatttatttgattgtgttccctgaagtactcaattgaaataataatggccttaactcatatttttacagcaatttttaaaattaaaatattacattctctgtagacgtcatttcaaaattaatgttctttcactatttaatgacctactctttttctttccttaaacgtatttacgtaggtttttaatatatctctatgcttgcacattatcactgagacaacaggcaataaaaatgccagaacgtctcaaacagtgaggccgagaagtcacaaacaggtcccagctggagggtcccccagcttgttctcccctcccctttctggccagccccttttaacccttggtactcgttaactctccttgtggatgttcagagtaattagacagtggtttaagtgtgtgtgtgtgtgtgtgtgtgtgtgtgctgggggatagtgatatggatgggtggatgcagtttggaaaggagaggcatttctctctaattagcggaagccacccaaacctcgatttgtttcatatgcaaaatagtaaatgtctgcagcagacccagacacctatctggcatttggaacaggtgacattattagttccctgggccctgtttgtgtttacttttgttcacataagttaattagctggttttaaaaaagtatcatttctgccttctgaagaaataaaactttactctcttaatatggcttaatttaatagtgtgtgttttgcatttgttttggatattatttctaagtgacatcttaaacttcataggtgtgtcttgggcgtaacaaaagtaattattctattaaaaagagtacgtataaggaagagtatatttaaagatatttatctcaagataactagcactgaactaagtagctccttcccttaaaagacaaaatgtgctgagactgtactcacacagccagtctgaggcatccgaaatcacaagcaaagagcctctctggtgatgtggctcggactgttttgcagctgtgcttggtgtgcgggtgtgtaggtgtttgtggggctggggtgggggaggaagattgacattgtggcttgattggcacaggcatatatcatgcttctaagggttgggcgtatcttcgttgctgaaagtacaagctggatgaagtgctcatccttagctcttctggaagagctcatagaatggatctcctagtttcttactcagtgtccagtgacatagctgtcaccaccaagtgcacttctctgtacaaacctgccgtattgatcatggggtgtcatccagcactgaggagcaaggagggacagaaagaggaaaatgacattaaagggccactgaattaaagccttcaactcaagtgccagagacaccgtgctggcagacgccagccctgtgtggctcttgtcctggcatggtcttcctatctgcccaggaaggcaggccccaggcacaacctgtgagagaacaggcactgcctacttggggagaatggacagcagacagtcgtggtctgagccgtctcagctgtacccaccctgcggcagaaggacccctccaggcatgcagggctgtttggctgccctctcctgtccagagtgtgtggaaaaatatgccaagaaattagtctccctgcttttgtaacagtagcacatccaggaggaagagccagggatcagtgggtcctccacagagtgtgaaggggacgccatccactaaatgttccttttccgcactgtggtcccaaacactgggttctgtgccgatttcttttttattttttaacagtaaaagtttctttctgcctgtgtttttgctacttactttcctcccttgctgagaagcagaagtaaaatggtcgcaggtttttcattatttctaaccattgtcagaaactgcctgaatatctgaaggctgtggttcttatgcagatcaacagttccaaatacctgaataccagacattgaccaggagctagaccttgacagcccttcagctcctgccacaagtgagtctgaagtaattgctgttgaaagaatgaccccatgccaccctcttctttgctgtctaaaccctcaatcggcctcaaattagatcaccatagagaaacatacctgggccacagatggatcacctcctcctctcattgtggcctgcctgtgacttacgcccttgatttttatttaggaacgctattaaaaaaataggaacaaagaaaggaacaatctacgactttgaaaaccttcccacttgtgttcatcagtatccatgtatgagaccttatgtacctagtgccagagaaaagcattacctaaagaactagtatttttcttttatacaagcagcgtgagctatctcccccagtagagccttttcctgctgcagttgcctcatcttctcagagagtgacaagatggtgctcataagctttaaccatgctatgcaaagctctggggcatttccccactgtcacggatggtttcatatccctattttaatatttcttttgcactttattatttcacttgtacgtgttcacattgtaagaacatattaaatcatttttagaaggagagtagatacaaattatgagtaattcattaaaataaatattttaaacatattcataattttctgatttcaaataatgtacaaataatgccttataagattctaagttatagaactacttgatctggatattgagcctctgaattcacaaccatacataacatattcagcacattctggagtcactaagcatttacttgtaacctttgcagcacattatactgggacgagccctacacttgagttcagagatttaggaatgaatcccaactatgccactttggtgactttgagataaaatttttcatctgtaaaattcttaaagaatactaaaaattattaaataaagtaagaaatatagacacgcctacctcagtgctctgcagaatatggctctcgatttccttccatccacttgtgctccctgaatgtgaggcagtcttgtgatgaagggtctgggaaactaaatgcattcaaccgggatcactgcggtcctccttggttcatccatgtatgtatttactccatatttacttcatccatgtaggaaaatatgttccaggttacctgattagacacttagaatagactggtgaagaaacatagtgggtaaacatgatgacagaacagctgttgagggccgggtgcggtggatcacgcctgtaatcccagcactttgggaggccgaggcaggcaggtcacaaggtcaggagttcgagaccagcctggccaatatggtaaaaccccatctctactaaaaatataaaaattagccaggcgtgctggcgggtgcctgtagtcccagctactcaggaggctgaagcaggagaatagcttgaacccgggaagcagaggttgcagtgagccaagatcgtgccactgcactccagcctgggtgacagagcgagactccagggaaaaaaaaaaaaagaacagctgttgagaaggaaagtcagcatttaggagcctcccttcctaggatcatctgttgggggaagcacccatccacagacacgaggaacacctacaaataacacaggagtgtttcttgtacctccaaaactcctgccttctattaccagtattcctcaatgtgtgttttctttatcattttacctctcaattttaacttttattctgatttgttttctgagacttttcttttgatttactgacttactaaacatcttagtcatgcttatgaataatttacaattacctaattaatagagggaaattttctcatatctccctatcctctaagatatttatccacttgtttctagagatccctgtgacaggaccttcttcagtgcttagggaatgtccaggggtccagcttttggctgggtaggtgtcagtaagctggtgagtgttaggatgaaaacattctggtagtctgtgtctacaatgttgtaaaatccagataaatggattctagatttgtacaaattgctcctgtctatatttgcctgcacactctatcacatctgtcagactgacatcatcctaccgatcgttacctttttaaacacacacctaattgtttgtattgccctgtagtagtataagtaaaatatgttttcgttaatatttcacaaaggaaaataatttctttttagaaaatgtttaaaaagacttatttaactacttttaaaagtaatccttagttgaccctattagcatgtcatataagaatatgcagtatgtgaacattttcacttttaaaatggtcacaatttacaacttttttgagttcaaagtaacttttgcatttattaaagatttcaccagaattgatatcatcagagtggaatacaatgagtctctgtaaattattgtcagtgaattgggaaatgtagctaaatatatccatgtaatttgtcaggagcataatttttacataaattgaaatgtaacactgattgttttaactttttaaaaattgttgtcgatttaaaagttaacaaaacagtcaattataaaccaaggaatatattgttgttatcatccagtgagcatggtgtgtgtcagatgattctccttcctgagcaggacttgagcaagcatactgtccatgctgtatgtgctgaccatagggatttaggggtaccccgggggggcactgtgtggcaagtgtactcccaaggttcagcagcatctgctcacctagcaggctttctgctcttttctgggatgttggtgctgtagtgtggcccagagctcttcaccaaacacagtgcatgcattaccttttttaaaaataaaacttttatattgtaactactacatttgtaaaggttaattattttgtttttcttggtctcagcaggtttaattgttaaacttcgggaaacaattcagagtggcccattgaactggctgctgctcaggagtaaactgagacctgccctttaataaatagaaaaccaaatgattagcagcagaattagctcatactcactactaactacctgctctctgtatggcactcagtagctccaaccacttaacatttttaagccttttttcccctctgtaatgtaaacttcgtgaagctcaggcctttttaaaatgtatacccttcgctaagtacgcttgatacaataaaatctttgttctctgcagcattgcagattcatatatgtatatacacacatgcactgtctaatatttatctggtctggaataagcattaatctttaattactatataaacattttaaacaggtgtggaataactgcactctcaaaaatgcagtgtttatctccttgctgcctgatggcatcagccccactgcctgacagctttcacctccctgtgcttgaggtggaaacggagaggtggtgggtaaagggcaaagaaatgccccaaatcccacatgaatcagaaatttccagttgtaaattatgcaccaccataacatcctttaccacagtttgccagccaggaattgagtttggggtagtgtttttctgtgttggtagggtgtggggctgggggctgtatatatagccatgcatttttttttcttcctgtggattgtacgccctcagccgccttttcttggggctgtgcacggagcctgtggtgtgaggagatataaagcagcatttttctaactgcctttggaaacaatgagggctctgttaacaggagcccaagcctctgcagaccgcttcgctgggtggaatgactggtggagcccaggttcaaagccattggcctccaagtgctttaattcagcgttatttttgcttctctaacatcttttttcctttcgttctttttttcttttttaacctaagcattctgaggtctccttgtttggtagggaagtgagcagcaactttttataattagattaaagttaatcaaatgaaggcttggatatttttaaatgtcatttaatctgcttctcttcttccttcatggattttatcactctagcttaatttgttataaaatttcacctcatttttgcctagtaccaggttttccagtttaaaataaagtagaaatagaagacaacagatattttcagcagtctctgttcttccttgaaatacacaaactcaattctgtactagacttgacaccaagtagttgtaatattcctagtagtaatttttctgctattacaaatctgctaggttggagaaatgaaagagaaataggaaatacaaggttctataattaaggacaaaatgaagaggataaagttctcaagaaaacttaattgaggaatatttcttacagaaagcagtttatgtctgtggtaagtgctgactgatgaagttaggatattttggtcaatctaaaatgataatccctgaagagagagagatgggagcatggagttggggagcacagatgatggcgtttctaagctccggcaataaaaatgtaaacatcctttcttgtttggtcaaaaactctatcttctgtactatgttttgcaaatgaaatatgaaaacaaggcaaaggaaacaatgttcaaaactatttttaacatcttacactgttgtaaactcaaggtatcatatgaagtttgactttacacttggggtctttctctgctttggggagtttgctgctcagctcagccttgtcgggtgtttgctgctcagcttagcctgacaagcctactttctactcagaggaggggagatcaggtttccaatttgttaggcgataggcagtgaggcggtgcactgacaggtctggttctgatttttaagtggtgttaaaaaggtcaaggttcacatttttcccattttatcctgagttcatcaccagcaaatctgcctttgccacatttagtcaacactactaaatgaaccaagaccagaaatggggatcatgggtttgctttcctccctggttatattctagcatccactgcagaaaaagaaaaattcatgtcatcatagagtggcccttgcttcatagttttgactagtagtctgatcatataaatctctagttaacattttttatttattgtgaaaataaatagctcaataattttaatgtttgaaggtaagaatggagggctgttttattaattcatttttcctttgtcatggttctttaagtttacacttctgttttgaaaaatgctgttaagagctgcattatgtaaaaatatgtaatattgaaattatcttttttctaacacagaagttaacaatagcttcccaaatctctgctataaaagattaagtatcattttatgtagtaatgctaataaataatgagaaaagtttagagaaataattcttgatatttataatgttttatctccttgggattgttttttgaactgatgataaactagaaagttaatttatttttgcaaaaagtgacaaaacttaaataaatgaaacgttatgacccacccctcttagagaaattaattgtatcaattgaaaatggccacacttttttgctggtttattggctaatttgtttgaaattgattaatgctttttttaaatgacacattagaaaatatatattaaacttttatttttattttgagataaacctgaaaactttaaagtttggtaatttgtgatttgctaaaatgcagaaatgtgaagaaatgtacatgtatgtgagatgtttggcttttattggctttgcaataatgataaagtgatttatagattatcaaactactatactcttcagacacatatattatgatgttccggtgtgatctcaggcaaccttgtaaacctgtctaaatctttaatttaaagaagaattttcatttgtaagacttaaaagaagcttgtgggacgtgtcagaatttttaaattactgctcttttattcacaaaaagctatgtgggtactccatgtaaattgagagatactgaatgtccccttccccacttatattggaacacacacacacatgcacgcacacacacaatatttttctgtgtttataagtgctatataaagaattaatatgtggacacattacataataccttagagttttacagccaaacgtttgtgggtgctgtttccactcccacccttcttaaacacaaatatgtacttaaataaggaaaaatataccctctgaagtgaaatcgtaaaaacattttcttttttacttgcgagaatttttcctatggtgggttttcctaaacatgtgaaagaaactaatggttatgggtgattttaacacctcctaagagctaattgatagggccagttcattaagatccccctagccccttacagccacacaggtaataaaaaccatcgatgcaacagataacaatcagaaacctttgaatttaatgtttaaaatcagagttactaaaaaagcttcttttttctgcaggataaaaatgcaaacattttacatgttaaaaagtagaataatgtggctagtttagcctttaacagttattactcataatgaattatctatacctttagtatttaacttatccaatttttgggatgttttctcagtgttttgtataagttgtatgttttatatttggaagagacaatgttgcttgaaagacttactcataagtgttatagacattatatgcataaaaactatagctctcctccaataaatcttatgttatccccattattttattctaaagaagaatgtagatcaccggcacaacataataagaagtatggaatttttttacccagggaactatgtgaataaaacgttagatgttttcaagttaatttgacagagttgtcattccaggatattgctgaatgcagctgggaaaggttctttggcaaagactaatcagtacaagctccagcaagttgtggaaatatattaatcacagaatccttttatgaacagttataatgtttgttaaccttgttctagctaatacaaagaattttttctgagacacacttggtatattcagcagattctctttgatagcttgataagctgcacctagcattgagtaaagcagtggtgtgtgttgctaatacatttcagtgatgtccccccggattcgaagctgtgccagcaggatcctttgtcttttcctgatacctcttgttcaaggtgtattgatgtaaagggagaaccattattttagtttaaaatattaaacaaaataatttttatttctatttcaatactgatggatcacccactgccacaaaaataaataaatgagcttaagtcatcaaacaacgttattttattggtctggtttatgaagaatgcgaagtcccagtgcagaagtaagtatctgctctttcctcatcatcaactcccttcctgttctagttattgtctgtaaatcccagttaagtactcaaagatttaaagtgtaatgaaacttagatggttgggaaagtggttgaagtgaatgttctctgtgaagcttttttattatttaaaagtttgggtaattccgttgttctcttttcctaaatatattcaagaatacctgctttcagttcagattttaacaatcataattttcagtgcaacagataaaatgtattttattttatgtagactttgctatctactcactttttcagaggtgaagtccgaaaagacaaaatgtgtttataaaaccctagactcacctgtgactggggactaaagtgcatttcttcccattctcttatgttggcttctccacagaagaggccacgacaccaggtcaggaggctgataggagaccagatcactctagccaattagcccatttccctgtaacctatgggatacctcctgccttttcgcatttttttttcttttttttttttttgggagaaagagcagtgatgccctctagccactgacatttctgcttcatgccccgaaattagaggaatctgctcagcctggttagtgtgagcaatccaaccctgtgggctggtattcccactggaacagcctctcctgatcaaaaatgtagtttccaagatgcctaacccaggctgtgtggtaaaattaaacccctcaccatccccagctgcaccacactggagtggcccctcctggtcctctagacggtgtgattctcagtcctgtttgttcattatgcaaaccattcttttgttttgtttaaatatgtttcatcatctcttcccattttatacacatgtatcctcccagaatgaacactaactcaacacaggactgagcccagaactttagagatgtcagtcggcttcctgctccttcattcactgagggtgctttccccttgtgtgcacgtcaccctccaggtgatttctaaaactctcctccagtgatctggctcagaagcagacatcttacttagtagtttaacagtgcactaactggaaggcagagtaaagacagacagatcttgtttcggtaactctgttcttgaatggagaagcgtgatatttcattgccctaacagtggagtctgggccaagggcatgtgagtgagagtgtgctgctgactggtgcagttagtggagcaagactagagaaggcaccagcccttctgggcacacatcacaaacacagacctgcctaggttcctctctccttcccatcagtgtgtgcctgccatgtaactcagcaagttggagaacttcttagcttatttaatcttcttaaagtacccttggattttgccttccccatcaagttcctacaacccaaacctgtggaccagccgttctcttcttcacggttgacaatgtgagaagactcttctcgtcctttttttggacaccagacatatattggtggagaatatcagccatttaggcaggtgtattgaggtgtaacttatatacagttaaatgtactgttattagtatgtagttctatgatttaaaaactgcatataggcctgtaactaccaccatcatcaagatatagaacaatccatcttgcacaaaattcccctgagcatcttcagagtcggcttcctcctctctctccccagcccccaccttataatctctaatgttttctgccctaatgtttttccttttccaggatatcatataaatggaataatcctctgggtaacttttggagtctgtcttcttttacttcacatgtgcatttgagatttatccatgttgtgtatatcagtagtccattcctttttgattgctgaatggtaatctattgtatagatcaacttattttttaacttcagaaacaaaatcatagaacttcattataagatttttattacatatcacatttatatgtattcttaacattttaagttatatataattaaagtctgagatacaatggttaatttttaattcttgtattcctcttttaaacattgttatatagggttttgttttgttttactgttattttcagtttatcttattcactacaatatgaagtctagaaggccagtggggctcaggactgtctgcaagacaatctataggtcaatctgtataataggcctctactccaatcatattaaagtaagattttctaattttttaaaatttttacctatgtattattttcttaaaataaggactgaatatgtttgaaggcattaaataatacattatgatgtttgttcttcagatacaatcaagggttctgattcagagatcaaatgtgactattgtaagggctgcagacatcacctgtcagtcccctgatttcacagtagggaatctcaacagatgcagggacccctcagtcattcactcagtggaagggcagacctcagtcttcactcctggtccaggctgtgcttccagaggctcctcagcacttcctctgaggctaccttactggtcttttgacagaccatccagaaacaagggctttaggattctttctcgttggctcaaaaaaccaaaaccaaaaaaggcaaaggtttgaagtgcagcatcatcatgaggcataaacttgtgaaggtaattggattcatttcattgcacgtttggtggccattacagctgaaatgttgcagttttatgccaaattgaatgaatttcttgtattactttttttcatccaacaaactacagcctagctccatttgactttctacctggtggaaggtttttatttttattgttctctgtcatgaaacagattttagtaaatagtttgtagagggccattgtccaagcagcagcatttgcagacatcatttctgtcagcagcgccgaagtagcaccagggttccacgttggaatcctcttttccagtgaggtatcaatgtctacggtcagactcctgggtaagtgctgcatctggatgtcagcaagagctgcaagacagtttgctagtcaatcagctactgccagggctggctggaagcaccatctctgtgcaggtctgactgcaaacaaagcacagacctgtagggcagactgcgtcacctcagacctgagaatcctgccagtgtgcttctatgtcatctcagttaagtgcctgccccccccaaaacacaaaaaaagcactgagatacggccatttctcctttaatgtaccctgccaaggcttatagatgaccttaaaccattaaaattcattttttaaagttgaatagattgtaacttcttatgtagacagtaaggaaaaaacaaaaattgtcgtttttattacgttctcataagatcagcaaatggtgctcaatattaatgatcccaggaaggtctatagaaatgttaaagtgtctctttaaacttgccagagagaatgatcttgggagttaaaaaagcattggctctcggtgtcagaaataaacatttgaatttgctcttctttctccattacgtttctctccctgtttttatccctattcagtaatatatagtgtgcatttctcagtgaaaataacaaccaaagaaagtaattggaaataagtaaaatctaaaccaaatactagtgtgaagtagtagaaaaaaatgaaatggaaatctagtgacaagcaaagcattgttattgaaaggtttttggaaaaaagcctctttcactttgctggcccagttagaaagtttggtccctggtacaaagccatacagctgcacacaatataaagtaaggttaacagcatatttggtgcgtttataacttccctagggcattttaacattaaaaatagcgattgttaacccggtccatctgaacttaaatatgagcttactttgcaagaaatgaggggtaacgtctaagcacttttctctaggttttattattatttttaggttttacattatagcttctttttttgtctgttttatatgttttattccatgtactgagatacttggagttgtaggctaattggatataagactcttgactctcaactctgtaactttactcttaggtagtatgacatagatcttcgtaagtataatacattcgttactcttacacagggtgacattgatcttcataaatatatgcgctttcctctaacatggtgtgacattgatggtcataaacataacacaagcttatggtggatgtggtagttctttatcttagaatggcccatgagtgttccaagatgataattatagacaactaccttagtatattttgatcataatcacagaaatgcagttcctaacaagggtggcaacttctagactgtcagaatggttgcagccatatatatgatttttattaataaacaaaaccaagaagtctgcacatggactagggctcagtcttgctaaaaatatagtgaataacacaaatacactttattatctcttcgataatgcaaaaaaggtagaagcatccatcctttcaaggctgagggaggtgtacattctgcttggcaattctccaactcacaaacaggaagcaaatatatttaaccataagaggcatcctgataaaaataagtttaagggcactttccaagttagtccctactgtgatcctgaagtcaaccaactattagccagagccaaacagcaatttccaaggtgaaaggagataaagatactagagcagacagcaactctcagcccagatccaatgtaacacaccacagaggctgctgtctccgtatgtccccagccttattcatggttcatgggctttggaagctgtcacccaggtaatcctgtgcttccctttatgatgagtggaactgaacgcagcatacggactgtcaggtgattttttgaagtgggaaaactgcaaaacccagttacgttcactacaacaaggaatgtcgtatgaatgttttcctctgtaccatctctaagacccacttccttttatactttataacttggtagtggagtcaacattgtctgagataagagcctgagagcatcttgatgacagattcgaatggcaagtgctggtgctcattccctctggaaagcacagggaactcttgatagaggtagaaatctattcgcatgtgggacaactctatgcattctgggactgagttcattagtttagtttcttagatgataagtgtgctgaaaaacttacaaactcacaaggtgtccttccagcaatggtttttaatatttttgccctctctctcagtggcacatgagagttgatgcctctcacctccaagatggacataaggaaggattctgttcacatccacatggccctgtagggaacaaagtgattggtcacaagggtaagatgtctaggatggaatatcaaaactacgcagcctaaagagttccacaccaaacacttctaagctagctgctgggtctagggtggagccccctacctgttgaactctgttggaaataagagtctgtactcttgcattttgtccagatccgctacagcttccttgctctgggcagtatgccaggattgcctgtcttgagcaaagctggggcatccccatcataaagtgaaaggagtccactgcagctgcagactattaaaatgcaaattgggcaaatacgttagctctcagccatctgaagagctaatgtctacagcagtggtagagtttggcactccatatggtagctaataatgttttcagggccaggaggagttttctgatttatggaagtaaagggagagagtgtagctgctgagttgtaagtaggaatagatacaggcaacctctcacaggtaggttagagcacatttctgtgacgttgtggcaagcctgtgtgaattataaagagagttttcattttcagcaactttattcaccaaaatcagaagatgaaaaaagttagggtattttaaagacacatacaccagcattatcaccatcactaccgacaagtttgatcctcaccagccataattccaaaatacaaaactgaccccctgaggcagtctatgtacttacagggaggttaaggattcccaagatactttactgttcattgttcagccatttgaaattctggaggatgttgaaacggttgtggggagattttggatttgagagattaggtacacagacacactgtctgtatgaatatgtatttataaatccaatttgtcacggtcagaatctccctgtaatgtacctgcatgcatccatccatccatacgtgtgtttgtgtgtgtgcattgtagtagcagatagaaaagagaaggttagactgtatggtgcctaaaatttgttgaaaaagtaaattaaaattcattttcaaatgtttccatttccagaagggtgaatttgtgtacatttttttcttgaaaaatattgtttctttgtcaacctgctagtcagcatcctgctctcagactgtattttggttaacaaaagtaacatttttatcacttggtccagttgaatatttctctcagtggatctttgagttctttttcctctgatatttaacttcatttactacttcctggtgacagctgtttacataacaagtcaggtaccctctcaatacttggggagtagtaccagccctctctagactgcattctggactctgcagtgatctctgttctagaatagaactctgttctgtttagtgttaactgaaaaatccttggccagactccagcttcttgcatttttactttttctttactaagtaggccctcccttcaatggtagaaataagaaagaaaatgagttgtaatttaagtcaccaaaatttgcttgattagtggtttgagcaaatggctgacacctagagaagatgttgatgtgaatggctaacagctctgggactctgaatgtcttaggtctatggatccccaagtgcttttcccagagcaggtcatacaggcacttggagccacctgatgtctttcctgacaccatatgcagagattgtttggctgatcaactgacatataaagtatgggagttagctctctctatttgtcataggtaaacaaagatcaacaaaataaatgcagaaaggtttttagatgccaagtgcttatctaccacagatgaggaacttttattttttttctgacaactacacatctcagacccacagacttttcttctctaaagaaaacacaaaaaataaccatcagttaatagtgaagaatggcttatttctcatcttctttttcattccatttactaattatctctgtgctttagagtgagctatcccttagcaagaaaggatgataataaaggaaatattccaggataatttgagattttgaggtatctcctctcctctaaacgtgaaaagaagacaagacaatctcaagacattggagataaggctgctcatgaatgtggcccatcttgctgctagatcgcgagtctgcaggcagcatctggtgtgcccacatgctgaatgagaatggctctgcaatgtggtactgacattttagaccaaataattctagctgttctgttcaacagtgtccctgagctctgcctgctagaagcacccagacagccccagttgtgacaatcacagatgtctccagatattgccacatatagcttgggtgataaaatcactcccagttggaaaccactcttctaaaaggatagataggagctaaatagtgctggaggacatgattaacagagaacattggaagtttgtcatcagcgtgttgtgttttggtgtttacaacaaaatctgagttctgaagtctgaaattccaatttggtatgtggtatttttgcccttgtttgcagtaaaataatgccattaaggtaaactcaatgtcagtggcctcatccatacacacagactcataatccatctttctctaagttctgttatcacatatctgtgtatggaaaattggtgcacattaaaatacgacttttaagacaagcatagttttcagttttacagaataaaagcatttctgctaccaaatcttgcctgggtgtgaatttttacacctgagatattaatccttgaaaagaggtttttataatggaaatgctgacacaaccttagctgccctgcttgaaatggtatcattatattattccactcttgaccatgtccatgttctgaaaacagtggcagcattgtctgcctctgaatagtgctaaaggaccatggaggggaaggatttggcactgatatcagaaggggggaaattaaaaatacaccttgcatttatgactcattcattcaactcgggggattttctacaatgaataagtaagtttgatccacatagaattgatatatttctccatatatggacaactcaaactgataagaatgtcttttggttctatctcccagactattttaactgagtcttcaatagctaatcacttttctgttggataacttatgaaattttcattaggctctgtggctactaacagcccacatagacatcttgaaataatgttttatgtcttgccctgtacacgtggttgtccagatgtgtatacacacacacacacactcatatgagttatctccttgtataatctttttttttttttttttttttttgagacggagtctcgctctgtcgcccaggctggagtgcagtggcgcgatctcagctcactgcaagctccgcctcccgggttcacgccattctcctgcctcagcctccccagtagctgggactacaggcgcccgctaccacgcccggctaattttttgtatttttagtagagacggggtttcaccgttttagccaggatggtctcgatctcctgacctcgtgatccgcccgcctcggcctcccaaagtgctgggattacaggcatgagccaccgcgcccggccctccttatataatcttcagacagccttttccaaaaaggcagtgttttgtgtcttgtgttggcagtatttcatgtctcagatacttttcagagtttcttgtatgcccttagtgagtaggaaaggggaaaaaattctcctagcaagtcctgcctgcatttcccctttcccctttctctcaacaaggacagaaatgagaacattctccaagatgtgcgcagactttaaagcggatcccaggcaggcgcggtggctcaagcctgtaatcccagcactttgggaggctgaggcggatcacctgaggtcgggagttcgagaccagcctgaccaacaaacaggcacaccatctccactaaaaatacaaaattagccgggcgtggtggcgcatgcctgaaatcccagctactcaggaggctgaggcaggaaaatcgcttgaacccggaaggcagaggttgcatcgcgccgagatcacaccattgcactctagcctgggcaacgagcgaaactccatctcgggaaaaaaaaaaatcggatcccacgtcccaccgtccttccaccattgccagggacagaaaaaatagttcaggatagttagtaacaaaattaagagaaaaaaaaagacactaagaaaaacataatgctaaattttcaaagcaagtattataaagaaacgcacctttttagtggaggggaagcttgtggaaaataaaagaaatagtgaaaaagccctgttaaactcgtttgctctcaggcacaggacagaaaatgtatcactgtgcctacaatggaaaggctactgaagtttttttcatatgcacctcaactgccatttttgagtttactcgttaagcaaaaagcttttattacagaaaatatccttgaaagattttgaacaaaaggacatactgtaaatttattgtttgattttaagttcttggcatgcatactacatattggtaaccattccttcatttaaagggcattttgcgagctcttgaggcctgtggctttgagggaactgcgtaatgccccgctgagttttcatctgctgctactgcaccaacacatggctttgaatttgagttgccagcaaaactgcggtggttggagtgaccactgtggaaaagacttatttcagagcctccgctatggcccagaacaaagtagatggcactgtccagaaacacgttctgcatctctttctcgctcccttcagggacccttgtgattccgtgtgggagcctctcctcctgcctctccctgccagtgatagggtgctgagacgttagtacccatggtcacagaagctgcccaggtggtgacaagacacacacgtgtgtgcctgctccggatgtctgctgtgggtggagcctgtcgtttggaaagtgttcatctccacaaatcaaaggtgcttgttgtgaacaagaaacacagtcacctcagactgccattaaaagcatttcatgttctgtgggcaattctgaactccagcttttcttttttttcttttaaaattattatttttaaaaaatatagtgttcagtggtaaaatccagagtgagggaaagctccccaatactggaatactggtgatcacttcctcattagctggcccacatttatagccccgcaaacacagtccccttattaaatgtattaaatgcctcgttctgctgtccagtatggggtctgctatacagtatgtgtgttttcaaacaattagatagcacaggaaagaaacaaatccctgccccgaaggtcctaactttaataaagtatgttatttccaataagcccctttaatataatattatattgtttgccaaatgaatttaaatattttaatgttgaaatgatatcagcaaatacctaaaacttatttcctgttgcaataaaatacacgttttctcagtctcacaactttccacattaataataattaaaaggttagaaggcagccttaattacatagctaatcactcggcctttcccctcgttgtttgggacaaacatacaagttttctaaatgtcttagccaaaatgtcctacgttccattcttcttcttcttttatctaatgtgtaagaaagcgcatttgatggatggaacattcccgtccacaacctctccagtaaatctctcaaagtccttaacctcgtacagcctgcctgatagagcatttgctgttgtttatagtctgttatcccagggattggctttctgtgtaataaagtactaaaagtctcgtagagtaggatcaacttgggtgttctgcggtttgcatggtggtggttatacctaattcccacagcagagacgggagttagagggagcatcataaagaacacaagtcagtgggctgccagctgagtgagctgccctgcgaacaggtttgggtaatagcaatatttctaaaagggagggcaatgacacttaagtgaggttggtcttaggaagcagttgcaggtctggatccaataacgtatcattgactgcgtctggaatagatcgccggataaattgagtgaactcttaccctgctgggagcttttttgctgtgtgctctgtgcttattagcctcctagccctcgtttgaccctgttccctttttaaattaatgcatctccaattccctaatctagacttttttttaatctcatgtttctttgtttccacccaatttgaggaaatagctgaggagttttcaactgtttacccaaaggcaaaattaacaggtgcattcagggttattgtaaggctcatcaaatacactgaaggcctggcccatttccagttctgataaataagttagcattgtaaattaactgaaaactgacagataagaagcagtatttagtggcctagataaaagttttactgtgcatgtgtagaagcgcctcactacaacatgtatcttgacacttaggtccataataatgagtttctaatgagcagaacctgggtaatagacactgaagcgaaaccagaaagatcctgcttttaacacagtctaggaatgtatttacatccgatagcagcttggcacaaggaagaaagtgttcaggagtttggccatctgtttgctgcagtttatgcctttatttggaggcagttagcagaagacccatgagattgcatgaggaggattaggaagaaaaggcactgggaaaaataaggtgtctctgatattttacgttggaacacatgatgatcatttatggggaaacaaatagtattttatgtgcagtgaatgtcttcaggtgtaaaaagctctttaagacctagcttccttattttgaaaaacgaacttcctattttgcaaaaaacacccactttttttctgagcaattctagctccacgaaagggttttgaaaagttctttgttagatagaagggattgcaaaactgtgtcaccataatattgatggtgttgctgttttatataatatggcaaagagcttcggtctgttctgtcgagtctctagacataatagggtaattcttatagtagactctttagaataaagagcttataataaacattttggaaagtcaaattcagggaaaagctacaacaacagtaattctaggatttatttttgcaatgctaaaattattttattccacataacttaagtacatttactgggtattcacaggttattcccaaataaaaagccttcacatttttgcgtttattagcaagtcagcaaactttcctgggtctggagagtaaaaagaaataacagtgctgtttgcttttttaccctttgtcacctcctttaagaaagagcatcatgtacatgaagtcactacattcctactcccctgtgttcattcatgagcacgtgtggcctgtaggtgcatgaagatgaaacagtttgatcagcatgcgtatggtggtcatattcttttatgaatccctaggtttatattaccagatgttttcctgaaatgtagcattttttaatttatttactaaatgtttattaagcatctagcattggcctccagtgtgccttatacataatagaagtgtatcaagcatttgtttaacaattaatttaatcaacaagtgactaaatcacaggaagaaagaaacttgcttagaacctatacttacaggtctaggccagcagtgctcaaatggtggcaattttgtcccccaggggagttttagcaatgtctggagacaggtttgattgttataactgagggatggggaacagggaggtagttgccactgtcatctagtggttgaggccaggtatgctgctacacatcctgcagtcacaggaaagcccccacaacaaagaactatctggcccaaaacgtcagtgatgccactgctgaaaaactgtgctagtagaagagacagtgtatgctcacccatccctccctatcagcccacttcactatacttcacacaccctcctaggtgatgcctacactcatgggaccctcaacagccatgtgcaccatcattacttacaaattcttgtcttcagcccagaccactccatgaagtccagccctatgcagtcctgccctctggacgttcccaccccactatcttcaaaagctctttcaagcacagagcaaccaagttggaattcaccatcttttactcaaacattagcttacagcattctgctgggcacatggttgtcacttagaaacaaaacaaaacaagaaaaccaaaaaactttgttaaatcaaattgtataaggtacccaagacagagagtagtcaatgtcaagagaggtgacgagagttttcagaataaggataaagtgctttttgctttaaaggcagtaggagccagggtgtgatgggaggccaggaatccatagagattttgtggagaagttgccaactgagctgagcatgaaggataagtggcgtttaatcacctgggattctgggtggtgggaacagatgagcagaggcacagaggttggaaacagggccatgagcagaggctacataacggagcactgtgactctacaagcggtagatgatgaaatggggcggtacgttgggacctggtcttggagattttacatgcaaaggtgagaagtccatgcttcactctgtagccggtgtggatctatgaagattggaaattgagatgatttgtggtagatttttggagacaaactaacagcagtgcctgccttctacctcacatccttcaagtctcatttcgatgtcacttccttggagaggcttctccagcacccatggtttggcttaatgccttggccgtacactcccagggtgtcttatacttctctttcatatatctcgtctcactctttccttctcctaaagtgctgatcttcccgttagacagtacaccctcaccaagtctatttcagtgtactcgaacacccagaccgcacaaaccaaaatatcagcctggttgacagagatgttgcctgggtagacactgtgtagaacttaccaactgattagtattggggcaaagtgaaaaatgaattaagaatgactccaaggttgtaaaccttcctaataggggcatgtggtacattcggattactaatattaatatttctatctatgaaacataggttgacacattctgcagaaagtagctgagttctgtattggacacactgagattgaagtgttggttggtattggtgtggagagattagtaagcatgggacatgtgcaagggaacttagggaatggaattagagatgaatgtccactgaggtgatggtatttaaaaccgctccaagacagactgaataggcttctgttacttggatcttctgaaaattgccatgaatgactatttcattgttgttcccccatgatttttctcaccatcttctagatttcttaaagaatatttaccctagggcaggtgccgtggctcatacctgtaatcttcaggaggccaaggcaagaggatcacttgagcccaggagtttcagaccagcttgagcaacacaggaagaccctgtctctacaaaatataagaaaattagccaggcgtggtggcttgtacctgtagtcccagctactagggaggtttaggcaggaggatacttgagcccaggagtggtagactgcagtgagctatgattgcaccactgcacaccagcctaggtggcagagcaagaccgtcttttattttaaaaagggggtgggggaaatatttaccctctccccagtaaaaggtacatcataattctatttcaatacatctgaaaggtcaagcatgatttcatctgctgtttctccccctgcaccttagtcattatcaggagtcttctccagcttcatacttgtcattgttttgctggagtttttgcctccttggtttagtagagtccacagtgatatatttgatacatcctaaaagatatgagctgtacataaatgttctaagtgtttgtaaaatacctgctcaaatgctgccctgaggctttgctttccggtacacacagtcttctggccacatctctcactgtcactgagtgttcccctcagtacgttgctttgcctagcccttgtctttcagagtacggtttgcaattttcaccttcattgggggaaacagaggttcacaatctaggattggaaagaatgtagagcatagcttctctttccatgttcccatggcttccatatcgtttccctgtccctgccagcctcttagagttttcccatctttcctatcaatggagagaaacttattcattgttttttataaactatggttcactctaacccaatattgtagtagttttgtttccttttattgatattgagaattttagagagaaaaagggcattagaatcatggtgtctggctggacacagtggctcacacctgtaatcccaacactttgggaggccaaggcaagtggatcacttgagcccaggagttcaagaccagcctgggcaacatggcaaaaccctgtctctacgaaaaatacaaaatttagctggacatggcggcacacacctatagcccccactacttgggaggctgtggtgggaggatcacttgagcctgggaggttgaggctgcattgagctgtgattgtggcactgcactccagcctgggtcacagagcaaagagaccttgtctcaaggaggaaaaaaaaaaaaaaaaaaaagaaacatggtgtctggccctggaccttgactccccatctaatattatcaaaaagaccacaggacacctggtatcccagggatcatatgcttcaggccaaggattcaatgctactccactatgtcctcatgcctgaatattgctatgaggacttaacagcaggggtccccaaccccctgagccacagaccagtactggtccatggcctgttaggaaccaggccgcacagcaggaggtgagtggtggaaaagccttacctcctgagtgccacctcctgtcagatcagtggtagcattagattctcatagcacagcctctattgtgtactgtgcatgcaagagagctaggttatgcgctccttatgaaaatctaatgcctgatgatctgaggtggaacagtttcatcccaaaaccatcgccccacacccccagtccgtggaaaaattgtcttccacaaaaccagtccctggtgccaaaaaggatggggaccgctgacttacagcattcagaggaagggtaccctgtgaagaatttaaagtagtagagagccacctgagaatgtctcaacatatgctagatattcatttaatgtttataagccgtgaagtggttggctaataaaactggaccagatagttattctactataatcttcaatgtgcattttctacaagatctatgttttatatatatatgctcatcactgataaatggtacaaagagaatctgggtatccttttcttcctctaaaagcataagtacaatgttgaatatgggataataaactatgaccgtgaaacccattacactttctgccattaactcagtctgtgaccttatataagtcacttattttacttttaatgtacaatagaggaatcattagagagtcagatgatgacattgacaaattgcctcaatctcagatgtaaaatgctgtgtgatatgaaaacaatttgtcttgccattatttcagatgtttctactttcctcctgtaaccagagtcacatttcatcatcagtttgaacatgagaaaaatattaagagtacatgatctaaatgcactgagctttagcagcacttacagactggtacagtaaaacctaaggatttcttctgaggccaaattttccttcctgaatagggccactcatttagttattatccattcttataaagaagtgttaccctcaggttacagttgtaactctctgtcgttaatttcttctagttaaatgaagttgtctgagaaagaagctaacctatttataaaagtatatatttgttcttgagccaaaagtcatttcgagatgcactttcatctgttaatgtcactgaaagttgctagataggtgcagcttgaacttccattttctttgtcatgattgcagacccaaatattttaaacacaagagaagacactgctaaaatcaggtttttttttctcagatccaggaaaaaaggtgtaggttgttaatgtttcttgttacaaagttttgaaatattttctcagataatgaaggctatttataattgattttaggaaaactcaagctaactgtaataaatatgccaagcattaagtctgaaaattcaagctgaatgcaaaaagtatggtatgccaagaattttaagtttaatcctgacataggtaaaaactgtttgaggtaggtttgctgtaatactatttttaaagaccaaatcacaacattaaatgtacaatccaagtacatacaatccactcagtagtcagtaagttttcatcctagtcttttctttgagaaaaattcattctactttagatttttttaagcttcattttatttaggtaatataccacactaggaaaaatacagggtttagagacaaacttgcatataaaccccagctctgctattcaaccaattgtggactttggggataataagccctagtgaatgggattatcatgggaattcgatctgtcagtatatctaaagctcctaacacagtgccagcacatgatagatattccgtaagtagtagttgttgctattgtgattacttatatcctcacattgaaagcgcaccctgtgaacaaggtgagaagagagatgctgagggcgagttgaagtctcttgccgacaagccgacaccacagctctcctgcatttctgacagatcatgcagacgctatggcctcagttctcccctttcttcttttggaggggcctggtgggatggagcatggcagcatcagaggctaccctgttctcagcaaaggttggctttaaccaacatactccacgcatgcatgcatttatttatttatttgaggcagggtctcactctgtcatccaggctggagttgcagtggcacgatctctgctcagcgcaacctccacctcatgggttcaagtgattctcgtgcctcagcctcctgggtaactgggactacaggtgcgtgccaccacacccagctaatttttgtattttcagtagagataaggtttcgccatgttgcccaggctggtctcaaactcatgagcttgagtgatctacctactttggcctcccaaagtgctgggattacaggcgtgagccaccattcctggcctgctccttacatttaagagagaccctatagggctctggtcttttttattttgttgttctcacaccttatactgtacattgatgtagcttcttttctaacataggagtccagagacccagagaagttgacagacatttccttttgatccacatggccatggcctgctttgtgcatgagtgggcctgcctgcttgagaccagcacctactgccaatctgagggccatccccttgggtatggacagtgatgttggctcactggtcagcggctcataaccctcataatctgtactgtctgttctgtaccaaccaggcagaatccaggtagaaattctctttattttattttattttattttattttattttattttatttgatgcagggtcttactctgttgctcaggctggagagcagtgacacgatttcagctcactcactgcaacctccgcctcctgggctcactgaccctcccacctcagcctcctaagtagccgggactacaggtgtgcaccaccatgtccagctaatttttggtagcaatgtggtttcaccatgttgcccaggctggtctcgaatgcctgagctcaagcaatccacctgccttggcatcccaaagtgctgggattacaggtgtgagccacggctcctggctgaaattttcttatttaaaatatacaatgtgagcctctgtacctcattgcaacctttgaaagcaagaaatactaggcagtttatcccctatccccacccctcaaaataggatatttttagcttcaagtaacagaaaatttgaatcaaattggctttaaccttaaaaaatgtattgtctcctgtaatccgacatttggaggtaggctgggatttgcagttggctaatacagagtcatctaggacccaggcttctctttgctgtccacagtattgacatcatccccagactggtccctgctgtggctgtaagtcggctgccagcagcagttggagtcacattcttctccatttggagaaacagagtgacttccctggcctttcctgaagtcctcagcaggcctcctctcccatctccctagctagagttgggtcatatatccagacccaggctatttgccagtcagaggagttgggattgcctttccttaggctactgctgtgggcagcctccctgatgcataagggcaagaacaaacacccaaactacagtggggttcccttcagaaaggagaaggtgggactgtaacgaccactacagcaaagccactacagaagactttttggaggaggggatttttgtgctgggttttgaagaataaatagagttaggaagaggtgaggtggagattttaagttgatggaacatcatatacagaaagttcagaagtgggagagaacacagcctttgagagggaactgtgagtatgtgaatatggagaatggttagagtcacaggggatgagcctggggaagagtccatgtgtgtcacgtagaagtctgaatgccattccgaattgtgagagcatccagagaagatatgaggaaggtcctggttaagacaatggtgggaaaaacggagaggaagtggcatttagggaaataggcattgcaggacgttctggccagtgggatagaagtgagtgagaagaaagcagtcaagtggtggatatgaacaagtcacgtgtcctccagccactggaaccacctgtgtcagcgtccttcctcatggttcttcctcccttcctatctgtgtctctacatcacaaacatacacatgaacaccacctacctgtacctgtacagagagacaatttctatagcagtgacactacagcaaaaatagggatatatgtgcaaaatattgttaatttgttgtgttacccattctgatattaatagcgtcccctttcctaatctttggaaatcttttaaataaacaattatgcttatttgaggaaaaaaatgagttggtaatttctaattagcagtgacatggatctttagtaggaagcaatcatttcaaaaacgttagcatttggttatcagcttgtgagtttgttaggttcgatagaagtttcactttgcagtgagagtttgggaggaaacactattttccaggatcatgtttcttacaaaggactaaaatatgcttaagccaacctcctccctgcataaagttcacctctgaactaagaccaaactgaaaacaaggaacgccttgaaatattttgggatgttctgagagcaagggattctaggagagagagttcatttgatttttagcacttccagcactttagcactccttaaaggtaaatgcccatgacttaccacccttattcttttactacataggatctttttatatcactataaaacattagtcaacaaagcttaaaaaaatcccgagaattaaaaatgtctagctagttcagtctctgatacctacattctgtttatgcagtgtgtccacctggcagaaacatgaaaaaaatttgactcataagtttccgtctgtcctgtttgtttgtaacttgcattacgtgtacagtgtagctggatggtgcaacagtcgccctcacaatgtcattagtggctgccagatccggtgagctccaaactgccactgaggcattttaaccaacccgaacgctgtttgttgagattaccctcaagaccacacattacggctattctacaaatttttcctttttttaagtctagcagagtcacatgccagttttggctcctttgagaaagcaggcttctggattagctggccaccagagcccggtctccactcagtgctccacttggaagtgcggctgacccacactttggtttcttagagtagccaaaaacgagcatctggccctaatttagactgagcgtaggggctccccactagcagcaaatacgtctcttgccctctttcctctctgctggggtatagtgtgggggctggatatcagcaatacatgctcctgttttcctggcttggactctctcacttccagtaacattcttctttttacttgcacaagcctagttgacatttctggttggcatgtttgcctctgtaagccattttcatgactgctgggtttatttaacactcattcaaaaagttttggagaacctactatgtgccaggcacgtgatgtatgttctggaaggggtgaggagaggcagagcgtgagaggggtggtaccactcctgaactagagacctgggtgccccttccaggtgggaggtcttgcaaagtctcaacagaatagcattcacttatctttttaaagtgggtattgcctaatgagggccctttctagcccatcttttggattaaaatacatttcaagaactgtgacatttgaagtgcactggttttgtgcgtaacattctgtgagagttttacaccatagcagaaaaaatgcagtcctcgcctctcattgcttctatctaggcattttctgcctaggaaacctcaaggaaatttaaataatacacttcccaaatcatacctcaataaagttgatttcaaacaaatgaaaacagtttccaaaatattcctttcacgattgcgagccgaagacgaaactggttctaaagcatcccacaaaggcgcagagggctggccagagccaaagagcaacccacgtcccctcggctgcagcctgctcctcacactcatcactgggactcctgactggcagcacaccctgccccttccatgggtagcatctagtaacaagtgctttcagctttgcctgacagagctcattgtgaagcccatgattttatttccacttccagggtgaaaattacaacatcagttggaatagtacatctgacttggaatagactagagtggtcagaatgatggatctgatatatacttgaagggataattgtacacaaccagtttaaaagctggtaaatatttaagggtcaggggttaaatgtcaaagccacagtgcttgggctcagctccataaagtatctagaatgactgctaattaaatccagggtatatttcaccaaagggaaataaatttgacagctaacaaccaatactggattaccaccttacagaggttagggatcatgctagtaattgtaggtggtttacagtttttaacccagtactaatcgggaggatgattgcttacagttacagattaccatactaaagaaagttaagtcttatgagccaaaaataagcagtaccacaagcatatagatctgggtcccctggctcacttcttgtttaaaaataaatgccctctggctgttgcggagcaaatcactaaaacaaatgtagacatgctcactttttttttttctgagctgaaaattttctctgtgattaataattaccaaccagtgctgtagccaactatgaaattagatgaattggattttcaaaccagagcagcaaattgaaggcagaaaaatgtcggctaaaggtataatagtccctctcctagtcaaacacttgtcgttgtacttaggtaatgtgatatttttctcaagttcagcatccttacatgggcatgtaatttggacgctcctttggatgtcccacctcagggaaaaagctgtttaccttcagatgagatataccttatgagcactaagcaaacagagtaattgtaatattttaataggtatgtttacatgcagatcttgagattgtttctgcattaggtgatttatagggctatattaagtaaatcacacttggaatgctgttccaaagaatgactcataaaatactgccatctcccctttctcctttcaatagagagctccaagggaaagagacaaaagaggaattcctccgctcttcataccaatcacagtactaaccaagaaatcatcccatttaataacagttcagctattttcgatattttatttgcattgccaagtcagtgtaaaataaaattgtctaactcaaaatttcacagaggtaaatttatgtggaaaaaaacagccaaagcctttatagaaaacctcatcatccctgatactccaacttctgcaggctgaactaattactgcatgatctttacttgaggtattggttatatcaattaagttgttaggagtaatttcaataatgctagtgtttgagagaactacatagcaaacatgatttgccttaattagacttttaaattcagagccctatctaagtctggagccaagagctctattttgattctcttctgtattcacttagttgtaaagggaaattttttaatatgtctggctctaagtaattagtttgcaaatttgtaatgtgagatgttgtaggagctgagttgggaaaggagagcaaagcctcctccctttttcttttattagcatttcctgtatctggagacttcctgcaaggatggaacattcctttaagttcaactcgtgggaggtttgcaccaatagcataaaatgcctccagacaggtacctaccactgaccttcatgcaccttttgcccttaaaaaaatagcaatgcttttatttgtcaagcctttcagagcacttggtgggcagtggagcctgtgggcggcctgagcagtgtccccctagtcctcctgtctgctccctgtgaggcctgggtctccttcctccctgagctgtagatgctgagctggagatcctgtccagacctgtgggaaagtgcacaaagccccagccattcatcctgcgtctttcccactcactggggaaggaactcccagcaggaaggcttcattagcctgaaagaatatcgtgccttcgctttaactctttggcccctatggcagtcagtccattgagtgcagtattcacatataagatgtcgaagttcttgagagagtcttcattgcttggctcccacagagaattttcccagtaacttcctttactaggcaagcgtttattaaaatgtgttcctgtccacagaaaattcaggattcgggacgggggtacaccacacttaccaacactttgagtcgtgccattaagcatcgtgtatgcaagtaacagattaggaagcaaaaaggccacattgtcatggaatctaaatcctgagtaaaatgtaagttgtttagggtttcccattctgcaaagaccacatttctgtaattttatgttaacttactatatgttttgaagaaccggctatgtcccttccattggcaaagaactttccctccacccacccctgcccttttgtaaatacagaaaaatcaccacaatgatgacatacaattataataaacatttaagaatcttgtactttcccaggtttatcttatcatctgaacatgtggtgagcccaaattggttgtcttttccctaaggtacaatatttctacacattttaatgcaatttacattttatttttaaagacttacagtgacatatttgaacattctgaaaattaaactttgtatgaacgtaattgcaagagttagcggaaactgaaatgaaatataaagacttccacttcctgtatatgaatttttagccttttcccaaactttctctattgtaaacttaaaacaaagtcttatcagcaagtaccaaagaatagcagctggatatcattaaatccctctgtctaagctattcttcttcattacctttttcctgacagctcttgctctgcacagaaattgtaactttgtgatagagatttatgtaattcaggtgtcctctatcctgaatgagagcttggctgcaaaagaatgaagggtttgccagagtccatagagttttataagaagaagaggggaaaccatacgaaattcagtgaagaaacacatgttaatgtaaccagttcatcagccgcttctacccaatctcccttttatggactattttcgtaagaatatttttctgcaaactgatgtagttagtagatgtcattatactaatgaaaggacattagctattttatcataaagtatgcaccagcactttgcagattcagtgaaactctaaaaatgtctttatctagcaacataatagaaaatactatgatagacatccaaccataaacaaattagaacaggcaacacaaatgcctttttcagtttagtgaaatagcgtagcagttgcttagttgatggtgacgtggtaacatacatatgccgatctgtgagcatttcatttggcctctactagctttcatacctcaaattttgagttcaggtctcagagtttttctttcatttacacagcaaaaccaccaggaaagagactttaaaagagactatcaggcatgacaagatactagtgaatcaaaaacgtacttaaaaaataaagcaaacgaggccaggcacggtggctcaggcctgtaatcccagcactttgggaggctgaggcgggtggatcacgagatcaggagatcgagaccatcctggctaacatggtgaaaccctgtctctactaaaaatccaaaaaattagccaggcgtggtggtgggcacctgtagtcacagctccggtggtgtgaacccgggaggcggagcttacagtgagcgctacagatagcgctactgcactcctgcctgggcgacatagcgagactccgtctcaaaaaaataataataaaataaaataaataaaaaataaaataaaataaaaagcaaatgaaaaaaatgtctaatgactcccatgaacattaaattgatggcctcttctttccttgatttaacagttattttttgccctattaccaaattgatatcttaaagaattgttttactccaaatgcacttattatgtgcagttttattcatggttcctcacaatcaacaaattaaatgatatttatgcccatctgcctgcacttgttttttgaattagaaatacaaaagagatctaagaacttataaaatagttggtttatcaagcctaaaaagacataaatctaatttagtaatttaaatgtgaaaattactagatttttaaagattattttatagtgacatatctccttctatgtaaactctgtttcacattattttctgtaaaagcagaataagaattcaccaaatttgttataacaactccctacaaagaatgctgctgatctcccagcatgtgagatgttgtgggagctgagttgggaaaggagagcaaagccgcctccttccactcttctagagacacagaatgtagaatgctgccctgagttccgacctgcagcagcataagccacctccaccctatcccagtgatctgtccctgtgtgctcttcttctggctgccttagggtgttcttcagccagtttcaatgtcatgtcctcaaggaaaacttccctgacagacccccccttacgcaacacagactctgtgcccctcccgtccgtgttatttgccccgtgttagcacttagcactcactttatattccctccctccttccctctccctctctatcagtagagaactaattaatatctaaataaaaaaataattaaactgtggtaaatctatcatgtgatttgcttgcatctgtaggaaagtacaagaacattctccgtgaaactgaaatgccctcagagacattaagttgaaaaaacaagaatagtgtgtataaagtagtataaaaaggtggatgggggtaataaaactgttcctgtggttgcctggttgcaggaagggggacggaacaaacagggttcccgggacctggatggagaaaatcgagtaatgtcacattaatttttgagattttaaccatatgaatgcaatatctgatctttaaaaatgagttattctggaattattgtatagtttaataagttatagtttatataagtttaataagtttaataggaaattgtttaataagaaattgcccttcaattctctttaagaacagagtaatcttgcatttaacttagaagtatgttaaaagcttaacatacttctgatgcttaaaccaaatcttacaaaagcactgtaaataaaggattttgttgtgttttgttatttaatgaaagggagttgccgactctccccatagatgtcaagcgctaagaaaagatggatcccaactggagccaacagacagatgatgtatcatggtgcctctgacatttggtaacctccaggccctcagagcaattgctcagggaaatgcaacattgtaggtctggatctgttctaccagatggaaattagtgccttaaaatagcccagcatttttcccccaccactgagaacattttaaatggaatctcttttagatttaaatatttttaaatcttcaatggacatttaatgaatccttatagaatagcttttattttcttgataattgatgaaattaatatcatctgttttaatttcaaagcatgccaagcattttaacctgcaaatccgtaacctaccaggattgaactttaactactagattttaaggtgctaattcttaataatttctatttaatttttttgtaaattttaaccagaacctaagctctgactttgtgattcagttatgtttgtatatacatgtcttcatttttgagtgagtaagaatattagagttgttctatggatttgatgcgatatatgcattgtgattttaaggagagcatgtttctcatttagatattgactagaaatagagaaaacctaaccaacaacttcttaatttactttgtttgtttaatgagcagtttgggtttggtattaatttctgccttcataaatttcccttctcttgaataatgaggatctttcaacccactgcccttccatgtgaaaatggttttttaaacaaccttggttatagttttaaacttcgctggaagaattaggtcatccaaaatatgtgtggggtgtgaagttttgttttctgcacaaagacttgtcatgagtctaaacatttctctctcaagtaatttacaatttaattaccttgtgttatgttccctcaggaaggggaggagaagggaaaggaagaaaaggcaaaaaaaaaaagttttaaaaatgtgtgctgcattcaggatttagatttcaccttataaagtttttattacagcgtcctcctcccctcattgtgccatgaaatagtgaatcactctgcttggtctctgaggacagatgctgttctcatgttttatcctgacacctccgagatgagctttccatatgaaggaagggaggacatttgatgtgtccagtgttgttctggggcctccccttctctggaagtcactgacacgtgtagttttggcattgaagcccagcgggagacgacatttggccaattcccctgctgattaatgtgcctgagggtccatgccaccctttgcccccttccagtgcattagtttaaaaaaaaaaaaaaaaaaaaaaaggctttcatacgctccactgccgggtgagctgggcacaggtccagcggcgccagcaattttccgtcctttgtgtgagtgatcagaggccaaccccacaaaactgacagtggttgcactcagtgctactaatgatcttcagtagccgaagacttccttcctcgtgtggcctgaatgtttttactgggtaaatatgtgatctggaaagtggccacagagacgcagcctgataaagttcatcgtgtgcttcacatgttcatgctgacttttccgctgaagctcatcaggtctgtggcaggcaaagacagaacttacgagacagaaaatgaaaagttcgcttttgccttataggcagtttgcagatatgctttctgaaatgtgtcggcctcactttgttcattcttttctcactgaaaagagctttgcagtcaagctaacaatgcatgtggtggactatttttaagaccaaggagtctttggctctggcttacctttacctgtccttttccacttctccacttcttcatcctgaacatccagtgagtccggaacagccaagttactgcttgtgtaatgggcacaaaagtaggtgatcatgctgtgactggctgtcagtgcatttacatgctctccaacacacataaaaaaaataaaagccatcactccagtcacagagtcaaatgctacaaataaaaattaatctctaaggagttttggattgttttttttgtaggggtatagagagtctcactccgtcccccaggctagagtgcagtggctcaatcataactcactgcaacctcaaactcctggtgggttcgaggagcttccagactcagcctccctagtagctgggactacaggcacatgacaccacacctggctaattttcttattttttgtagagatggggtcttgttatattgcccaggctggtctcaaactcctgaacaacttcgagaccagcctgggcaatatagcaagttgctcaagtgatcctcccaccttggcctcccagagtgctaggattatagacatgagccactgttctaaagagattttaattctgtaccctaccttcacttagtgctaatcaaaccacgtaagatggtagtttttatatatttattaaatttctgaagacgttatcaaccaccttatggttttttgttctaaaaacaaaccaactgtgaccagacagaaatttccttggaattatgtatttacaaaaattcttatggggagggtaaaagtggctgaaactcctctttggcctttgtgcattggctgtgtagagacctggtgagagatggtgactgtgggctggaactaggctaccagggattgaacatctaatttttcaatatgctagcttgctctggcaaatacctctagaagcaggcttcagctccttcagataaataatccctacaggtgcttaaagaattttcaagattttataaaaaacctaaaaaggttaggaatatgtgtgttcggatgaatcctcagaaagctggaataaaaaactttcttctatcgcctgagtgacatggcatcctacagtgtttatttttattttactaagtcatgtttccctaactgcctctgggattgtaattctcattgatgagtgctcttctttagtccctttgctaaaaactttataaccttacctaaaatacttaaaattggcatctgtttagtgttttgcagttcatagagattttcccttcacgcttcccttaaggaatgattatctggactcctcgttttactaaagaaactgagaaatggcacattggtaagtggcagatccagagtacaggcattcttgcttatatcacttgtcacacatggcagatgggacacagccactgaattctcctttagtttcaggatgggagggctttgacctaacgtccaggaggccagtgtaaccagcggaatgatttagagggaagaaagccattgacttactttaatcctataatggcagtaatgcctttgtagccaatcaggaaacaatttacaaatggccttaccagaataactctgctggatcattctgatttgggaatattgaacctgtatctgcattggccaaatatagcaaacaagataatcatgtttatgtgcattacttttgaagaaccatttaaaaattataatgctttgggcaaatagtttcctagacatgaatggaaggactacattttctgaagtgtttgggtacattttcacatatcggtctacaaaacaggcatattctcgaagaggttctaagagttatatatatttcttatccctgaaatgccttatagtatagtgtgtatactatagtgtatagtgtggaggattcaattttatataaatttcagataatttaatatcttgttgataataactatcacatagatttctgaacaggtgccagatatagtttatcattcgcttacattctaggcaaaagcaactacatcatttattgctgtagttattgttggcttaaaaaaactagagaagtgttgtacctttgttagagtggaaaaccactcactgcttagggcttgcttctgtctcatcttcttgtctttatttcttaacatacattgaacccctgtactatatcctctgtggttggttatatgtaatacaaagctgaatacacatactccctctccttaagatgtttagagtctagaacagtggttctcaatccagggcaatgtgtggagacattttggttgtcgctactgggggaatggtcttgatacctagtgggtagaagttgctaagcatcttaaaatgcataagacagactccacaacaaagaattatttgtcacaaaatgtcagtagtgcctaggttgggaaatcctgatctagagtagttttagtgaatagaattttatctgcttatgggaatgttctatatctgcaatgtcccacatgatagccaacagccacatgtagattttgagcacttgaaatttggctagtataactgaggaactaaattattaatttaatttaattttgattaatttaaatttaaataaaaaagccactagtgtctaccatattggacagcggcagtctagaagaagagactgataagttaactagtgattacagctctatgtaagataactcaaaaccaaggcttgtgacagtagttatgagaacatacagaaaaaggattctgaattaggctgaggcaagaggcagctttccaagaacatagcacacagagggtgattcttgagctaagtgttgaagagttaaaatgtaccatatatgcctatgtataaagtggcttggaatatttgatgatgatttgattccccccgtccacctaataagaagattcattaaaatactaggtgtaagcagccagatgtggtggctacgcctgtaatccctgcattttgggaggccgaggagggtggatcgcttgagcccaggagttcacaaccagcccagccaacatggcagaaccccatctctgcaaaacattttagaaattagccagccatggtggcgtgtgcctgtgttcccagctactttacaggctgaggcaggagcatcacctgagtgagcccagaatgttaagtctgcagtgagctgtgatccacaccagtgcactccagcctggatgatacagcaagactgtgtcccagaaacaaaacaaacaaaacaaattgggtgtagggtcaacttggataaacaacctcttaggggaaaatgcctatgcataatatatttttttatttggttatacaaacatttaaaattatatacacatacgcacacgttcacatacatagatacacacacgtatcttcctatatccatatatattcatttagaaatatagatacacagttaacccttgaacaacatgggtttgaactgtgcaggttcacttatacatggattttcttccacttctgccactcctgagacatcaagaccgacccctcccctttcttgttctctcaagcctagtcaatgtgaagacaaggatgaagacctttatgatgatccacttccacttaattaatagcaaatatatgtttcttatgattttcctaatgaaactttttcccgtagctttcttcattgtaagaatacagtatatggtacacatatacaaaatatgtgttaatcaacaattcttggtatcagcaaggcttgcagtcaacagtcggaattagtagttaagtttttggtgagtcaaacattatatgtaatttttttacagtgcaggggtttggcacccctaaccctccatgttaagggtcaactatgctacatttttaaaatttcaagctgaaagactcactttggtgtttcttgtaggagaggtatagtggtaatgaactttcttagcttatctgggaatgtcttattttctgccttgtttcatgggacagttttgctaaatatagaattcttggttaacattgtttttgttttagcactttgaatatatcagccactgggccttcttacctccaagatatcatatgagaaaatggctgataatcatattgaagatcccttatatgtgatgaattgttactgttttgctgcttttaagattccatctttacctttggcttttgacaatttgaatatgtctcaggatagttctctttgagtttatcttacttgtttggtgagcttcttggatttgtagagtcatgtttttcatcaaatttgggaagttatcaaccattacttcttcaaatacactttctggccccttcttctctctgcttcttctgtgactcctgcagattatgttggtctgcttgatggtgtcccttgagttccttaggcgctgttcactttttttcattcattttcattcattcttctttctgtttctcaaactcagtaatttgaccttcaaatttactaattcttctgcttgcttaaatttgcttttgagccccctctattgtattttccattttacttattatactttccagctccagaatttcttttggtttcttttttaaaatttctctttttgttgttattctcattttgttcatacattgttttcctgtctttgtccatgacttaccctagatctttgattaccttaaagatagttatttatctggtaagtccaaagtttaggcttcctcaggtatgttttatgtcattttattttgttcctttgaatgctctgtactttccttttcctttctatgtcttatttttccattgttgttgaaacctggacatttgaatcttagaatgtggtaactttggaaatccagttctttcccttccctagcatttcctgtgggttttctaactgttgtagggtgtgtctgtgccagggatcatcccaaattgaaatcttaagatcttgtgaggtcttttctgagtctgcatttcaccctggctatgcatggtggcttcctaaatcccctcatctatgcagctgttttgaatagccaaaaaaaatatgtgcaattcttttgaatcccttggaagctgcttcagccagtggaagttgaaataatgatatcaaagccttatcttttactaaagcttatgtaaaacgttaaagctaaggaatctaccttaggacttttccaaaacgtgtgtatatacaggttttccaaaacgtgtgtatatacaggttttccaaaacgtgtgtatatacaggttttccaaaacgtgtgtatatacaggttttccaaaacgtgtgtatatacaggttttccaaaacgtgtgtatatacaggttttccaaaacgtgtgtatatacaggttttctaaaacgtgtgtatatacaggttttccaaaacatgtgtgtatatacatgttttccaaaacatgtatttatacatatatatatattccaaaacattgtattcaatcccttgaagcgagtgtgtatccaggatacatatatgtatatatatcctggatatgtgtgtgtgtgtgtgtgcatatatatatatatatatcctggatacacatacacacacacacacacacacacacacacacacacacacacacatatatatttttttaagagacagcgtagctcttctgcttaggctggaatgcgggccacaatcatagctcactgtaaccttgaactcctacgctcaggtgatctttctgcctcagcctcccaagtagctaggactacaggtacatgccactgtgcctggctaattaaagaaacctttttttttagagagtgtcactatgctgcacagactactctcaaactcctggcctcaagtgatcctcccacctcagcctctctaaacactggtattacaggcatgagccaccacacccagccagatatttgttaaattataataaacaatagctctacaaacttcattttgtacatactgggcttctaaaatgaaatgatttcagataacaatttgaaacttatatagggcctcaggacattcttgataaaacctcagaattgaaaatgcaatcaggtattatgtgtaattaaagtcaggctattttaacttgcctcattaatttggagtttataactatattgacaatatctgcagaaaggatttgtttagcatattaatggtttagacaaggtccaaataatgcacacctacaacaaacttttaagcacttaaaataattttagaacctccttttgcatgaaaacaatttgctaaaataaattttatgtctatttgtaaatttggatctcatatgctctctacttagaaatattccaagatcctcttactaaagatatagtcgtgcaccacataatgacgtttcggtcagcggcagaccacatatacagtgttgataccagaagattataatggacttgaaaattgtttaatcatgtagtgacgtggtagccatccaaacatcatagcacaattaccttatttttaaatttcctttagcctaagtgtacagtgtttacaaattctacagtagtgtgcagtcatgtcctaggccttcatattgactcacctctcactcactcactcacccagagcaacttccagtgctgcaggcttccttcatggtgagtgcctgtacatgtgtaccattttctatctttttatttttttgagagagagcctcaatctgtcgcccaggctggagtacagtggtgtgatctccgctcactgccacctccccctcctaggttcaagtgatcctcgtgcctcagccacccaagtagctgggattacatgtgcatgccaccacgcctggctaatttttgtgtttttagtagagatggggtttcgccatgtctgccaggcggctggtctgaaactcctagctagcctcaagtgatctgcctgccttggcctcccaaagtgctgggattacaggcatgagccatggcacccagccattttctatcttttatgctatattttactgcacagtaaaactgtttcgaaatgtttagaaacacaaataattatcaccatgttatagttgcttaaatgagtatacagatttgtagtataggagcaataggctatactatatggcctagttgtatagtagactctactatgtgggtttgtgtaagtgcactgtgtgatttgggcccaacaaaatcacctaaggacacatttctcagaatgtgtttctgtcgttaaatgatgcatgactgtgttcaaactagttcctcaaattagactggcagtatttattcaccatagctcaattatgccagtgtttaatttatttgtctgctattttgtaaacctgaggttttgtaatgcatttggtttggtccatttttaagaggtaagaaaatatatgctttgtagaatttttatgttttctgtatccaatgaacatgttctcccaagagtcatgatgttttgaaggatgctatacaagttaaacgtcatcagcgatcttctcagccaatgcgttgctttggcacatgtaaatacccactaggcattgtgtcctgtgtgcaactctgaaatggtgactgactttcgtaatgcgatttatctgcaagtgaaggatctaacatctctgtagttcttccacccttttgcctccttgacctccagtaaattctggcccaagagagagtgacttcagaaaaataaccacatatttagtaagcacctactatgtgtaaggcaccgtgctgggtgcccgaggtgatttaaatatgatagtgcatgcccctgacttctaaaatcatatttgggaggcaggaaaacaacaaacgtatggtaccacagtccaaagcagaggatacaggagaatgaaatcgttactgggagtgaggatattaaaataacagctaaaaaatattgagcacttaaaaagtaccaggtacttaataggcattatatttcatttaatcctcacatcctaactgttaaattttgtccctgctttaaaaggaggccctaggtgtggagagttcaagtagtttacaaaagactacttgagtagttcatgttagtggagctggggtttggatcctcatctgatacccacatgcttacactctgccctactgaaaacttcatgggagagaccaacagaagacagaccaccaggcattgtgagaggtgggcatttggtgatatttttccaaaacacagatcagcaggcgttgtgacacaaagacaaaaaaagtgtggacgtattcagggaatgtgaatagttaattttgtatggggggcggggcgcggcggtatagttgaaataggctgtacagggaagtgagaatgatgttgtagaaagtgtagaagtgcacacctgaattcactggttgtgcacacagccttggagtttccgtcacgttgcatggagatatgttgcatttgcagagaatgtgacaagaattgcagcccctggaatggtgcaacactggccaccctggatgaggagaaggttataaggcaactcaatcacatagtatacttcaagggtcccgggctaaagggatggtggtggaaacagatgagaagagaagcctcaggcttgcactagttggagttgctggatgagggagaaaggagagtctcagggatggtagggtggtaatagcataagcacacaggagacacaggagaagggatgttcttaggaggaggcccgtcatgagaacagcctgagtgtgaagtactagtatgctgggaataccccagtgaaggtgctcagttaggctgctggagccattctggtgtagcaagtggtggtgaggttgggttttcttttctttttgagtcatggacagctttccatgaccattttggattctcaacaacaacaaaaaatgcatctatttatgcatatattctaacatagtatcaggagtctaatgaatattcaaactccctccatagaccctctgtgcctagcttaacaatgcttaggctaaaaacatagatatttgaagccatatatattagtgggtaaatttactggaaaacagtatgtaaaaggaaaagaagggggaggtaaggtcacaaccttaggaaatgctaaacttcaggtgccagaaagggcatgtgggcagtggtggggggtaggaatcctcaggacacatgcaggaggaagaagatgaacctgccatttgtagtgtcctaggagcccagggtctttccaccagaaggctgtgctcagctgtgtaagaacatacaattgggaagatcatgactgaaaaactttagacttgatgagttattgcagttcaatattatccttcccatttttacaaataactttgagaaaagaggtcagattttaaactgaagaagagctggttgtgagaaattagagataatacggaatcttattaatttggtgtcacgatatatagtaatttttcactaatttctgacccaagaaaataagcaattagtagtaactaccatgctgtgtttggctctagagggcatttaaatataaaaattgggtaattttatgtatgttgtacaaataagtttcattttacaaatgagttttgccaaatattttacacacttctagtatccataccaaatctttttaatgagctctaaattataaaagtacaaaaagccactggaattgagaggatgtttgcaaagaaggaaatcctgtggtataaatgacccaaatttatagtattttcaccatactgtaactagattgaaggatttttctattgcattttgtaatttggggaaaacctgtttatttcttctgtcagacttctcttaatcggaaatatttatagtaaaatgtacacaaaaagtactttttacattataggtcattttaaagttaacagtattgaaatatttaaaatataggcgaggcatttcactgaagtttttacttctatattattgtaacctgacttagcatctcatataagaaaaagcaagtctccaagtatgtaaataaatttcaaacatgcttctacttttggtttatttgtatattcatcacaaagccttaaacattaacagataattctatttctccttttttcatctttgtcatctattggaatattaactgttaagtaattttctaattttgctaatctagaaaaatatcaatatttttcttgaactatctcatgactatgtattgtttccacgattcctttctactcttggaattcgtcagattattaccggagtttgtatatgtatttttttccctctttttcatcctaacaaactcacttcctgtgaaaataatcagagcactgtcaatactaccagggatatgtgacctaaatcttaccccaatacttctcagaatgatgagtttctaaatgtgtttgggctttgccaagccatcacacactttaaaatatagctatggttttgaatttccaaatgcattcacattaagtaattttataatgttgatattttttaaatgggaaaatgtgagttgggtcagaaagctacctttcaccctgagttctccagcttggtgacgtgtggtaccatttcattatgcaggactcagtgaacaagaagtcagttgtcatagccgtctgtttcctggtagtttacacaccagaaactgaaatctgagaatggtacttgaaggaaaacaaagagctttacagtatttttttttcttttcaggaaaacacacagaagctaattttagcgtcttgatcaaattgacccagcctttaaccctggcaaacgttaccacgacacacttccaatagacaatagtttgcataccagcattgcactggaaacagatgtgcatgcagaattggcgtcccctcccccgccgcaagactgagcccgccactgtcatgaaagttgaaatgtggtccttcctaattggggaaaaaactaggtcttctttcaaatttcaaactacaagctttcatgacttctttaaaaatttattatgtcacagttatgttttgaccagagtttcaaaatatcattcactagagaaacatctcttggctttagcatgatttttatcttggtaaaaaaaaaaaaaaaaaaaaaaaaaaacaaataaattgttagcagctgcgctattcatgagtgatggttacacagtttatatattaaaacgtttggaatgtgcacaattacctcttttactttctcaccaggtctcctacagtttatataaactgcatttttattaccaaagaactgtccgtctttccctccttatcctcgcccatcccagcttggcagagtttgctccctaaagcccacgacagcgagctgccccccgtccccacccaccagccgcggctcccctggcagtgttgaattcagcctctccgctcaaaaggagctgggagggtttgctcagtttaggattacttagcatagacccttctcagaacctccgggagacccactcacttccgaaatgcaagagagtttttccatttttgccgagagacaagaaacaaatatctgtgtttcttgagcaatggaaaaggatgtttcctgtctcatttgctgtaataattgcttctctcaaaatatcctttcactctgggatagctataattggttgcagtatatgcatccatatatagagtccatgtatacaagacacaatgaggtggcattttgtaagcatgttccataacttaaaaatatacatgtgtttagaaaacattggccctgtgacttctctgaggccatagagaagttagtgacaggcaggcctgggctagagccccatgcccatgcgtgcaggaccacccagtggccaggagcagagatttctatgttgtaggcagagaaatctcaactgataattcatatttttaaaatatgaatttaggggaatgcatcattgtttaaaaagcagcaggcttgcagttataaagcactatgtaaactatagtgcttattagaattttggaaattcagtgaacttactcagttcaaaagtgagttgttagctctctacaatattcttgtctctaaagaaataatgagtgctgcttattcctgtaggtgaagtgtttacattaaaacgtaaacagaatttgaggattctatttagaattataattcatctgtatggaattgcagtaaacagattttggactactgaaacagtaatttcatgtgagatatattaaatgcaaaagttattctaaattttatagggtccataaataaccattagtcagatacccagaccgaaatgttatttcttatatttgcaagttaataaccaatagctacatttgaactttgtgaagggaatttaaactattttcctggaatttttgtttgactgccaaagggggaaaattctcattggactttgattgtgaaatccagtgctttttgtgtgtatgtttttactaccaaagcattctttatccacattttattttttcataataaaattcatgcctcttctttcagtaacacatgagtagcagctaactaccctaagtacttttcccctatttataatttatattaaatgttttcaagattttaggtttcatttcattaatgctaagtcagaaatatgtatttataaactataagaaaaactagaaaatgtacaatatcataaaataattgttttcagagagctttttatattagtaccagacagaaatgtttgtgtgatatatgtagttattgtgtagagtgtaccaagataaacactcaaaattaatgtaatactttctgcttagcatgaggattcctaatctgtatcatactattttattttctttaatgattttatcattacagtgaagcaaggagacaaacattactcctaaaatgtctacttgtcatattctatctctatgagaaacataacccaaggtagatatatatatatatatatatatttttttttttttttttgaggcagagtctcactttattgcctaggctggagtgcagtggcatgatctcagctcactgcaacttctgcctcctgggttcaagcaattctcctgcctctccctttcaagtagctgggatgacaggcgcctgcccccacgcctggctaatttttgtatttttagtagagacagggtttcaccatgttggccaggctggtctcaaacttctgacctcaagtgatccacccacctcagcctcccaaagtgctgggattacaggcaggagccaccgcacccaggcccaaggtagatttttaagtggatataaagaaatatctttcaaagagaagagcttttccatgtgacttttctgatacaccaaggtacaactcagtgcttttcacagaaaataatgaatccgtcgaataaaaacatttgagtttattaaaataaaccacttagtaattgcagggtataacacttgggccttacctgcattaactttttatttctctgagtatgtaaatatatatgtgtaaataccagcttctgtgtagtcatgccgcttttcttaggtgtggccactgctaagttactatgatgagtctgtttttcaaccttgccaagttaaaagaaaatgtagactcatttgtattagaataggaaggcatgttctagattgcagtctgtcagtagcatcttgtatgtgagtgtatgtgtgagagtgtgtgtatgtgtgtgtgtgaaggagcagtgtgttaaatatatatgtgtaaataccagcttctatctagtcatgcggctttccttaggtatgaccactgctaatttactaatgataaattttttagatatgctttagaattaaggtgagtggtattatctctagtttgagacaaagagaagcgaagtaacaaaaggccacataagtgataaatagtggacctggagtttaaacctgggatccccacctaaatcagaaatacaaaatcaaccacttttttgatgatccagggtctatgtatatttattacatgtatgtatatatgtatatatatatgcatgtgtatatatgtacatacatacatatagatgtgcttgtactagtgtttttcccaccagatagttagcctttcttctccccttgctcactttttttttttttttttttgagatgaagtctcactcttgtcccccaggctagagtggaatggcacgatctcggctcactgtaacctccgcctcctgggttcaagtgattctcctgcctcagcctcccgagtagctgggattacaggtacctgccaccacgcctggctaatttttgtattttcaatagagacagggtttcaccatgttggccaggatggtcttgaactcctgacctcaggtgatccacccgcctcggcctcccaaagtgctgggattacaggcatgagccactgcacccagccaaaggagaaaacttttatttagaaaaacttaactttcactcgttagaaaaacgtgttttgataatctaatttttaaaaatgcattaactatgtcttatcttggctaacacattttagttgacctggttatttcccagaaatttaacagatacaggagatatattcatttttggtaatatttatacctgtcgtcataccataaatatgcatcatgcattaatgtgcattcagattatgtatttgcatagttcagtcttctgtactttctatagttttcaggtgggctagtgattatggggcatacttttaaggcaagctctgtatttcagaaaagtaaaaagtggattcactttttccccctttttagctttttgcaccattacaatttttctttcctttgcagttctccattaaaaaaagaaagaaaaagaaaaatagttgatcattctgttataatcttccttaccgtactgggaatgggttgcttttcctgctgttaaccaggcttttacctccgtcctagggtgcagacccttgaagtattgagagagtcaggtcacgtgaatagcatgcagattgtagactccccacaaaccaaggggtgctcctgacccagcttcatctggagctattgccctcacaaggacagaagcaattaaattgtttgttctgctacagagtaaatggtctactgagaacttgtttgtacttttatatgtttttatggttaatgttttcagtgacccatgttataaagtaaaccataactacttctgtaagcatgttatagtagtaaagcaaaactgtatattcctagatatttatatcacttcactcaaaccctcggagtaaaacttaaaaaagaaaagatttctttccaaacatttcagttagaaactcaatttcagaaccttggcagtcttatgtataggctttcttacatgattgttgaataacatgttattatacgtggggggaagaatagttcttttgttggctgcattacattttgtggtgaaattggagaaaacaaatcattaaggaagtctattttggttcaagacattacacacttatgacgagtctgtttttcaaccttgccaagttaaaagaaaatgcagacccatttgtattagaacaggaaggcatgttctagattgcaatctatcagtagcatcttgtatgtgtgttatgtgagtgtgtgtgtgtgtgtgtgtaaaggagcaatgtattaaatatatatgtataaataccagcttctatctagtcatgccgcttttcttaggtatggacactgctaatttactaatgacaaatttttttagatactgctttagaattaaggaaaaaaatattttctcgatgaaatgttaaactctgtgacaaccccacccagacctgcttttctctggcagttttcctagtcttccaaactctaccaccccccttccattgaaactcctatccccacctgtgccttatggtcagcagacaaaaagaaagacctccaccactttaaaaaaagaagaagaaggagaaaaacaaatctgtatttgtttgttgcagtttgtgagcagagatagaagtatgaaaagaaatacactaaactttacatgttcattaattggttgaaaaggtggagaaacctgttaattctgtgcacttctgtgttctttgattaatgacaatgagaatatattacttttatatgagttataaaaaacagaaaacaaagcaaaatcgtttacagtatactgagaattcccagtactgtcttccatattacctctttggataatatccgtattttagaagggagtgctgccactgtatatgaataaatcgaattaatggtggtattttgttgggtccccatgatacagtcatcagtgaacacctgagctttggaatgagacaaaattggaatccagtcataaatcagtcgttttatgtgatttaagactcctaaataagctctctgaatccatttccttatctggcagtcataaaaatattatttctctaaggtggtacaaagatgagataattaaaacctgctagcacatggcagatcttccataaataccacctgggatgttgccaagcacacagtaggctctcataaataccgagtgaatagataggcgaatgaatggtcacttcttctcccaccctctaccgcctaccctatcccaccaccttcagggtcagatcaaggcaggagagcaagcccccaacttggctcagcgccctcactggtggggcagtgagcatgcgtgctcgtttacttccccttgcagagagccgggaatgttagcaaccatagtgtgtcagaggtggggaaatggatttggtgtcatggatgaagactttctattcccagctgaagttcttccttttcctctttattttgcaacattctgtcagctgttttcttgtgaaagaaatctggaagagtgaaaacaagaattgacatcaggataaggtgtaaaacaggcagagggtcatcaaaaacagctgagctaacgacagcacgctctctgtagaatgtgtcttggccttcttcttgtgttccttttcatttaaaaaagaaagcaaaaagaaagggattggaagtctcatcttttgccttgtgagtgggagtgggtttatgtttaaaatctcacttgaacaaccttatagattatttttaataaaagatgtttgaaaaaagcatgtggcccatcacaaaggagaaaacaaaaatttagactgtttttcgtttggttttcacataaatggattattccatggccatattcaccaagtggaaggtccccttttaattccatataaggctgttgcgcaggtctagggatctattcagtgggatcaataaggttgagaccacatgtagccttcgtttagaacttagcagtaaaaatgaaggcactgaaattttctgctgtaactatttttctccagaagtacagaagttatataatactttgtgaaaatatcccttattatatacatttgcatataataacttggggtaaattttttacttatatggctaattgagactctaagcctgcctaaggtgaattgctgaatttttttcggtagatgaattgcatttttattgcagacaatacatgcattgggtgacaaaatctgaaatgatctgaagtatttgaacacagagtggagccccagctttctatgtgaaaaagatgtactatgtacgtgggagattaacccacagcagaatttatttcatcttaaagaggggtgttttataacatgattatgtgttttgtcttagaatttatgatactttattgcatgcctgttgtccacaaatgtgacctattttgttttccatatttgatttgaaatagacacctttctttccttagtacaagtcaattaaatacagaactgttcctactatcatttttaattggaaactgaaatatcaggaaatgttacagaatcatgaaataaatgccagttgtttaatttgttttatataaagaggtttagagactgaattataaaacaggattgcttcatataaatgaattttgaatatatatatatttacgtacacatatggcatctaaagatttagtataattaaatatgaatataatttttaagttatcagtcaaatatatatattacatccatgtgatatttcttcataaaaacacaaaataccttcagattaaatctgtatcttttactttagagttccttaaaactatgaacatgaagttgctcaggtcttcataatatcccacacgtgtttaacgtgctctcttgcctcatgtggcacagccccaaacttagaacatacagtgtgggtggtcctgagggttccaaaggcagctgcgttttttttttctgggtgcccttatcttgagtaatagtgttgaaaacattgtaagacttatcagaatgttccagtagtctttatagtcccaaaatgcacacctcttttagaaaagaaagaaaacaaaaagctgttctagccgtggtcctttgagtgtgggatgcttcttcctgtagtggagaaggtgcctgtctctggtacaggcactcctacagctaaggagaatgaaagcctcccagttttgctaactaaaaaccttcttgtagccacattgcatttaatcagactcttatgctagaactgacattctgatttggtttaaaattatgtggtcaatcttagtttttcttatcaacatgtcagaatctgctgaaatgaaagtggaaacacaaatcacaaataggctccaggttcccttagaacactgaacttcattttgaaagtacagcacagctctcataatgtcagttttcaaaatttactcacatgaagcaattagattttacaattcaggctctatatgtctttatataagcccgaatattactgtttatgttaagcaatgcatggaatctattctctgattttccccctaatatttcagtttccaattataagacaataagatggataattctgtatttagttgactcatactaataaaaatctaaaaggaattaaaaaaaataatacatgagcacaaatcagtaaaggctttattactagaggaaaagtcagtggatcgctcctaccctcttacttgaagaccttacgtgtcgcatggggatgctgtaatctttggaaagatgctcttatttaaacctctggagctctctctgttttctcaaccatccattattagctatctagaactaattactctcaaggcatcactttaggaattttatgattctttctgtctcctgggacatcatgtaaagttttcaaatgataaaagaagcctcaaaaagttatttctttttctcaagtcaggtgaagataggaatggctcaggagtagcagtttctaaaataacctcacttaggcattgagcgctgggtttctcttctgaaccttcatctaacgaacgctttaaagtgattagcttagaaaaaaataattcttattctttcccaagattcttgaaaacatattgattcttaatatctaattttatttcaatttttttaattaaggtttttttttttttttttttttttttaagagacagagtcttgctctgtcacacaggcttcagtgcggcggcacattcacagcttcctgtagccttgaactcctaggctcaagtcatcttcccgcctcagcctcctgagtagctgggactgtgctcatacaccaccagacccagctaattaaaaaaaatttttttggtagagatggggttttgctgtgttagcccagctggtctcgaccgcctcaagcagtcctcctgccttggtctcccgaagttctgggattacaggcatgagccaccatgcttggcttaataacttattttagaagcacctagagaataataaaaaagataaagcaataaaagcactaacaaaaataaatttctgttcccagtatacattctttttgtactgaagtctaagaaatctacatcaaactgagccttttgttttcttttcaaaaacagatgaaaaaaccatctacctcctcttcaatgagactgagaatttacactaacaaatctcaaacctggttgcataataactgcagcttcctcagcccctggtttgcagatcctgaatcagtcggtggggggtttgggaactggaatcgagttgtcctcctcctgttctggtgtctctgacctgctcccttccttttgtggcttctcctctgtgtcccctttgctgccccttctcttcctcttcctcctctccctctcccccttgcctttctttcctctgccctttcttctttttttcccctcagatcctcctcctgagtttcctagaagattctacagctgccaacactgggaacctctggtttgctctacttttctaaatttactgttagcgaaactgtggaggccccagtaggtaatcctctggtcctagtttatggactgaaatcccccttctcacgctctcttcacatcagtcaccagggtcctgggcctttctttaacttgctctgtgctcggagtcctgtgtactttgctggtcctgtttactctgcctggactacacagcctctccctggcttgtgagctcctcctcgttctataaggtcctcctctaaaatgttgcctctgtgagttttgcgccaatctaccttttacaccattcaaaacgaattcctctctctgcggtacttctatagcactagtgcagatctgtatttagcatttattagatcttaattgtagatctcttcccctacttgactatgattcctcggacagtagaaaggtatcatttgtatatttccagcagtgtacctggaacatagtaggtgtacaatgaacattggttaaatgaatatcagagcttttgattctaatatgaaaacagagctttttaaaattaggtacttaatttctagtggatttgtgttagatagcccaagagaattctgtggacattgtactgtaatggaccatcaaacttactcaaagaattgcagatagcaaaataggaatagaaaaccagtacatcactgtcattaaacgtggagtgcctactgtgtgcagtggcagtggaggatgagcagtatttgcatctttcagtgaggcacgaaggttgtgcctgtagatgtttcaaatgcttgttgtaacaggaagcaagacacctctttcccgtaagtctccagaaagcattgtgaagggcttcagttgaaaaaaaaaaaaaaaaaagcttgactagtctaaatattttaattattgtacaaataagattttgtgtcttaaagatacaataaaatgaaataatctactccagttaaaagcagtactcatttatttcatttattgaaggtgtttttaatcacctactctgtgaaaaatactggagaattataactagacattaataaaactcagctgataaggcttccatgacttgtttgtccaaatgtctattcatggcagttcaaacttcatggcatcatactgaatattagaaaagatcgcaagagtatgttcttagatgacttttatggaaaaggacatatttctttttgacaagggtgaaagatcttaaataattattttatcatttcaacttcagaaatatatgagcgtttactcagcacagcattgtcttgtggtcagtgaagtaatcagaaaaccaaaagaagactgtaaaagtctttcctctaaacacaggaccagctctcatcaagattctgtttcatgttgtcagaatcttcctaaaacaattacaaaccactttacagcaatactgggagagggaaaaaaaaaactaggagaaaagacaagctcatgcctaagtatcattgtgagatacttcccgtttccacagaaaatgccacaaggatacataattgccacaaaggtatgtttttagtttccattattgttctgtttaaaagccaaaatgcctaactttgatcattaaatggtgttctaatgaaattagccacagtgataaaggaataatcgttctaaatgccaatctgatctcgccattggcctgcttgtctgcaaggttatgtccagtcatctcctttggctgaggaaacccttagtaattttgacccctgccaaccttccctcttcccctcctccctgtctgttccctggcagatcaggctcttcacgcctctttcacataccctgctccccctgccataaaactgctcctttcagccaggtgtggtggctcacgcctgtaaccctagcactctgggaggccgaggcaggtggatcacctgaggtcaagagttcgagaccagcctggccaacacagtgaaaccctgtctctactaaaaatacaaaaattagccaggtgtggtggcacacacctgtagtcccatctactcaggaggccaaggcaggagaatcatttgaacccaggagatggaggttgcagtgagtcactgcactccagcctgggtgacggagcaagactccatctcaaaaaaataaaaataaataaacttctcctctgccccctgcctattcctcccacttgtcctgcccacctatccagctgagttccctccctctggtgtgccccatcccacacctggggctgctctgtgacagcacacagtgacatacgcagttagccagctccctctcctctggaatgtgagctcctctaggggagggcagggctgtgccttattaatttcaataccccacccccggctcaggggctaccacatagcaactgctcagtgtagttgagctgcgtaaccgaaggaactgttaaccacatttaagaattaatattggttattaaaaataaccctccaatgtttatctctgtgacacttgataccagtgtctaccctttgatatgtgcaaataagactataaatataaaatatatttcaaagtgaacctgagttgtattgtaacgtatcaccctccggttaccgtaaatattccatgcgtggttgttgcatcactctccctccattcccctgaaaagagaaaagattctcttttcttttataccaagattgtcttttcaggatcttaatcctgatctgttcttaggatttcagaattctttcactagccctcttctttgtcactagttctttaatttacacagttggttggctggttcctgttactcggcctacaaatctgtcctatgtcatctcctttgagtaatttatatcctccataaaatgccacgtagaggcactttttcacatttttgagtaatggcgagaaagaatcgccttgggaatcaaaaatccaatgagtcacaagattattttgttatttatgaccagagagtggtcattgacaatatttggcaattttacagctatgagcctaggctattgtgctttagaatgtaatttattaagcaaataaaactcttactggtaatgggttctgttaaacctggggaaccacgtgagctcccggccggtacagctgtggaagtttcatagtagccacatacatctcagatgtctggacactagtattttacacttacttcatggttttatttattcagttgcctttatattcttgattggattctgaccaaccattttggtttaagaagtcatcaactttgagtagtgagggaggagcctggagaaaataaaatgaatttatgttgaaaaaacataaatccctctttcattagatatgacatttagtaaatccaggctataaagaaacaccagatgtgttcatggaaagtattgatataaaatcatctttgagaaagaaaaagataaggacctaaaatttccttaaatactaattgtgtttaattccattaaatatagacacagagataggtaaataatggatgtgtataggtgtacacacacacacacacacacacagagagagcatgcactagtgcaaagaagtctgagtgagcaagcttaggattttttttaaaaaattactcatttatatcagtagtattttgtaatgttgggttcagtttagtaagtaatggaattctagctattatcttttaatatgtttggaggaaaggaaaatcttgaaattctcaagataagttgatctttttctaaatggcaacattaggcaatattaattttttaatattttaaaacttgaaatttatctcctttgatgtaaccattgtatgtatgtacctggcacctaggattagagaaattcagttctgtactaaactgtatgaaacactgtcaggaagccggatctaaattcaagctctaaatagtgatcaataagaaaattccatttcttttgaaagtaagttctagatgttcagctagctctctgctctacaagtcattcatttaaccgcaccgtagccattgcctcatgtctctgtttagcaagaggtggacaagtaagacttcagtatgtgtggtagaagtggcaataataaaaatgagattagaaggaaatgaaactagttacgtgaccttcaggactacctttaacttagccaagcctcatcataaggaaaagctaagagcccccaattttccaactaacagtcatcatttgccctgagaaataggatcaaaccaacagcacggcagcaacttgttcattcattcaagcatgttccttgttcctggtacctgactcaccttaggaactgtgaacacacagttgatcaaatacatgacaagaagttatcagtttaatcagggaggcagaaaagcgtactgcaaattacataatacagtgggaaatggcttttccttatgaatttctagttatttatatagtctagaaatgaagtcctctgctagttatgtccattgtaaatatttctccgaatctgtggctttccttttcgcttccttaatgctctcttttgatgagcagtttttatctgtcatgaagtccagtttataatttttttcatggttagtgatttttgtgcctttaagaaatatttgccttaatccttatgattatgaagatattctgtgtttctttgagaagctccatagttgtggctttcacatttacctctatgatccactgctaactaattttgtgtgtgatgtgagatagggatggagattaattactttccacatggacatccagttgctctggaatcttactgaaaacacctcccttggccccactgaatggctttgatggtgtcattcagttaaaaattagaataatagatacatttataaaaactatcctaatgaattctaatgagtttatggtataggtattgtcaaaacaagggtgaaaaatggacacagtttctgccctcatggggttcacagtccatgggtctaccccttgattaagattgaaacagggacaggattgtatgagagtaacaatccgtcagcttaagcatgggatccctatcagtaaatctcactgcctctaatatgttctttgaatttttaaactaaatattgtgactaaaacaaaacaattaggctgagtgcagtataatcccaacactttgggaggccaaggtgggaggattgcctgagcccaggagttcgagaccagcctggacaatatagcaagacctcgtctttacaaaaaatgtaaaaatttgccaggcatggtggtacagacttgtagtcctgcttctcagggggctaagacagaaggctcacttgagcccaggaagttgaggctgcggtgagccctgattgccacaccgcactccagcctggacaacacagcaagaccctgtctcaaaaaaaaaattataattctgaaaatgctttttcaaagcataaaaactgcttccactcctctccccgtattgagatttttctggtctaaattaagacaaatatgcatattatatttatagcacgaagacagaatctatccataattcacaaggctggagtggttgaatgatgagatttctttatcctaaacctgatgacatacatatacagactgagcagtggctgtcaactcagaggaagaaccattagttggttcctgaagttgagagatatttacggttctatttttgaaaggtaaccatggcttaaataaaaccctgtgattcaatgctagtatcagtatgtgaaaatatcaacagagcctctttctcattttgatatgtaagaatcctaaattctaacctagacaaattcaaatctattatatgtcactgccaactattaatagctgtaataacagacggttttggtgtcaaataacaaaatggacagagtggaaacaatgtttaagccccgatttgttcagttacaaaagagcctacagactcgggtctcattaaggatttgtgtgtatgcatgtgcgtgcctgtgtgtgtgtgtgtgtgtgtgtgtgtgtgtgttcccatgtgctcgaggtctcttttgacagttgatagagcacccatcctgaaattcagtctttctttgatttgaattacattgacagcataaaccctaatctaaaggaatctgcctctctaatccaaaaccgagttttcaatttataagaacctttagtagtattcagtacgttagcctatgataagcaaatactaggacctgttttaatttttgaatgactaactccttcctccaatgtatgagggactaaattggacttggagagaaaagttgattacccagatacctttttaaagctttttttctttcctttgtttccttttttagagacagggtctcactatgttgcccaggctggactcaaactccttggctcacaagatcttcctgcctcagcctcctgagtagctgggactactgtctcataccagcaagcccagaacccacatatatttttatatacttaccacaattacatatatctacattttcatataaattgaagtttcataatgaaggagcataaaattggaaacaacctaaataccttataccagagtttctccaactgtttttgtctcagaactcctcttgacagtcttaaaaatgctgagggtccaaaagcacttttgcttatgtgggttatatctatcaaccatagtaggagataaaactgcaacatttaaaggatatttattcatttaaaaataacgtgataaatatttttatgaaaaataactgtattttcccagacaaaaatattagtaaagtggcattgtttcaaaatttaaaaaaatctcattaatgtctgcattaacagaagacagttgagttctcttaactgcttcagtatctcctgtatatcggtgaaagaatgtggatgccaaagaagtatggttctagtattatcataaaaatggttttgcccttgaagaccaaacgaaagcatcttagagacctccagaggtgcctggaccatactttgggaactgctgccctgtactgttagaatgcttatggtaaacatgttagagcagtacagcagaataccatataactctgtacagtggcatgtatgtgggggactgtcaatacatcaaaatacactttttagtaagatatgttcctcctggtcagaaaagaaacagtgtatcttgtaatactgtagtgcatatataactaccaggaaaaataaagcataaatgtcagaccccttcttatattaatatttaataaaaatccaacaacttagcattgaaccatctcaaagaactaaactaataatttaccttatagaaatctaacaatataaagacagagatatgagttctgtgttactgaagagagacccatcagctccaaaaatgaaataaagcaggtgggaaagttcacactctgttatagatggtaagatagctgtcttcatttctttttgaaatagaaagccactcaacttctttagaaggttggctacaggatacttagagaccaaggtttttcctcgaacgaaggcattaattcttttgaagcccttggaaatacattccattgagagcttagtgttctatgccttaaagtttggcagagatgactttagcctaaaaaatattaagggtaatatagttcagctgccattgaaaatgagcgtatgatgttaaagaattttagaaaatcacaaaatagaataaacacatttctgccatgtaaaaaaaaaacctattgataaggattcgaagtgagtttttaataaatttttagaattttctgtttgctggcttctttctataaagttaatgtataatgaagttctataattttaaatgaaagcatatacaattcatgacacataggagatctgagtgttctgtggtagtgaatctgctgaggcccagcacgcactgcagttctgattcactggcaaaattagcaataaagccaacagttttacccagaatcccaacagtggggaagaaaaaagcagagaggagaagtggaggtggcagacgccacagttaccagtggtggagatgagcctcagggatggccggggtgcgccacatgggcatctgcccgctggccagccgtgagttcagactgacgggaaatgcatggcttccacggcctctttagaaccaagctggtgtgcacaaggggaactcgccacgtagcagtgaggactggcaaactgcacagagagcttttattgttcttgcttctttagagcaaatgaatttacaaatcaaattgaccataaagcatttaaagaatgaagacaaaaaggaaacagcgcatcttattaaaaacaaaaacaacgacaaattaatggttaaagtttcgccttgaatttgagcagtcaccttatgcttagaatctgttttcttgtggtgaacagccaagttttaccttctcttttattgaaacccctaggattttggcacttctttcaaaatgtgtattaaaactcagagacactaaatcatacctgtgagcttaaagcagcaaaaataatttactgaccttattcaccccttcagttgcagcaaactctttactgtatatttcctgtaccccaagcaagtggagagtccattttttacttctgaacctctcctccactctctcccacctcatttcccctcagtgtaaccaaatattttcagcaactagaggcccaaacaatcttgttaacttaaaagttttcctgcagatttattgacccagcagagttaaacagggtaagtgttgatcaacacctctcaggtatttctttaattattggcctggcatctctagagcctaataaaaatttgtaatgtgagtttgtaataaagtaactattatatttatttatttatttatttatttggggacgggaagggagcattttggtttttctaaaggggagcctccaccttttgccataaattgtagctgtagccttgataatactgtggttgaacaataaggtctcaagggctgctcgctgaaagagattaaactgtaattaaactacactatgagtaaggagagacggaaaaaagaaaaaaaaaattgtggttttcataaagcagaaaagaaatacattgactggtgtttacagcccagagacgttttttgccttctcgactgcaaaacagtcttatttttagccagccagggttttgcaagaatgccgtatcaatcccacatttctgttctttgaaataattgcaccaagctggtcccaaatcagcagtaactaactgaaaagcaggagggaaacatttctcaaacatacagtgccgatgaaatttgccataacactatgagttatgtcggctgcctgcatgaggttccacataatgggaaaaaagaatttaactagatcttaattgaacatgcagctacataatatccttttgtttaggctcaaaaatggatttttttaaacctccttatcagcgcagctattaaatattgtggctctccagctatcagtctccgatcagcacagttagtgcattttaccttccaaggaagtgcactttgagccagctggagcacaagaaatgtaggagctggagaaagtcgtaattgaaacaggcgactgcttcagtacagacaggaaataaaaggaagactggccctccaatggattaaattagatgtttcaaattcagacagtatcaggaaaaagaagacttatgttagagggggaaaaaggtaacagtaagttcattcagcggagcgccccctcctccccgcataacacatgtttttgctggaatcttactgtgccgccctgtagggcagactcgcccaggcctacctcctgccgaacaacagcggagcaggtccctgtgttaatgtcacactatcctttctctcctgcctgccctctccctttcagaggcctttggtattctatttccataaattaggcgtgaaattatgttgggctgaggatacatgatttcagctgttttatagttggaaaggaaaatcttttagacctaaagcaaaaacatttttttaaatatacttcctgccttattagtttgagatatgcctattatagaaaatgcttgctgtgtagaaactttattattttttttggtctcacagattgctgtcttgtccttcagttcaagtaatattgattgagtaacgactataggcaagatcccagactaactggtgtctgcaaaattgtacattcattaggacagtattaatttatgggaaatgtaaattctcaaatgaagacttgtacctctgttgaaatatttgaagaagctgattttattttacattggaataatctactgaaactttcaacattttttcactttaggtggtactgcatctccgtttttctatttaggcaaatatggcctttattaagtacaatttgcttaaatatccaactcccaattttgttactggcaatgcctgagacagtggcttttaaggtcagtggctatttcaacattatagtgtccagtgccgtttttattcggggtgggagggtagcattagatgaagtctttctctgagatgtaaataaataaaccacaaaattcaacaagctaaaaattactgtggttcttctttgtcccctcatgaaagctgataaagttgaacagtatagcaagtggacagaattccaactttcaagcttgaaaatgcctttcttttctaccctctatggccctctgtgtgcggaaaacatagtcttggaaaaatgtggggcttgtgcccggggctgcccgccagagccaggcctcatttgctcaggtgtgctcaccgttttagcttcttgaattaagccctgggaaaattcctgtgcaaacatctgctccctttgccctgcctctccgacgggagtgaggtggggtggggaatgcatcatgtgagtgggttttgcatggaaaatgttgcgggttgcctccactccagctggacagctttatacagctataaacctttactgctgtattaaggttctattcaaagggtatgaatctctgatattcatggtccaacaaaactgttactaattacttatctactgaatagctaccaggattggcagcttgaataacaatcacaaaaatctgtgtactcattattctccaacaaggcaagattctcattcctgtaaggagcatagcttgcttttttgaaaactcatgaacaaactggaaatgtctacttgtgcccccttcctcaagaggccaccttgcatagcttcctcacagaatatttctctgttcctgaaaggtaatttcggtgcaggtctcatagaataagcacattttacagctctgggcaggctattctagtcacaggtcctcatggtccgggctccagggagcacctggaagcagattgtatcccccgagtgtcacttttcaggagcagggatgaagtggcagctgcctgctgcagagatctgtcacattcactaccctgaaacaggacacactcttcaagaatcaccaataaccagagttcgctcctccagcagttcttcccagaagtttactcagcaccttgacatcttttggtgtgactccattcttggaggtccagacccacctctgtgctttcagatgcagaatcacatccacttcttgcagctgtttgctgtgctgtgcctgcttcacccagggctaaggagctgatgataactgtgcagtgctctgaagaaatagatgtctaatcccagcactttgggaggctgaggcaggcagatcactgaggtcaggagttcaagaccagcctggccattatggtgaaaccccatctctgcttaaaaaaaaaaaaagaaagaaagaaaaagaaaaagaaaaattaattgggcatggtggctcattcctgtagtcccacctactcaggaggctgaggcaggagaaacacttgaacccaggaggcggaggttgcagtgagctgagatcacaccactgccctccagcctgggtgacagagctagactccatctcaaaaaaagaaaagaaaagaaatggttgtgagtaggagtcataagaacattctgctggccttttatagatgtctaaccctcctgagaaaggttggtgttactatccactttttacaaattagtaaactgagacttaaagagttgaagaagctcaccaatatcaatacaacctgtgtttggagttgctagggttcacaaccagagttctcagaatcggaagcttctttatttccatatatcatgttacttaaactagaccttattcaccttggaaacctaaattttatttcaggagaccttgtcgagaaggaagaatttcagaggccaaccaccatatgggcatcatcaagcagccctagtcaaggtgggaggaaggaagggaaggctggcctcctcttcccctggcctcctgctctcttcccttactgcaaagctctgaatcactgagaccattgcagctagctgggattttaattttttttaaaaaaagacattaaggtatgaatgacctactatcttaacccttggagagtctgttaatctaaacaaatctccaaccgatataaatgtgtgaggaggtatttgaagtagtggttgagttttcttgtgtgttcagagagggagtcccaaaattagtgtatctaggaacaaagtacgcagtttgtttcgtaggctgtaaccctgaaatcaacaatgtgtgttagtggcaacatacagcattaaatgggtagcatatgcatatatcaagagtcatcttctctggagtctccctccagttttaattctccctccctccccagcccctcagccaatttctcttgatttccttgctttgccttccttctttcctgacttctgttattctagaatgtgactagaaagtagggaaggaaaagcacagccctattttctcgtcttctttcacctatttcgataataatgaagaccttcagacttaaaagtatatcttgatcacagttttcccatttaaaaattattcccatcagaggtatcacaacttgaaaaagaaaactagaccaaaggcaggtggctgggagtcaaaaggcaccgtgttgccaaggcttgagctttcttagatatatgccatccactccagcatatcatcgttagagattaaatccataataaattggatgttttaaagagactgttttttattatctgaacattgaggggaaaagaaggagggagcgggggactctttgccagcgggaagcacagaactagctgcctcccctcaccacccgcaccctccaccctcgtcacggccagttctccactcttactccacctccagcccagatccctggctccagtcccttccctcgctaatctttgacctacacgatatcctagggatcggtaggagtaaaggtttgaaagttcctatttgaaaacaagtcttagtgatcaaaatgcctctttgctggctggtgaagtatggaccaggcccagaacaccctatgtttgacagaagtaagttgggggatttttaagttatttgtgttccagtactttccataaggaagaagtatgttttgaagcaagcaagatacaggtttgtgttgccaccagtgtgtcatagcctgcagttcacacacccggtgtaggtgtcaacaaagctgtctcgtattctccaacagtatgcgatgccaaaaccagaaaatgggatctgattgcaagggaggcactggcaaaacagaactttacagtgctcggttctgtttgacatttaggggacattcgcttggaggactcccaaacaagtaatacgccaagagaagggatggcttctgccttctcttggagattcagcgggtggctggctttaggcagaattacagagccttctgatccaaaggagcctcacgcttctacctccacatgggcctcactcacattccagctacgagaaagcctggatgctcttccagacccacccacacaaaaggtttgcacaagactcagtggttctacaggttctgctcttatctgagaactaagtacagaaacagtttcttaatatttctttaaaaatctggtttcttttaaaattatccactacagtgacttatatgaaaatcataccacagtgtggagttgcatcttgcaatgatagcttttaaattcttaaaacttttaagacaggagtgtgtgtgtgtgtgtgtgtgtgtgtgtgtgtgtgtgtgtgtgtgtgctctgtaattagaagtaaatttatacatcaaaatttaagcaaggttgttcttcagagtgcagtcacagttaatgaaatttctagaactttggaatgagtgcttttctgaagctggtacaaactgagatcgaaaccaaaactggaaaaatgtgaaaactttgtgtcctttgactcctttgttcaagaattgcaggaagatgttttccaggagtacttttgaatatataaaaccaggaaataactatgtgacattcctagcattagaactgaaaaatgagtcagagacaaaactgaaacaaacagagacatcaaagtgtctgttatcaaagtgcagatgccttgacttgttagcaaacctgtcctggtatatgccaaggcatgggatctggtaattatagaggacactccaagctgtgcccattggggtccacaaatgcacaccttcccttgtatttatgtgaatggtgtcccttggaacataatttctgagcttcctgggttcagataccggctctgccacacatcctagctgtgaaatgctggccaagtctattaagttctttctgcctcagtttctctctatgtaaaatgaagataatattcatacttacctcataggattccagtgggaaattaaacacattaatgtgtgtagctttggactgtgactattttaaaatgttagtaactctgatgatgatgatagtactgacatatacttgccactgtgcttttcattgtacaaatcaaaacatcacaaaacacttacttgagaggagctttcagtttcatagaaagtcagcataggtggacacaagtctattaaaatatttatgacctaagctcaagaaggaagtgagagagttctttttacctttttaacatgtggagtttaccagatacacctgtgcttatagcaggccagctataacatttaaatgacaatttttccactgactggggggtggggacgctttcatgacaaaactgtttcacctcagatcatcaagcattagagtttcataaggagtgtgccacctggatccctcgcacgtgcagttcacagtagggttcacgctcctgtgagaatctgatgccttggctaatctgtcaggaggcagagctcaggcagtaatgctcgcttgcaggctgctcacctcctgctttgcggcccagttcctaacaggccatatactggtactggtccctggcctggggtttagggatccctgcttgagcacacagcagtcatgatctaaggatcatttgttgggcatatagtaacaccattcttcctacatttttgagccatttgaataaacattcctcactgaatcagatcacttttttactgacttactgtaagggaatgggtaaagcatctgatgagcgtatcaaacatcactacagtttgaaggagctacatctttcctaagtgcagaggaaggaagaagcttgttctctgcttcctcaagtttttcgctactaaaacaaagtgagcatttgaatggaaaacacagcaaattaatattttatgattgttatttttaactgaagcgagagggtcagtgaattattatgttgctaatggagcaagtgtatgtagaagttcaatattagaagattgaaataaattttgagggttgtgatttgaagtcatattatcccaaggaaattttccaaaacagcatcaaatctgagctcccaaacatgacttgatcattatgagcatttggggagctttataaaattagagtttcctgggcccctctccagtatacctaattgcagtctgcaggcgtgaggcctgagaatttgtattttttaaaagtgccacaagggtctgaaaatacactaagagtagtctataacctggaccagcttcactttttatcctattttttgaagatctatcatactgaaaaatgacaagtttcatactttttcttacatagattttttttcctacatgtcttcctgcctaagatttaatgactacagatcccagatctcggtaagcctacaaggaggaactatgaggctgggtggacttccagagccagcattccaggatctcttccccagagccctgtccacagttcacagctgcagagccctccaggtcctgtggggttgttgaatagagaagcatacacaaccctgtgcttacatggggagaagaactctttccgctgaagccacacctctggttaccactttctcttccgatacaggcatcctgctaatttggtggagtttgtagagagaagagaactggccagtccccgccttccccccatctctggcctcactgtttattgggtcactgtgactatgcagattatatatttcggataaattattagcattcatctgagtgcttatttagggtcctgttgcaaatgtttcttgaatattttaaaattaaggagatgtttaaattgagtacactgaaatgtggatgactgttaatgtgaatgaactgctttcagaataagaacatttatttacaagttctttaaattgcaaagcttattataccattgaagcatttcatgtgaactttctgttttgaactaatctttaaattttatttgcattcaaagcatatttcctcctgatttgcccatttctcattgtttgattatcattttaaaatctgtaatgtttcattcaccttttaatttttccccaataaggaaatacagtttatgaggcacgcatagatactcttcctaataaatgatttaagagaaatatatgcatatatgcatcatatatctgtatgtatatatacagatatatgggaaaagggatgaatattcagaaggaagatcagtagactccacacagtcattttagccattagactagtgttgtatgcattagtgtaattttgatgccttgtgggttttagatataactgggaattccttaaaaaacaaaaaatctgtacctcagagtctttggtagcatgtagaagtctatgtatgaaaatacattcatttttgatgatgatgatgattgttattatttttgagacggagtctgactgtgtcaccttggcaagagtgcagtagtgctgtctcagctcactgtaacctctgcctcccggactcaagtgatcctcccacctcagcctccagagtagctgggactacaggcatgcgccaccatgcctggctaatttttgtgtttttgtttttgttttgtagagatggggcttcgctatgtttcccaggctggtctcaaactcctgggctcaagtaatcacccaccccacctcagcctcccaaagtgctgggattacaggggtgagccaccgcaccttgaccccagcctcattttagattacttaggatatcatcgtccaggtgcagtggctcacccctgtaaattaacttttaaatacatttaatctagaatggaccatctgtctccttttcagaggttccatatgatttttatatatttgggataagaatgacgtgtcccgaatagtacacatataaaggtcttgtcaggaaatgtatatagctctcaatcaatctataaaatgatttgggtaccattgttaatatccagagttgagaggaagttttgaaaatgatatttaatcattccttcaacccaacagtgttaaccctactgtgttatgaagtcaaactgaggccaaattctctaaggctagtacattttctgcagcttctcagtaccagatttgacctcagattctgtccctagacatagaacattccatggtttcgaccaccaaccaaacacccagctttctatataatgccgtagtttcctttccctgtgatttttgctgatatacatgtgtctttgtttatttaaatgttttgtaccacctcagtggtttatatatggtgctgcaattttccaagtatttttttttttgcctcagtgaagttattttagagaatatcttagattaataaatctttggattagagtagacatacgtaaatgggatttggaatgcaattatttaactggaaatcttcatgggtttatcataaaaggagaaagaaccctctaggtgttgatagggcattggaaaagtggccagtaaattcatttcaaaatgttaggataaactcctcagatagatccaaacattatattttgttgtttcttttttctcatcctcctgggataatcattcactgacccaatctttgtttagaagtatccgtcttcatcccctgttcacttaaaatgaagttattcccacgtaagtgtgtaaagccctttccatcattccacttctaccattattggcgactctgtcctatagacctaagcacattatattttaaactgagtacaaacatttcttcatttttggcaataagctggtcaaactttctgtttttttaaaatcttagacatttgggagaagcactgagatgtgagatacactggcagggaatttgtgtttctccaggaatactaagcaaaatgagaaacccagaattccaggtgaccataaaattgcagagaatgaaggaaaagggtagtaattttcctctacgtggcttttgacttcctttggcattttaaagtaggaagatgagctgccttcacaataaactatatgtatcacctctgtacacaaggtactccagtctccacctgcggtggctcagaaacatccaggtgtcctggagttgatgacattcgctgacataaaagcagactcatcaagtccatggacatcttaaagatcataagtcagatttttgttcatgaacttcttgaaagaggtcatttaaggtttcccaccctggttcaggcctactttaaggggaaatggaatttataagtttatctgaatttcttgtaaactgttctgaagtgagctggaactcttaagctcatgttaacctctatctctatccctagaacagattcataggctcctaaagccgtcctggagtagagaagtacctcacaaatgcatagtcattttatcatgggttctgagactatcatagaacacaggacattggggaatgtatcatgacccaggaaactgccccacagtgcccctggaggaaacctgaagaagtcgtttgttgaaactagaagagatcactattgcagtgagtgtagatagggaaagggcatcaagaaaggggtgaagatgagatacatggggattagaggatatactgaagagtgaaaacgtctaataagaatttcatagtgagagatggaaaatataaggaaattatcatatgaatatgtgaagaaaatttcccagagcagaatgtaattcttgagattgtaaaggctgtgtaattgtccagctcagtggatgaacaaagacccacaccaaatactgttattgtcatatttcagcattggagttaaaaagaagatcataaaacttccagaagtacagatttcagacacatgatcaggagtaaatttggcattctatcaatattggaataagaagccagtagagcaaaaccaccctctaaattttggaaatgacttttaatttgaaattctaaaccaagtcaaggtattacagatattttcaaacacatatcatttttaatgtaattatcctccatgtacttttctgagaaagctattggtagatatactctaccaaaacaagggaatacatcaagaaaggtgaaggtgtagtattcaggaatagttgcaggagatccaacacagagagagaagggaattctcaggatgacagcaaaggaagtcccaagcagacaacagtagctggtctaggtgaaacgatcagtatcgaaggtgaaacaaactggattgaacactgatcccttcaagagagatgtttccaggagaagagtataaaggaagcagtaggttctctgacaggtttgaaggtatgaaaaattacattggcatgtgtgttatagaaagttggagagtgtgagaaaatgatatataaggaaaactaatccgaggaaaaaaaaaaaactaacagttaagcctggtggggaaaggggatgggtttttaaagaaaggaatgaaatcatgttatactagttgactctgaagaaaataatatttatatagaaactaataattgctactatgaatatagacttaaccaaaaattgagaagtaattatagaggggaagtgagtttaaaagtatataaatatgctaaaaattctgtagtgctgtaataagtcagtagttaattcctcaaatacatcgatcaggagataacagaatagacacatcatttggcaaactataagtattgaaaggggactctgaagagtctggcaaggtgggaggagcaagaaacaagagatttctgttttttattatcagtctcatcaatatttgactttctatattacttatatatgctattttgattagattaaaaattcattaaaaaatgtgtcatttggctgtatattataaacagtagtaaagtttaaaaatatattcaggtttaatctttcctaaaaacaccaaaatgcacgttgtattctaggaacaggaaataatatgttaattccacttaggaggaagggaacaaaccatacttgtttcttattttttctgattttacaaaaccagtgacttaaaacaacactgctgtggactgaattgtgtctccccaaaattcatatgttgaagccgtaactcctaatgtgatcgtatttggagatgtggcctttgggagatcactaggtttagatgagttcaagaggccagggcttcataatgggattagtgtccttataagaagaggaagagacatcagagctctcccccagcccaccacggttgagaacacagtgagaatgcagccaccatctataagctaggaagagcatcctcactagaaaaagaccatgctggtagtgtgatctcagaagtatagcctccaggactgtgaaaaaataaatttctgtgtttaagcgcccagtacaaggtagtttgtattggcagcccaagcaaactgagacaaacacaaattatcatcttacagttctggaatcagaagtccaaatgagtgttatagtcaaggtatctagcaaagctacatcccttccagaggctctgggggagaatctgtttccttgccttttccagtttctagaggccacctgcatttcttggcttgtggctctctccagtgcctacaaagtacattctctgtcctttgcttccatcatcacttaccttctctgtcttctgaccttttgccttgtagccctttgatgacattgggtccacctagacagccgggatcactccccaactcagcattctcttaatcacatctgtgaagaccatcttgccatgtgaggtaacatagtcactgattaggagttagggcatgaacatctttgggaggcattactcagcctaccacaagaggtaaagcaggcagcagcagaacttcttcacacttaatccctaagtatcacgattgttgtcaatgaactggcattcactgaagaccacatattcctcggtacatgtggatataaatgaaaattcaaatcatacaattatatatagctactatagaaaaacatatatactatacaaaaacgatatatactatatataaccgctatagaaaaactatagaaaacctcgatatgttggaaaatttggaaacttcatgtaaaatttgcctcatgaaatttttatctgcttgtttcctttaaaacaggtaggtaagccaacagcagctacgagtttaggtgctagagtcaaagagttttaaaagccaacttcactttctgtgtgaatctgaacaagttactcagcctctctacatttcacttttgcttctttataaaataaagaaaatagtagtgtctgccctactgggctgtggtaagaccatgcctaactcccatggagactttggaggcattcagtaattgtgagctcttattattattattgctaattattggctcatcttctttttgagaagaggggcttgtctaataagccctaaatgctgaaaatttctttctgagctgtcatactggagtgtgaccatttatttctggatttctcaccaagtgagtaggattgataagattgttgacagaaagagtgaggttttcgggatgactctgaaaatgtgagaagcagttcatcaaaaataataagaactttcatagcaataaatgcaatgtcatatatttaggaacagaaaaatgtatctttatgaatacgagatggggaaagactgatagaatataccagagtggatcacaaatgatagaggctcataaatataagtgtgatattatttaaacagatatgccacttctttaaatgctagcataatatttagctatgctaccagcagtaagatacaattagaaagtaattttaggctgggtgtggtggctcacacccacaatcccatcactgggaggctgaggtggaaggaccacatgaacccaggagttcaggactatcctgggcaacatagtgagaccccatctctacaaaaaaaatacacaaaaattagccaagtgtggtggcatgcacctgtagtcccagctactagggaggctaaggtgggaggattgcttgagcctgggaggtcgagactgcagggagccgtgatcgcaccactgtgctccagcctgggtaacagagcaagagcctgtcaggaaaaaaaaaaaaaaaaaaaagaaaaaagaaaaagaaaaaataattttttgtcaagttctatctaacttatataataaagaatttggcctttgtcctgattcctaggagggagactacatccttggcatttcctaagtaataggagcgtctctgtaattcatggtgggcccctgtatggtttcagggtgggggctggccaagctagataagccaaccatgggcttagagagtcagggccttgagccaagtgaggtcagcatacggccagtggttcagtcagtcatgactatgtaatgaaacctcaatagaaaccctgggcagtgcagcttctgggtagtgaacacgttgatgtaataagggggtgatgcatcttgagcacatggaagctttgcctttggggcccttccagaccgtcccctgctgtcccttcatttggctggtcctgagttgtatcctttctaataacactgtcattacatgactattgtgtcctgagttctgtgagtcatcctagcaaattatgaaacttaaggtggagacccctcaggtttataaccagttggttataagtgcaggtgacctggggacccgcaaaccggggctggtgcccgaagtgagggctgtctcgttggggatcatgcccttcagtctgcagagtcacttcctaactccaggtgggtagcagcagaattgctttgcagttttacactaacacatagaggaaaatgaaagggtgtccagagatctaagttaattaatttttttattttaactaaaatccaacaaatggcttttgaaagagttaaaattatttgacctaaaatatagagttccattaacagcatttgagccaaattccagcatttgagaaacttggatatttcttaatgactagattgaaggttagccctaaattagaggtttgtgaaaaaggagaattctgacagaagctctttttctcttacctgaagtaatgaagtcatcacctgcaggtcttattgttccccttccattgctagtgtaatatcagaaactacctctttcttgtaactatttccaggcagatcttcccagacatttctgccaggaaaccccaggatagtaaagcctgtgaatgaattgatgcatacctcttaggaaccaacaaaatgcccccagaattaagccattcatgtgctactgcctccctttaactcttgtcccattgctttttaattttgaagaaattgaagaatctattggagtacacagtacgcgtaagacatcctttacctgtgcaattctgccctgcattctttaagcctgcctgttcctccacctccctggtctgaactctggatcgccctcccgactgtggccttggtcggctcccagtctttgcctctgtctcccttacttgtgactcatggtttcctctctgtgcctgtttctggcttgcttgccaagcctttcctcattgcctgtctaacctccacatgttaatattccaatttgacatctgggcgactgagagcaagggtgagcaacctgccaaggctgcacggtgggcagtggcaggtctgggctcccagtctgcctgtctcgggttgccttctccacactctcccatgccacctcccactagccgcacctccagcaccaggcggaggtccacatttcagtcctgtacacactcctctttgaaaaatgatgcatttgccagcaaaaccttagggttaaaaagtttacaaaagtgtgtgtgtcccacaaaaaatattccaaacaaaatcccctcttttctgtatttacgcatttcaggcagcttatgaaattgatgtgggctttgtttctactctgcagtctgaattctgtctttggtgtccaggaaaatgtttttataccttcttcacattaaaaatgtttcaagtatccaggacttgttcgctctcctttttcatgtatttagatgaagagactttgcatattaattttgttgtttaaaaaagagtcaaaccaattgatactaaaattaaaaagctaacaatttagatccaacagaacatttcaagatctgttttttcccttactgtaagtgaaattcccattaatggcagccaggcctgaacaccgatagtgaatggggcctctcgtgttctgagatggacttatcacatggttagcagctgggatttatgtggagactcattaaataaaacagcagtggcagctacctcctgctgtagtacacttggaggtacagtacctgaatttttccaatcctagctggtcctttatactttgttttatgtctcgctcatttttctgactggtcttgacattttctgacctcacagtgcttttattattatttttattgctactagaacaatgataactcatgactctgatttatatgatggcagcttagccaggggagagattaaggcatacccaaaaacatgcagtaaatgttcaagtctattagcctttcgcttttattaagtgggaaactttagttttgttttgacacagatgagtctggagagtcatgagtggctgcggggctgagcttgctgatgggcccttggctgtgggtacgcgctggcagagtggcgcgaggctgtaggtacgtgtgaggtggctcatggtcacaatcctgcagtcagctcactcacttccgttgtacattttgagtaactggtagtcattcttttgttcttttcttttccactgtaatcatagttttcaacttactgcagtgataaaaaaaaaaaccacaaattactgacagatttccttgattttaataatttcgctatacaactgtctcatttaggagatgccacagctcctgctctcataaccaaaaccaggctcctgggagtgtgggcagcattgcttcgagcttccaggcccagagactttttcaggcctctgttgtgctcagtctgtagggaggagactgcccagcgccactccaggtagtgcctgaaccatcacaaactcagggccagagttcagttcatttggccccagtgtgtggccccagcctgggatgctgaggtcccctcctgcccatgaagcctctgctatgcttgctcaggctgtgcgaggggcttgtcttaagtctttgcatcctattcccagagactggagtcccactctttccctggcctgctggccttggttcttactggtgcttgcccatagccaaccctgcttcctgtgctgcttccctcagccgaggctctagacctcctggatgctttttactgaggcattgcatttccatctttctggatcacagttatcaacctcattgatggctgcaatttaatgaattttggtgatgaactgaattgaactgtaaatgataaaacattttcatggagttattaaaatcacatcattctgcatagattatatgaccttgagcttcactagaaagactttccaagaccttcaccgtctccaaattctcggacggcactggaatatcacgctgaagcagcagcacgctggttttacgtgaatttttttttcctttaccgctgtcatatttaacatctcactccttaatatttcagatttctgactaagaaccatctctgctgagcctcttctcctcctccatcagcacttgcattggaatttatttccaggagcatttttcacaaaggaaatgtcatcccttcttgggagtaagagggtgctgaatggtgcgcagaaaatgagcactgctgaagctcacagagatgagctctaccaagccactatggcagattatgctctaaatacgaccacattggagtcccacatgctcttccagagccttgctacccccatcaggagatggagcctccttccctgccgaggatgctgggcaggatggtcatggctgcccagatgaagagaagacagggctggtgctgaggcaggtcgtggcaggcaacactgccccacctgacttgctctcgtgggatctagtcattgtcctgggaggatgcccaagggggcccacgtggcgagggctgcgtagaagggcctggaggtcagcactgacctccagacataggagtgaacggcctttccaacaagtacagctgccagctgtggaatctcccagctcaggccccagacaacacctctgtccaaattgcgggcccaaagaattcatgaccataggaaatggtggtcttaagctaccaagttttaaggcaatttgttcttgctacttgttagaatttttcttgacctaccatctagagctcttttttattttttacattccatgctgaagatttattaagagcacaaataaaaacacgtttttattttgtttttcaattactaaccacctagatttgttatagcaagacaaagagcttcatgaattatatacataaccctgtttaggtaatataactctctgttagaaaataatgggtcaacttcttagactttgaggtgttactatagctttatccagcagttttatgttgattcttgccctgttagactaaaaagccaccttttatcctttctttgagaaaaatttgttatagcacagattgtttctgcatcagaactattcttgaaaattctctaagtaactttttcttcatattttatgaatagtaatgttcaaaactaattgtgcagtagttcaattaattgtgcaattgttggtgttctgcagtgctccctcagtcagatccgcaaaggcataacagttgtagcttggagaatgacatcagtgcactttacacataagcaaaggaaggaagcttgctgctgggtggtcagccttagttcagtgttccatccaaaagaagcatgagccagccacactgtgaagcatgggaaaatggttttattcttttctgcagtctctagaagaagtggcataagggtgtcaatcacatgacccagagcagtaagtccaaaagtttctctaccatccatctccccagatgtctccagatttgttttatccctctcagctccagactttgctctgacatccggccaaatctgctgtctcctctctcccctctggctctggcctctgctctccttcccgccccgggtagtcctgggatcaggcaaaccgaacatcctcaggcaggggaaagggaaggagttttgcgaaaattttcttttttttttttttttttttttttgagacgagtcttgctctgtcacccaggctggagtgcagtggcgtgatcttggctcactgccacctccacctcccaggttcaagtgattctcctgcctcagcctcctgagtagctgggattacaggtgcccgccaccacacccagccaatttttatattttcagtagagacggggtttcaccatgttggtcagattggtcaagattatcaaactgacttttcagttctctgtcccatattattatactcagaaatctttttaaatggacaaaaataaatagcccacctataacatacaaatattacttttattacaacagatttaatttcctaattttttttactcctgttagggccttaactaaggccttcagtgaagttgagacatgttcatggtttggggtttttttaggcttgttcatcttgtgtcacaacctactgagttatcacaaaatccagggcttgcatagacccaggggcaagggacagggcttcatagtcacccagagtaaccttcacatcgcaatgttgtttctgtcactaagtacaaagagcctcatggccttttagtatgtgtatttgaagcttattaatgtgaatgagcaagcttccttgtcagatagcttatacctactgaatgttttcaaatttctctctaccttgttattttcagtagtaataaaattaccacctcttaaaatagccaagtatttattgtagcaatgttatcactacctatgtaaaacatcatggcttctcctaaggaacaaggaaaggttaaatttattcagtgtgcattttattattttgattcactaattttattcagattctatattgcaaacaataagagaatcgtgctcctccatttggattgtctttgatgtgtggatcctgacttcagtgtttgtctgatacttgagtcaggcattagggatacagtggtcaacgaagcaccatacttccatacttccctcaagggatgtataattttgcgggacatgcccaagtaaatagattattaaaatatcagagcccattaagacttgcacctgcaccccgtggaacctcaggagcaagatctcccaaaggaagggatatcagagtctttaagttgagtgattaagtcctgtttgaggtttggtgttaaataacttgttcagaattcagctccccagttactcccctagttataccagtttcttaaccttctcctctctcctctcctctcctctctttggcaaggtctcactctgttgcccaggctggagtgcagtggcgtgatctctgctcactacagccttgacctcccaggctcgagtgatcctcccacctcagcttccagagtagctgggaccacagttgcatgctaacatgcccgactattttaaatttttttttgtaaagatggagtcccactatgttgcccaggctggtctcaaactcctgggctcaagcaatcctcccacctcagcctccgaaagttttgggattacaggcatgagccaccacacccagcctctgtgatcctttcttgacagagaaataataatgcctcctttacaacgttattctgagaattagacaagttcacacccaagtatggggtagtgcctggcccacagtggacatttagtcaaattattttataagtgttttatttcattttgatctatgttctcatttcacccgtacttattccttcctaacaacttcctaatatttgcctttgccaagagtgagttaaaatcagtaagctctaaaaatcagccagttagccatgaggcatgtctatccaaagtctctttataaagagcattcatccttctatgggtaatacgaaatttgtgtttgaagatggtcccattttctctaaattcaggtttttattagtcctaacaaagttggtcttaaggcttggactggaaagatattattaaaagattacagatttgaagcttcttgtggcctctgatgagataataaaaatgttatctatttgtccttactcaagataaataagtaaatgaatgttcacagagcttaaattgtagatgagtgtgtttggttatgggcatctggaaacagtgactcctacagtacacctatgtttaggcttattggtttggtgttttatttttccttcatgctttttaaatacatgtaactgggtcttttgctagaaatatattttgggctaagttggtataaggtagtaaatgaaagaattggaccaaattctgtgagtctggactaaactgggtcaaattctctttcttccatgcagtttcaatagaattccattgaattaattttactcatcataaaatcagttgtatttcaagcctgcttcaagactctcagatccttttgatccaagcacaacagcctgttgctgtgcagtctgttgaacttggcggcgaggtgtagggaccgggatttgtgtttgaagttagcccactttactcctgctcgtcaatatttcaggacagctgggattctctaaaaatcagtttttgccaaaaaaaaaaaaaagttggtttgagaggattgcaccagttctatattattattcctacaatactgtaaaattgtacaaaggcccccatgaccattaagaatattggaatatggtgactcatctttcagtactaagttgaaaggaaaggaagttatgaccagcagggttcatttcagaggatattcacagcgggatgttattctcccggctgacaattcagagggcttaaggccatgtgtggaagagccatcaccacatttgatttgaggtggcctcacctgggtgtgagggtgccagggagacagcagaggggagtaggccctagagttcaggcttcacacgcaggcactcaagctcatcaggcccagtgggagcagtggcctgaggaagtaggcagaaggctcggcagagtcagcttgaggagcagagggctagaagcccaggccagggcccagagtagcacaacagcagaaacccacgccagcgagagtaagcagcgagagcccaggagccgggcagcaatctgcacactgggcaaggaccaccagcagcagcaggaacacagcccattctgagctctgtccttcacccgggacctgaaccagcagcaaggacacctggaggaaggaccacgaaggcagggagccaggcagagctggagaccccttcgtgaggcctgccttggttccctgaaacacaaggccattttcttactgttggtcagcaaagagctttttctaaacagcaagctgtcatgtgccttctcggtgtccttcgtcttgcaatcgtgttttcccacttaaggcgagcgcttgggattcgatgcttttacaacacagattggtttttgtcgaactgcaacagtttcagagaaaaactcgctccccacagaccagtcttcaaactcaaactgtgttcagaatgagatgtgaaaggaaaaggagaagggaaatctggttctagtttttaaaatataagtttggttccttgatgtaatttgtaaatcctgggttacagttcagtctctctgattaaatggaatcatcaccttggtgtataacaaagcaaaacaagatggcgaagttcttctgagtctgacatctcaccaggcactaggactcctgtgatggcgtgagcgagccctgcagcctggggaggtggcagtgagccgttgcgtgttgatgctgccggcacctgggcaggagacgggcagaggatgggcagagcagcgcgggagccagctcctgggcctggcacccagcagccccgctctcctcaggcaggcagagaggctgggaagcaggaggggaaggagagggtttataactgaccaaaaggctcctggtgctgcagacaggcagagaggtggaggccctgccatgccgtcctctcccaggccagcagaggaagcgctctcaggaagctgtggggacaccgttgccactgcatgagtaacccataataacagtagtagttgccatttattgaatacattctgtgtgtcttctagcatccttggtactgtaatttaacccctaaaagaatctctgtggcactacatggtagtatcatcattttacagatgagaagactagggcctggagaagtgatttgcctgaagtcacacattgccaaaggattagaaatcattatttagaaaacaaaacttttactcatcaaacttacttatacaaaacacaattgccagcatgtatctttacgtataagccagggacaggctgcaagcggagcaagagtgtcggattcacttcgctctttttcgatttggcgtccattccccactttgagtgaggcgtgctcacggtggctcctggcctgagagagctgttgggtgggatgtgtcctcaaaagactaaactcagaactggaccacactgtgcctttggtggccttcagccaaccgaggcaggatttgggaaaggtgattctctccagcagttttggtaccagcctggctgtgtctggtgttcactaaaatatgcctgatatgacagtcacagggccgacttccactccgctctgtgcactcgaaacacagacacttcgctcagttacgtctgtggccttcaatgagttaaagaagaaattgaatttggtcagtgtttttttcattttaccactatcagttagagggacaggttcgcatccatgattgagtcatgcttgtgcagctgcttatacgctgttcttgggaggggatgggaaacacaagagcgcttttggggtcatttcctatcagaggacattcgttttcacacagacgcacactcatggaggacatgaggattgtctctgcaggggtcacacgcattgtttctcgctggaaaatcgcagactctatcaaaaactttccttccagagtcattgtctctagaagcttctcaattcacacacagttacctttatctgtggtggcagttggaggcagagggcccaggtagagtcccaggctgttaattcacctgatctgtgaccctgggcattggcaaatgcatcaggatgccacaggagcacttccagctccagaagcaggatacttcccccggccaggaggctgtgttagtgggactgggctagaatggtcagaactgggcctgggctcagaggggagcatcaggggatgaaagaccctcctctgaagtttccagtaagtggagccttggacagaaagtcctccagcatgaccctgagagggctgctggaggaaggctgtcctcgtacccagaggcatgtggacggtggtgatcacatctggtctgatttctaaacagagtacagctcatttctcttgagacccccacttgagcgctccctcctcactcccaccccagccaggactggtccagggatcagcatgggaggccacgccagcactgcgagatgatggggtaggcctttgaagggccagacacggcaataagaaacctgaaccaggagggcagcaggggtgttggggttggaaaaacattttcaggcgtatttctgctataagagaaaaaaaaaacaagaaaatgcaaggggccaagttctgactgcagagctggtacagtcctggcccacactggtcaggctgctgctgtcgacgagctttgaggtctgagctgcaaacgtcagcaggctttttcctggctggcaggaagggaaagttccctccagtgacagacaaaaataatggatttggggcaagtctaggccttcagaggttatagtgaaaattaatggagggccacgttaactaatgttactctaatcctgcagttcgagacattgggctaaatttctgttttatggcatgttttacaaactaacctattttagatcttggaacactccaggctggagtaagttccaggtcaggaaggctgccccctcctcttgaattccacagttccttggccactcctcagcacagtgcccgccgttccactcgtctgctgtctccactgaacctttaacatcagctcatttatctttcaggtgttataataattgacttcaatcagtattccattatcctaaacaggcaattatccacattgtcacttttgcatttgctcttttgacctaggggtcacagaggccctagtgtaacagaatccagcaaagttattcccttacctgtcatataaatagtcatcccagcaaaatgagacccaagggcgcttttcgtgaggtgttgagaaggccagtctaactcgatcctttattcagctctttaaggaatgcagtactgttttggcactctatcaaaataaaacaaagttccatttttcagcttctttttttaatgcgtgcacccctgagcttacaaatgcttctttgtggccctctttattgaaatttccattcagctcttccatctgttagctgtgtttacctctatttctagggaaagaattcagcatttcacctttatttggggtgtaaggtcataaaactgtctggattatttcagctatatttataccaaacttaatattgcttctttaacaggtttaaagcttttaattccctggttcgttattcatggtgagccgtctgctgagaacagtttgcattttataatggagaaggtactttataccctcttgctatccctccatcccccgaagaagaaagtgttccacaaatgtgaatttcatccaaagatcatctaatttaaactctagttctattccctacacatgcctgctgaatgcacataattgcatttcaggagcagagacgtgttcaacattctcctttttcctagaaatattgatgtcattacaatctcgggaaactcttttcagagtgatggtgtaacacacactgttgaaatggagtctccagatggagctggtgtgtgtgtgtattttcttaatttttcaaaataaagtgacttcagccttcagcagtaaatctggaagtatatcaagaagaaatatagaaataacataaaataaaaatataagcagattagttttctttctagaattgccacatttaaaaaaatatcacacatcctccgaagcaacatgaacattaaggaagcagtgtggaatagtggaatgaacattacctttgaagtggacaggatctccaggctgcctaggagctgtgctatgtaggcgcagcagcgcgtctcccctccatgtcttctgccacccagcaggagccacgtaacctgtttcactgccggcgtgaggattaggggtatggcccatgcccatatggtgcctggcacacggtaggcattcatcagtgaggggctttattatcattatgccaaattttacagggtaaaatgtgcctagaattagtgtctaaagccgtttgttttcacactcatgattatctaacacctcatctatcatctgggacctctggccagatccccacctacagatgctcttgttgttgcttccttagttgatgaggtttgggccacatccccccaggacttggcagatcttgggggagaagagtgtcagtcttcacccgtatatctgcgcatttcctgtttaatggtctttcagggcaggcaagctaagtgcccagatagaaaggagcaaaatcagtgctttgaaaatttacttagaggcaggtttcgatggtgtaaatctgaaacagagcctaacagtccacatatttcactctcaagtgatgcccacagaccttaatttttttagggacaaggtcttgttatgttgcccaggctggagtgcaatagtgcaatcatagctcactgcagcctccaactcctgggctcagagtgatcctcctgagtagctgggaccacaggtacatgccaccatgctcagctaaatttttttttttttttctgtagagacagagtcttgccatgttgccaaggctggtatcaaactcctggcctcaagtgatctccatgcctcggccccccaaagcactgagattacagatgtgagccaccacacctggccccacagaccattttttgaaaaccaaggatttaatattccaaaaattctgtgtgggacataattcttcgtaataatggcgatgccttagatttaacgaaatcttaaatgaaaattctatgtatttttgcatcgtttgttcaaagagaggcagcaactgtcctctgactttccaaactcgatggaaagagaaatggtctttattcactgccctcccatgaatggttgagaaaactctgtgtcttcttgagcctggtgtatagtcaactccggattctgaacggtcacggctttcgttggaggttgatgcaggcactgagtctctgagtccagctggctgcccgtgtcattccacgacggtagcagtgcagaggttgtgctagtacagcacaggaggggacaggacacccattgtattgctcagtagaatattatcataaaaccccacatacctcccatctccctttttttatttctcaaaaataaacttttcttttttcacaataaagacagaaaagaataaatgttcattttagagaatttagagaacttgaagaaaaaataactattatgtaaagacagccatctattactcatatttttgaaaaagtgtaggataatttctctgtatttcaaagaaccgtgttttgaactccaagccacagaagtttctagaagaaaaacaaaaaactttcattgcatttcacagcaacatggaaactatctggcaaaacactgccttttttatatccctggatccctggagcagggcatcaggccagctgcaaatcgctctatatacacaggcttcaaagtaatgtgttttgacccctgctaaacatgaggtcaaggaaggttcaaagtatagtgggtccaagcacatcatgtccagtgagagtgccactcttacagacatctttgatttgtatacttgtggtaattttctggcaagtgacagtaaagtgttttatcgtaagaatcaacatattaatagagtttttcaacagagtaaaaggaaaaggcaccttcctctaagacactcaaaagatgcctttgagctagcagccaccctgtagaattggtggtggttatgcagtgtttgtcttttaatatttgcatcgttttggctcttccagtatctccaaataccatgcagatagaaaggaagatgttgtatgagtaaagaagatgagtagtggggtcttaccaaggttgtccataaaactccccaccttcagccatgcatgcgcttgctagcataattctccatctcttctctagaaggcttggtatttctgaagaacttcattcctgggtccttgatttattattacttttcctgtcaatcatattagctgttacagattttattaagttgttgtctctaacagacttgtctttcggaatcagccaaagacaggaggccatcgagcaggctccgcttggaaatttctcatccccttcaactccccctggaatggacattcctcgctagtcagcctggccttgcctctgatgaactgcccaccttcagctctctgaaactcagttccctttcctcaatctccagtcttctgatccctgaagttacatgccacactgattcaatcagatgactgcagtgatgactgatgaaagtttgcttctttataaccacagaggagagttttggaagctgttcctttaggtgaagtcgtttccaccccaacatgagttagcatgcctttctgcacatatgttttcaatgtgactgtagcctgaaacatctttcctggatatttggtgagacagacagaaggacgagtgtgtgcattcttgtacatgtttgtctgtgtgtctgcacatttacacacaatcatcatttggggatgctgatgggccctaatccactttaataacacagtgagagattgcctcatgctttgctttataaaatatgaaaactatctgcagctgtgaaggaatgaccctcataattcatctgagagcctgcccctcttccttgtgggatatactccatatctcatatcaactcattgctctgagtgtcctccacagatgcagaaagatcctatgatagatgctgtgatttccgcagcgggggtggttagcctgtgacatgtgagtgatgaggcacaagtgagttacgaagacagtacatctctccacaccagataatatactgtcctttattctgcagctatgtttatatgaacattacagctaagaaaagagatgagggaagtagaattcttatggttttgattcatttatttataaggccttgcctctgatatagtcagcactctttgggaattttttaaggagcaacaatggtcatcactttcttctttcaagattttcttcaattaatttttgtacgtcatgtttggcttcaaatagtttgtcatttctgtgctttaaattaaagctactactcaaaattcagtttagttcctgtttttcaaaaatgtacagtgtatagtggtttgaacttttgacccaatagtaaatgtttgaagtctgagatactcataaactgttaatggatttgatatttcttaaaaacaagtctacaccctttcatgtgaaactctcctgggtgcttcccaaggagactgaaatcttgattaactctttccttcttggaataagatataattacctccacggtagtttcttccttgcaaatcctctcaagaggagtgaaacggttagaattcctgtgtcagacactccccaaggagaactgggccagtccatctgacagccatcgatgctgctcagcacaggcctgtttccgagccagtcgagcccttctctggcccactgtgaagctgtcacaccacacgtgctcagatttccctccgatgtgcacgcacctgcccaagggcagccctcttcctccatgagtgtcactctgcaggttgtagtccccaggcatccccaaccactttgtgaaacgatttagcaccaacatgtatttcatgcctaacacttcaacattgctgagcgctaaacattctaagcagtggtcagagctttcgttaataaccttgttaagagaagagagttgtatttagagaattattcagtaaatgctgttactttcaaggaatatcataactattgagaaagaccttggagaacccaaataatatagatattgctctcaaatagtagacttctcttaaagttaaaaaaaaaaaaaaaagaggaccctctgtgcattttctaactgccttgaatgcatataaaatgtaaaggccatgctctgtttttccccttgaatttctgctgccttttttcatcatccagtgagttagtctaaaccctccttgccaagagcctcctctgtccttgcagtttgctttaaccctgccatttgagcctcatgtttgcaaatagggattagcaggctctgtcattcacaaagtaagaatatgattttacaatattggttccagctaatgacagttaactgctattttgctctgaaacatccatttcagcttaagcatgaggaatattaaacaggaacacagaggtagtattttcaataaaactctctttctagaaactagttgttgctgacaagccaccacctacagaacagtggagaggaagcgaagcgaccctgagtccatgcttgtttttgttttttacgtttggtgtcatcacgaaccctgaccagtttttcagccaggcttcgtctgcagtcatcagctggttttcaaagttcttatatgccagtccccacgaacgtatactcccccgtgctttgctagtctagataatccagcacatgatggcagatgatgttgcaccccaaacttcagtggatgacctctgcatctctgttcaagcgttttttactttaattgaagaaataagtagaatttgtaaaatgtctaaccattgttggatgcagttccagtacccagtgaaatcctttaatggccccttttggatttgaaacttgccttttctctttatgtgcagattcaaatggagggggtatgccatgtttttctctggggattaaaagaaaggactcaggaaattatgtgcatcagaatttctccacacatactacaagcactttccaattataagaaacatgttttttcttttctttagcatattccttccttgtcctaccctcaggggttaaaaaagagagagctcatgcattggattttgattatggtcttcaattcattgtctccttcttcattttccttgtaacagtaactgaaaatagcatgagattttggagattacaaaagggcagtgtatacttggacacattattgtactgttttcataaatatcattcttctagtccctgtaagcccagacctcagtaaggctacaggtttccgctcacagggctgttctttctattgctgttggaaattacacaaaaaccttctttgcctgctcttccttttctttcttagactctaaagtttctcctgagactgattgcctcctagatatatgttcgtgtttctcagatagctcttctcttcttccccttcttggatttttacagtattcatagagctgagcttaagcatcatactgtaccaatagatgctgataacgtaggatgcttttctggctggacatatcagatattgtcaaactccagctttcagttggaccacttcttatttctgcactgtgtgactttgacagatcagcgaacatctcacaggttacagtaagatttgcacaaaactcagaaatgtgtcatgaggaacaaatgacatctgcatgaaggtgttttgcaaaacagacagtgctgtgtagctgtaggatgcatgcatccaatttactcagaggaaatggcatcatcagtgcacactattgtagccaccattgtattgactcactactatttgcttggcaccgttccaggcacttcacactccttttcttgtgcattttgtttgggcctgcaaaggaggcattgttatcataattttacagcggaggtgacttgccagcgtcacagtcattaagtagcagagctgggattcaaaccagagtgtgtctgaggcccaggccttcctcatggtttctttcagcatcctaagttaggttgaagagagtgaggaggaagagaagacaaagaaacccccagcacagccatcctcagtgggatgcatctggaactgaatatgatttgtttgactgtctggaagctgacacgctccagattaatcacactttcaggcttagatggcttcactccaaaagaatattgatattttaacaccagggaggggctattttagcatattctgtgtaagaaataagtgactatgccttataaacatttcacttatttaatttatttaattttagtttgtttatatatcctatgaagacatgaatagctcattattttacatatatcaaaaatatctgggactgcctgaaaatggaaattaaataacacttttcataaactcacagtcagagctccatgctgcaatggcaaatgcctcttcaattattaccttggcagttttctttcttattggatcatcattttaaaataccttttcagaacagttgactggatgcttttggtatgcagactcctgattaagtgatcttctatcctcattaagaagacccttttggatgtttctgactaatcttctgccatctcactttcactttcctggtataaatttttggtttactactcagtggttggctctcaaaacaggaaagcaagtttgacttcataaaaccaacagctaacacttgcacagtggtttaccacttacaaagcaagtactgttcactctcattgtctcactccccacaccgtggggtcatggcagggactccaaatcaccaaggaggaaacggccatcccagaggcgctctgcagcagccgcgttgatggtgtctgtggcttcaccctatgtgtgctccacggtcagattctccgctgccacaacaagattcgatagttccttgtgtcccacacagctttacgtacagtgccttacgcgtggtcttcagtaaacacatgcaaaattgaagcatcagtgagtgaaagatcactggaaattgtggctttctctctgaaaatccaaatttcctaacctagggtctaaaactgtctgtgaatttcctcaagtcgtaggtaaaaatgtgttcgtgtgttggctcacacatgtgtgcagttctcagggaagaagatatcctcatttttcatcagattctcaaaggagtccatgactcaagtaaagttaataataagtgcttttaaaaattaaacagagaaccccaaaatgttgtaagattttagttagcattcataacaaaagatatcaatcattagaaagttacatttaggctgggtgcggtggctcacacctgtaatcccagcactcggggaggccgaggcgggtggtcacttagagtcaggagtttgggaccagcctggccaatatggcaaaaccccatctcctctaaaaatacaaaaattagccaggcctggtggtccacgcccataatcccagctacttggaaggctgaggcacgagaatcacttgaacctgggaggtggaggttgcagtgagcagagatcacgcattttttggttgtggagatcacgccactgcactccagcctgggtgacagtgcaagactccgtctcaaaaaaaaaaataaaaaataaaaaacatttaaactctgtgttacctaaaggatatcaaaattttgtgtctgtgctaattgatgttggtttgttagagctttaaactattgaggtcgaagcttgggcttcagtcttcctcctggccaattaatagcctcgttaagtggctgaggatttcactgagtcctgccagtccccttgaaaatgcccatgaggggttagcaaaagggaaggcagggaattacagaatgccaatcaattccatccctgtgcttcctgggttgtttgtgttttcatagcttcagtgtgaatataacttggattttagctgagaagtagcttgacacaggttaaagtgtcattttctttatttcctccagctttgagagaatttgttaccccagtattggacattccagaattctgtttactcacaagttagactgcataccttctgttacactggttgcttctgggagaaggatccgcttcctctttatctccgtaaacccagttctattagtgtcagttattgtcgtgaagcttgagtgaaagtcgatcacacagaatcaccaagtcaaaataaaggacttttctaggaacgaattacatcagtagataacctaacttaaattataatatactagtgaataattttttatcactgagtacttttctctctgtagaatatagtataatcagacagagtaagctgttatttcctctcctgggcatattattctgtatcttttatctcttacaatattgaaggaatattaaaaggaactcaaaatgaataagcacacaaaaaatgagaaatataagcataactcttttagtctgtaaaatgtcagtagttaaataggagttgtgaagtgccagtttttacaaattatgaatattcaaaagatacaaaaacatgtttaaatcaaagcaaaatatatagattgagtattccttatctgaaatgcttgggaacagaaatgttttgggttttggagtatctgcattatacttactggtcgaacatcccaaatccaaaaacagaaatgctccaatgagcatgtcctttggacgttaagtcagcactcaaaaagttcagattttggaacatttcagatttcagatttttggattggggtactcaacctgtatattatgtgacagtgactaacaagaaacatttattcatgaaggaatgagtaaacgtagtacctccttggttgaagcaggagttctaaggtatgtacccaagtttgaattcttcagtatcttatctgtcatatattggtagtagctggcaatattgatcccttttttggagctgttcttccaattaaatttttagaagcaaatgctgaaatcatcatccttgcactttttgaacatatcctattgattatactgtcgttctaaatatttacaatgtattctttcaaatatttgtggatataatagaaagcatgtctctatgacattgtatgctttactgaagtgacattagatattcccctgtttacacacattcatatggttaatgactcatgttacctattaaggtttcctgtttcctgatttaaaagatatttaaaggcctcagtactgaaatgtttatttttacctctggatcttctgcttcatatagtaacatatacaggctaaatacctattttaacaccaccagacccactttttacctttattatgaaactagggtttggtcagctgagggcaagctgtatgcataacatagctggcagtatagtcggtgaactgtcaccgagaagagagtcaaaatgtaaacactgagcaattctacagcagcttagagccgggattaactgggatcacctagtattctgtttttaatgaaactctctcccttgtattttcatgtttgggagagagtccaaagttatctcatgctaatttagttaggcagtgccctccggggatgtcacaggcttccctgacctctccagagagagattcagtgaagggatgaggagaattaaacattcctgagaaattggaaagcaacaacccccagagaatttgcagagaaactcgctccagactcggctgccagagactcaagtcaccttttcagcacttgcttaacatctctctcagtcccatctggcttgactcagaggtcagtctgggagactcgggagtggtggcagctcagagaagaattcaagggagggccaccaatagcacattctgctcttgttgcttgtttttatctgaagtacatttgaaaagatggacagggcataaggttgaagtaataacttgactttgcttggccatctttttttccttttaacccaaaatttactttaaggtgaactggtatttttatttcccaaataataagttccttgattcttgatgactgaaacttaagagttgttgtcgtttctgttatacaggacctctgtgactaattattttgtaattagccattttacaaaggatattttcttttatgcgtttaatgaaatttgggggggtggtgggtggaaaatatgtttccggttttaaaatcatattccctttgtggtttacatttcgtatatgaagaatttcagaaaactaggaaaacaaaagtattattaaatattgaatctgtattataaacaaatctaaggagctacattttatagtttgttcatttcattttctactgaacagaataaagttcagtgtgccctacagctgtggtgtgagaggaaggtttggggatccctgctcgattttacacttaagtcagattcagcaggaaataaagaacccttacccggtgctcctttaagccagattgctgagctgggagacctagctgaccagatctggcccattgccaggctttgtttagtccagtcagtgtttcagcccacagctaacattttagagtttgttgggtttttaaaaaacataacgcagtttttagcatgttcgatgtgcagctcctccgtgtaagcagatctggtgagactggttcaacatccccaggtgggaaccgtctgtgggaaacggggcgcttgctgggccttctagaaggggagagcctctgcaggctgcctgaggtgagcttccctgggctccggaggcactggagtagcgaggcccaccttagaccctcctcccgagccatacacaagagagaaatcacttttcaaagtaagcgactttgttcattagaaagtgagttatagcagatatataaatatgatactcatttcttcattggttcccattaggattctcaagatgcttttctctctccgtggtggcctacaaagagacctggcccgggagacggaaggtgtgggttctaacgcagagcctttccccagcacctgaaacagctcatgcaccgcgtttcctgaagcccaaatgaatctgctgcctcgaaagttctgtggtctttgctcctgtccaatttccagtgactcaatgcacatcagcttaaattagctaacttctccttgcttctgtgccacacacaaaaattaatcatggcatcaggtatcttgatgcactgaaagagtattacatttaaacagacgggcagcgaatccatgaatcatcctgagcttcacatacccaccctccatttcacatgtgtcgttttcatatagtgcagccgctctgcccactgggagagaggacgtttgcagctgatttctgaagtagaggagttaataaaggcaccaggcatgtttcgaaggacccaggtgaaagccttcttacatcctcagccctttgctttagggctgaagataggacagagagaagagtcctgggctgagtctcgcaagggccttctcaaggcctttgcgtttgttctgctatttcctaaacctttctccactgtgccgaaggagttaaagggctccgagccctaaccctccatcggggagtgtctcgggcaccagcgagaatctggcacaggacatgttttcatggaactgcttatcaaaactaagcttctgccgtttcatttagacggggtagattgggtggaaaactggcccagggaccaggaaatttgccttctgttcctgctcagccgccgcgtgaccctgttgcaggtcagtcctccaagcatgtctcagtttctccatctgtaaaattagacaatgaaatgaatgttatttataagaaacctgagggaaatccttctgattatcttcactgaaacaatgcgaatgaatatttttgtgggggctctgccttgctctcttcctgggctcactcttgcctagcgccttcttatctgctcgaggggtttttcagaccacagccttctcagtgcttgttaatgggttgtgttcccatctcaccttcttgttaacaccatccccagctctaggaaaagaggcggtggccttgggaactctttatgccaaaataaacaacaaagtttggaaacatttagaccaagataattaggaaaatggtgttgaataaaagatagcattagaattgctaccatgcttaagttagaatccggttccaaaaagcacaatctccagttaactgatctgttgtaaattttttttttctttttggtttagttttgttttttaaaagatttaaattgtttaaatcttctgatcactcctgtcagttaaggtttcttcctcattgagaagtcacactggggggaaaaaaatgtgcccacagctgtttactatttagcaacactattaaaggaacactatttaacaataattcatgaagctccctactcagaaaaaaagacagctcctctgaactatctacctatataatacaaatttattttcttgaaattgcaaaaacccgcatgttgagacaaacatataaattgccaggatttttgtgttctttcagaacttaaatataaccaaacgattttgggcaaggaatcagaaattctttagaacggaaatgttgaaaccccagattcagttctaaaactcatctttcaaaaagaattcatgctctgaaaaatgcagcgtttttatgtttggtatgataacagccccatggaattatcacatcatatcttgacgatcgttacggagcggtgatgatctcttaggcattaacccaggattttctccaataatattatcatttataacagcaataacattttgtagatcacagagtgcttttaacatattatctgatgggatacctaaaaccctataacctgtgtaagaaaatcaagggtgaaatgagtaagttgtctaaagtgacaagcctattccagacagggcccagcgttttaggacttcagtccaagttcttttcactacatgatattaagactatcctttatcatcgagtattttcctgtaaaaataattcatttggaaagatgaagaaacacataaagcctccatctcttgcctctgtgaacctctcggctctcacatcccacacacgggcctccgttttgagtgcatgttttcgtattcaccctcacagcacattcccagctttaaatagttgtctcccatcttgtatgaatgtacatttgtgatcacagaaaggccttctcagttaccagcactgtttttactgctgggaacaaaatcatttcaaacaaacagcttttttttttcttcgctccttcactcttaacccccagcctcagtagcactacgaggagatgtaccggacaagcagcaggcaggcctacaatgcccgctctgtctttcccctgcagaccctccaaactagcaggggtgcctgccaagagggggtgcctcagctccagtggatcgcagcttcagcaaatggcactgctccctccaagggagccctccacctgtgcccccagtgtggagacagggagcactcttcactctcaggagcggatgttcactactttcactagtggtcctagcaaagtttcaaactgagctactgagtgggagacagattcgtaccaatggagaaactggttcttccgctttctagatttcatgccaccatgatgactgggatgtcccattgttccccctgggcaaaccggaaatccattttactgttagaaatactagatctttaaaaaatctgtttattctggagtcagtcacacacagggcaatctatgtgaaagaaaagaggaaggagcagttgcataattgtcataccatccatcatgttcattctcacactgaccatggtttttaatgtctgtccacctgcagtctgtggcctcgccagacagtaagggcagcgccctggaagtgggggatttatcacttgccagtaggtttactcttggggagacgctggggttttatctccatgcccctggagaattgacttactgaatgcttcccttgaagacctaagtcactggttcttcagcccctttgcatagtcctctcactgaaatcagaactgaatttgttctttttcatttttggttaagaagatgcacattagaagacagctcagagcaatggggctgacctagtgggaaaagacactggtttcttttcacgtttctggatggcccgtggcccacatctgccagcatcttcgcacgtgtccacagcaccagtcagcctcacccaccttgtctttccctttgcgatcttagaaagaatttggtagaaatgggaaccgaagattgagcagaaagtataattaccacatgtatttaccagctcattttcaagagcagtaaaagtacactaaacattctgcttgtacatacactagcactttaaaactaccagctttctaaaacatggttttgatttttggagcaaacattcaattgctattctttgatattattgatttataaacaaaatgatcagcattccctaatgtctcgaagcaaagaaattagggtaacacatttaaaatttatcagtttgaaactttctaaatactcttccttaataataaccacaatacactgaaaatgtcaagttctgtaaaaaatgaacagggacgcgaatgtgtcgggcttcattttgaagacccagcgtgtttctcatcctccccaggaagggaaggttgaaatcatgaagttaacatctgccttttcgtaaacaccacctcaaagtgctctttctcttaggttggaggctgaaagaaagaagcacaaatcttccctgggccaagagtttcatcataagccctgtgtgatcaataagtacattgtggtggttatttcatagctgattaacttatatgtctacaagccaacacttgacttgaaaggctggtcgggttgctcgccgtgcgagcatggcctttaccagcctgccctggcagccagctctgggactgctcactcctgaccacaacccgggtacagccctgaagtttcgtcgtgagtaacccgtcagcaggagcccatgcctctctgaaagggcattttgtcttttttggcagtaccaaatggcaggataattagtgttagggagggaaaaaacagaattgaaaaccacatccgatacctggttatggactcttcaactttgtggaggcagaaaatgtggtggctttatttttcttaataaatgcagacggttataagcaattgagcatttaatgatgagatgatgctgaaaggcataacttaataaaaattgcctctgtgtttctcacttcatggttgaaacagactgtgcttctcggctttttctgtaatcaggtttatatcagattgtcctttaattcacgttaagatcttacatcttagtacttcctcttagagtttttgtattcctccttgcaaagtctctgtttcatttttagggaaagggtttcctatagtttttttttcgtctccagtgttgcttttaatttcaccaattatggagtaaataaatcattgtgtacttggaagaaaaattggcaggagagcagaatatgttaaggactcttgcttttcattgtgagcgagatttcccaactggagcgtctctgttttattttgcctctggctaacatctgaagatcagtaataaagctctatgcaaatactttcatgtattaaaagaacaatattttgacactcattgacacaagcaaaaaaaatacaacattaaattagtgttcaggcaaacaatgaagacattgttcattcacatgaaatgcatgtgaaaaatgctgtgttatattaacagaaaagcttgctcctcagaactcgacctttagcactggcgtaaatgacattacttatggtgctgtatagtattagacaggctttcttgttaacagtcttgagcagccgttgataacttgtcagactactgagaattttagtcaccaaaaaataaatgttcattctcagtacctgataatttaagtttctcacagattttttaaattatcttttggatattttagagttttcaaatactcgataagttaaatactttaaaagtgttaattcattgtaggctttttctacttgtttttccagatttcatctagaattaagtagacttaattttttaaaaactcccttgatcatctataatgtgtttttaaaataattgaacttcaaggtacgctcttgatttttattctgaatcttggagaacacagggggccttttgtttaattttcagtcatgtggacaggcccttccatggaaggggaggtttctctagatgactctttgcatgtatgtagtagaatttctttcctcctttatcactacactcaaatgttacagttacaatcattgttttcttaaatacaactggcttcccttttcatctgtgttgatccaggacattgcagagtcagcatctgggaaatcattatgccaacagaccatcccagtcccgggtgaggtcaagttagtaagagcaattggaccacccgaaagaacaaagctcagatactcctcatagtgggacattctcagattagcaaacaaaaattaaaagaagaatgattaaatctaattatattcagcatgtttttcagagtactgagtggaagagtgacttttaacttgacatctagatttttgtgaatgaagacactggggaaacacatttgaaatgagttttaaccaacaagttgcataggacactaggttcccagttacaaagacggtgcatgtcccagcctgccatctttagaggcgctcaagggtgggcggtcctcggcggtggggactgcgggggccatgggttgatgacaccctcatgaggaccctgagtactcctcctcctctggtgtactgggttgtctcctctgtgttcccacagctcctttcacactggcccctctcccatcattttagtggctggctgggcaagtggccatcttccccactggatactgaggtcaacaggtggtgacttatcccccctggagctcccttcttaccactgaatacagagctgatacacaactggtcccatatactcgtggtccagaagtcctatttgctctttatccaaacttgtttgctaaaggagcagaaaccaactcaaagaaattcatggaaaacgggattttttgtaaggagcctcagggcacctcgcaggaatgggaaaggaggatctgctttcctctgtgtctgcacatctccctcactccctccctcctcgtgggctccctttcccactctgctgcccacacaggtcttcatgcctcccagtctctccagctggctccgccccggtgacagtctcacgcctgggtgctcagccctttcctgctgtttctgcctctgggtctcttactgcaaatgtctttgacattcccattggcccagaatatgttaggtctccatccatggaaaccgaagggtgttggggggtggggggctggggcgcagtaggcacagggacacatcacctggtttaaatacacctggcttgactcactccttcatcaagagcagtgtgtggggacagtcttattaggaggaaggttttagaaaggagccatacctgatagttccctgataactacctgaagcctctgtcccaaaagttatttcttaaatcagatttggacttttaaaacgctttttcctatataaatgtttaaagcacgtaggccaggcacagtgtcttccctgtctgttcctacgtggtctatcgccagactctagcacagtgcccagcaactagcaggcacactgtaaacattcatttcttgtctggtcaggtccccaggttagctcacaaaagtccacacagctatttgtaaccagcacgtagaattgagtttcaacaagaaaatgtattctacacacagccattaggagaatgcacaagagcatcatgcagtcgcaagaatacaggaaagggagttgaggttccagccccagctctaacacttagcaggtgtatgacttcaggtgaaccatttaatctctccagtttcagctgcttcatctttaacatttgtggaattgaatgacaacacctctaaggccccttccagctattaaattctgtggctgtgactaacataatcaggatttaattcactccaccctatcagtcttccttccccatgctatttatgggtgcaagagtttggttgtggagatgaactacacattctcctgggcaccagtaactccctcaagatacgtaatcatcattgtcatcatcctgatgaaaaaattagccgggcgtggtggcgcacacctgtagtcccagctactctagaggctgaggcgtgagaatcacttgaacccgggaggcagaggttgcagtgagctgagatcgtgccactacactccagcctgggcgacacagtgagactccgtgtcaaaaataataaatacataaaacagccccctgaggtagggattattattattttttgagaaaaggctggtctctaactcctgacctcgggtgatccacctgccttggcttcccaaagtgctgggattacaggcgtgagccaccgcgcctgtaatccagaagtcacccagtgaatagtggggctggagcttagacgcgggtttctgattcccagcccaagctctagacacagagtttctcagcgcgcttcccagatcagcagcctcctgcttcaccctggaacttgcacattctccagctccacccaggcctattgaatctgtagctccaggcctcaagggggccagcagcctgcgttctaatcttccagaggattgcagtgcacacttctagcctgacagatgattctaatgcacgctaacgtttgagaacacctaccccctctgcagcactacatttcaccaaactccagagggtttctcaggtgtttactcccaggtattccaattggggagagagtgtggtatgagtgcccatttgtggatggatgaggcaggcaggcattcaaacgtcaagtgcctgtaaattaggagctagttgtgctacttttcaaacactcactctctcccagttgtcatcgctgatgaaatcactactgaagaagtcaggaggtggagataatgaccaagaagggaggaggggccattattcctccagccgtgctgtggagaaaatgaggaggccttctccaagaagccccggcagagagttttagcaggataagcaaacaggattagagtagggtgtcacatagcaaggttccttctccctcttgaacataaggctggctctgtagccccacgcagcccagcgtggtagccacagccttgtgtgtctgctgagcactcaaattgtgcctcttctgagtggagatgtcctgtgaggacaaaagacaggctacacttcaaagtcttggtacatagaaaaggaacgtgaaatatctcaatcatattttgtattgaaatggtaacatactggatatattcgattaaatgaaacatcaaatttagcttcaccttttctttttactttttcaatgcaactgatagaaaattttatattacgtgtggctcacattatatttctattgggcagtgctgttttagaataatcctgaaagtcctgtctacatccaccttaatgcacgcactgtgatgtccataagttgatattttctggtaacagtgattgtcaacacttcaaccaagaaacctagtgggcctagaatcagttcagaggttaaattcccaaggtcagagttagaccaagaggcagaatcaggtgctcaggatgactagcttgaagaataaggtcatagaaaggtcataatggcttcccaggaacagatttaggtagcacagtcaggagccaagagcatggagatgaaggatcaggtggtcatgagtgtaaagaaacttcctcctgcatgcccagagcttttatgttgttcctactgggccaggaactaattctagaatggcttacccaggtatccgagcgacagaagataattggaaacacctggctgaagtaggtggcttggcacgctccaggaaacaaccacttctgggaagtacgttgtgacagcagtggtattgggccagttagagcattcgttagattagagtgacctgaaagtgagctcccatatcccaggtgtatgcgtcgtgagttatttttgccctcatttaaacctgtcactgcacgatgttaaagatagatggagcttaattaaaaactgcaagctgaagcaatgtttatattagagacaagaataataacttcattgctatattgaaacaatcagctgacattagagttatcacaagatagctctttgtggtagatttttttctagagatggctacggtaacccctcccatcctgcgtgtccttttgcagtgtgactctaccacccctcccataagggggagagtctgtttcccctttgtttgaatttgggctgatcctgtcgccaatgcgtgcggaggaagtgaactggacagcttccaggccaaggccttaggatgctttgtggcttttgttttgccaccttggaagcagccaccacgtaaagaagcatcgtctagactaatgaacaatgtcagaacgcttagctggagaatggccacgtggaggagaactgaggtgcatccagcacccagcaccagacctgtgagggaggccatcttggccccactgccccagtcagtccgccttggccatcaccaccgggagcagagaggaactgtcctctgagccctcttgagttcctgcacactgaatcacaaacaatcaaaaggctgcagccagccgggcatggtggctcatgcctgtaatcccagcaccttgggaggccgaggcgggcagatcacctgaggtcaggagttcaagaccagcctgaccaacatggtgaaaccctctctccactaaaataaaacacacacaaaaattagctggacgtggtggtaggtgcctgtaattccagctactcaggaggctgaggcaggagaattgcttgaacacgggaggcggaggttgcagtgagctgagattgcgccattgtactccagccagggagacaaaagcgaaactccatctcaaaaaaaaaaaaaaaccagaacaaaaggctgcagccatgaagctttgggatggcttattaagcatcagcagacagtgaaacagcctttgtttatatgtgtatttttcattaagcttctttcatacattatttacatggtcacataattggggaatatattgtttatggtaattctgttcatatcctttgcccacttttggagggggttgttgttttcttttacatttgtttaagttccttatagattctgcatattagccctttgtcagatggatagattgcaaaatttttcaaccattctgtaggttgcctgtttactctgatgatagtttcttttgctgtgcaacagctctttagtttaatgagatcccatttgtcaattatggcttttgtttccattgcttttggtgttttagtcatgaagtctttgcgcatgcctatgtcctgaatggtattgcctaggttttcttctagggtttttattgttttaggacttacttaagtctttaatccatctttagttaatttttgtataaggcataaggaaggggtccattttcagttttctgcatatggctagccagttttcccagcactatttattaaatagggaatcctttccccattgctgttttgggtacagtggtcttgcagtatagttcgaagtcaggtagtgtgatgcctccagctttgttctttttgctgacgattgtcttggctatacgggcatttttttggttccatatgaaatttaaagtagttttttctaattctatgaagaaagtcagtggcagcttgatggggatagcattgaatctacaaattactttgggcagtatgtccattttcatgatattcattcttcctatccatgatcatggaaagtttttccatttctttgtgtcctctcttgtttccttgagcagtggtttatagctctccttgaggtccctcacatctcttgtaagttgtattcctaggtattttattctctttgtagcaattgtgaatgggagttcactcatgatttggctgtttgtctattattggtatataggaatgcttgtgatttttgcacattgattttgtaccctgagactttgctgaagttgcttatgagcttaaggagattttgggctgagacagtggggttttctaaatatacaatcatgtcatctgcaaacagataatttgacttactctcttcctgtttgaatactcttgatttctttctcttgcctgattgccctggccagaacttccaacactatgttgaaaagaagtggtgagagagggcatccttgtcttgtgccagttttcaaagggaatgcttttgcccattcagtatgatattggctgtgggtttgtcataaatggctgttattattttgttattattttgagatacgttcaatcagtacctagtttattgagagtttttagcatgaaggggtgttgatttttatcgaaggccctttctgcatctgttgagataatcatgtgggttttgtcattggttctgtttatgtgatggattatatttattgatttgtgtatgttgaaccagccttgcatcccagggatgaagccgacttgatcgtggtggataagctttttgatgtgctactggatttggtttgccaggatgttattgaggattttcacatcgatgttcatcagggatattggcctaaaattgtctttttttgttgtgtctcaccaagttttggtatcaggatgatgctggcctcataaaatgagttaaggaggattccttctttttctcttgcttggaatagtttcagaaggaatggtaccagctcctctttgtacctctggtagaattcggctgtgaatccatctggtcctggacttttttggttgataggtattactgcctcaatttcagaacttgttattggtctattcagggatttgacttcttcctggtttagtcttgggagggtgtatgtgtccaggaatttatccatttcttctagaatttctagtttatttgcatagaggtgtttatagtattctctgatggtagtttgtatttctgtgggatcagtggtgatgtcccctttatcattttatattgtgtctatttgattcttctctcttttcttctttattattctggataacagtctacctattttgttgatcttttcaaaaaaccagctcctgtattcattgattttttgaagggtttttcatgtctctaatctccttcagttatgctctaatgttagttatttcttgtcttctgctagcttttgaatttatttgctcttgcttctctagtccttttaattgtgatgttatggtgttgattttagatcttttctgcattctcctgtgggcatttagtactataaattaccctctaaacactgctttagctgtgtcccagagattctggtgtgttgtgtctttgttcttgttggtttcaaataacttatttagttctgccctaattttgttatttacccagtagtcattcaggagcaggttgttcagtttccatatatttgtgtggttttgagtgcgtttcttaatcctgagttttaatttgattgcactgtggtctgagagactgttatgatttccatgcttttgcatttgctgaggagtgtttacttccaattatgtggtcagttttagaataagtggaatgtggtgctgagaagaaattatattctgttgatttggggtggagagttctgtagctgtctattagatccgcttggtccagagctgaattcaagtcctcaatatccttgtaaattttctgtctcaatgatctaatattgacagtggggtgttaaagtctcccactattattgtgtgggagtctaagtctctttgtaagtctctaagaacttgctttatgaatctgggtgctcctgtattgggtgcatatatatttaggatagttagctcttcttgttgcattgatccctttaccattatgtaatgcccttctttgtcttttttgatctttgttcatttaaaatctgttttatcagagactaggattgcaccccctgcttttttttcttttttgctttccatttgcttcgtaaatattcctccatccctttattttgagcctatgtgtgtctttgcacatgagatgggtctcctgaatacagcacaccgatgggtcttgactctttatccagtttgccagtctgtaagttttaattggggcattaagcccatttacatttaaggttactattgttatgtgtacatttgatcctgtcattatgatgctagctggttattttggccattagttgatgaagtttcttcatagtgttgatggtctttacaatttggcatgtttttgcagtggatggtaccggtttttcctttccatatttagtgttctttcaggagctcttgtaaggcaggccaggtggtgacaaaatctctcagcatttgcttgtctgtaaaggatttcatttctccttcgcttttgaagcttactttggctggatatggaattctgagttgaaaattcttttatttaagaatgttgaatattggccccactctcttctggcttgtagggtttctgccgagagatctgctgttagtctgatgggcttccctttgtgagtaacccgacctttctctctgactgcccttaacattctttccttcatttcaaccttggtgaatctgacgattatgtatcttgggattgctcttcttgaggagtatctttgtggtgttctctttatttcctgaatttgaatgttcgcctgtcttgctagattggggaagttctcctgggtaatatcctgaagagtgttttccaacttggttccattcttcccatcactttcaggtacaccaatcaaaggtaggtttggtcttttcacatagtcccatatttcttgaaggctttgttcattccttttcattcttttttctctaatcttgtcttcatgctttatttcattaagttgaccttcaatctctgatatcctttcttccacttgattgatttggctattgatacttgtgtatgcttcacgaagttctcatgctgtgtttttcagctccatcaggtcatttatgttcttctctaagctggttattctagttagcaattcatctaacattttctcaaggttcttagctttcttgcattgggttagaacatgctcctgttgctcagaagagtttgttgttacccaccttctgaagcctacttctgtcaattcatcaaactcattctctgtccagttttgttcccttgctgccgaggagttgtgatcctttggaggagaagaggcattctggtttttggaattttcagcctttttgcactagtttttcctcatctttgtggagttatctacctttgatctttgatgttggtgacctttggatggagtttttgtgtggacgttctttttgttgatgttgatgctatttctttctgttagttttccttctaacagtcaggcccagctgggcacggtggctcatgcctgtaatcccagcactttgggagcctgaggcaggtggatcacaaagtcaggagatcaagaccatcctggccaacatggtgaaacctcatctctactaaaaatacaaaaattagctgtgtgtggtggcatgtgcctgtaatcccaactactcgggaggctgaggcaagagaatcgcttgaacttgggaggcggaggttgcagtgagctgagatcacgccattgcactctagcctggcaacagagcgacattccatctcaaacaaacaaacaaacaaatgaaaaaacaggtccctctgctgcaggtctgctggagtttgctggaggtccactccagacccagttttttttggtatcaccagcagaggctgcagaacagcaaagattgctgcctgttccttcctccgggagcttcgttccagaggggcacccatcagatgctagccggagctctcctgtgtgaggtgtctgtcaacccctgctaggaggtatctcccggtcaggaggcacgggggtcagggacccacttgaggaggcagtctgtcccttagcagagctcaagtgttgtgctgggagatccgctgctctcttcagagccggcaggcaggaacgtttaagtctgctgaagctgcacccacagccacccctttccccaggtgctctgttccagggagatgggagttttatctataagcccctgactggggttgctgcctttctttcagaaatgctctgcccagagaggaggaatctagagaggcagtctggccacagcagctttgccaagctgtggtgggctccgccgcatttgaacttcctgatggctttgtttacactgtgaggggaaaaccacctactcaagcctcagtaatggcgaccccccttcccccaccaagcgctggcatcccaggtcaacttcatactgctgtgctggcagcgggaatttcaagccagcggatcttagcttgctgggcaccatgggggtgggatctgctgagcaagacaacttggctccctggcttcagccctctttccaggggagtgaacggttctttctcactggtgttctaggcaccactaggatatgaaaaaaaacctcctgcagctagctcggtgtctgcccagttttgtgcttgaaacccagggccctggtggtataggcacccgaaggaatctcctggtctgtgggttgcaaagaccatgggaaaagcgtagtatctgggccggaatccacagttccccatggcacagtccctcaaggtttcccttggctaggggatggagttccccaaccccttgcgcttcccatgtgagggaatgccccaccctgcttcggctcaccctccatgggctgcacccactgtctaaccagtcccaatgagatgagccaggtacctcagttggaaatgcagaaatcacctgccttctgcgttgatctcactggcagctccagagtggagctgttcctattcagccatcttcaagaaatatatttttaaatgactaaatataaggacattttcattcaacactcctttttttgaaaccctctgaaatcaagaaaaataataaagttaagaggaaacttctgcttcattataacaatgaaattggacacaacttgaaatatgaggtattaataatttgaggctggtggctcagtcctttagtcccagccctttgggaggccaaggcaggaagatttcttgaggccaggaacaatgtagcccatacatacatttttagtatttttgtatactaaaaattaaaagcattagccaagtgtggtgatgcatgcctgtagtcccatctacttggaaggctgaagctggaggatcacttgagtccaggagttcaaggctgcagtgagctacgatcatgccacggcactacagtctgggtgacagggtaagaccctgtctacaaaaaaaatgaaaaagtatttgagacagataccatgacatttgaagaaaatttagagcagatgttaggaactatacacacaggctatgaattttgcacaaaataatttcagtcctaaaaaacccataaaatagtattacctattagagagaagcagaaactatcctcatagatacccacttgtacactacacagtggcaagaaggtgttgctgaaggagaagacaatttcttttttttatgtttaattttttttttttttgagataaagtctctgtcacccatgctggagtgcagtggcatgatctcagctcactgccacctccgcctccagggttcaagtgattcttgtgcctcagcctcccaagtggctgggattacaggtgcccccgcccccaccacgcccagctaagttttgtattttttgtagagacggggttttgccatgttggccaggctggtcttaaactcctcacctcaagatatccgcctgcctcagcctcccaaagtgctaagattgcaggtgtgagccactacaaccagccagaagccaattttattgtcactggcataacctcctagccaaggaacaccgcagattgtgatctggggtaaaggcaaagtgaaagcaaacatcgccagagagcaccagggcagccctacaattcatgggctcctttccactaatcacactcaccagcaaaatcttgagaaattgtggcagccacgtcctggggcaaagcgtgcaatgaagttggtagagggctttcagagaagcctgaattaaagctgcaggctgtcctcagtgtactttcctgttccccctcctaagattcttcagggaacagccagccttgttcaagtataataataagtagaaaggcactaccccagaatctatgcttgagtgtgagtggggaaaggattgcaagaagaagaaaaggaacataagcaaacagatgcattgtgcatatcataaggggtatcattcaaaaaaattagcagctagagcttgggtaattgttctctgtagagtcaaagaaattacaggcaacatatttttgttaagtttgctgaaagcaaaggtgggcaaatcgtagtccatgggccctgtaactgttttattggaacacagtcatacccatttgattccattttgtccatggctgttttgtgctgcaacagcagagaaacagagaccatgtggttcacaaacctaaaatacttactatctggctttagaagaaaaaagttgtctgtcccctggcttaaataaagtcacaaaaagataaaaagcaacctggtagtaaacaggaaaagtatggaagagaaaaaaacccttacagaaattgaaaccatgttaccaacaaaatataaaataaattttactaaaacaatcaggtgaacaggctggaggaaatcatataaattaatatgaaacaaaacccaaaaatgattagctcggaggtgatagatgtaaaagataaaacaaaagagatatatgcataattgatgtgcatgaaaaagaaattgaatagaagagataagatatattcaaagataaatagaagaaataaatatataactagaatctgcaaattgaaagaatagataatatcctagaaaactgattcagaatgattaacacaagactaggagctgttcgattttatattgtttctagggaagagaaacattaaccccaacctggagtttttagctgtgtattcctggctagagttaaaagataaagggcaaaacaaattttgacattgcctctttctttcagtacatatggtgttgatatagaatgatatgttagcaaagaaagaagcaagagctatatggctttctgggttgtgttcttttatttttggtcctttgattaatttattatctttttttttctgttcagtaacgtcgtatctttaaaacgtctaaaagtcccttaatctaaggaatccgtgtgacacagcgtttttgcccaggaagaaaatagacatagccataaggccagactttggtttcacactgtttgtttttattagtatagttttattaattaaaactaacccaaagacctaagacctacctatgtgaattccacaaagaataaggcttggctgaccacaaaactactggaggtcctgactcaaactaaataccaggctgccatcatgaaaacagctactaaataatgtttagagatgaaacgcatgtgaatgggtacacactgggcatcctttctctggaactttaatttccatttgttcaaatttccatgatttttattagagttatttcatacatgttctcccctgaaatgcgtatacatacataagtgtgtgtgtgtgtgtgtgcgcgcacacgcatgagcgtgtgtgtgtgtgtagttttaaggtttttgtgacagtagcacgtaaagcacaaaagcaccagggtgaaaaagtaacagtcaaatagacatagttaaacataaccttcattaacaaatcttgttattcatggatgccagctcagttaataagtgtttgtggcttggatactgaactggaggttaacgtcgaggtggaagcaattgtagaatccagatttttaagacaaacacacatcccaccacagaaggcatgcacggaatcaggtgtagtcagtcggctgtggtgatgcactttgagtgttctccttcattggtccagctctgaacagccaccagagctggcagcttcccaagcaggggagtggcccttcctgagcctcccaaaccacttctgcatccacccctcaaattaccaaatgggagactgtgagagaggagtatttttatttgacattttaaaatttaagttttgtaggctgggagcggtggctcacacctgtaatctcagcactttgggaggctgaggccggcagatcacaaggtcaggagttcaagaccagcctgaccaacatggtgaaaccccatctctactaaaaatacaaaaattagccgggtatggtggcgcacaactataatcccagctactcgggagtctgaggcaggagaatcgcttgaacccgggaggcggaggttgcagtgagccgagattgtgccactgtactccagcctgggcgacagagcaagattctgtctcaaaaaataaataaataaataaataaataaaactaaagttttatttttacttctccaaattggatttgtagaacagatagattaattatatacttacagaagagtacgtgtccaaatttaagtaatatttatacccatcttgacttggccatcaaaagtcaatggtctggagtcagatttcccttgaacttcatttgcttaaaagcaaaatgaatgcaagacatgatttgaaaactgccctgtttttttggcaattaagggacatttttatgttaaagaatctgaagccctggcacattccttaactgatttgctttcctctctgtgagatggattaaaaaacaggagatttttttcatgtgcactggtaatcaggtcaggactgaaagtaaataagtatttgaggaagtggacaagtcagtcacatcctcaaaggacaccaaaagaatgcaggaagactgtctttttcctccttcattccttgagagacaaagagagaagactgacctctaaaacatgtaacctcaacactgtttctctagtcagaagccaaagctgggtggcgatttgatcacagagtgtggcctggccatgtcatgggtcatgtggtccagcatgtgaacaggaaggtgagaacgggtgaacttttgcctcagttgtgccatccatcagggaatcaatggagcacatcaacgtgtgcagctgtataaggaggcggatggctgcgtccttctcacacaggggcctttgtctcctggacatgatctagcattacgacgggatgcactcagcctcggctttgtggtgaattactaacccattatcacaccagaacacaggatcatttatcttctaatccagagtgtcacctgttcttcatttaccagtcaataaccattaattatgctcagtggaaatttaaacaaagccctatccctctgttgaaaccagtaaactattcagtaataacaaataaatctggagttgtatatcctttctcttctcattcccagactggagtctggtacaatatgaactttagaggaaatgcctagaaattgataggtcaaaggccacagatagtctgatggagaagaaaagagcagattcttggctcttgctctagtaaaaggagaggccctgactgatccctagattcctgccgggaacaaaacaagcaccaggggacccgggccggtgtttaaagtgacccaccagtagccaacagtcaagtttctccaagtgatccaccagtagccaacagtcaagtttctccaagtgacccaccagtagccaacagtcatgtttctccaagtgacccaccagtagccaacagtcaagtttctccaagtgacccaccagtagccaacagtcatgtttctccaagtgacccaccagtagccaacagtcaagtttctccttttacatttttagcacgtccttgtcttctttcacatgactaaaaataggacttttttgagaccactctaacacagcggactgtttctaaagaagtaaaataagctgagtggccctgaaagacctatttgagatgttatttttagaatggaaatttgagtcaaacacattaaagtgtatttacccccttacatctaatcccgcagaagaacgttcagataggaattctagccataggcatcatttaatttttcctaaaaattctgaaggtattttggcaaaagccaaaataagtttctgtgtgtgtgtgtgtgcacgtgtgcctctgtgtgtgtccacgggtacactcgtgcgcccacttgggtgaagtgggaggctcagcttagttgggaagcgggccaaagggcaggcccgatcccggtgaagccaccatactgtgtgcattggaattcattccagtggctagacttgggaccctggtccgggacctagagagaggtcagcattcccagacagatgaggagacagggtgttccaggccgcgggaatttcacttgcaggcacagacctacaaggagcagctgctcactaggcctctgctcgtgcacacaggccttggtgcccctttcagaaagacaccttggggaacttcttgacaaacggtgccgagcctgggctgtacttcagatctcattgctctcctcagcccccagtgtttaacagtgttcagggagctaccaagccattgtagactccatctgcttgtgtggactatcccaaaacagtgaacaacttgtatttcatgccttttaaaagctcatgctttatcattagtagtagtagtggtagtataacatttaaaaagtcttgtggctcagttcaccaaccatgatttcttaaggcaaaatgaaattgcaggtattccattaatgtgaacaaatatgtcttctcgccaagataatttcttccgtcagttactttatagaatatcactgacttgaaactattaccattgtcccaaccagcatgccacatctccaaagcatataaaatagaccaaaatcttgtcttccatatgatttaaaacaatcttgtaatagaccaaaaatacaaaaacatacacaggaaataacttcaggtaaaagagaaattattttaaattttattttttagaagttttctacaaattccaatgaataaaaaggaaattaaacttttttggtggcattttctaagagaaaataggctggctcattgattttagcaacttcttgtttttggcttatcaaggaacaacttagggagacgcaaaccaaacagttttgtttaaattttgctggaacgagagttcaatgcacatatcattggaggctgtgttataattaagtccttactgtttttacctattttattttgagaagtgggtggaagtgatgaaaaaatagagattgatttttttttgttttgcttcaaccttttttgaagagacatattcctgttggattcctgctacacttatttttttttttaaatcttcatctcctatctgtattaaaaaaaaaaatctttaaggtgcaattgcgagatacaggaactccaggcctatctgctgttggtaaaagctaaccacggggagcggggctgcgctggtgccaccagtcagtatcttggacatgcagtggcatttttgcccaccagactcctggctcctactgagaaagtgaacctgtatagacatccattttttttttttttttttgagatggagtctggttctgtcgtccaggctggagtgcagtggcgcgatctcggctccctgcaagctccgcctcccgggttcacgccattctcctgcctcagcctcccgagtagctgggactacaggcgccccccaccacgcccggctaattttttttgtatttttagtagagacggggtttccccgtggtctcgatctcctgacctcgtgatccacccgcctcggcctcccaaagtgctgggacgacaggcgtgagccaccgcgccctgctagacatccattttgatgtggaagttgagcccctggccttgaaatgctgccttatgaacccattaactctgggataaatgttttcattgcctctcagacagcttttttataatagtagtactctccattacgtggttgtttttccattaatgattcgcacttactttgttttttgactagtaccttctcaactttattgttcaaaaattaagttctacttttgaggacaaatacctgtctttaaatggtttttttccttgactactatctatgatatgaagaaaaattaaacagtgcttttagaactgctctttttgtaaataataccataaaaaggttatttgccatagacactgcttcacatcacattcctctacgttgtggtctgaggacctgcactatgagaatcacctgggatgttaaggataaatattctgagagagaatctccaggcctctgagcccacccctctacggctgcagccctggcatccacaccaagaagttcctcatgttattcggatactcagtaaaagttgggagccattgctgttgtgcttagaatatgctatgaaattcatgctcatgttccagctgtcgatgtccatatctgattatgtgcactggaaaacaatgtgtggccactgagtgtgacttcaaagtgaacttgcctctctttccctctaggctatgtggttgatgttgcagaatgatgagccggaggacttcgttatagctactggggaggtccatagtgtccgggaatttgtcgagaaatcattcttgcacattggaaaaaccattgtgtaagtatacctgagaaatgactacttgtagctctctggcaggtatgcacctgagcttgctgaagcctcggttctggctgtcatcttcccccttcactctcctgaagagcaatacagaaagtttcagtgtagagtggggcctttgctctgctctgcatccagccctacttgtgttatttgtcagatgttggtcagcatctaaaccaagtttttccacatttctttcatctttcttttaagatgtttttggccaggcgcggtggttcacgcctgtaatcccagcactttgggaagccgagacaggaggatcatgaggtcaggagttcaagaccagcctgaccaacatggtgaaaccccatctctactacaactacaaaaattagctgggcgtggtggtgcgcgcctgttatcccagctactcaggaggctgaggaaagagaaccgcttgaacccgggaggcagagattgcagtgagctgagatcatgccattgcactccagcctgggtgaaagagcaagactccatctcaaaaaaaaaaaagaaagatgtttttactttcatttatttttaaatactattttattttactttttttagttttaaatgttttgtctcaatataagcaccttcttttttttttttttttttttttttttgagacagagtcttgctctgttgctcaggctggagtgcagtggtgcgatcttggctcactgcaacctccacctcccaggttcaagcaattctcctgcctcagcctcccaagtagctgggattacaggcatgccccaccatgcccagctaatttttgtatttttagtagagatggggtttcattgtgttgaccaggctagtcttcgaactcctgacctcaggtgatccacccgccttggcctcccaaagtgctgggattacaggcatgaaccaccacgcctggccaaaaacatcttaaaagaaagatgaaagaaatttggaaaattttccaaatttctttcatcatgttatgtgaaagaagccagacacagaatgacaagtactgaatgatatcactcctgtgaaatctaaagaaagatgatagagaagcagagagtagaatggtgcttaccagaagctgaggaagggatgggtggaaagaggctggggagagaatggtaaatgggtacaaagtaacaataagataggagaaataagttctggtattctgttgtacaatagggtgtctaaggttaacaatacctattgtatatgtcaaaatagctggaagagagaatttttaatgttgtcaccagaaagaaatatgtgcatgagctgatagagatacactaactaccctgaatggatcattatacaacatatacatgtgtcaaaatatcaaaatgtaccccataaatgtgtacaattataatgtgtcaattaaaattttaaaaacaaaaataagaacactcagaaaaagagatactgcccaattattttgtgaacattttgtctcaatatacttccaattttatgaaaaatattgacaattcgtggccaagagttacataaatttgttttgcatgaaaactttgtgcaggaaactaatgacattaattatagaaaattaaggcaaaaataagatctttttcaaattttacgtataatatggggagttggaaaatagcatatagataggaagcaagaagatataaaataatctttgaagtgtaatttggttatgttgattcttttggccttctattttattttttaaagaagatacctcatttttcaaaaaaaaaaattggccttcttctcttgtggactgaaaaatgcattgttggattgattatgtttggaattgagggtttttttatacttttcaaatataaaatttatgttgcttctaagtaaccctcctttttttttttttttgagacggagtctcactctgtcccccaggctggagtgcagtggcacgatcttggctcactacaacctccgccttctgggttccagtgattctcctgcctcagcctcccaagtagctgggattacaggcatggaccaccacgcccatctaatttttgtatttttagtagagacggggttttaccatattggccaggctggtctcaaactcctgacctcaagtgatccgcccacctcggcttcccaaagtgctgggattacaggcatgagccaccgcacctggcccaaaaattttaattaaaacgtatagtttagcagaaattaatatctgccactctcattaattactttttttaataactctctaacatattttaacaaatttatattgtatatgtgaataacacagattatacttaaacaagtttaatgagaaaaataagatgtaagcataacatcttattctttaaaaaatatgtgcacttttgtttatgttctctgtaggaatcaaacatgacattttattattaggagtgtcctgttatgctccaaaagttgcgaaggatgatacgcatgaattattttttaaatgtgtgaagtatctatgctaataaaggcttaagcatagtgaaactgtttagtactatattaggaaagggagaaaagtgaatggactttcccagcagtcagagttcttctgtttttcaggaactgaaactgaactcagagtagccttaggtacctggtgctccttcagggcccctctgcttcttggctccagtgccctgggatgttgcctccatccctcagctgctccccatggcagagggcagtctagactgcctttctggggacacagcctcacacagtcaaaagaggaatagaacctttaagaacaatccacctagaaaaatcctgaggaaggactgtggctggcccttgtgggtcctgcagttatccctagacctgtcgctgtggccagcgtgggactggatcccaggccttggcctgttttcagggtgtgaggattctgggatgagcagccccactgaaagtccactgtttgaatgcgggggagcagggtcttcccctatagcaggatgctattgcagaagaacggcaggatgtgctccaagacagacagagacagcccatgctcaccgcggcacgcagggagtggttagggcgagcctggaggcatgccaggagccgcacccctactgtgtttaatttccagggctggggcactattgcactgagaaggaaactgaggcacagtgcagttcagtgctctccccaggtcacacagcaagggagtagcagagccagggtctgaaatgagtatgttgtgacccaagacgctcctctttcctttatgtgcactttttatccttcttgttcatatgctgtcaaaaaaaactttgtgataggatatttgcagtgaacacagacccaggtcttcatgcctgtgggcatcgtctccttcccaggttatcctcagtgctctcaacagctgacggtgctctgtaaatacttaattaagcacaagtggatatcccaaaagccagcttatccagaaagtcctcccagaaacacccactgtcatcctgatttccgcagatttcatggttagccttattccctctcatatggtggggacagcttgagggaaaccaccatgcttcctccctagaggcttgttggagctgtccagctaaggatgaggaggatctgcattcagccgagaacatggagagggagaggagcgattgatttgagtcttagaatcagcgggatttggtgaacagccagatgtagagggtgaaggacagccaagctctctagtctcattagcattgccattaattaagctagaaagctttctgctagctcagagttctacttgttgtgctttgtgtccttgcctcatattacatgaggctgtaccgtatcagacacaccaatcagcatctggaacattctcacttttgctattctaagctctgctgtctcttcccatttttgttatcgtttttaaaatttatccgttgtaatgttctccgaaaaggcttgacacgtgtcgccatctgtatatttagaatcgacacagatatttcctcttgaagtctttgacatcacttgagtaatttgaataatttttgttttgcatttattagaaaatagcacattaatttgagtttgggttagtagaagatattcggggaagcagatcagtaccacatgcagtcctgataaaatgtaaggtaacgttttaaattcttacacagtcatttgtattgagaaaggcagccttatgacaactgctttcttttgatagcatctgtgtgtgtgtatgtgtgtgtgtatgtgtgtatatgtgtgtgtgtatgtgtctgtgtgtgtgtatgtgtatctgtgtgtgtatgtgtgtatgggtgtgtggtgtgtgtgtatatgtgtggtgtgtatgtgtgtggtgtgtgtgtggtatgtgtgtatgtgtgtggtgtatgtggtgtgtgtgtgtggtgtgtgtatgtgtgtatgtgtgtctgtgtgtgtggtgtgtttgtggtgtgtgtgtatgtgtgtgtatgtatgtgtgtatctgtgtatgtgtgtgtggtgtgtatgtatctgtgtgtggtgtgtggtgtgtatgtgtgtggggttgcgtgtgtatgtatgtgtgtatgtgtgcatatctgtgcgcgtatctgtgtgtgtggtgtgtctttgtggtgtgtgtgtatgtgtgtgtatgtatgtgtgtatgtatgtgtatctgtgtgtgtggtgtgtgtgtatgtgtatgtgtatgtgtgtgtgtgtttgtggtgtgtctttgtggtgtgtgcgtgtgtgtgtatgtatgtgtgtatgtatatctgtgtgtgtggtgtgtgtatgtgtatgtatgtgtgcgtgtgtatctgtgtgtgtgtttgtggtgtgtgtggtgtgtgtatgtgtgtgtatttttgtgtgtgtggtgtgtgtgtgtatctgtgtgtgtggtgtgtatgtgtgtgtatctctgtgtgtgtgtgtgtgtgtgtttgtgtgtgtgtggagcacattgcattgttggggctctttttagtgctgtgttttgtttttcctttcacatcaacttaccactaagtatgtagtgtgaaaaggaaacacttttctcctacaattaagatgatagtaggataacccaaacaggcaaatacttgtcttgactaattttctgtcattaatcttgttaaattttgagaagagagttgtaagagtaccctacaaccaggtgagaaccaacatctgctgcttgttgtcgttgtgggaggtgggtaatgtttcagacatggaaagtgttattgtagtctgtggtactgaatttacattttcagtaaaagtaacaagggcaacattgttatacatcagaaaagaaacccatttctaaaatcctcctggcagaggtaacaagctgttttgtgctcatgcaccttgctcccttcatttgacactgtttcctgatggatgggatttctggaccctgggtcctaagcttcatgaagcctctggaggccgatcttgaagacagctcctgagaaggaaggcctggcagcaggttccagggggtggatcctgcagccagtgtagctactgtaatgcattcctcgggaatttgcagagcttgggactgtcaaactcactgtgggagagcacatccctccactcagtcagttgttggtgatgaacagaactctcatgtaatgagccatacttctaagggttctatgtaggggcaaagtcaggagaaggaaactcactgcagctctgtattattccctaacctttcaatgtggtgtgtttagaccagccaccgttgatccctgagatagatttaactcccacctcagcagcttgccaaagcttcttttgatgtccatgctgtgaccaggtggagtaaaatctgtgacactgagtgatggaaatataactcaccttcattcatcgtcactcaaaatccccattagagctagaaaaagcagtcatgctgagaaaacctgcgtagagtcccatgagaactttctggagagactctaaagggactcacaccttcaagagtattcacattatatttggtcatcataaagaggttggacttttcatataagcttcaagttaccatttaaatgaggtcttcttctctttttcttctcgctttcttcctctctgtctctctacctccctcctggaaatctgaatcctactatcatttatgtttctgaacttctaagatgcttagatttttaacccttaaaaaacaaaatactacaacataaggtgatgttgtagtgcctttgttggagcaacagacttttgaattattggcacctgcaagatctaaatagagccctgatgtcatgctgggctgtgggtctgaggcaaccctcatttcatttcataggcagttgatgcaattcaccaggtcgcgggcccattttccttcttaactaagggtctgttagatcctcaaaataactgctgccttcataagtacctaaacagctggcacagcacctcacacctcttaggtgctctataaatgtgttatttgctcatctaatttcctctcaatgccaaactaatcaaagagaattgaaagagatttcctagccctggagaaatatagactctaattgggtgtcaattaataagaacacattatttacaaatatctgtgcaaatatgaagacattgtgcaaatttattatattgatactgaagtaatagcctcacaatcatgattggagttatgtttgcagaaagttagatgtaagctggaccttgtccagattgggagatacggatgataggaaggaggaagacattccaggtgggtgggagggcatgagaaaaggcatggaggcaggagctagtgcattgtgtgtgggcactgggtaagctgatgagcgagggtggaacagcctggccacactgggctcgtcaaatgcctgctcctacagttccgtctgcttctcctggccacttcccactcattcttcaggtcttagcttaggcatcctccctctgaccaacaccctgcctccacctagtctgtgctaggtgcctacctcctggctctgacagcaccctggctctctgccatcattccctcacaagactgtggtggccatagactgcaggctccttaaggacagagacatgtctagcttccacatacccgtgtccttagcaactggcttagcttactggctggcacctagcgggtgcttggtgaagatttgtggggatgggaggaagggagatggatagacacagtcgtgtaggtgaaagaggtgcagatgcagatggcccagaacagtggcagcgactctgggggtacttgggcactggtcgttttggcacacctactcactgtggcccctcaggaagcctctgtaagttttgcttcccccacacagcagaagctccatccttatccactgggggtggctaatatgccccagttgggtaaatataaatgaagcaggcagctggagcgcatttaatgagctgtgcgaggtagcgtggacacgctgaggctctttgaaatgctagctctgcgtcagaagatctgttcactgtcattttcacagccgaggagagccatctctggtcttgtcttcttgttaccattatcattattattatttgatctcttcagctaccctcagtagcaccacctcgcaaggctttttctgttgaattcatcttcctagtctgacttcctagggatgaagcataagaaaaggctgtttagaggggagcctccctattaagtaatttctcagtcctactgctaaaaagaagaaagcaagggaagtattgaccagctgaccactcttactgaaattaatgtttgaggaggcctccccacaaaaatggccatgcccttttgagagggcaccacacctttctggctcagaccacgtgaaacaggtgttgtctgggcccagggtggggcagcccagaagcctggcttggcagtcttggctccagcaccccttccccacgtgccatctgtaaattgttcagccctgtgaatttgtgttcttccatttatgcactgcagatgatggtacttgcctgcctcttggcatatgaattcagcaagtgacattcataagggccccacgatagagaaatcacagaatagatgtaggcgttaatcttaagaagtgccttctacatgaacagctgtataatggatttaaatttcacattttttgtggtagatggttattccttaactacaacataacacctgggctgagtactgccagaagccccttacttagaataattatcataaataagatggaagaattctaggcatggatggaggctaaccagcctccatttcagtagcaatgcaagaggccatacacagctaaggttctcatagatccagggttcaccgtttacactagcgctgtattttaaatgttagagtgctctgtgattaaagcagtgcttcccaagcataaaaacggcacccgccctcctttcccctgtcccactagcaggtcgccccgatgccccttggaagagtgcctcctcctggcctatggcctcagcccttctgcctgctcaagaggctcaggctgccgctcagcctccccactcagccctggccctctttttttttttttaagacaagagtctcactctgtcgccctggctggagtgcagtagcacgatctcggctcaccgcaacctctgccccccaggttcaagcaatcctcccacctctgcctcacaagtacttgggacaatgggtgcacaccaccaccaggcccagctgggacaataggtgcacaccaccaggcccagctaatttttgtatttggagacctaacatggtttcaccatgttgccccgactagtctcaagctcgtggcctcaagtgatccgcctgcctcggcttcccaaagtactgggattacaggcatgagccactgcatctggcctctggccctcctttgaggctccctctcgtcttttatagaggccccttcagaatcggggtccctccagtcactgcctggcctctctctccccctgttctgccaaaaggcatcaaggagccacctccacacacagcctcaccccatccattcagctcccgacaccctatccaagtagctttctctgatgtgcccagggccctgcttgagtccctgcatcctcctgacatctgcccatcatcacagtttggcagtgctgaccgccctcctccctgggctgctgaggtcgcatacttcaccttggcctgcctcttcccagggttgcctgctctgtcttctctgcagatttcatctgcccaccctgttagtggcttctgtggtggtgcaggatctggaatgttgatggagccaaagatgtcatcccctccccatccagaggcagggtgacaggggaatcctgtaaggaagtgctgggtctgtagcggagctagtgtgacagaatacccatctctggggcagagctcaggctggggtgtgctgaggcccatcttcttcgttgcagtctcgctttctctgcaacgtagaggggcctgcggggagggggtttgtcactcacatctgctacttacaaagctcacatttgtaattcttttttcccttctttattagatgtttttgtccagttaccccagcaccctagtcctctaatcattctacaggagttctcacaaatccctgctgtctcctacccctgcttcctccctgcccatttccctggctaagcccatctgctagggaatgttctgtgctctgctgtttggggtgctctgtgggccctttccgacatacagaaatgtttgttgttctgctgtggtacactgtcttatttaaagataattatttgtttctggaaattctattgtactgtattacaattattttggcatttatctccatgtttccaaataacatgtcgttactgattttgcccttctgggacttatctgtcggcctcctcttattcaaaacaagagttttgccctcttcttctccccttgacccatccctccgttctcttaatactcaattgttatgttttaattttggagtcaagtcaatatttagtgctacattaccatgactgacgaatgctatgcattccagtaaaccacatgtattttatctttttttatttttatttgtttatttgttgagacggagcctcgctctgtcaccaggctggagtgcagtggtgcgatctgggctcactgcaacctccgcctcctgggttcaagcgattctcctgcctcagcctcccgagtagctgggactacaggtgcccgccaccacgcctggctcattttttgtatttttagtagagacagggtttcaccatgttggccaggatggtcttgaactccagaccttgtgatccacatgcctcggcctcccaaagtgctgggattacaggcgtgagccaccatgcccggcctattttatcttctatgtacaattgtcatttgtttactgtagagctaacagatgccttctttctctgttctattgattttctgtgtacttatcactaactttaccccatactctgctccagctgtgcaaatcacctctctaggctctcaaaccccggttgggctgtcagtcacatcttcctgaggcagtcctagagcctctgacctgaccccgtgtggactgcccagaaggtcaaaccctgctgtgtcacttcatgctcctctggggggctctcttagctgctatcctgcactgagcccctatttcctgacatcttattcaagactacttggtttggtaaagcaaaatcataattagtttcctgagaaagatacctgggaaacaaatactttgtgacaaaatatacctgaaaatatctctagtccaatctcaaaattaataatgttgctggtatatatttctagattggaaataattttccttcagaactttgaaggtgttactccattgcctattaatttgcagtatcaccatgggaaaccaagagccattctgactcccagtcccgtctgtcccctctagaaagtgtttcagaccttctcttggtcccagtggtgtggaacttgatgtgaggtgggtctagacccattcgttattggaggacacccttttggtgtggaaatgcatgtgcctctctgctttgatcagtattcttgacttattttaagagagttgtttgctctgctccattttttctgtactctctttctggaaatcctgttatactgactgccctgaggcactctaatgttcttatcttccttcttctggtttttcatgtctacacctttttgctctactttctgggagattagatttcctcaactgtatcttcgaaatcatctcttggattgtgaatttctatgttttgttttcaacttctaaaatcctgtgtttcacattatttctttttatgtagtatcctgttcttgtttgtttgatatctttcctgatctctctgtctgaggacgtcaaaggtggtagatgtggggattttcttgtttgttttattttgtttctgattctcctccccctgcttgttctacttcctccacgttgctttttttcagtttgtttctttggatttctatttttcatatatgtgattttccttatatatttcctgtctcgtaatacttggttttctgcttctttaaaagtggggggcctaaaaagctacttgtgagttttgagagcatagttagatcttgtggctattttattataagaggacttgacggggccttttagttggagaatctctgatgcccagaggagcctccccagtgtcctcattggaaggaaataggcctgactgtcagcccacagagagctgtgtggtgggcctcagtattcatcgtgcatacaagcacctaatttcctctgtcttcagcatggtgacccactcttcactgagcctgtagccttcagtccagccaccttctacctcagggagggtgaggcagtgagtgtcggggagggaatcaggccccagactgctgcctatggagatttgcaatcaggtctcacttcctgagcatttgggaacttctgcaagtgtaaattggggccattctcagctctcccactgttggtttaggagacttttctaggacttctgctaagtcctttaacactcatccatctgctttccagcttccagaatttggtttctcacatctctttcctgccctcttagctcatgtgagtttattccttttttgaaaggggtctgcggaaggagcaaaagtgtgtgaaaaccaccatctttatccagaagctaatgcttcctccaggcctgccttatggcactgactaaattttagctcctgcagcttcctacttccataccctaattaaatcgcctttcttcagaataatccctgagcgcttttatgatatttgggtcactacgaggagtgtgttgcccccgccccacttagctctaatagtccccaaacttgactcatggtcactacaaggagtgtgttgttcccccgcccccaccaacttaggtctaatagccccaaacttgactcatgtggctgactttgcttttgttgctccttcaaaggaatgccgagttgagtagattttcatagcgctttgtcttgccttattgtccttgattctgttattcttcagtgctttctattgctatttaatgcttattaggagccaacaatttattttaaaaattgaattatacaggatccctgctcggtgagctgttgatctcaattcgtgggtagtaactcttgttaattaaccgaatcctctcctctctgtcaagccaccgtcacttcattaacagagcagccctgcttcaagtcgtaacatcacttgttaggacatgttagctgttaccttttacttgttaatacaagtgtttcatgtattgttgtaactgaatgttttttggcacttggccgaaacttttgcttactgccctcattcagacctggtgcaaattagaaagtggtttttgccaactcaattcagctttgagccatttcctgattacatttgctcattcaatgtagctatattaattgtagagggcaatgccatgcccttagagactgttttgactgtagacagcatttgcaagatgcaagttcagcagacagcgttcagacagtggcaagaaagtcgtgcaggggagctggtgcctgttgagtgccaaagtagcaccagacccaagtctgactttcaggctgtatttaataaacccctcagagagggagtgtttctccttcagccttttcccatttcagctagtgttacaaatcccaaatgtgagtctatgaccagcaaagcaatcaaagagaatcagtagtagacactaaaattcaagcagtctagccgtgcaggccactgctataaacaggaattaaatgctttccttcagctgagggtgaggcgataccattaacctgatcggccgaagcaggagtgggcaactggagcctgtgggccaaatcccagctgaggcccttttggttttgtttttggttttttgttttttgttttttttttttactgtcctggaggtaaggacaggttttacagtcttaaagcgtggtttaaaaaaagaagaaaataataaggaagaaaaaataagaggaggaagaagaaacagaaaaagaaagaggagaaaggaaaaatatgtaacagagactatatgtgatctgtgaagctttaagtatttactgtctggctcttcacagaaacagtttacagaccccaccaaagtctaaagacccctcaggcacggcctcagtcctctcctgactcacacgctccctcctaaaacaagaaaagctctccaagtctttaccaaggctttgtcgatttaaatatgtgtgtgtgtttgtgtgtgattttttaaaaattgaattataaatagatttgaatcaccagttctcatggttgtggcatttgagatttaccagtggaagaacagtggaatattggtgcgcacataagtcagcgtggccagctacaggcgaaaaatcagtcagcagaattgtaaatggtatttctgttaaccctttgacttggttggaggtactatcacgcaagtatctgctgaacttgtttctctttgcgaagaacgaaatgtgagcaaaaatagatcaaacatgcctgtgaaatacaaatatactttcatctactgaaagcctaaccaaaatttttttaaaaggttctacttaaacaattaactttagaattagatagttatttaaaaaaaataataataatgacttaaccaattgtcctcccttcctgtggatattagctaagatttggtctttatccacaggagatgtatgagggtcatcattccttcaggttatgttttaaaacgctttcaatctccatgctccaaaacatccacttaccgtttcccggtgaattttccaaaaacttagctctgatcctacctaccaattcccttgctttgaaattcttagacctatatgacctgccaaattgatctaatcaacattaaggaagaaatgaaaacaaattaccaaacatccctttttgtgttaattaattaatataaaagtcatggggaaatgaccagttgtacagctgtatattattcaacatactgcgctatataattctctgtgtcacaggacagttttcatacttgccttgagtccattggtaaattcagcacactaacaaactgattattcctccaacggtgaaatatttcccctttgctaccaagaagtgatttgacagaacattcaggtgattcatcagaaataaggcttatgaggtcagtttatgtctttaattctcaacctattccaaaatataactgggatcaacatttaatgttcattttcagtggtgcctgtggcttacataggcaggtaactaattttgtcttccccatgatgactctgaccccgagagcacacagaattgtcctgtgtccataggattcatctccagctcataatgcaaaccagttctaaggataaacagtaaagtcaaacatgtcatacttgttaatttcttctctttctttgcaaaaaagttcatatgtaaaaataaataacccaaattctgtaatattatagacatccagacgttaccattaagtgagtggcttgatttataaaaaatgagaacataaaatggataagtagaattttagcgagaaggtaatctcgaagcatatgagctcatcctgcatagtgtggacttgaggactcgctcctgggatccttactgctgtcaaccttggatgttcagggaaggaaacttgtgtgcaaacagtatcctagctaggtcagaggaggttataggaaagtaatattgatataccctcactcagcaggaaacaaacaattagttctgtactttttggaggtttaatcatctgagacttactaagggggcccaccattgacgggagagcaggagaacttgtatgtgatccagggatgcattgaatggttaattaggttacaaaacttattcccaaatggaatgtgttgaattaactctgaatatccctaaaactacaaaagaaagaaaaaaaaagggaagacagaagacattaatttatattaattaatttataataatttattaattaataataatgaattgaccaagaatggtctagagaaatacaaaatctttgaaatccctgaaagttgcccaattttattttctggctaatctgttcatttctaaagtctcacttctgaattcgtcatgattttcttgaaaaggaaaaaaacgctgcccttgcaaaacagatctagaaaggctttgaaagtcgccgttgctttaataatcagctggagcatcagcctgtgctgctgtggttaatgagcttaagcgctcctgcggggagagggctggggcatcccaaggtgctacagcatggccaaatgttcccaagcaattaggagctgattcagtgtttatcttccttacaggtgggaaggaaagaatgaaaatgaagtgggcagatgtaaagagaccggcaaagttcacgtgactgtggatctcaagtactaccggccaactgaagtggtaaggactctctggccacccagtgcgtggccacatttggctggctggctgggcaaatgcgctcatggaatgcctggtgccagcctttggagctgtcagttcagctccctggcatccttcagcgtgcatttccaaaatcagaacacagtgaattcaatttgagattatcattcttaccacaaacttcattgctctataaaggaaaacaagagttaaacccaccaaaagaaatcattgatttcagaaatggaatctcacatcacacgcagatctcctcatgttggtctcctattctaatggctggtccctgataacctacaggatgcctgacttaacaacgctgtcccagacctgcaggacatctaggtcctctccagctatgtctatgtctgtgtctgtgtactcatacacaagtgcatacttgcacactataccataaatggtctcccctgctttttataagactcaggtcagggaccaccctgtccatgtagccttttctggccgatacatcagtactgctgaaattccttcccactcctttctttgtatccacattatatgctatacataattctattatagtacctactataacccaccataatcatttgtttacatgtctttctctctttaccaaattgtgaactctttgagaatagggacttttaaaaaatatcttaaggccaggcacagtggctcatgcctataatcccagccctttgggaggcagaggcatgcagatcacctgagctcaggagttcaagaccagcctgaccaacatgtgaaaccccatctctactaaaaatacaaaattagccgggtgtggtagcgcatgcctgtaatccccactactcgggaggctgaggcaggagaatcgcttgaacccaggaggcggaggttgcagtgagccgagatcgcgcgccattgcactccagcctaggcaacaagagtgaaactccgtctcaaaaaaaaaaaaatcttacactagactataacaaggtaggtacttaataaatactgactgattgctagatggatgggcgaatttctaaatacagaacttcctgtgttacaaaatggttgttagaacataacatcctcctttcctaaacttataaagctgcctagcttgctgttattgctttaatgaggtccatcctcactatggaagcaaagctcaacatatgaaatatacctaaagataatagaaagcatcatctctagagagaaacgttcatatgtgttacctagtgaacattaactgtgaaaattgaattttttgaaaccattttccctgtgttctgaaccaaattcctatctgttgttcaaccttggagaggttaggaaaaccccagtgaagagagactgaaagtgaatcggtcatcatttaccactctttaaaatgtcttgtttcagacagaaggaaaaaactgtatttcatgcactctaccacacaggaggaaataaaaaggaaaggaagtaaccagtgcttgggagaggtagggctgtggagtcgtgcattgtccgggcacagggcgtggccggggctctgacacagtgaaccattgttcccggtgctaatggagagtgggtgtgcctaggagaggatgtgtactggccctcagggaggaagatgccagccacgctgtgctgacatagcagggactgccgactggagccctgagctgtgctgccatttgactctctggcctgatgaggtgcgacagagatgtcaattttctggaacattgcacagatcacatatttatgcaaatgcttttctgtatctacaatcaaaaatggtcatctcagagaaggaaatttactaagccaacagaaacctcaatttttacaacttaaatgtggctctttccctctctgacaccaaaatagtttcaaaagctaggaagtcattaagaatggcttgtctgtcattcctacttagacaaggtgtgggattgataaggacacagaacaaaagaattcactgaacaggaaaaggaccctcagactaacaagactgttcttgaatccgcatcgaccccctttcctgccgtgaccgacgccgcatccctcccgtttcttttgttcattcaagtgctatcatcatacctgttctgcagctctgttgacactagcattctttgagtataagagtggtgtctgatttcatatgcttgctttatttttccaccgatttggctctctcctgagcttccctttactgtccaattttgaatcttgaactacgttttatctttctaagcctctaggctgcattaatttcattcactccacttcaacctaatattccactgggtaagcttttcctgtatggtgagactaaacttttaacctcattcctcagaacaacaagttttcctaaaacttggatcaacttgacagcctcctgttgaattgcctcaggggtgagaatattcttccagttgaaaggtaaccagaactggagactatattgtaaataagcttttagttaggtgtgaggtcccaagagccaatggtctagagccatttggtatgagtcctgaaaagcaccaagcttctttgaggtttgtctacattcaacttaggatacatgtggaattctctcacatctaaactgaatctttccttctcagggactcagtccatcctgcacatgccaaaggcttcttattcttcttatagtctgtaaaagtgctttcaccgatcagcttaggtcatctgtcccccaagatcttctgcacagagggacactcaaaccaataactatgtcttcttagaatcatttcggaatgactgataggaaaaaaaaattgccataaagaggccgaggcgggtggatcacaagatcaggagatcgagaccatcctggctaacacagtgaaaccccgtctctactaaaaaagatacaaaaaattagccgggtatggtggcaggtgcctgtagtcccagctactcaggaggctgaggcaggagaatggcgtgaacccgggaggcggagctttcagtgagccaaggtcgtgccactgcactccagcctgggccacagagcgagactccgtctaaaaaaaaaaaaaaaatgccataaagaaaatttgaaaaaaaaaaaataggacacatcaggtctcagaacactgatatcctacagcaagactaaagggaaatagagctttatattatgttttgaataagactcagaatggtctcaaaaatggccctttgctcagcaaaggcaggtactagcttgaaagaggccaccagtggttccatagagggcgtagttccacctgtgctggtaatttctttttcctcattgatttagtgcctcaaaaccttcaatatcgcttctgtaccagtgtgaagttttcaaagtgtttgttctggactaaggactccagcatccaattaaagctcaattgagcaacattttttggtactctgcctacaggggtttgttaccacagagagcctgatcctggaaattagactttaaattttccatcactcctgaattctggtatttgttgatgataacattagtacttgagttctgtgccacttaagacccctgtcttgtgtataattttctgtacatgcatacactgatgcacagatttattgcattgtgtgttcattcttagagagaaagtggtaattatgctcaaatgtgggcctgttggccaaactgcctgagtttgaaacctattgattactagctgtgcgaccataggcaagttccttaacttctcagtgcctctgttccctcatttttaaaaataagattaataataggacttctttcaaagaattactggagaattaacagagtcagttatgcaaagtacttattagtacagtgtctggcacagagtaaatatctaatattgatgttgttcttaaccattcattcatgcactaagtatttatcaaacactgtgctagaccctaggagtacaatgatgaacaaaacagatacagtccccacccttgtggagattgcaaatgtagaaatgatagcagtttggccgggcgcggtggctcacacctgtaatcccagcattttgggaggccgaggcgggcagatcacaaggtcaggagattgagaccttcctggctaagatggagaaaccccatctctactaaaaatactactactactactactaataataataattagccagggagggtggcgggcacctgtagtcacagctactggggaggctgaggcaggagaatggtgggaacccgggaggtggagcttgcagtgagccaagatcacaccactgcactccagcctgggcgtcaaagcaagattccatctcaaaaaaaaaaaaaaaaaaaaaagacgtgatagcagttcctggagtccaggatctttggagaagcagaacgacattgttagtgacttgtgcagactaaccagccaaaaatggataatgaaacatacttgaagcttctagtgagtattactaagcacgttttaagatgctcatttttttattggttttcagcctttctgatcctgtttctgaaagttcaggggctactcagtaagtagtacagaaatattgtgtaaatatgagaaaactactattgacctattaatatatataaaataaccacaaatatgtcgtcttcttatgtgagaatttttaacttaaaaattcacaaaggaaggattaatgaagtagtcatcctaacgtgccaaatttgtaaccacatcaaatggtcaatccactaaaaaagcaaaacaaaagaaaaaaaaagcaaagagatttttttcagtcaaacaaacaaaaagtcccttttttttctgcagagcatcttgggaaatgggataaagggacacattcacagacccaaatcaagtatttttcatgaaaagtatcttggcttaaactctactagctgatgtttactcctttttttccttgctacactgtttgtctttaacattcatttttctttttcttcccattgtatttttaatctcctcagttgtgattggtttttgttttatttacttagatatctgatatttattcctaatctttatagatatcagggaaaaatcataggttaaaacctagaactaagaaagcaataacttcaaagaagtccaacaagctagttaaaacaacaccttcctcccgtaaaaacatgtggcctgtttctgatcaaattaccatatgcttgtcgagttgtcctccccaccccccgcaaacttttcctaatatttttctgtaaatgatgttaagttaaatggcctataattgcttgctctatctcatagccctgtttagaataatgatatgtaacactttccagacctcaggaacctgatctgtcatcagaggacttatataaatgccagtcagagcttccctcagctctgtctctgcgtttgggggtgaaaagccctcaacacactcaccagcctggccttttgtcctgaaactgtcccccttttctcccatagctgttctcaccaccttctcacacttcccctcccaaagcaggaaattagatccccccactctatcccttcatctgtaccagctctgttagaagccagtccatccctcccgctcctgctccttctgacctctaaggctctaatcctcccctccacccctgctcttctttgttcctttctctgaccagcgggagccagggtcagaggatgtggagagagcagattaaggatgagtgcctttcttcctgcactcttgggcctatagaaagagaggcgagactactcgttctgtaaggtcccttcccattttaatatcctggcatcctgtgctcccataacttttggaccacagtagtgtggaatgctgatcagaatgcttcctcttttgtaattattctctgaacttcttactgcttgtattttataaatagtttatatctctaaatcactgtttatatattttaagcctccctcttaggctcctcatactaatctttatatccttccttaatcacattggcctttcctgcccttttccttccttggacttaaccaagggagctttaagtttcagtctcttcagttgattcttaaatattccactgtttgttttccatacttcataggatcgcatacaaatccccaagggccatataacattcctcctgaagcctgggttctttcctcggttgctctcccccctcaagagcatttcatatctaatgaaatagtaattgtgtactgattgtaataaccccaacttcctccttttttccttgaagtttcttttcttattatcagatctagattaaaatgatgtcattaaagactcaaaaatctttatggctatacatagctatgtatcttcccttatttaagaatattttttgatttatccttaagtccttctggtattcctagtgcagatatgtccattacttgcacccgtgaggaattcctgcaacatctgtaccttttttccataaagctatccaggtgatggctgactatcctcatttataatcataatgcagacttattgacgtctacaaaataagtttcaaaatctttttatcgtcttaaaagtctgttttagcatctgcatcaactttccataggaggaacaattagttgttgagctcaacttctacctaaagtagctctgaagtacatcacctaaagaatagaattacttatgagagatccattcgtccctggtgtgattacctgttccatctttattttcatctttggccgatgacctctgtattcggaaatctaaaaaatccctctctcttttttttttttaaacaaatcagcagtgctcttcctgttccaccaagccttatttatcttccaaaataacagcaatccaaaaatctgtgttcatggagatttcacagataatactgcctgtggtttctctcaccccgttctgcctcatgctctcgataaagttaattattttttatcaaatttgattgttttcccagcaccttctttacttgaaaacagttgctctgcagacactagaatattctggggctgaaatgtagtcatgcccatctaccgtgggctctgcgccacctttctcaccctgcatgccttctcccaccacctcactgcccacacctgtggctcatgccaggccggcttctctatccactgttacatctagtagcaaaggcaaaaactcgtctggctccttttgtcattaactgccaaggtgataggtccaccactgacgggcttccgtcccaacttagtagctctgatctgcctcctagacaaatgcttaccaggtttggcccatcagtaaatacctggtttcattccgctgttactcagcaataggaactgtccttaatagcaaaatctaccttgtacattttgtaatgctgtcatcaatttgctagtttcctgagtaaatcaggtatgccttgcccccatgaaaacctggtgtaacaatatccaaactaaaaaataagtgactgtgtgtaggtactaaaagattctgcaggttttaggatttattacaggaatattttagatagtacattgaccatgcacatttaaaatataattctgatttaccttcagcttctcagatatatatcagtatatatgagaaaatatatatatatgaaatatatatatatgtatatatatgaaaatacatggttgagtttttaacattcaattttgaaaagaatgtttattgaacattccattaccgtagaggtaagtcccagtctaacaccaagaaatttaaagatagatgagataaggtccttgtccaatagaaactctcagatgaaagggaagcagctgcgaagctgccgggacagcccggggtggggtgggtgtaatgagggactcacggaaccagggcagcccaggcgagagaaacagtgacaggtgccagaacatggcagagatggagaccatggaatcagagtggactaaggacatgtggaagagaagacagagctgaggttgactcccaggacagaggctgaaccatgtagggtagtggggaggtgacgatgctggaacccagatcagagatccagcgagaagacttactttgcagggggaggtgttgaggtgttccgtcacactcccggtgccttcgggatatctgtgctgcaaaatgagggaggcagttggagctggaggcctagtgtagagaaaagaggtcagggctagggcctagatgtgcaagatgtgcaagagctgaaatcctgacatacataaactccctgaaggagcatttctaggggggaaaaagagtgtgcacagggagctggtcgcagagccaggcaaattcgaattccaggaggtaagtctcagaaacatattttgaaaaagtaggttaataattcacagcatacacaaactaagcacttgtatctgagagccatagggccagattaatgtgtaaagagctaatatcaaagagttacattaattggcagatgattacttcatctcaatccaagaaaaactgagtttcagggggcaagcagagacccaatttcaaatcactatgtcctggaagtcaggttgcaaagcattttcaaattcttaaagatgaaagggcttttataagtgtaaggtactttgtgctgcatattgtcattttattagtcatcattattaattatcattatcatatactcttgtgaaattattagttatcaaaagacatcttctgaaaggatgctttgggctcttcaactcctgacattttttatttaaatatttattttgttttatacctatagatcttcatgcagaaaaagttacttgttccttagtactgccagctgtgtgcttcttgacccaggggtagaaaggatgatcgtggtggaaggtagggatatgctgaattggtgatcgacttctgattctgcctaaacggtatgtttcaagggagtgtgacaggcgctgagatccagcaagctctacagctcctcctagaactgcagtatccccagtaggctagagagcagccaccaaggaagacatcaggctatcatctgcttttatctgccaaccaccccccatgctcctcccttggaaacctgtctgcaaaaacccatctttgtacttgctccctagagccagctgagtgtcactttgatagtctaaaatctatgttggtttactattgctgatgtaacaagtaatcacaaacttagtggcttaaaactacccagattcattgtcttacagttctggaggtcagaagaccaaatggagtcccactgagctaaatcaaggtgctggcaaagccaccttccttgttgaggctccagagttcttggacagtgagattttctcttggcagggaatactgagttaatcacttggaaccggtgctgggctagtgttttccatggaatggatagcatgttgttaatcactttgcggactaaaccaaaatggaagacgctggtgcatcatctatttaaaattgcataatgtacacactcagaaaacaccgctgatacatttgggcaactggaaatgaggacaggtcgtacttgagcctgagggacaaggacaggcttcctaataaaggggagttttagagcagggctttggaaagatttgtaattaaaagagagagttgggggacggggtgtaagaactgggaaagaattcacaattggggcaggaggtgctgtgggaatgaaccagccgcatgaacagagacataggcagggactctgtcaggtggagtgggtgggtggcccagtctgggaaccctgagaagcaaggctggtagagccaatatcaccacaccctgccctggccaggccttctctcacgcagccagcaggccacccctcttcaccgcctcacctccaagcctgtctgtgcagcagcttagccactcctcttatttgtacctcctattttcttgcctttttctttcttgctgtcacgagtcttaaaaccagtcatatgtcatcattaaactccacatggccactattctgataccattaatctgtcttttgatacctgccatctgacccctgatgggttcaaattctggaagagtgtctcctcacctgttccattaagttagttaaacaagttttgtgtttgagacaaattcttaaacagttcccagctgtttcagtgattaaaaggcagagccaggaatagggaaggccttactttcatgagagagatttgtttatagcataaacgtggatccttaacagtaactcagagaaaaccaatctaaagatgtttttaatctttttttacatattcttcgacttcataatgaaatgtttccctattttccagggattttgttgagaatgaaattaattctgtgtgaatgtttttcacagtggtattagaaagacactgtatattttaaattcaggctgtttctattattttttgaaaagaggtcagtggagaaaaatgtgcctaacatcgtcatctaaaacctgctgtttgaattttggggaatttgtcattttttctaaggcaagttactaaggtattgaagttaataagacgtatttgtttctgaatcagtttttgttgtggaggattagaaagtactatagtcccttattgaaattctaaaatttaaaaagtatagtggtagtttgaatatgtcctactagcttgcattataagttttaaagtatgtatctcaacaccttttattcccagctctcaaacttttgaagtcttctagaagctcctaacctctccttacttctgtttttcctgctacaacataacgatgagtattttcccactgatctcaataggcatgttgaaaaaactgatgcaatattagttacaagaccctgcacaagtgtcagctccttggtgcagcctgcacctgttcccccaggcagtcagcacttaccgcttatcccattgcattgtgatgggtcatttccacctggggtcctgggggaagaatgacatcggagggccttgaagacgacctggcacattgtcaggggataaagaatgaatgaatgtgcacattgccaaagaatcattcttatgctttacagccagctctgatagaaccaaaattattcaaaccagtgtattaaactattagagagcaatagtctaaactatactaaatagcaaagggaataaaaataataatgttcctctttctatttgagattccatggcaagatgagtgttaagttcactcacaacttacacttgtatatccaacctttgaaaaggtcatatttcgtttctattgctttacctctatacatgtcttttcactaattctttcatttctgccactttcctgtctccttatgtttctgctgatgttctctccttttttcttcatctgttctgaaactcttattttcataggttctgttcgtttctccacttccctctgcacctttcttgttgatctatcccaactgtctcacacaagctcagcactccagatgtgctccctggctcctctccacaggaagacctggtgatgccatattacagccactgcagcccggctccacccttagaccactagggcatgatgcctccggcatccacagcatatgcacattgtgggaaaatctcatagtatcttgaagtcttggcagacagcatcaacaataatgcatatgcaaaaggcatccaaggttgcttctgtctgaagagagtacgactgccaactggaggcattgccggctctgagcctccataagaaatgccccattgtcagccaccatctttcctttacccactctgaggctatatttgtggaacaaagtgtcacctagcataaaagacactcagttctctggctttccccatgacacgcgtttctctgctactctgaaactttctgaattacaaagtgagaaataagttctactcagtgaatggccatcatggctggtattggtatcgtggaaccaaggtcttccggaaacctggtggcatgatattcctttttctcttcacctagaatcttcaatgtttttcttttttttttttaatgtaagtgcaaagaacttaaatatatgattgtgtaagatgatagtcatttagaacaacattttttaaatttctgaaaaagtgaggccgggcacagtggctcacgcctgtaatcccagcactttaggaggccaaggcaggtggatcacgaggtcaggagatcgagaccatcctgactaacaaagtgaaatcccgtctgtactaaaaatacaaaaaaattagctgggcgtggtggtgggcgcctgtagtcccagctacttgggaggctgaggcgggagaatggcgtgaatccaggaggcggagcttgcagtgagccaagatcatgccactgcactccagcctgggcgacagagtgagactccctctcaaaaaaagtctgaaaaagtgttgggcttatagagattttcctaataaggtgtacagtgtcttcttctttgcacatccattttggtggaaaattcagtcaaatgcactagaatagtctttggatatgttttctaaaacaagtatctaattcccacatgaagagaaatggcctgattgagtatgcctgtcttaccaaaactgttaacttacagtgaggatgtgaaaaaataagaactcagataggcccgtggatcagatgaataagaaaaagagaagagactatggataaaaacagttgctgattttcctttgagatgtttgtgcttcatgccgccaaattgagatgagagaaaagccaatttcatgcagtttggcacaactgtaaaatgcagcacaaacacacgtacgtgtatgtgtgtgtgtgtgtgtgtcccattgatccaaaaagcctgtttgtctattggcaagacgaaatattatcttcatgcatcaccacctcctcctaaaggtaggatggggatggccgtcagtgccaatacattgtctcttctttcagctggcgggggtgggcagtgggagggagccacggggcggagacgcagagcaaacagtgccagcactggatcccggcgtgggccggtggtgggtgccaggagcagccagggcctgtgcctagtcgtcacatgtggtgctgagcaaccaccaactcttcccaggaaggaggtgaaaagataacacacactggagtccagtggaggcgaggacacttcatcccacagggaccgcagtggccaagggaatggttttaatggtggtttgacttggcatacttatgaaaaggctagcgcccacccgctggcctgtgggtttatttggcaaaacataaaacagagtcagttgcttgtccttgagagtggccactatggatctaccacatttctgacttgtcagtctgacatccgtggctggattctacatagtcttgtgttgatggatttgttgctttgggagaaacgcagatatgatggcatggccttctcactatctgcagcagaaacggccttgtgtctgccccgtgtccctggtcatccacggacattggtcaggctttctgattcacaccactttctcctcagccctccaactaagtaatatttatattgttctgctaacaacctctattgaaatccaaacttaataacctattgcttgctagaaatattctcctcttcctttctgcctgtttcatgatcttggttttttttttaaagaattcaacccttttgctttttccctttctccatctttataactttttcagacaattgaacttctgtctgaacttctgagctttccgataccctcatactttgtggtcagcatcagagacatcaaagtaaagtgggtatttgtttcaaaccctgagttgatgataagccattatgtctgctgcgtcttctctccatgtgagtgacattttgcaccccaggcttagttatagggagcaagttaggaatgtgtgttttgcagtttctgttgtttatgtaaaccatcgatatcagtttattcatctgaaggaaataagaaaaaacacttcagtcaaaataattaggagctaagataagaacacagcacttcaaagttcatttagctacttacatcttctactttacacgtcatctcagcttccctatctcctaagtgaaggatgattatgataaacttcacaaaagtagtgggaggttaaattagtgtttgtgaagcatgttgagatcttatgatcaaagataccggagtattgcagaatagtgtgattactatcaaagaaaagaattcctcaaaccaagagtctggattaatctgacttaattttccagcatcttctgtatctgactgaattttccagcatcttctataccttctatatctgaagccccaaacctccaatctcttgcagttttctcgtgatcttagagtccgtttctaagcattgaagagggttagagagtaggctgcagtcataaacttgtaaacagaggagaagtgttgggtgttaatgaaggctcaggcgaggggccggatggggctttggggggcatgttcggctggtgactgtgcagtgctgctctcagcagccaccgtttggctggtgctcgggtggggccttcactatgccagaaaaactgtccctccacccagctcattccttagaatcaacagggactttcatccatgctgcacaaaatcggacggaaaagatggctttccacaagtttcccaagtcacttaaggggcacggaaggggtatgcaggcagccggggtgtcagaggcaaagacaggctgatagcacagagataagcaaggtggatggaaaaccatacctagacataacgtgtgcaaaaattgcagagtagtatctccaaaatcacaggccacaaatacacagatttggtgcaaactggcaaaatgagtttgtacatttatttcccacccatgtgtttcattttgcctgtaatcatcagagctgttgtggatgggtgggttacccaagtgttcttaaagaggcaacccatttcttctcaggcaatactactactttaagcaaaaccgcaggcatcctttgtcaagggtggctaccctagtccatggttcttaagcctagtacgtcagactcatccagaaagctgttgaaaatacagtcttccaggattcatcctcaaaccacttgagcggtggaccctggaaacgtaggactctgcagggatcctgaggcagccggctctgaggctggccaagcctcggtaagtgggggcagctgtgccctgggctgcagtcagggaatgatgcacacagttgggttgtccctaaccttgttggtttcattcacctcttgaagaattagataaaagctgattccccccaggggaaaatgctcagaatacatcatgtatgtagttgtagggaattgtgcctgtccagctgtccatgcggagaaaacaaagctgaactgccaggtccggctcctttcttctccagccccaagtttttgcttggcttggcacatcctttcataggtgtacgtattttgtaaatgttcatgtccagtgattaaaactgtcattggtataatttctgacgatatgtagtcaaccccttcacaagtctgtcgttaagccctccacaaactcacaggggtgctttggaagagcttgacatccgccctccccaatggaacataagagccattcacacccccgccctgcaagggagggtgtgcttaggacctggacattgagcttggcagtatcaccagatcatttaccgattgaagttaaattgatgatagaaatgtagacgtcaagatttttgtgcctaggtagtctcagcttccctgaccccatcctcggagagctccaggtctagggggaccattcccaaggggaacctcaaaagtgtatctgccatgtcagggcagacgtgtgttttggttgtttttggtgaagccccagagggcattgtccctacacagttctctgataggcggaagctccatcaggtctgaccacagcctggttataccacggcaggtccagagcaggtggctgctcagggtttagggactgaatgaatgccgcagacgtggaaaagaaaatcaactagctgttttaggcatctgatcaatcagtgtgattggtttctttaccaagttgatgagtagatctgctgtgttctcagcagtaatgtggttaagcttctcaggaatatacacatacacaaatgttttccccggtctggtggagggtagtaataaaaagcagagcatttagagacaaagtcaacttgacaggcagagtggaggtaaacagtcttcctctgcaggagcagtgttgacaagcagtgattcttgggaagcgtacagctgtagcacgggctctgacttcagggacttcagcagtataaaaacaatttttaaatacccaaagtcatttattttaagtgtacttgtatggtttggggttttatgttatcggtttatatatatgtgtgatttttattaactatttccagaaataattctgcagttaagccaaaagctgctgcatgaagcaaaaactcttcctccatagataccctgcctcagtcgagttaggcaggtttagcccaaccaaaggactgtatttgttgagagaagagacatttgttttctccccaaacttcaagctctggttttgaaacataactctcagtcccatctctaaatcctagttacagcattaattctcaataagttcttctttttgcacgtactctcatgtaagcagcagtctaaatagccatgtaagggcagccagaggagtgggtttgtgccttggggaacagaggagccaaggcccacccacgttacttgtccacttctccttccatctgtgacaatcagctccaagcattaagggcttctcctggtcctgggggccaggcaacacgtcacctctgagatgttggcctttgccaccgtggcttctccagcacagagcctcattgtcacttcctccagctgctcagggaacatgatcttcactgttgtcatgtcagatgaggaaattgggccaccaggaagccgagtgacttgcccaaggtcacgctgtgtgctagtggcacagccagtttccaggccgtgctcccccacgaagcctctgcaactttcctcccagatcacgtgcactgggtcacccaaaaactttgcccttctgcacattagcctctaaggacagctgctctaagcactttctagccaggcccctcagcagcagcactacaagggtggctggcactctggttctgtagacactgtctcctgccttttctcagtgctgcagtgggtgtatctgcacctacttaatggtctgaatctataaaccagcagtcagacacctgctgtgcattcaggggacataacctgtcatgcctacctgtggagctgagtcagtgtacacggttctcggcaatcaggggacatcagacagctgcaccctcttttccagtgacacaggcaccaggtatgaaggctttgagggattttctggaagtaggaagggtcagggcccaactgaacatgtcaccacagcacctgacaatggctttttgtccttttagtgtatgactggacacacttacttaccatgtaaaggtgcttcttttttacatttaaaacccaaagctgtgagatgcagcgtacagagacgtgaccccggttggccttttgctgtttcagatggcagtactcagaggaacgccagccaggcccagaggcccccggcgctcactggcctttctttcatgtgcccttggagttcttagaatagactatgagattttaattcaaaaggaatattctaccagcagtttataataggcatggtttgaggaaaacccaaacctgcttttcccaagatctaaaccatttgatgcaccagttatctgatgcagtggggctctcgcccgatccattctttggagctacaccatactcgattgtgcggtgactgacttagccccgggcagttcagacttggacccaccgtgtggcatgtttgtcctcgttgctgttgctgtattgacaacgccttcagaggtggtttcgagtgcaagccccctacccgccttccctccactcctcatctgccctccagcttctccaaacacgcttcgctgcctgctgggaatgctgccttgcaaaggagtgacgtctcaagtgtcgggaaagttacagccttcgagttgtttccttccctacctttgagatatacccagatgccgcattttgtttcacgcttttctgtggatggtgagcaaatggctgattctttatggccctcagagccccaggagggtgtggacaagcacctttcccacttgatacttctggatatttcctttctatgccattaaaatcggatgagtgctgtatttgttttttgtttatttgtatttcatttatttataccttaccttactccagaaaatgtttaataacgcatgtgaatagtaaggatgtagcctagtttgtgaagtctttggtgcaacaacagatttggtacttgaaaacctttttctcccagaaagcgtgttttaaatgatacgagggccccagccctgccaacacaagcctattttcccaataacatgcctgaaatactaatgaaaatattttaactgcgtctagttaccatatgtaaaattgctttcagtgcaagcgcactttccaacgtccaaatctgggtgctactcacatgtgtctttcagaagagtgggtgagtggcagagctcctcccaggcctgtgtgtggtgggccatgccaggctgcctgggaggaggaaggtggggagctcctcccaggcctgtgtgtggtgggccatgccaggctgcctgggaggaggaaggtggggagctcctcccaggcctgtgtgtggtgggccatgccaggctgcctgggaggaggaaggtggggagcccacctccatctggttgctcaccctggacaacgccatggaggagagggctctggagcagggcctttgagagagtgtcctatgattacttctctcaactgtgtggctgttcagtctgtcactgaagcctttcctcccctcttctgtgagaccaagaagtatttctgagcaatacatagatagatggatcaacagatagatatttttaaaaatcagaatattttcagctcacattttgacctcaaaaccttatgacttggttttgcttccttaaagtcacattaaaaagtatggttagcagagacgtggttctggtgagcacaatggagatgtaattttaattccttctattcacaaccaacactaatattgaaattttgggtaagcaacatttgagaggcactgaaacttgagattcacttaactgctaaaatactactctgttatccacaaactaccagttataaatgtttccgtgcctgattcagttgacagcaagagacttcggaaggctataagttaggaaccagtatgagatgccaaatgcttccttgccttcccgaaaatactgccatgagagtaggcctttaaagcaatttccttcaggtttagagatctgttcgacagcatagtgtccaaccataggggataactgagcacagtccttccaaatgccaccatgcagcaaatccattaaagtccgtgtccattcagactatggagtagtagctcagggaagtgtctgggataaaatgatgggtgaaaaaagaagcataaaaatgcgcaaacagtatgatcacaaccatataaggaaacctacacacaggtgagcaaacgctgggaatcagccacgtgctgcggacgcctcgtgctcccagcctcgttccagcaaaactgttaacagcagtgttgtgttcatgatgggcctgcgaggggttctcctccgctggtttgtgttttccaaatgttcattagcgaacatgtgtgactttacaacaaaaagaaaacagtggtgaagtatgttagtcagacttcagcatcgttctcatcagttagaataaagaaacgcatgaggaaagagacaagtatttttcacaggcctcaggttagaacacatgggcagaacagcatggacacttcccttgactcccctgtttgccttgctgcccccacctctgatcagtcactaagcctgtgctgctgcctctggagtgcctgcctttgtggcttacttcttgtattcctgcctcagcacctgcccaccacctcccctcagaatcatcagctgtgccgcgatggtgccagcacaccgcacacatctgatcatacacaatatatacatctgattaatatacaaaaccataacaacccttgagaatcgaaatgaatgaaaatctgttcacttcattcattgccccaacaatttgaggcctgcccgctatagtaccaatcattctatttcctcccatattagttccaacttccaggcaccttatcaacaaccggttaattgctattccacaatgacgaattcaactcaccctaaaacttcttcagggcttaatgccccccagatgcacctgttcttgcaagggccttcctgctgcgccgccacccttctcattgctgtgtgggtctagccccagattgctgggtgcccagccgcctgccaggactgcaacttgatggtcattcctgccctccccagttcccaaactctcctgaagctacctctcctcctccctcaggtctcaggtttactggaacttcctctggaaagtcctccagcttcccaggagtgagctagacgttctctcttctgttgccatggacacccacacttacagccccacaccatgcgcagtccattatccgtgattccaaaatccaaagagctcagggaaaatcaaaacttcccttaaaacccattctcctacaaaatctggcccaacctgacacaagactaattatgtagtctgtcttcttatcacttactgtaactgttcatacattttgctgaaggaatattcacgtttgattatggtgtgctggccagatggtgctggggctgctcagaaagatgggattagggtaactacaaacttaccacctgcctatcgagagtacaaggggcaggggacagaggcagcaccaggacaagcctaactcagcctgtcctggcagcacagggcaaatgtccacctgtgtgttttgtgcccatcaccttgtgtctctacgagccaaaacatctcaactccaagctctccggaggctttggaaaggctctgtgcacctgtactctgattatttgtgtctatttctaccactgtctttttggctctttaagcatagggaaggtgttttgttccatttgtatccccagtgcctggcctgacatgtggtcagctatcaacacttactggtcaaaatgttcagtagtcatcgctttgtcgtttagtggtatttaataattatctatagaactagtatcctaccatcaaaagttactgaggtgggaaatttccaccttggctttcttcagcattttcaacatgagtagtactattaaatgctttaataacacaaccattcaatgactcagtttcaaaggtactttttaggaagaacaagtatgtacttgaaccctcacacccctcacccccgcccccctctccaccgccgccaaaacaatagaacaaatgctgtcatagccaggtggccttaatattaatccacaaagcaagctccacgcaggcagggactgtgtttattacttccaatttacgtatttctcttctcacacatgaaaatacccacaacaacggaagttcaggagtgagcacttaccgcgtacgtattacacactggacactgtgctcaaaactcccggtgcatttggtaatttactcttttcagtgacatcacaacacagatattttcacgctccgcatccacctgtcctggccctcttcctttctggggtgttcctttaattttttgaagtttctttctagttggtcttgctgatttcctccttttgctccaacagaccatcttgaatggtactcccgtactgaccttccttcctcacagacacgctcttgctcagttaccctcagtggctctctgttgcccacccccatggagcccacaccactctgccagcctcagagtgcccagaacctggtttcctgtgcattcctcaggcagggctgccttacccccacacccaccccgccttgaatctcagtgcctttattcaggctgcccccacccctgcggtcctctttctccttctgattgctctgttacatttacagccagcagccccaagtcagcctggagacaaccttgtgttgttgactcactgtatcatcagcgttgatcttgtccccttagcaaaaacgttaacttgttggagtcaagaacgaggtcttgtcttgctgtcatatcttcctcgtgcctgtcactgtggcagacaaatgataggtgatgatgaatagggtgatgaatgagccttagaaagtcagggtgcacagactttcagaaacacataatctggtttgcaaggacaatgttcttaaattcatttttacaagaagctaatgccgaaggtgaaagaaaaggaaaagagaaatatgattactctaagtcttaaacatagatctgaacatcaagttgtgggagaaatacaacttcacagtgtgccaaaaataaaacagccttggccctgcggccactggtgagctgagtgcgaaccaagcctgtgccatggggtcctcaagtgcagctcagccctgggctgctttcacaccagtgtgatgcccaggaggtgaatgatgtccccacagtacacctggcagctgtggggcaggacacctcggcagatgccagcaggcgcatccaggcacagtggccagcgtgctgccccacagctttattggggagtagggaagaggattgtatttctttatttatacaaagtagctttgaatggacttccacccagcacagaaaaagccgtataaaaaagcaactttaagttttttttttttcttttgaatgcaagtctctaactagctgagctacagacttctctttggtatgacaaggcatgtttggatatgctgtgttaccactttcgggtggaactggagataagaaaggtgaagtcaggtagcaactgtctgccttaagaatatttacaaactatcagttaaaacatctgctctccctgaggaagagcaagagccagaggggtggaggcagggacagaggaggcagagagagagaacaaagtgagcacaccccatttaccccagctcacttttccctaccatgccctgtgcccacgtagccagcatgcaggaactcctctgtttcacacaggagttgccgacaccaaggaacccactgcatgtgcttgtcctcattatgcttaagaaagatctcggcttccttcccccaaaaggtgctactgcagctgtagctcagggcgtgtgttttgttcagcacttcaactcatctctgcacatgtggactctggtccagtggcttaggaaatcctcacggagagtgatctgggatacaaaccccagcagtcataagtcaacatgatgtattggccctcctcttagcgagggttggggtggagctgtcacagagccgaagttatctttcacagagaagcgatttccccagattgaggttagggtcaccagatgggcagtgaggcggacattatctgctatccaatgtccagagctccaagaccctgagtgctgatggcttaaatgcatccgcctgaaaccttgcagaaactttcctgctgaagctcttaagatctccccagggttcccaacaggtggccaccacccttatcaacagtagtattaatgccaccacagctgggggacccacagagggacaacgtggtggcttctctccaaggctctctgttatcttccctatggaatgagcttcagtcatagcaagtgtggatctttttggtgctgctttctctgccctcctaactactcctcccacatacagtgaaattataaaaccgagccagaatcaatgctatcaggaaagggttctgcacatcaagctcttaaatgggcaaagaatatttttaatcaagactctgggtgagagaacagaatacagtctcatgttttaggccaggctatgctctgactgaagtgtgtgctgctttccctctgccctgactcaaaccaaggagccataccaggcattcctgccactctaaacgtctgtaattctctccaaggctctctagcagtgcctgagttaagctgcacctttacgaagagtcggagtccagctactgctgtcaaagctcgagcttgcatcaggcattgctgagaaaaccgccagctctgactggcgttgtggcgcctttcttccaaactttccttgtcttaaagggggcattccagtttctagttcgataatacccaagagaggcgtgcgtcatttgagaagaatctctcacacccccatcgcaaaaatgttggccatctgacattttataacatcatgtctgcctgtaaaaggcaaactcctgtgttgtgaatcagctttcagctactttggaagaactacttctctttgaatcagaacatgtttcattccatataaaattgtcatacctgtcatcagtaaacagaaataattagttgtaaggaacttactttaaacttacagaaataggcacatttatagaggtatggaaaggaagaatttataaatacatttatttattataataaatatatattatttgaaaataagacctctgccccagtgacctttgatttaatggattaacgttggaaaataaaatgtaataaattatttttagttttgtcatcacagaccacgctattactccctcagaaatttgaatacgcatcttttctttttctttttttttgaatatgcaccttttcaattgtacagacttgcctttaagctcaaacactgccctaattaaggactgaagttgctctgtcgatgaatgggaaagtgtcagagtagatgcgggtcatgtgttttgaaaacatgtaagcaggcagtgtttaacaagggtggaaagacacactgtggagacattgggttgaaggacagaactttggtcattattttattctctatgggaaggaaacattatgtatacataatgacacagtgaacaatgaaagaaatgtagcctgtattttttaaataataagtgccatttatgtgtggaattggggtcagctggttaattataaatgaaagcttaacacaaatatagtttatcccttcggacagattgatgtactccacgctaagggaagggagggagaggcagagagacaggaagaaatgaaggagggcaaatgggtttagcaaaggcatgcgctgtaaatatgggaggcgggtatctagtcattctacagttaattacctaaagattcctgaacccagactttttagtccctggtttgtcaccccggcggcatcatcagcctgagctggcttcctgggattttgcacttcactgttatgatttacgaataggataagttatgactgacccttcttgactcctgccacctgtctgtcagttatcttttaaagtacagttagggtctcggatttccagaactggggctgggatggcctttgagtgtcaggcattcctgttcttggtggaggtggactgctcagcctcaggtcccagtgctgggcccgaggagggacagcgcgaggtgtgctggcacctgcagtcttctttcttgccaccgcataggacatcactagacaaaagacatcaaaatcagatgctgttgtcccacgttgccatctctctcctcaaatcagtgtcccaatattcaggccgacttcggttcatcctgttttagctgtgcccactagaatttaaaatgtggccgtgcagctcctgactctgctgagggtgcctcggaaccagaagactgtagagctgcttttctcccaggggagaaactaatgatttgcagaagctagtaatttagagtctatggaacttgccccaggctctcccttccctcctgctttcagtggtactgaggagctgtatttaatctgaacagaaaattccattttcttctgatgattttgtgactatatgaaaatggaattaagggattgtagatttcttccccacaagcatattttaaaatccagagtaaaaataaaaactttcgcagagtaattgagaataaaggtgagaagttttctaataatactttaaaaaattctcatatacagataaattagaagaagcatgaagacttttccttaaagaaatgttcctttccctgcactttgaatagatggacaaaattagtatgcagggacagatccaacttttgtgggagctcatacactttggtgtcggtgcggagggggtggttcttctatagaaaaagaatgcaaaaatatctcccttttgcagaatgttcacattctgcacgtgtgagctgctgttctcctcacctgggcctggagaacatgggtgagatgctgagccccagggcttaggccagctgcctctgcgtatggaggctgtgtgtgcccctcagctgtgccagggaggagtcacagcagacggcgtgctgccatcctaatctctgtggcacacaggagaatgtccccacccccaaggaagtccccatgctaattctagaatacgtggctatgtcaccttacatgataatccagagactttgcaaatgggattgagtgaagggtctggagatggtcctggattttccagggagccctaatggtaaccacaaggtccttataggaggaaggcaggagggtcagagtcagaaaaggagcagtgaagacgaagcggggtcagggtgattcaaggaaggggctgcgagccaaggggtgtaggcgcctctagaagctggacaaggcaagggaacgggttctttccgggagcctctagaggcagccagccctgcccacaccaagaacgtaagaggatcgacacgtattgttttaaacccctacacctgcgttaatgtgttaggctggactggctccagcctctcccctctagcctctcagcaacctccacagttaggccctcctggagacccctcctggctgcctcaggccatctcctgtacatccctcctcctcccctcacccagcttgttctttctccccacccccatcttccttatttttcttcttttctttgcaacctcaaaacataaaccctcaagctcatttccgcagcctgatgtgcagtcttcctctctgtcttgtgtctctcctctcacccatgcctccatgggggacagaaggctacaccgtgtggctctggcagcccctcactccacacagtgtaggcatgtgctgttctatcacacatggacactaagagatcttgtcaagtagacagagactaagaggacctatgtgttcatgacactttttaaaggtctgagctgcccattcagctttgcatgaaaatggagattgggagttttgaccaccccatgactgtggcttgttgtgagtgtctgctgtgaagtggcactgcctcttcacaatatcgttggaattccatttggccaggtgacaagaaagtattcacaagcctaaggaggaacttatctgctccttcctgaggaaatatgtgcccccaccaaaaaaaaaaaaaaaaaagggaaaccaggcctcagtgtgccacagagcagcactgccactggaggccgccctctgtccagggtcgcgcacacgtgggcactggggccggatggcccccatgcctgcccttctcagagtgggctgtgctgcactctgagaagcgtctccacctcaataccaaccctgtagacttggcttaaagcagcggtcctgactcagctcacctcccggccatctcatttccttactcgggagagcggtgattctgtgtatttttctaataagcaaagtccccagagatgaaagaagccaccacaaaatactcaactctttctggaaacagaagaaagactgctgcccctatttgcagggagggaggatgttcttcccgaaacacctgagtgtgtgtttggaccacacgggtggaggacagttcagggaaaccaggtttgcgtttaaaagatcttggttccaacctcataggtgttgtacacccattccaggccttgtctccagcgctacctcacatgtataccagctataaatactgcagtgtatgtatatgtgtagatacacacaaagctaaagtatacattcaccaagataaactgtgcttgccagggctttaatctccccaggaggctgttattactggagtccggccccagagcgccagctgaggagaggaagtgagactctggtgttgggaggctgggcggcgctcctctttgtctactctttgctttttagaacatatacatagctagcattcacatgtggccacagatgaaatgatatgcttgactcccctaaaggtgcctttcttgtcagtgtgttactttacggagatactttaaccttgatcgtccgcagccatactggattcccatggaacaagagagcaggaagtgcttccatcatattttccccgttcagtttgagcaatccaaaatggagggatcatgacaaaggaagaaagcttcctctcgtgagcttgcattgttttagttctccttggcatctagtctgacttctacttatggtctggaccagtggttctcagacttgcacaagcatcagaaacacccagaaggctcattcaaacccagattcctaggcctgattcccacagtttctgactcgtgaggtgtgcatggtgccccaaatttgtttttctaacaagttctcatgtgacgctgatgctgctggcctggtttggggaccatactttgagaaccattggttcagaacatgaggctgcagcgcgccaaggtttttgcattgttttctattaaggaatagcctataagaaataggtttctagctttttaattttgttaccagcctagactctatgattgacagggtgaccagctgtcccagtttgccctggggcacaggattattcttgctgaaaatgagaaagtcctgggcaacctgggatgaattggccaccttcactattgatccaacttcccaaatgctttgtctacattgctggtatctggctcggaggaagccctgtgggaaaggctgtgagtgtgttgccccaggttccacaggacacttagagtttgggggacacctgccgtcaacgcactgcaacaatctttagggatgttaattgttcctcaggaggcatacgtaggaatcacatccaccttaaacatgcccacttatggcatttgggctcacacagccaaacagctgccattgtctgaagtaacgcatgggctgttgggctcctacggtgtgacagacatacttctctgcatcatccatgtaccagcctgttttcttctcactgcagcccaatcagctaattatcatcatttccatctttcaaaaacaaatgcttaaagatgccattatttaccccagggtcacagatggtaaaagtgacagaaccacaggccaaacacttgttgttttaccatgtgactccaaggagcatgaaatctgaggctcttcatccatgagattttccagccactcacgtcccttcctctgttggagatgaagcctctccagagtggaaggcagtggacctagcttggatcaggatgcctggactttgctcctgcttcttccagataccggctctatgacttgtatcaggtcatcttttaacccctctgagcctcactttccgcatctgtgaaatggacatcataatgtctgccttaccttctgccttagcttgtcttgaggagaaatagaaatgatgtctatgaagctgtcagtaacgtgtgaaagcgctgtccctgtgagcatatatgtgttaaaccttctgttattccaaaagagaggtttggcacatcaactcgaggaatatttacttaagtggaggagaaacaaagcaactaaagtagccaaaattagcagtgaacagaagaaaattctcaggaggaaaatggttcttcagctggttttgcaaggattagcaacatgtgtgtcccattccagagcagcaaatcacggcgtaggccctagccattttgctcagggaggactgcgctcttcgggaaaagttctgttgcaagtcacagattataggtgtgtggtagaaggccaagcctgagttgtcacttcctcagtgtcaaagggtctcattacatttcattacagtgattttctttttgctgaaacattaggaaccctggagcactgagccaagatcatggaacagaatcaccctctcctgcatgtttttgtttctgtctcctgcttttctgttctttttccactttctctatgtgtgagttgacttggctgcctgtagcttcatcgtcaaagctggtccacgtgggttcaacttggtgctctcactctcctccagcattgtttttgtcatcaaagctaaaattaaaaaaaaaaaaaaagaaaaaaaaaaaaaaaccaagacagaaaagaatgttgtgattgccttctggccacgttcagcttgctcatggagccacaggcttcatctcagcactgtttgttctcagggccaagtcactggaaaccaggctcttaagtttgagcctggaaaagaacacgtgggactctgaagaggcggtgccaggacctcagagtgacagggcagggtccctgcacacaggggccttgcagggaaaagcacacatcttctgttgcagccttaaggattctgccaagagctacttccagacttcatttgtcatggccacatgctgatgctgatgttgagaaagaactggctgttagacgttatctactgctgcatgagagagccctctatgattaccaatataacatacagaaaatctgtgccctgtatgtcactgtcaccccttcctcttctgaaataggacacacagttgaaccattcagatgaaaaatagtgcattgcaaggccaggattacagcagtctttgcattaagataactatgattttgtagaggggattactgatgtgaggcctcaaaggtagttgaatttcattctaccgtttcaatgctattcattggttcagtttttacagaagactccaaatttaagattcactcactgtggagatttctaactcatatcagaaatgaggatcttaaacagtagccagactcttcaggattctccacgtcacctagtgaactggtggtatattgtgcagacgagctttcctggaccccgtcatgggctgcatttgtcaatccaagtaaatgaccgtcctcacacttttatcctcagggaagtttgttatttttttttaatttgctcatagaaagaaatatgactctgttctctgtgttttacactgaagagatacagaattaacaagaaaacaaagaaattctacttgaaatggcaccctcctctgtggtattgtgaggaagcattccttactcaaagaacgttagacaaacaccttccaaagcagggttggctctgggtcttactgcacaaaactaggtaggaatctataaaagtaataggtacttttcatttggacaggtgtatgtcctagtttaaaatttggttattgctgcaataaatactataagctttttctaagtttatgtaaccttcacgacgtaattgtttattcactagattgtgggcagatgagaaatgtcattctgccaacacactcatttatcctatttccacctcttgctatgctactaaagcaaatataactcctagggagcacctaggcatatacatgtgtgcagacgtgtgtgtatacacacatgggcttgacatgccattaaaagcatatgtttgattttaataggactgatttttttgacaagcatataagaagtagcaaaagtctggcactgccatttactgcagtgtgaccttagacatgtcacctacccttgagcctgagcctcagtttctacttctgtaaatgcataccacaatgactaccttttagggttgttgaaagaatcaaaagcaacagtagtacccagtacatgatactgtatcattttattgattttaatatgcatattgtttcttttttaacaatgctaaaattgagatccaccctaaaattaacggcatctaaaacactatgctgtggtttaatgggtagatttttttccttcttacggacagataaaataatagtacctcttacaatccgtagcatagtagaatcagtaaaagagagtaattggcatcattatgctttgtcaagtcatcagagaattatgtattttaacaatgctaccattgttcaaacacactttgggggcccaggatcttctctttagtgccttcagaactgcagtgaataaaaacagtctttggaattggagaaacttgttttcaactcagccctgtcacctgctagttgtataaccttgggcaagttatttgactctctaagttccagtttcctcttatataaaataaaactcatagtatttgttttataagtttgttagattaaaataagaaaaatgtacataaagcacagcctacttggagggtacatagcacgtgctcagtaaatgataacagagaaaacaaactagtaactgtgcttgctagtaacagaactttatctttgccattttattttcctgaaataagaaaaagtaatccaaagtcaacccttgccaagttgatggccgcattgagtgatactaaacactagcattaagacagccacttccagccaagatggagtgacagggacagatttgccctcctgcccaaaagacaaaacaacaacaacaacaacaaaaatatatggaaatatgttttttagtacacactggatgtcaggcaacggaggacagtaacctctgagatacaggaaacaaatgaggtgagcccttcgagtaccctagctcactgctgggagactgaacaggatgaggcatggggacaggattcgggcagagcccagcaagttccctaagcttagaggacagagttcagggcagccggactggtaagagaacgcagggcagaggtgaggagaattgcagtgattgctccagagatctgcagaggtgcccctggagcagtcagggcagtgctgatcagcacaggaggaaactacctaaggctggggaacaaccatccaaaaggattagagggaacagtactgaatgttcacacagggctgggaaggtggcctgtttccaccagccagactggaaaagattaaaatccacagggcattggtagggtgttcggaagggtcttgcctcttagaaggggcactggctgctccagacctgcctaacaaatcacgaaaggaggagccaaaagtaccgctgcttccaagtaacataactgggtcccagaaacgaagttcaagagtatgtacaggaatacaaaaatatctactgccccagaagataaatttcacaattaatggcatccaataaaaaattaccaagcttgcaaagaagcaggaaaatatatcccctaaacaagagaaaaagaaccaatcaaaatcaacccagaactgatgcagatgttagaattagcagtagagatgttaaactaatttttagaaccttattctgtatgttaagaaagttaagtagaaggaagatataaagaagacactcagattgaacttaaagatgaaatctataatgtctgtcatgaaaattacattgacataattaatggcgtattagacattgtaaaagaaaagattagtgaacttgaagacgtagcaatagggactatgtaatatgaaacagaaaaacagaattttaaaaaaattaacagagaatcagttctggaggacaacttccaatgccctaatgtatgtgtgtaattggagtccccaaaaaggaggggaggacagaaaagatatttgaagaaataatgctaaacatttttttccaaatttcatgaaaactacgaacacaaatatccaagaagctcaacaaaccctgtattagtcagcattctctagagggacagaactaataggatagatgaatatatgaagggtagtttattaggagaactgactcacatggtcacagggtgaagtcccaccataggctgtctgcaagccgaggaaccaggaagccagtccgagtcccaaaaccttaaaagcagggaagcctatagtgcagccttcagtctgtggccgaaggcccaagagcccctggcaaatcactagtataagtccaagagttcaaaagctgaagaacttggagtctgatgttccagggcaggaagcatctagcatgggaggaagatggaggccagaaggctcagcaagtctgcccttcccatgtctgcttttacactggcagctgattagatgctgaccacccagactgagggtgggtctgcttctcccagtccacggactcaaatgttgatctcctttggcaactccctcacagacacacccaggaacaatactttgcatccttcaatccagtcaagttgacattcagtattaaccaccacaaatcccaacaaaagaaacatgaaaaaaactgcactgaggtccttcataatcatacagcacaaaaccagtgataaacaaaaatgttaaaggtagccagagaaaaaggacatgatatgtttacataggagcacagataggatgccatctctttattgtatgttaattatataccttaataaagctgttagggcaaaataaattttagaacactgtaactataccatataaaactgcttttctaatgtgccttgtagacccactgttaaggcagttcccaaagggacacttaagacgtattttgaaccaagactggtataggtaatagtagacttctaagatcactttatttttatttttattttattttaaattccggggaccatgtgcaggatgtgcaggtttgttacttaggtgaacgtatgccatggtggtttgctgcacctgtcaacccatcacctaagtattaaggccagcatgcattagctatttttcctgatgctctccctcccccacaccccccgcaacaggccccagtgtgtgtgcccctccccgtgtccatgtgttctcattgttcagctcccacttacgagtgagaacatgtggtgtttggttttctgttcctgcattagtttgctgagggtaatggcttccagcttcatcgatgtccctgcaaaggacatgaactcattcctttttatgttttcgtagtattccatggtatatatgtactacattttctttatccagtctatcattgattagcatttgggttgagtccatgtctttgctattgtgactagcactgcaatgaacatatgtgtgcatatatttttataatagaatggtttatgttcctttgggtatatacccagtaattggattgctgggtcaaatgctatttcttcctctaggtctttgagaaattgccacactgtcatccacaatggttgaactaatttacattcccaccaacagtgtaaaagcgtccctatctctccacagccttgccaacatctgtggtttcttgactttaataatcaccattctgactggtttgagatggtatctcactgtggttttgatttgcatttcactaatgatcagcgatgttgagcttctttttatatgtttgttggctgcataaatgtcttcttttgagaagtgtgtgtttgtgtcctttgcccactttttaatggagttgtttggtttttttcttgtaaatttgtttaggttccgtgtagactctgcatattagacctttgtcagatggatagattgcaaaacttttctcccattccgtaggttgtctgttcactctgatggggactcaggaataagactgcacgtctacaaccgtctgatcttcaacagacctgacaaaaacaaacaatgggggaaggattccctatttcataaagtattgggagaactggctagctatatgcaaaaaattgaaacttgaccccttccttataccttacacagaaattaactcaagatggattaaagacttaaatgtaaaatctcgaactataaaaccctagaagaaaatctaggcaataccatacataggcacgggcaaagatttcatgacaaaaacgtcaaaagcagttgcaacaaaagcaaaaattgacaaatgggatctaattaaactaaagagcttttgcacagcaaaagatgttttctttaaaacaaatgatgctcaaattatttgtatatgtaaatgggtgcccagttttttgtgggttggtttgtttgttattgttattcttgagacaaggtcttactctgtctcccaggctggagtgcagtgatgcgatctcggttcactacagcctctgcctcccgggttcaagagattctcctgccttagcctccctagtaggtgggattacagatgggtacccagttttattttgattaataaaagcaatcttattaatcagtggtcatgctttatgttatctacatatatttcaacttgttttctatgctgttgtaagccagtgtgaatactcatttatgattaatccaggtatgctcctcttgacctaaggaaatcacgcgtcttcactttattacaatttttcagaagacgtttatgaggtgatcatttgctagacattacagtatattaatcctttgccaaggtgaccgttgaattagaattgtagacaatgttgttggacaaaaatcctgggaagataaatagttgcaggacagaaaagcaataagaaggagatttgtgtgtcagtgagggatgggctcaaccctgaattttcaagtttacttagggttgccaggaacatatttactcctaatatccattgtcttataccagaagatacaaatgtatctgattcaaagaggtggtgtcatttctaacattatatctctatttcagttccacactgcttgttattcagggggagtgtcctaccttgctacattgctagatgacattactcatgagacagatcattcaaagaatgaaaagttactttataatgctagtgaaagctttcaagtattcattgtgaggtaggcctacacttgggtaattttatgggctctcttgactcatgtttgcagtattgggtgtggagcagtccgatgaagaggaagagagaagtggttgcagaatccttccctaactgtattctaccaagtttgaagtatggaatcccacacaggccattcctcctgcaactctaccatggttaaaaatatatatctgacacaaccacaacctcagcttgatttaataaaaataactttgtgtctgtccatgtaaaaggtcactggtgcttattatggcccaaaggttatcgtttcagagcctcatttttcaatgcaaccctcatagcaagaacatgttataagaaagtaacctctacagtaatgatcatccacatctgcattctctaatgtcagttttaagtgatttttagggaaaatggctgatgttgaagtgctatcatttatttcccttccaaaacttgcaggaatatgtagagagctgactttaaaaaaataaaataaactcacattcctcaaacagatgctgtcaattggaaaaggcagtacccccaaaatctgcatatacctcacaagtgttagctggctatctttatataatagctactgtatcccatcttggtgcctctaatgaagaccattacagaaatacgtttaacataaattaaactctacatgggagtattaagtccccaggcaaattctttctttttggctggtatttaagataaagacctcatgagagctgcagtggatttgtgactcaatagctaaatatatgctttgaagagcgtggagaggtttcagaggagaatcacggagaggatgtaatgtagaaacacacacaaactttagaaggtggagggaactggagttgcttgattgctggaagcagatccaagtaggaggaagaaaaagaggtagaccagcttgtattccacacagcacgctccacgtgcgtgaccatagcaaggtgcggggtttccacgagccgtcgttcatctgtgtaatgggggcaaatgcccacacttgagagtttctgagactggtagagaaaatatgcttgacacttagtaggtgctcagcaaatgctggtattctttttgctgaaaccccaaagcatcagagtcaacattgactcccctccctctctcacaccccacaacttatccatcagcgaacggttcactcactctccttcggaaatcaacccagaatccagctgtgtctcaccagcctcccaagccccgctaaacaaagccgccatcctctctgctgtggatttaagagcctcacggcctccattcttgccctcctacagcccattgtgaagatagtggcactttttacgtaagtgagaccacattacctctcattcagaacccacctgtggctttacagctctctcagtggaattccaggtccttcccgcagcttacagtgttctccatgacctgccccgccccaacctcaccccgcttagctcctgccctcttacccccatgccctctctccaaccacactgacccttcagcttcaccttggggcactgacacctgctcctcccccagaaagttagagggcaggactgctccccacactctttcagtctctgcatcagagaagcctccgtggcttctctgaacccccctcacgttcttcacctgcctctttgtgtctctcctcccgctagaatggaagctgcatggctaagggccctgtccattgtgctggcaactctctccctagtgtcaaggacggtgcctggaacacaggagaaggacggtgcctggaacacaggagcttgctgatggcctgctgagtggaggagttagtattggccctggaatccaatgggaagcgttctgggctgaaattcagaacacctggggcctgaatgcagctcctgaccttgatacctaccacctgtctgatcttaggcaagaccttgacctagaacattggcctcatcctcctcccctggaggttggaggcctgcgccacttccaggtctgaaacccaaccagcccgtgaagtgcgggagagtctaggtagcaggtgctgttcacgtccttcctgatgttcaagccttgggggtgttgctgtagttgaacaggagctctttcgtttctgttatgggagttttttgtcagtgagaaggttcgtgaaccttgaaggggttactgatgtaggtaaggacatctctggggcctgacaaacggggtggcgcctcttgtcctggaaaatattatagttgtgattttgcctaaaactgaggatggagttccagtcctacttgtgattttaaacatttgtatcttcctttaagtaaatattatttgggatgcaggaaatgaagttttggaatatttcaacagatggcgctgctggtagctattatctgactataaaaattaaatttaatccttactaatttcagtaatttcatttaaaaaaattgtattgcctccaaggataacacattagtttgtttagtcctttatcttaccagtacctcagagtgaatggttttaacccttttataaagcattgccagccctgcaacctgggcagctcaatttcagaagttgctgcgttaatgtactgtgcactgtgactcagtgctgtcatagaaaatgtgccaaaatgctttactcagagggaaagatggtttgcatataagtacattccattatggcttatgccataaatacaagccaacccgggggggatctatttagatcctttaaatagatgcaaatattttcttaaatggttatacaaagacaaatactgtgactaatcagtggacacagagaaagatgcgtgcttgctagagtctaaggagaaaatgttttgcagagaatgatggccaaagtgtcagagatcccagtgacactcactcatcagcttccccccacaccctctccaaccatttccagttggtcttccagcaagaccattttaattatgtagccatgcacttgcttctgggtgtggtttccctgattgcatacttaagtgcagattacaaatatttggcaggattccttcctctgtgggaaccagacaagtcataacaccaactgaacgctctacactgttgtgcgggaaagaggccgcgtcatctcgggtttcagagtgcagagcaggagaaactggcttcagttctgctcctctctcacagccacatgcccccagccagcaaagggtctgtaatgagggctacagacttcgcttcttctgccaccactgtaaccagacccacggccaaaaagaaccagccagaaagcccaatgtggagcgacttcttgtctcagaaaatgactccacggcctgtgctttatggcatgatcacccagaatgctagagagaaattaagattcgggcatgcacgtctatgccaaaggaagacttcaccaggggatattcaggaattcactgataagcttaagaagatttttgcaattgttagctcttaaaatcatttttaattagtgaagcagagaaatgctgagtgaaacagccatacttttccccaacttgattgggaaaatctccatcctgtgcccctccattccttcccatccttcctcttcactccgtttttcctggtaaatgttatggccacgttctgagcaaccaacctccctgtgctctgtgcggccagcttggaactgcaggtgggggaggatggacacccatttcctgtctcccaatctgggaatccatgggcataaatctgcaaacgctggcatagtcattgttggcatgaatggagacgaggaatatattgtcagcaggcctttgaatttcattttcagattaaacagttttttttaattaaaaaaaaacccttactaaagtcgcttagcaaacaaagagctatactgtttgcatcattgaaaacagaagagcaatagcagtgccagatactcctctattactttgtttgtttgttgttttttgtttttgagatggagtctcgctctgtcacccaggctggagtgcagtggcgtgatctcggctccggcctcagcctcccaagtagcttggattacaggcatgtaccaccacactgggctaatttttttgctgtttatagtagagacgggggtctcaccatgttgaccaggctgatctcgaactcttgacctcaagtgatctgcccacctcggcctcccaaagtgctaggattacaggcatgagccaccgcactcagcctcctctattactttttaattcaagtgtctcaaggtgctttacaagtgttaattaagtctaccttttttttaaggtgggtaagtagttaaaaaaaaaggggggggagagagggagcagttttgtgtcatagtatttgaaggagaaaagcaacacttaagcctgacatcattgtggcttcagtggcaggcacaggttgataattctaaatggcaactaacaggaagaggatgaataatttactgtgtatatttacttggtgccaggtgctggactcggtttaacccccagctttaatgaggtataatttatttaaaataaaaatcacccactaagggtgtacatttgatgagttttggccatatacagttgtgtaaccatcaccacagccaagacaggaccatctccagccccagcaaaaagctcgctcctcctgctttgtagtcagtcctgcccccaacaccgccccttttctggtcactgtaagtttagaatgttgtgtaaatggaatccttcagtatgtgtcttttgtgctggccttcctttacctggcacaatgtcattgagatttaccatgttccccggtgtgtctgttcgttccttttcattcatttcatagtcttcgttcgtgtggatgcattgccgcacagccgttcacctgaagctcatttgggttgtttcctttggggatgatacgaatgttgctgctgtgaacatttgcattcctggtttgtgtggacatgtgtttttattgctctggttacatacgtttgagtgagcccacggttcatctgggaagtatgtctgtggccaggctcaggctgttttccacaaccgctctgccctgttgcattcccaccagcaacacgggagacttccagccgccccacatcctggtgtttccatacgacttcagcggatgctcacacagcacggtgaagtcactacttctgtgactcccacttcaccaaggaggaagctgaggcctgaagagagtgagtggtgtaaaatacaaaaaaaatagctgatagagggcggatccaggtctactgatggcaaaacccaccctcatagctgatagagggcggatccaggcctcccgatggcaaaacccaccctcatagctgatagagggcggatccaggcctaccgatggcaaaccccaccctcatagctgatagagggcggatccaggcctaccgatcgcaaaacccaccctctttctattacagtataaaatgtgttatgcctcaacttagaaaaacttctgttcataacctagaggacattaggacaggtgcagtgtgattacctgaatgtcagaagccaagagcctactacttcatctcacgagttatgaaaagttgaacgtgtccaagggaactttctaaactaactaaaaatcaagtttaggaaaaacacaagtgagacaaaagcacctctcatgtctaaaggtttttcccccaaatgcgtgtatcgtgtcatttctatgtaataaccgatcctcatccttgaaagccatgagggcagtggtcacatcctatttgctaaaggtgggagaagatggtgcatcagacccgggattcctggccctctcacatgtttcccaccagagtttcttgggttaaaataatttctccattatgacagggcttgaggcagatatcctaagacctttaaaactagagccatccaggccgcgcgcggtggctcacgcctgtaatcccagcactttgggaggccgaggcggacaaatcacgaggtcaggagatggagaccatcctggctaacacggtgaaacccggtctctactaaaaatacaaaaaactagccgggcgtggtggcgggcgcctgtagtcccagctactcgggaggctgaggcaggagaatggtgtgaacccgggaggcagagcttgcagtgagccgagattgcaccactgcactccagcctgggcaacagagcaagactctgactcaaaaaacaaacaaaagaaacctagagccatccctggagtaaaatgtgtgctgtaggagccagtcccaaagagacaggatgtcgacgtcggcatagtgagactcccacgtgctcacccacgtgcgtggttttaccccgtctccatgacccagccacgggtcttatattgggggcttctaggaccaactaggccaatagaagtgctttctttaattgaattaaaatgtcagtaaatttcacccaaatatccagatttccctttctaaaaaaatgaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagattgcgccactgcactccagcctgggcgacagagcgagactccgtctcaaaaaaaaaaaaaaaaaaaaaaaaaaatgaaaggccatcagcactggggcagattcctcactgactggcctgcccgcctgcctggcctagtgggcacacagagtccccggtcctcccagtggcaatggcaccagcatggccagagggcacaagcctcaatctctttcatgtgggctgaccagaaatgccagcagtgaggctgagcttggtagcagtggaggcctgaggaggcgggggttggcagaggagctcgtttgggctcagacactgctgcctctttctgtctgaaggtgttatgaagtgtacctatcttttgggacatagattccttttactccttcctttgtatttgtcataaaataaattatagaataaaataaagacatatcatgaaattactcataattgcattacttgggaaggtaaaacataggtatttaacaaacatcaaagttttgggaggaaaaggcatttcataaacctagacatacgcaatactgaaggccaggagacttgtaagtgaaggggccataccgtggagccaggtcttctaaatctaaatctcatatctttccatattaagaaaaaaaaaaagccaggcacagtggttcacgcctgtaatcccaacactttgggaggcgaaggcagatgaatcacttgagcccaagaattgagaccagcctgggcaacatagcaagaccttgtctctataagaaatacaaaaattagccgcacactgtggtgcgtgcctatagtcccatctactcaggaggctgaaatgggaggatcaccagcgtgcagggaggtcaaaactgcagtgagctgtgatcgtgccactgcactccagccttagtgcatttctgcacagacacactgagtggtgttttgaaaatcagattcacggcattctctttagcaccttccagcactttatggtgggggttgctggtgagatcccctggcctctctgcctggggctgccagggagctggcggatgccactctccaccggaggccttccctggcagtcgtagactgttcccactgtgcgcctgggtctaccgcctggtcctcctcacctggagccacactgatttccatcttgtcctgaatggcagagctttcataatttcttacaacctcagattctgacctctgtaggaccactttcttcttgagccattttgggactgtagatgctagaacacagcagattgaaaatgcagtgacatatcccaccatgtaacagaatctgtagtaagatgtcacccatggcagccaagcagaagcttttatcacagcccaacaagtaccagcgtgtcttggcggcagggtggcaggacactgtgaggaggcaggtgtgtagacacagtcctcttctgcattggcacatgccctgtgctcatcgcctctcggtgggggaggtgtgtgtgtgtgtatataggtgtgtgtatctgtaagtgtgtgtatttgtaggtgtacgtatgtgtatgagtgtgttgtgcacttgtgtgtgtatgtgtgagcatgtgtatgtatattcgatgtatgtgagagtatatttgtgttacttctttctttttatcctccctgccgaggaggcaacagtaaatgtgaacggtgagagagaacagactagttgttacattctgtctcacccactgatgtgacttttctttaggaaacatcatccagggtaacctgtcatgaaaagctgccttttaggtcacttatgtccatttcagaaatggcaagggctctgggcatccaccaggcaccaggccctattataagaagacccctttgcagtcatctttttgtggtttgttcaatgggcacatgctgggcaaaggcacttaccaggcaaaccattatgtggctctggcggctcaagtgatgcacctggaacatacgccgttcatgacactttgcctttatgggcccctttaactcgaggatctcaaagggcctcagcagtatgaccttgcgtgtcctggccgggcgcccaagggagggaggccagaaggtccacgctgctttccgtgtgagaagtcaggtcacggtgccggatcagaactaacacctggcctgcaccctcattggtgtggtactttggaaggcagaggtataagaggagaactagcaatgttggcaaatgctgatagttggggtcaggatcccaaaacatttaaattctgataggggtcaggccctgtttatttactgccactcagctctctgcctgtcctgttcattaacctgatgacttagagtcatgtctggatggtttggaaggtgccacgaggaagcaggtggatgaagggcgcacatcaagaattcatggtagcacagagaaatgcctcatataagtgaagttcacctctgaggcccggtctttgaatatctggatgcctattttcttaggcagtagaatttcctctttgtgaccagctgaaaatatcatctacaaagtgcgcgtaatttcagtgtacaagacttagcctaatgtgtgaaattacagactagttgaaattaatgatcaatttggcaggtatttgttcaatgtggctatggcttatccaggctgtgacatccaagaacaatatatttcattgtcaatcttttattttgttttctttccttttttttccttgtctccaggagaccaattaattgttcaaaggtaatatatagagatctcaagagcatttactttggcacagtctctgcccctttgtggtctggctaacaataaagctaagatttgttttgtaatgacggttccagttggactggaattcctttgaagttcctgaagtttgctgttgtgagagctcaagatattatttgactgcaatgaaacactctctgtgtattatcaaaatatcgtatacactgaactgtaacaacttgcagtaatcagacttctccttcgaggtggcctgcgtgagtagagagcatccacagagagatgagcttctcccaacatccatttagtgttcagtcatcacgggccactcatggatctgaaccttcttacaaggtcgataccaacaggtatgaggagcagagagcagatcagcacggagcagcattagctggggcccccttgcctggcctggcagtgaagatagagcaccatgccagttgttcagcttctcagcgcttgcgtcagctgacctaaattatttaaggatgttgtcacctctaaataaatatagtcattgtcctggtctctatttatattttaaaactctttcccagcccaccccgatggcctaaaacaattcatatatttcagtagaagagggtgtcacagggctatttgcacaggtttggatccagtgccagcgttagccttcacacaagttacactcctctgagatgtaactgtctcctgtgtatgagtgccaaagtatttgataaccgccatctgtctgctctcaacacaggtttcacaagcacagtgatgtcttccattgtgtgcgtaacaactgtgtgtgtgcggagagagaggactctgtacgcatgcacatgtttggagctacataaatctgagaagcagttttgtctagtgtcgtttcagtaaatgggactcatttagtcagtttgctttgctgtcagaatcatattccagatatcagaatgtgctatggcaggtacttgtttaaaacaagtaataatatccttgtaatgtttagcaatacagctgactggtctgtgttccattacttgtgtaaaaggaaatatgtaaagcttttaaaaataagtttaaatgatcaaaagagatgcctgaaaatatattttggcacaggaaattacaggaatttataaatgtgtcatgtggaaagataattacaaagtttattttaatcttttatctctgactgaatcttaagttaaaatattcttcccggcatcctgtctggtttttgccactgtccctgctttacgtgttacctttccatgttgatctgagttgcatttagttgaggagaaaaaaaaaaataaaagtccattgaactcacttctgattccagcccaacttgtaaggagcaaggaagttgtcactcagcccccacaacaagaagaaagccaaacacactgaaaatcagcagctcttcctggttcctttagtgaatcaaggtcaccagggaaccaggctgctcaaatctgagagatcgatggatacaaagaatcagagcttgccaggagcagcagctgccactggagccagcattgggtgggaacattgggagggtgattgactaagggctacagacgcggtgtggactagcttgaggggagacctttgttagggagaacagagtcctctgggtatatttcaaaatggttacttttctcctcctcctgccagaagcacaggggattttttcctgatcttcgccttgagaacctactaaggggtaaaactcacgcaagttgtggggtccctcctaaggctggccaccaagagtttttgatctctcaagctaataaaaaccagagcagcaattaataaaaatgaaaacaggaaattacaaatataaaaagttaaagaagttccatcactattaatcccatcgatatgagaaggctaacaaaggaatttttttattcaaatgtttttatttatttttttattatactttaagttctagggtgcatgtgtacaacgtgcaggtttgttacatatgtagacatgtgccatgttggtgtgttgtacccattaacgcgtcatttacattaggtatatctcctaatgctatccctcccccctccccccaccccacgacaggtaccggtgtgtgatgttccgcaccctgtgtccaagtgttctcattgttcaattcccacctatgagtgagaacatgcggtgcttggttttctgtccttgcgatcgtttgctcagaatgatggtttccagcttcatccatgtccctgcaaaagacatgaactcatccttttttatggctgcaaagtattccatgatgtatatgtgccacattttcttaatccagtctatcattgatggacatttgggttggttccaagtctttgctattgtgaatagtgccacaataaacatacgtgtgcatgtgtctttatagcagcatgatttataatcctgtgggtatatgcccagtaatgggatggctgggtcaaatggtatttctagttctagatccctgaggaatcgccacactgtcttccacaatggttgaactagtttacagtcccaccaacagtgtatttctccacatcctatttctccacatcctctccagcacatcctctccagacctgttgtttcctgactttttaatgatcgccatcctaactggtgtgagatggtatctcattgtggttttgatttgcatttctctgatggccagtgatgatgagcattttttcatgtgtctgtcggctgcataaatatcttcttttgagaagtgtctgttcgtatcctttgcccactttttgatagggttgtttgattttttcttgtaaatttgtttaagttctttgtagattctgtatattagccctttgtcagatgggtagattgcaaacattttctcccattctgtgggttgcctgttcactctgttagtttcttttgctgtgcagaagctctttcgtttaattagatcccatttgtctattttggcttttgttgccattgcttttggtgttttagtcatgaagtccttgcccatgcctatgtcctgaatggtattgcctaggttttcttctagggtttttatggttttaggtctaacatttaagtctttaatccatcttgaattaatttttctataagatgtaaggaagggatccagtttcagctttctacatatggctagccagttttcccagcaccgtttattaaatagggaatcctttccccatttcttgtttttgtcaggtttgtcaaagatcagatggttgtagatgtgtggtattatttcagggactctattctgttccattggtctatatctctgttttggtaccagtagcatgctgttttggttactgtagccttgcagtatagtttgaagtcaggtagtgtgatgcctccagctttgttctttttgcttaggattgtcttagcaatgcgggctcttttttggttccatatgaagtttaaagtagttttttccaattctatgaagaaagtcattggtagcttgatggggatggcattgaatctataaattaccttgggcagtgtggccattttcacgatattgattcttcctatccatgagcatggaatgttcttccatttgtttgtgtcctcttttattttgctgagcagtggtttgtagttctccttgaagaggtccttcacattccttgtaagttggattcctaagtattttattctctttgaagcaattgtgaatgggagttcactcatgatttggctctctgtttgtctgttattggtgtataagaatgcttgtgatttttgcacattgattttgtatcctgagactttgctgcagttgcttatcagcttgaggagattttgggctgagacaatggggttttccaaataacttcttcttggtttagtcttgagagggtgtatgtgtccaagaatgtatccatttcttctagattttctagtttatttgtgtagaggtgtttatagtattctctgatggtagtttgtatttctgtggaatcggtggtgatatcccctttatcattttttttttttttgagacagagtctcactgtgtggcccaggttggagtgcagtggcgtgatctcggctcactgcaacctccacctcccgagttcacgccattctcctgcctcagcttcccgagtagctgggactacaggcacctgccatcacacccggctaatttttttatatttttagtagagatggggtttcactgtgttagccaggatggtctcaatctcctgacttcgtgatccacccgcctcggcctcccaaagtgctgggattacaggcatgagccaccgcacccagccagctaacattatacttgatggtgagaaactagatgctttcccccaagatcaggaacaaggtaaggatgtcccttcttccaccaccatgattcagtgttgcactggaagccctttctaatacaataatgtaagaaaaggaataaaaggcttgcagatttgggaaggaagaaataacactgtctttgtctttcacaagtgacataatggtctatatagaaaatcccgaagaaacaaccaaaaaaaaaaaaaaatcctggaactaatttatagcaaggttgcacgatacaagtttaatatacaacagtcaattggttttccatattctaacaacgaacgagtgcaattttaaatttaaaacaatgtatcagcactttgggaggccgaggcaggcagatcacctgaggtcaggagttggagaccagcctgaccaacatggagaaactccgtctctactaaaaatacaaaattagccaggcgtggtgttgcatacctgtaatcccagctacttgggaggctgaggcaggagaatcgcttgaacctgggaggtggaggttgcagtgagccgagatcgcatcattgcactccagcctgggcaacaagagcaaaactctgtctcaaaaaagaaaaaaagaaagaaatttaaaacaatgtaatttacattaacacccccaaaaaagaaatagttgtaagtctaaaaattatgtgtaagatctatttgaagggccagccatgttggctcacacctgcaattccagtacttttggaggccaaggcaggcagattgcttgagcccaggagttcaagaccagcctgggcaacatggtaaaaatccatctctattaaaaaaaaaaaaaaattagctgggtgtcccagctacctgggagactgaggtgggagaatagcttgagcccgggaggttgaggctgcaatgagccgtgtgaatgcatcactgcgctccagcctgggcgatagagcaagactatgtcaaaaaaaaaaaaaaaaaaaaaaaagagagagagagagagttgatgagttggaacttcagaaaaattaaaaacttctgctccatgaaagacactgttaagagtgtgaaaagacaagtagacaagtcaagactgggagaagaagctttgcaatacacatagtcagtaaaggactgattatctagaatgtacaaagaactcttaaaactcaaccacaagaaaatgaacaacctgatttaaaaatgagctaatagacacctcaccaaagaagatatacagatggcaagtaagcatatgaaaatatgctcagcgtcatacgtcactagggaatttaaactaaaacaaccatgagataccactacaatcctattagaatggcaaaacattagaatactaacatcaaatgctgactaggaggaggagcagcaggaactcttgttcattgctagtgggaatgcaaaaggtttagacactttgcacgaatgtttgcaatttcataaatagcacgatggtttcactacgcaatcagcaacctcgcggctatgtatttacccaattaagttgaaaacatgtcctcagaaaaacctgcgcatagatgtttatagcagcattattaataatcaacctaaactggaagcaagcaagacatccttctaatggatcaacttctggtacgttcatccaatggaatgctcttcagtgataaaaggaaatgagctatcaagccatgaaaggccatggaggaaccttaaatgtatgtcgctaaatgaaagaagccagtctgaaaaagctgagtactgtatgattccagctatatgacattctgggaaaggcgaaactatggagagagttaaaagatcagtgtttgcccagggtccaggggagggatagaggaagagcacagggggcttttgtggcagcagaactattctatatgatatagtaatggtggatacatgacattatacgtttgtcaaaatctgtagactcatgccatggagtgaaccctaatgtaaaaatctatggattttaggtaataataatatcagttcatcagttataacaaatataacactctgagatatattgttaataggggaaattgtgcaagagtggggtggaggaaaggtcctgtgagaactctctgtactttctgtgtagtttttctataaagctaaaactgctctaaaaatactaagtctatttaaaaaaaaaaaaagccctttggtaacctaactgaggagaagtcacgaagttgaaaaaaactgagtctcctcatgccaaaaaagtagtgggatggaggggaatggatgtggtcccctgatcacttggccctgcaatttgttgaaccaagcagccacagtgttgtgcaggcatcggtcagctgaggatgagcaggctggacagcctgagatactagaaaacagagctggcattggtgactgtctgaaactggagagacctctctgagatcttaaacctcatctcttttcactgaagttcaagccactggtgggcctgctggatccgctgccagctgctgttggctgatcaatgtttgtttcatgctgtttgaaaatacagtatagacttcgcaattcccaatcctcgctgaaatgcccggctgggagtggtgggagtgcacagccagcaattagatgtttcttttgtcacatccagaaaggacaccagggaatgcctttattccagccctgtgacatctccagcatctgactagcatctcagggcagtttcctaagaaagggtcagaagaatgcagcgtcagacagagcacagttaaccccagaattttgcatcaccactgttccattgcctggtgaggtgcttagattctctggcaaacctatttgaacaggagggttttcactttctggaaaggtacccagtctggtggtgatgaaacaggttttctctctgtactcccgggtgaaccctctgcagtctgccatttcttggaatcctcttaaccaatcttagaattatctcccagcatcagattttgcttattaaggaaaccaggcattgtgaaatgctcctttctacactaatctgaaagacataaatagtggcagagaatgttagacatagagcgggaaatttcagagacttttgttggaagaatcatcactctcctgcaggaactgcaaaaaacacttgatctctgtttacacatgcctgcagacacacagagaggccctaatcagcggcttgtggacagccttctatcatagctacccacttttctctatgaccttccctgttcttccactccatgtctatcctgactctcattcacgcatcacggcttggacacttgtgctgcctttatcatttgggaaaacatggcgcagcaatggcctcaagtttgtcagacgtctcaaatgctccacagtcgtcgtctctgaagccagacccaaatgtagttgtcttggtgattactgggcattgtctaatccaggaaaaaacactcttttgtagaaatataataagacagtgtgggtggtgctggatctgcagttttgtcattttgaaatttattgggttgatgcaaaaataatcacaatttttgccactaaaagtaatggcagaaagtaattaaaaataggccaggcgcggtggttcacgcctgtaatcctagcaatttgggaagccaaggtgggcagatcatgaggctgggagatcaaggccatcctggccaacatggtgaaaccctgtctctactaaaaatacaaaaattagccgggtgtggtggcgcacacctgtaatcccagctattcgggaggctgaggcaggagaatcagttgaacccggggggcagaggttgcagcgagccaagatcacaccactgcactccagcctggcgacacagtgagattccgtctcaaaaaaaaaaaaaaaaagtaattaaaagtatggcaaaaaccaagattacttttgcaccaaccttaatatcttatacatacttagggatggacaaaatgctttcctctcaaattctcagaatgatatcgttgattccgtgtttctacgtatttgcttggtggtttacatttatatacattgtgactgtaaacccagaaaataataatgccctttagtagagtagccttttgtggtggggtgcgtgggggtgggtgttgtttttggcttgatcccaaaagcaaggcattcaacctgctgaagattgtggggcttcccagagagcaccccagcaggggagcagtcttcagtcgctgcttcctctaaacagggcgtcgagtgagaagcagcctcctgaacacatgcaccaacatgaatgtgtctgtaaactcctaattgagagtgataagccgccaccagactctgaagggcaggcgtctttgtaggtcacaggttgccgagaaagctaagctcagtgccgctgattgacacttggagcagttacattgttctgtggccttcgtgggttactgtggtttgcaggggagctgccatcagatctttgcctgagtctgtaggctcaagccttctgaaggcccccacagtcgctgcaaggggagcaacatggaaatgagcttcattgtctagaatttcaaaaagccctgcagccatgaggtgacagcaaaactctgagcaaaagtccgggcgagcagggaactatgaacaacttgtaagaggtgtggttcattgaatccagcctcagagcaagagttttcatgttttcagaatgaagatgcattttttaaaaacgtactaggtacttacccgaggccatggtttgacctgcagatgacttcaacgtttggaactatggaatgcagaatgaaaactaaaagtatggctgaagacaaaaggcacgaggagatggttatctttctctctagcactactgaactattaccttaggaagaatatatttagagcatggaagtctattaacttttcctcattttaaatgttctttttaattacagagccacttagaaaatattctagcttttcatatcagtgttttcttctctgtcttatcccggtgtagataagccaatttcttttacatatctgagctgctcattaattaagaaaaactcagcattagttaccgttcatgagtcctcaaaaacacaaaattccacattccagcatgtgttacattaagtggaaaagatttgtctaatgctgtcctcatttttagtgcaggtgaaaaaaaaaaaaaaccaaaaaaaacccagaaacacttgattttgaagtagctctttcaaatcagggcaagaaaaatattacttctgaaagtcgtatgcaacacctgtaaccagcgcatcccttcttgtctgtggtcctcattacagtcatttcacaccctctcacccccttgtcccggaaggctgctgggcagaagtccccgagctgctggtgccacagggaggagttgagggggtggggcagtgcggtgcacgtgcgcagcgctctgacttgaggcttccaggagacgtgatgggtttcaaaacagtgtgcaagatctcccctcgtttgtgacaccaagatgttcctatggagcccacccagcccctcccgaccacctgcattcccaaggaagccctgtgacctctccggtcacccagccatcatgggaccggcggtgacagctttttttttttttttttttttttgagatggagtctcgtctcgctttttcacccaggttggagtgcagtggcgcgatctcggctcactccaacctccgcctcccaggttcaagtgattctcctgcctcagcctcactagtagctttgattacaggcgcctgccaccacacctggctaatttttgtatttttagtagagatggagtttcaccatgttggccaggctggtcttgaactcctgacctcaagtgatccgcctgcctcagcctcccaaagtgctgggattacaggcatgagccactgtacccagctggtgacagctcttgatgccaagcccctgtttgaacacagaggtgcctgagctgcggtgaagtgctcagcacatgacgatctcattttcagcacccccatttttatggcaaaacatgcaatatgtgtttctatttacatgacataggaaggtgtcatccacaaagtgcgtttttctctctaaacaaacgtttcatacatttattgaatcctaaaaatgggaagaacctcagagatgactgattctgaagtgtatcccagagagtatgtgtgcctccagagtgtagactcagagtagtggagcctgaatgaaccccagaggccatctcctctgaagtgcatgcttggctgaggaggctaagccccaaaaaggctgaaattcccaaaaagcaccccagactatgatagccaacccttgtcccagcctgcccaaccctgctttgcgcttttttccattattgtgtgaaatcaatgtcttctgtctcttccttccagagaaaaattataataattcttttaatcagggcagcaagacatttgacaaagtttccttagaccttggtattagattttaatgttgcagagagttcttcactagtgaaaacagtactgacatatgttagaaatatattccattcaggtctgtgagtcttcactaattccagggtgtgtcaagttcagtgtaaaagtctctttggcaactcactggctctgttctcctgagctgataccttggtacttctctgatttggccagaattacctgatgtgttgctttgtctagttatacatctttacacatatttcaagaaagtttatttctaaattcgtagcattgttttcttccccttaatggagagtgttctgttttaatgttttggctcctttttattcccagtggttttttttgtttgtttgtttgtttgtttagacagagtcttactctgttgcccagtctggagtgcagtagtgcggtctcagcttactgcaaactccgactcccagggtcaagcagttctgcctcagcctcccaagtagctgggattacaggcgtgcaccaccacacccagctaatttttgtatttttagtagaaatggggtttcaccatgttggccaagctggtctcaaacttctgacctcaggtgatccgcctgccttggtctcctgaagtgctgggattacaggcatgagccattgcgcctggcccccagtgtgtcttaaaatattacattttctacctaatttttataatctacagtttataattcaaaggcctttttatcttattaagatatattacgaagtcatttctaaaagagtttataaatcttcaacatttatttgttctccagtatcctattttagcattttaacagaaagtaacagtatcctacttatttggaaactcagccacaaagtaactgaataaactttttatacaaagcaaaaaaagaaaaaagtaaacacctctaagatcagccttctcttttgaaatacctttacactgaggtatatttatttacaaagacaaatatatgcttacatttttatagaacatctaagttttattgaaatattagcaaatcaatagccaggtacgatcactcccttcattcaccctgggacttgtgcataggccagactcccgggatgtcagccgcatgtgatgtggagataactgtgatcttattatctgaaatgtttgaatacggagagggtcccagtcttcattagaaagaaacttaaccaggacagtaaatatgttcaattcctcttaaaatgtccaatttactgataagtggggcacattttttttcatttaaaaaaaattggaatggccaccttaaggcaaacatttgagaagaagaaaaataatacaaatatattacttacaaaacaatacaaaagtgtctcagaccaaaaaaaaaagaaaaaaaaatacaaaagtgcccattccatgttgccattagaccagttagtcttcagacaggactgtcaccatcaatttttcatttttaaaggattttaattctttcagcatgttcatatggttttataaagccccagatacccagcaaatccccttggtgttgtaagacaagattgctgttaaaaaatgtttaggcttagtcagcttcttctcactgctgacttcacgaggggctctgggaaatggtgtttatactgagcttaaattgatagggcaagtttaatgcaattgggtcaaaggtacaactgcttagctggtctcatcaaccactcaggtttcagcatgggtttataaagagcagtctgtaatgataacatctggctgcttgagcgtgactgcattttgcctgctatgattgaatggaatttaatggtgggaggagaaaagctggggcaatttcatttttgagttatggttctagatagataagacaaaatggtagactttgattggtctgaggccggccatctcgcagattgcttaacagacctgcttcttctatagaaccctaccgtcaccactctcaaagacagctgtcctcattgagtcaatggtagaggcatggggtgggcacagctgctctaggctcatgtgtgtctgcacgctaggcctcctctttggcattgctcttctcgctgagttctggtttgttgctctgtggagactgtgaaggtcctagcgctcagcagaaaacacagtgcccttcccccagagggtgctccattaatgggagagttgactccattcactgctgggcagaaggtggatagaaagccagtgccaagctgagttcaggctgtcaaagagaggagatgaagaagttagttcccagtctccactatcgttccgcttagaaggacactgtgaccttgaggaccaaaaatgtaaatgtcataagtcagccgtagacgttacaggagaagcctactacgcaacacctccagagagggaccagcttaaactgtagctccggatcccaagggtccttttcattctgtggaaactcggtgattccattagtgatcacaccaccgtcacgtgaaaagctgactgtataatttcatattgcctaaggtcttttatagtcttctcaacttcacctttggatcattgagtgtataaccttttaaatttgcaagaacttttaatataaacaagtaggtagacaaacaggtagggatttacctccctggtgtaactaggctgagagggtagaggaagggtcagggctgtacacttagcacttaaccatatttcctccataaataagaaatattcttggtcttggtgcatcatcaggaccaacaggagaggaaccctagcccaccagatccacactgtaaaataaagacggcacagaaaaggaggggatgcaggtactgtggtgcaggggagaggatgctgggcagagcaggactcccgtctctaggatctcagagcgacttgaccctcagggactctcacggcctttgctgcttcatccataacaaggggcaaatgcctaatcagttcacttcccatacactcagcccacttatatgaaagccctcctgtagaccggaagccctacatgaatggaagtgtcgttgtcactcctctgctgatgacccacttggctgtcagtgtgcccagaggtcgagtttaactcctccaagtcgctgaaattaaaaatacggtctccagaaggaaatagtctatgtattataggactcaacttgacataccaaatccaaacctaccagatatattaaggtgatatttagaaagtagttcttatttgagctcaggagagctttttcacacagcgggcttccttgtagcctgaagacatgatgatatgtacacagaccctgtttttctagggctgtttagctattatgtgtagcaaggcacacgtgtatcctccttcatccagttgtggcccatcgaggcaggagtatgtggcccccagagagcagaaaggaggcctcctgctctggtcctggtaaaggaaggaaaccaagacatggaaaacaacagcaaagccttctgccccgtgcaccttcctggcagatctcattcctacccaaatgggtaggaaaatgggggaaagtaatgtataaagtgaaccccaagtaagtattctgttgtactaacaagccagaggtctgtctcccttcctcttttacattcatatttcattgtcactttcgattcttaggctggcccattacctccctcaaacaaggaactgaaacaaatctctttaaagcaatcatggttatacattttatatttcattgtcacttttgattcttaggctggcccattacctccttcaaacaaggaattgaaacaaatccctttcaagcaatcatggttatatattttgtgcccttaaaagtataagccaggaggggggagagatagcattaggagatatacctaatgttaaatgacgagttaatgggtgcagcacaccaacatggcacatgtatacatatgtaactaacctgcacattgtgcacatgtaccctagaacttaaagtataataataaaaaaaattaaaaagtataagccacctctgaatatagtgatcaaagataaactgccaactgccacttccaccagtcatactctgtccaagagatacacgtactctgtggtagagatgtgcaaagccagctgagtatgcagaagtctatctgtattcacatagcacgtgtggtgtgtgagagcgatcctggtgaacaatagtgacgtgaatatgttcattctacagttaggacgcttctaactttagtttcaaaatgtttctactgcactataccttggtatcaatgagatttttaaaaaatctctacccacatgtgaagcctctttactactatataatcactagtactttccaaattaaatattatgcttacattattaaacattagcattgccccctgttaggccagaactgtggctgatcagggaatagtttacatgagtctcaaacatgtcaatgtgacagagtgacacagtaaatcacctctaaccagtatggcttatactcaaaagcacattgctttcagcttcgttatgtgattgtccgtgctgtgcctgtaggagtggccagacaccatgaatcggggactctagggagaacaggacactcattcatctcacgcctctctaaggagaaacaattcctctcctctgaagagaatactcacggtctcccatgtgagtgaacgatgaagttgtaagaacactcccccacctcactgttggtgacagaggacagtgtggttccagggggtgggcaggtgagagggtccagagagtgaaggagatgcttggatgatccagaaatctggggccagctcattggcccagactttcattagttttgactgaaggctgacacaagattcaagtagcaaagggcagattctcggccttacagagaaatgataaagattccaagagttgatttttgcagtaagaatgggtaacatttaagaaacaccaaagtaaaatttgactaggttacttctttttctttttataagcaacttttagcctaattattgtaaagaactataacggggcatgcatgtgatttatttgttgaaataaatgtaagcacttatccaacaaattcttactgggtgcctaccgtgtgccaggcactgctctgggtcctgagggtgctaagccagtaggtgacttattccaacaaattacaacaaataaattacatgctcccattcatacaggagggcacagaccacaaacatgttaataacatgtcaggaggagatctgtgccatgaagaaaaataaagcagggtaaaggtgatcaaggaaggcctctctgatgagacatttcagcagagccatgaaggaaatgagggagcagggcacacggatcttcaccagtcaccgggggactcctgtgcaaaggccctgtggcaggtgtatgctttgccagttgaaggaacagcagtggggccagtattcctggcacagagaaatggtgagggcagtagccacaagcagtcacataaggcggtgcaggccagtggtagggtttggggttccaggctgtgaggaggagggccgccgtgtacttgcattcacaaaaacatcactggtacctttggaaaaattccgcaggggcaaggataaaagcaaggaaaagggagcttggtttcctgctcttctaggagagatgatagctaaaatctcttctagggaactttgggacgtttcagttaagtaggtgagaacaagaagcaatatgggggtgctttggtgaaggaggtcccacagttcagactgagctgggctcctaaatgaaaacagtggctgccttttctgagccaacgacctgcacggtgcttctgtgcgttgccatcacttcccagcatccctaacgaagggtgcagagacaccccaagttgaatttctctccctttccttatcagtgcatgttctagaaaagccataagacactatgaaaagctacagtctgctcctaagtatcatatttgagcagtaagttctaagaaattctattttaggtttgacatctggctaaaggaaatcagagaaagaaatgtcatatttgaaacagaaaggtcaaaccccttacgatatccagaaaggagggaagtaggaagcttttagtaaaataaataaatgcaaacctatatccttattctgacagtctcgttgggaggattcatgcactatggaagttttgcttctgaatctgtgctcattctttattcaacaaactttaattcatccccaaagtagcattcctcccagctgactgccctcagcatcttggcaggagagaacacaaaatgttatgcagcagtaagccctaaatttgtgtttctgtcaaataattgggaaaatgttggaatgatttttttcagctcatctttgttgagaatttaaggcatttcccttggctctcaggacagtttatatacatcaacataaagcagctgatgtcatatacagagtccacttgcctgcttctccttggatgttccagtggtacagacaggcctggacctcccactcccacctctgggccctccccacctctctgagactgtcctcagatcaactgtacttctttgtgtgggaactctaatccttggattccaaggtactggtcacccatgccacaggttccagaattcaaagtggagcccccagcacacacggtgctgctatcatttctccagctgttcccaagtctgcaccttctgcagctcttcccagaggccctcctgccatgtcactgtttccaacgtccagagtccttacctgtctgtggtggtgtgggatcactgtcatcatccacacatggactcgattctgatcctgcctgaaaactcaccattgccacctcagtttcccagtgctaagataagaataagatgaagtaatgttcacctgggggagctgatctgaggattaaataagtgaatgctgtaaaggtctggaacacagaaggcaccgagaagtgctggctcccttccttcctttcccagtcccgcacaatgccttccagccacgcagttcctctctctccaccagcagcttcggagccaaggcgagtcgccatttgtgactcccggtgctcctgctgtaggatttcatctagttctcaggtccttcctccatctccccagtgtagctgtctgtcatgggtttttgatgaccctcagatgatagcctcctccatgcttcctccattttctgccccctcaggcacccacccgccccttaacaatgacatccgactgtccactgcctagtccgcctcagcagcagggaatgctgaagcaagggctgcaccccccatcactgcagctggacccagcagtggatttgctagagcttgctcttgctcactcgctctctgtcagactcttactaactcttttgggttggaacgtggttgaggaagatccgggcagggtcctcggacagcctgtcagcagatctcctgcagccacagtcccacttgctggggatggcgagggctggggagtgggtgagcttcttgacctgccactagcacgcctccgtgtgtgctggatcaggtgcttccaaactacattcccagacccactcgggcttgtgtggcctcaagcaagccgcttaacctgtttccttatatgtcaaatggaggtaatcatacttaacgacatcacaggggtgtcgtctatattaattaattaatgtttgtagtgagctttgaagatgcaaagctgcttaaatgttgaggtattctgatgatagtccttgcgtgttattagaaccttcccaggttcctggaccatcactcactgattacaactaggatctaatagcacctgctgtgcaatccactcagggatctatggcacgacccatgaggatttaacccaaatggataattgaaaaaggtatcagtgaggcctgtacgcagacttcaggccagttacagcgctccgtagcagttttccagaagccgagaggactgccccatggtatttgctgcaaatggtgttcgttgtaatcacgtgggaactctgatccttagatgccaaggtaccagtcacccaagccacatcttttatgtggcgctgctcagatatggattgaaaactgcttgctgggacttgtgatctgcttgggccatatctcaaggtcatgatgggaggaaatggaggccatctgttgtgatcagctgtgattcatttacaaacctgtggaactatgctggaaagaaggaattactaccatggttgtcttctaggcagctctcaaagactccaggtccgcatgagaatattctttgccgccaacatctcctgtcatctcgtattgcctgtacttcacaaactaaatcagtaggttgaattcagatactagatactaataatcagaacagagagaatccactcccacatcttgtttgagatatgcctcttattcagttgatctgcatccccgcgtctcgcagctttcatcacactgcctgactacttgaaccggaggtgtgattcctgtgccttttcctcattgacacatgttttcattttctcctactggatgagccacatgtgaccccctacatccgttctcctccccggcctctccgcagaaactcatcccgtgtctgcagtattgtcaaagtttcagaaagccaaaatggcgttcttagttttctgggcacattgtgttgtttttgtttcttttggattttggatgctgtcaacctaaagacactaaaagcccccactcttcaagatttgtgtgaaaaattaactctggatgtttttaaattcctacagctgaaatcctagactttgccttaaaaaaatgatgctggtgccaataggaccccttgcttgaaatgtaattggcacatggtttggtggctttgcctggcccatcccatgatgattacccccagatatggtcagcaggggctttccaggaatgctttagcaaggaaggatgcgggtgtacataacacagcaagcatatcatcttcttcaaggtgccacttaggcacctcctgtaagaacacaagcaggtccgcggctggggagccacgtgacgcatgcagggtgtctctcactggacgttggagtctaggccaccgagacttccttttggggtgcaccacagggagcccaggtttaaaaaggacttcctttttctggttaacatatattaacatgtcagggaaactaattgggtttaaaatggctgttactctttcttttttttttaatggatattatgtaacaattatgatcatctttttactagaagtttctgagcttcagttactcagtttcctgaataacaaagtctttctcaagtaattcagtgttgctgagagaaccattgaagtttattatgatacatggtcagggtgaaaagtgtcctctgcccgaaacagattcactatatgggagtatggggcaggggggcagtgagagaagcagctaccctatcctgttgccccctcagtggcatctgcccttggtccactgggtgctatcacccagctgccaaccttttcctgtccacccagccccttccttgcctgaacctatctgggtagacagtatggatattgcttattggtacaacaccctatcacacccaaagcaaggtacccaggctgtaactgggaggactgggatggaatgcatgtgagacaggcccctcccgagacagccatagtcccaagagacctgctttagttgaaactctgtccccatgggacctcattgggatgaaaggttctgacactgatgtatcatgaagcttgcacaatgtggtaaagttactaaaggccactgaatcgtgcagttgaaacgagtgaattttatgatatgtaaaacatgcaacagtgatgtttaaaaaaaaaaaaaaggccctgccaccgaagagcccacagcatccagtgtcccctgcccagcctccctccacagagcaggaactgcatacaccccacagaggcccatggttcatgaggaatagcaggaactgcatacgccccacagaggcccatggttcatgaggagtttgccactggcccacaaggctgccttttccactctcagaaggccatcagaaagttgttttgggttttttttcctattaaactcaaacctgcctcacgtgacttctacatatatctaccccaagtagttccagcccctcacagccttgtgagagccgttcaggtattccaggacgtctcttttctctaagcaaactctcattgctccctggatgtttgtaactgcgagcttggctggggcaacagtgccatgccggcaaggtgacaatagtcagaatgttggccttcccaagcgtgtgcctcagttcctgtctgtgagcagaaagccgagctaaatagtctcaagcaacttaaatattctagagtctgtgatttgagacaaataattccaaatgtatatgttgattttttaaatcttactctagaagtatttttttatttttctgtgaaagtattctttaagaaaacaatatcattacccattcagaaagactgatgtttcttttcattcaactgagtgtgtcatacagtagaggaagcattccataatgatggagagcttccctctgcctgtccaggaggatgcctgtgatgcactctcacctggacacaggtaggcagagcgctgggctgtgtgggcgcagggccgaatgccagcagtcggtgggatgatactcttatgttcctcagcaaggcccaggtgggaaagccttcgggaaaatgcgacttcgcaaattgcagcttcagctttgaaacagtgaacaagttgaagggtcctcagtagagaagcaacatctgctgggtgatgactggtgttttcatcccaatcccggtgaagagatcatgctgtggacaccttcagtaggaaggacagtggcatgtataaaggcagctcacgatggaccacccaaattgaaggcaaataaccctcaaaattatgtcttttcacttggaattcagaggcacgttttctagataatcattcaggtatctatttgcaaacacacacccccggcactccctgcctctgagcagttccaagagaatgctccagaaactccagaccccggcgctacgcaaggcaggcctgtagaggcagccagtttgctgccatgcgcagagctcacttcactttaaaaaggggagggggatgggatgccacttagtctaattatgggattttctttttcttttttttttttttttgcttgagttctttgttacaaggatcttttaggagtaaagaataaaagaaatgacagagaattttgcccaactctccagggagagagaaagtaagtgggatagaaattggtgagtgcggggcacctgcccccgactgtcatttctgatggaaacgttttgaggcgcccacatggttgctgctcccacaggaatacttaggacaggaaatctggtctcgcctcacaaactcagccagtgaaagagccgtgtgaacaccagttaataaatgcctatgtctgtctttaacaatggagggtatcagtgtcctgcttgaaagcattcctaggctagtcaatgctgtaaaataatacagaaaactgacatttttattgtggcacgagttaccatacagcggctatctgctggctcatctggtttttataatctgccatgttgctgtcatactgagacttgacctgctgtcttcaggcacagcctctctcatttcagcacctgcctaagtgcataagcaccgcttccagcacagaggtcgatgggtgctgtccaccttgcacctgcgctgtctctttctcccttcagtcctcactctccactctgtctggggaagaatgtccttgaaacagagattccagcaggcccatgacacatcgtcagggacttcatgcttgtcagtagtctagtggcatcaaagatctctttaagaggattcgtggtcagccatccatgaatcagtcaagaggaccaaggctcccaaggagccaatggtcatcctgtggcaaaagaaaccctcttgctgtccccacaccaaggagcccctctgcaagtggacagggcagagtggccttgggtgagatgtgccccccgccactgagacctccagcatggtgctcttggcgccagacttcagtctttccttgtggctagtgaaggtaaagattgcctcctggggaagaggctgcttgaagggacactcagcacttctccaacaaagtcctgtacaggtagtatctcagttatacggtagaaggaggcaccgtgtacagccaggagccaagcccagatccagaagatgtaatttttttttttttttgagacagagtctcgctctgtcgcccaggctggagtgcagtggcgcgatctcggctcactgcaacctttacctcccaggttcaagcgattctcctgcctcagcctcctgagcacttgggattacaggcacacaccaccacacccagctaatttttgtatttttttagtagagacggggtttcaccatgttggtcaggctggtctcgaactcctgacctcgtgatctgcccacttcagcctcccaaagtgctgggattacaggcatgagccaccactcccggccccagaaaatgtgaatttgtgtttttttgtgttttccaacaatcatatcaatcctacatgaccatgtatactgattcaccatttatggaactcttcacagatgttgtctcctttgagcctgaatttgtgatggcaaatctgtctggtgaacagcgtgaaaaagaaagagggcaaaaaccatttttggagctcttggagacagtagtgacatttcaaaggctcaaacaccggggccaggagaccactgactcataaggcatttattttctgttttagaaagttccattaaccttatctgaaaaatgggctaagttttggaaaattaatcttattagttaagatcaacttgtataaataaaattcaggctaatacatttggcagatgtcctagagccagggccatggagacaggtgttctgggttccagcatcagctccaccacgcactctctgtgtgacctgggtccagttgctcacctctatgtgcctcagcctccacatgtatgacctggctgtggggtgtgcgtgacatcacaatgtgattctgactctgaggacattatcattaacacatatacactgtggccaaattagaaatcatgagttgttgaatctgggaatgtatccgcaggctcatcatgctcttgtctccggttttgtataaaaatatgttaaagacagccaggcgcggtggctcacacctgtaatcccagcactttgggaggctgaggtgggcagatcacctgagatcagaagtttgagaccaacctggccaacatggtgaaaccctgtctctactgaaagtacaaaagattagcaaggcgtggtggctggcgcctgtaatcccagctactcaggaggctgaggcgggagaattgtttgaacctgggaggcggaggctgcagagagccactgcactccagctgggcaacagagcgagactccgtctcaaaaaaaaaaaatatgtgtgtgtgtgtgtgtgtgtgtatgtgtgtgtgtgtgtgtgtaaggctttcaaacgtaaggaaaaaaactaatgtaaatattttacataaataggaaaatgtgtcaattgaaaaaagaatatatacatgtcagtgcaatatgaaatagcttagtgagtagccttagaaatttaagaaaagaataatcagaacccacgtattcatccctgcacattatttttaaaatttcgtttacccagttcccgtgatgtaaccagcactgtgctaggcactaatgatacaacaattaaggctcagatacccccaaggaagtagctctagtgtgacactttttgtcttttttgaaaatatacttttaatctcctttttgaaaagaaaaatgagagttagtgattcagtatagtgagttattttatttttcaagttaagtatcagtggaatttttttttttttttttttgagacggtatctcactctgtcaccaggctggagtgcagtggtgtgatcttggctcactgcagcctctgcctcccgggttcaagtgattctcctgcctcagtctcccgagtagctggtactacaagtgcgcaccaccacgcccagctaatgtttgtatttttagtagagatggggtttcaccatgttggccaggatagtctcaatctcttgacctcatgatccgcccacctcgagctcccaaagtgctggaattacaggcttgtgccaccatgcctggcccagtgggatattttttaaataatggtaaagtacacataaaacttacatcttaaccattttcaagtgtgcagttccgtggcattaagtacattcacagtgttgtgcagccatcaccaccacccatctccaggactcttttttcctctaaaactaaaactctaccccattttctccaccccaagctctggcaaccaccattttttccatctttatgaatttgactactctaggaacttcacgtaagtggaaccatggagtatttgtcttttcataatgggcttatttcacttacagcatagtcgatgcatgatttatccatgttgtagcaggtgtcaaaattgtcttcctccttaaggaggaataatattccatagcaaatattaccacagtctgtcgattcattaatctgtcaacggacacttaggttccctccacattctggctgttttgaataatgctgctgtaaatatgagtggacaagtgtctatttgagactcagctttcagttcttctggttactagcccagaagtggaaatgccagatcatatggtaattctatatttaattttttgaggaactaccatactcgttttccattacgactgcagagttttacattccaatcatcagagcacaaggattccagtttctacatattcttccccaatacttattattttctgggttttttgatagtaaacctcctaatgggtatgagatggtatctcatggtggttttgacttgcatttccctaatgagtagcgatgttgggcactctcttatttgcttgttctttcttttgttgttgttgttgttaagttgtaggagtccactttgtctgcttttactcgtgttgcccatgcttttggtgtcatatctaagaaatcattgccaaacccaatgtcatgaagctgttctcctgttttcttctcagagttttatagatttaagtcttatgtataggtcttcaatctatttgaggtgacttttatgtacgatgtaaggtaagggtccagctgtgttctttcgcatgtggatatccagttttccagtaccattcgttgaagagactgttctttccccgtagtgtggtcttggtacccttgttgaaaatcaattggccgggtatattagggtttacatctgggttttctgttccatccttcgtatccgcgtctgtctttatgctggttccacactgttgtgattactgtatctttgtagttttcaaatcaggaaatgtgagctctccaactttgctattgtttgttgttgttgttttcaaaattcttctggctattcagagtcccttgagattccatgtaaatttcaagatggatttctatttctgcaaaaacatcattgggattttgatagggattgcactgaatctgtagatcactttgtgtaatgatctttaccctaacaatagtaagtcttccagtccgtgaacacaagttgtctttgcatttattggtgtcttttgcaacttgcatttgaaggcctattataagtgaagtacttgtaagtgaagtatatgtggtcatggaaaaataatttaatctttttcctacggcagtgtacagtccagtttaaacaataagacaaattgtacaaataagagtgtagatgggaagtgacactggcaccttggggacgtgccacgggggtctgtggagggaggcatgcatctgtgctcctcaaggctgccgagcagtaggacctgtgggagacaacaggagccacgcgggccaggtgtctagtgggtcggagacctgggtgactgcaggtggcccggaaggccaaaatacaatgcaggcctgagggatcgagagggacatacacagacacacgtgacccaggagggcaggaagaaggccagcaagcacacatgagtgtggcagcctgtacacatcccacaagcagaagcaggacaaacagcaggtccggacaggagggagacctcagtgtctgagctggccagaaagaaatccagtttattaaggtgtctgtctgtctgtctgtctgtctgtctgtctctctctctctctctctctctatatatatatatatatatataatatattatatataaataatatatattatatatattatatataaataatatatattatatatattatatataaataatatatattatatatattatatataatatattatatataaataatatatattatatataatatatataatatattatatataaataatatatattatatataaatatatataatatattatataaataatatatattatatataatatatataatatattatatataaataatatataaatatatataatatattatatatatattatatataatatatatatatatataatatatatatatttttttttttagcggagtttcactcttgtcacccaggctggagtgcaatggcacgatctcagctcactgcaacctctgcctcctgggttcaagagattctcctgcctcagcctcccaagtagctgggattacaggtgcctgccaccacagcaggctaatttttgtatttttagtagagacagggtttcaccatgttggccaggctggtctcgaactcttgacctcagatgatccacccgcctcgcctcccaaagtgctgggattacagacatgagccaccacacccggcctgttaaggataatcttagaagatttctgatcttagctctctcagttccaccaagagaaagctcagattaacgtttctgagttctgcactgctgccagcagagaaaacatcaaacaaggaactttcattccccagcacgtgccagtgcaggagacacccgactgagtgtgtgatgttgaagttcattgtttctatctctaaagcacccttgaaaaacaaggcatttgggcagctatacttttaaataggaacaagcgaatattgttgtttatcgagtgccaggtgtagggcttttgcatacacattatctcatttacttccttacaactctgtggggtagggctcatgggtctatctaaggatggagaggttggcacggagatcacctcaaagatggtaaaaactgaacagtcacatttgtgtgatgccaaccacaggctcacatctgaatctgttttctcccagaacagagatgagggccagggcaaaagtctagcttcagacctggacaggatgagccaagtatgtcccacgccctgggtgcggcccccaacaactgttcttctagttaaaggagggtgtgcccatgggatggccaggaccctggtgacaccagccctggaagtgaagatgcacagagcatctgagaaggaggctccaggagaacatctacctcccttccctgttctttgccaggaaggttgagatgccagtcccaggacagtgtgcacagaactattcctgtgagacaccatgctgggccttagtgagccatgccaggctgctccctcacaccagccggactctttgaacttgtcattgaattttccaaaccagcatgatgggtgtgagctgatgacccagtgagaaggggtgcatgctgccactggtgtgggctgctccatcaaaccaagcacaatgccacactcctggtggagctgcggcccagcatggccatcgtcatccagatagcagctcagcagggcaggtgcacccactcaggacaagcctaattttcctcccatgcagggcccaggaaaaccactcaccaatcttcactgtagagctggccctgccttctcaggggacatggcagggttgccgagtacttttctgtttcattcatctactcatttgcttttcaatctaacaagactgttttattctttagagcatttaatcttaagagtcagaggatgagaatagaaaattggctgggcacagtggttcacggctctaatcccaacagtttgggaggccaaggcaggtggatcacttcaggtcaggagttcaagatcagcctggacaacatggcgaaacccccatctctactaaaaatacaaaaaaaaattagccaggcatggtgatgcacacctgtaatccagctactcgagaggctgaggtgggagaatcacttgaacctgggaggcggaggttgcagtgagctgagatcacaccactatactccagcctgggtgacagagcgagaccctatatcaaaataaataagtaaataaatgtgtttaatcagtagacagtaagggttaagagggtttttcctctgtgcttgaccattaaaatgaacgaagaattggtaggagaaggctttgagtgatttggattctgcctgaatctgaacggactggaatatttcacacgttcttaaaaggtgccactgtaccaagccatctgatgggacacaccaggagggctgagaacctaaggagtctcttatgtctttaaaggaagaaataagcatataattaatggttggttttttttttcctgggcatgagttggatcaaaagagagctgtcagagccatgggcaggagatgatcctgtcagtctttgctgggctcacggctgccctgaaagttaaaactcttggtacgataaatgcagttgctgatagtattggcaccagtccccacgagctagatgaggaaaggaaaaggaggccatctcagagctgcgtggccgagggaacctagatgattacggccagcattgccactttacagctgaagaaactgaggccgtggaagtcgttgcttgcccaaggtcagacggcaagatcatcacttcggaagttactttcagaaggcaaggtgcacattcactggccaggagactgctggaaagttccagtctgctctttcaaggcctctcttgacagagggatttagaaaactgtgaagccaggcactggccaccctcataaagtgacaagtcacctaaaactgttttcctgcagagctgtcaggagcatgatatctaaggggtgtcttcgaagtgcagtaaaaatgtcttgattggagaaggaggcaataaactttctttaaaactaaagaagagacagtttggaaagaacctggggtcattggccttgtgtttgagaatgagttggaatgtagcaaagggaaaaagatgccctttggcctgcacataaagatgcagtaattagggcaggagcatttggatctagtgcatctgtgccttggataacgtgccttcatgttacaaggtgcaaagatagcagatttcaattcctctaggactcttgctttaatggcgtattatgagcaaaattaaagtgtattattaaatgtgtcctgaaataggctggatgcacagtgtacagtcagttttaatgttcatggcataagtatcatgagttaaatttagagttgggaaattatcagatattctgacctcaatttgaactaaaggcaagtcattgacctctgagactgagttttcctgtctgtgaagagttaatgacatacacttgaaacacgggttgaggtgaatcacagcaagactgtataaaaccccaaaagagtaatcggctaatgtcttcctagtacccaagcttacttcctgacagtacatcacagtattattccaaaccaggacccccagtggctagacagggttaacgtgtcattcctgccccatgaaccctagacttactggcaagtgatttgcagcataacccaaaacctgatgtatgaataatatttgaaggacagtgtcataaatttacactttttaaaaataagagttgtaattatatgtgtgtaaatgtgaatgactgccttaaacgtaagctcatgttctctctctgattctgtatagtgttgccttgagaaccattatatctggaaatgtggagcaaaaaagtcaaataagagctctcggaagactgtatgttttagatcttttatcagcaagatctctgggacagctagtggagaaatcaaacagggaggcagcaggccagtgatcgccgtaatagtttaaacttagaccagtaaaacggagctattttacaaaaaactgtggcattctaaatcgttgaaagttacgtttcattatttgggagtggtaattagctagacaatgtatgattaaagtattatgaaactaacggatctgacagttctctttgcaaagaaggaggcaagagccatgcttttttgtgtgcagaggaagacttcatcgcatattctttacgtgttcaaaatgattccttgctattgatacttgttctaagttttccccacataaattacagtagcattgtgaggctagttgtgaaattaagccatactttatggagctgcccttagtggtgatgtaaaataatctttagagtctcttgtgttactgagtacagatcataggcagcttcaaataagtgggcagctacatcagaaagcatgacgctggagagaaaggtttccttccgaccaaggtagaacctgaaatgtccagatatattggaaacatgaaatgtatccagcgtaacttccactgctatctgccacacagaacaaccacactgtttatattgtcacttctgaagagtaatagtgaggagatcctgaggagagaggatatgataagccattgcccaaattacagagccccaggcctattccatctaatcaggagaaagagctttaggcgaggatgtcctcactctctcaagagatatattttgagtcctcactataggcaaataggtatgggctctgaacagggtggctaatgaacaagaccgagttcctttaccgtcgagaagcccctgcaggtacagagcacccgagcatcagggatgtgggaactgtgctggtccctgagatgagaacagctgtggttcaagggaagaccagaccgctagcatcgttgtactctgagaggaggtggcattcggctggcactggagggatcagtacagtgtcggtaggtccggatgctgagaaggacattccaggaggaaggaagggcttgtccttcccccactccggcctgagaatgtgtccgagattcctcaggactcagcccagatgactccttctctccagagcattccgttccacacaagagtgaggactcacaccctttcctactttccttccactgtgcccaggaactaagtcagtgtcttgtcacactacatggcagttactggcatatgtgtctgtgtccccttgaccttgttcattagccaccctgttcagagtctagtacctatttgcctgtagtgagtactcaaaatatatctcttgagagagtgaccatatcctctggtatagctgaaggtattaattcttatttcagtatcccaggtatcagcttccagacccttcagcctgctggggacactctttttttaggatttgggggtggggagaagctgcttaaattcctgttcccatccagcaggaaaccccatgtctccccagtagctctgagaatcacctggctccagtgaaactccgaatgccctgcagcctccatttcctacgttccacagcaaataagatgttctataactgcaggtgttcagcggaggggttatgtcttggttaagaaaccactttaaagccacatcgtggacaggcctgttctcgaagcttcctggtcattgtttcttgcagaacactggttcctctgggaggggatggagttcttctccctctgcacctgcccagctgccctgagcagcccttgtcacctttatgcaaagcagtccagccctttccgccatccttcctccctagccagggcaaggaaggggcaagaggcctggctaccacccgtgcccacaggagccatcaaggtggtctttttgtaagagactgagtgagcccagtaggccccctctgacctggcttttgaactaacctccccaccccaccccccaccacatggggtgcccaggacccaggcattcaatgaattcctcttcagggagttttctaaatgtgcagaagtggggagtcttcagcctatgcctgattcctggttaatctgacttttcctgaatgcaggatataggtggaaaaaaatgggaaataaacctggaaaaggaggttgggatcatattgaaagatactgggctgggcatagtggctcatgactgtaatttcagcactttgggaggccaaagtgggtggattgcttgagcccaggagtttgagaccagcccgggcaacatggcaaaaatccatctctaaaaaaaacataacacaatttagctacgtgccgtggcatgaacctgtagtcccggctgcttgggaggctgcagtgagccatgatcgtgccactgcactccagcctaggtgacagagccagaccctgtctcaaaacacagtggtcagatattggaggtcagggtgagagtttggcttttatttggcaagtaatggagggtcctgactaagggactgtcacagaaaagccctaggtggaatgagcacggaccccagagcaggggagggctggtctgtgaagcgggaggatgctgtcatcctccaaggacacgggaactgagggcttgggccacagcagtgatgcagaagaggtgcaaggaaagcctgggtgccagaggtactggaagtggcaaaatagagaagaaggagctaaaggtggctaagattttaaatctcaaggatgggagtgagtgagaggaatggtaacagtgcaacaggaaaagaacaattgcatttagttggggggagatacattgacttcagttttaaacatcccttgaggcattctgcaaataccgatcgagtgcctctgcgtgccaggcacagtgccaggtcctgaagacagaggtccatatagtgcactcagcactgatgttctagggaggcagacgacagggtagtgggtggattggcaaaataaccacagattgttaacaagtcctcagagaaatgagagggacactgtgctagagagaagcgaagttgcatgtggagacttctcacaggagatgcttgctgtagacagggtgacgctgcggtggccatgggcactggctgcagttgtcaggctggaaagaagaatgcagccctggaatccaggagaaaggcaaaggctgaagatagagtgatgtcctcacatagaggccatagttgaagttgtctgcagaaaggggcccgccccaggagagcctgcagaaagcagagacactaaagccaaggttggacccggagagtgggaggaaaagagcaagtgaggcaaggcaaggacagcacagggaacaccaggcgagggctccggacctccaggaggacagggtgagcgtccccgggcactcgagcatgccgtgcacatgccatcatgggggtagaaggcgccatttgcacagtgattgaaaagtgccttctgccatcaagacagcatccgtgggatattttagcgctgatgggtgcaggaagctatgctaggcacagcacgggtgactgaaaatgggcaccatagattctctgcccatggggggcttgcattcagtttggggaaggaagtgtgctggatgacagggtataagaatcaagcaggctgggcgcggtggctcatgcctgtaatcccagcactttgggaggccgaggtgggtgaattacgaggtcaggagttcgagaccagcctgaccagcatggtgaaacgccgtctctactaaaaatacaaaaattagctgggcgtggtggcacatgcctgtaatcccagctactcatgaggctgaggcaagagaatcgcttgaacctgggaggtggaggttgcagtgagccaggatcacgccactgcactccaggctgggcgacaaagcaagactccgtctcgtttaaaaaaaaaaaaaaaaaaaggaccagagtctgaatctcatcctgatacaccccacttcctaacctcgtgactctgggcaagttactcactaagcctcagcttcctcatctgcagaatgtaggtgctggccaggccctgagagccaaagctgtcagagcttgcagtgggtgcaaggctcacagtacaggtgcaagaaacggcagtgggggtggccgtgaaccctggctctgtggtcaccagaaaacctcacagtccctcctcttcgccataaatcagggaccttgggatctccttcctgggcgggcagcagggattagagcagctccctgtgggacggtacctggctcctcccgacaggagatgctgagaaatgttggctgacttagagcacaaatttggtcttctaaagtggagagaatttcagctggggaacttgggaagggaggaaaaagtgcaaggtggtgagaaaggcaggagcaaagtgcaggcagcagcaaagttttgagcctgtggggagtgcagcctagcggctcatatgcagcctatttatggcaatggtgagacgccaacaggaaggcaggaaggctctggctgtgttgagggcaggtttggatgcccagcagagggcttccaggtggcaatctgcagtccacctgacaggccctagtcacagctgcagtgccatccgctatcgttcacacgttcgctcgggtggaatcaggggtctcccctggcggtggagggccctccccgcgtgggtccctggaggaagagtggatcctcatactggtggctgcaggctactagtatctgcaggctgaggtgccgtgctgacctacctcagaccgggggttccttgccagaagagcaggccgaggacacggggcaatgtcagtcacagcgctgggccctggggctcagaggggaggtgtctggggacaacgggggctgggtaagggccgtccgccctgggagccttgtcagctgaggagtcaggcttggcctctagagagggcccacctgcagggtgctttgctcctttgtttcctctcagggtttttaaaaggactttttttttagaggggaggggagctgggaagagactttcaactttttttaatttttaaacaattttattgaggtataattcacacatcatacagttcacccacttaaagtatatgatcaatgggttttagtctgctcagtgtgcagccatcaccacaatcaactctagggcattttcatcaccggaggcaaaaactccataaccattagcagtccccagtgtcccccccaccgtggcccaggtggtcacctctccacccctgtctctatgcatctgctgattctgaacttccgctgtccccacctagctataggtgtgtatcctttgaccagcatccccacaactgcctaaggccctggtaaccacatcctactctactaaaaggactctcgaaggctctccttgcctcatttatgccatgggagccgaggaaggcatgagcaccttgacagccacctggagatgagcacagttgcagcaacagagcctcgggggctcagctgccccgtgggcagtcagggttcgttttcaggaaggcgtaaggaaattgcatttccttacaatgcctgtgtgtcctgccaaatgggctgggtctcagggacaccaagctgagtgagatgctgtccctgccccccacacttgtctggtctggtgaatcaatcctcagacaccttctatgagggcacccttggagattccggcacatctcacctggctgaggacctcaccaagctccacttttcacaaactccacaggatgtgttgagaatcaccagtttctctggggagactcaggggaagagactcaggataagaaaataaaaggaagtatggaccggctctgcaggatgcccccctcgtcagcagatccctcatgatgtggttgtgttaactctgctaagaccagggctgtttaaaagcccccaaagattctctgtgaagagctattttaaaataggggaaaaaactcagtgaggaaggggactccataaggagtaaagggaaggggcttcgtggggcccggctttaggagcagagatccgaggcccatcctgatcttcctgttggacttggagagacagaccgtccaggcccagcttgcctgtcgcccacatgggaccagcacagctgcccacctgtgctattcacaaagacacaagaagccatcatgaagcaggctttataaagtcaaaatattactccacgtctgttatgcataaggactcaggacgatggtcaccatggaaccccgttctccaacctagaggacaaagaccaggttgaccttcaccttagggggaaggtggagattttgaaggagaaatttattttctccctgacaaaaccaaaattttcagacaaatctgagcaacagttatagaacctttggggtaggtttaaagacggaaactggccgggtgtggtggctcacgcctgtaatcccagcattttgggaggccgaggtgggccgatcatttgaggtcaggagtttgagactagcctgaccaacatggtgaaaccctgtctctactaaagacacaaaaatattagccgggcgtggtggcacattcctgtagtcccagctgcttgggaacctgaggcaggagaatctcttgaacctgggaggtggaggttgcagtgagccgagatcacaccactgcactccagcctgggcgatagagtgagactctatttttttcttaaaaaaaaaaaaaaaaaaaaaaaaagatggaaactgcccagatttcaagagaattgaggcttgctgcgctccccttagtttctgaagagcagggttccaagtgagcgaggacaggatgaaaaggagagtgctacgcagggcgatctttctgagccaggggccagtaggaaaggacaggggcatcctgaaggagcaggtgaaacgagggccttcttcggggttctgagaacttcctagtgtgcttccactgtttgggacaaaagaagtgtgccgagttgttggggtatttccgcttcacctttcatgaaggtaagtcagagagatgcgtgggggagccccagggcagaccccaaatatccaacaggaggctgaccaatatttaaaaacctgactttcaattaattaaatcctgaagaaggaaagggagagagaagagggatagaaaagagagagagagagagagagagagagagaaatcatccgagagacgcgagctgtacgcgcctgactgctggaggtaatgccttgagcagcagaatggagcgctcctgtctgggctgctcagggcctctccacgggaccttctgtgcctgctccatgctccgcccttccccagtgctaagcactgagtcacctgataaagatcgcagtggcccttcaggttctgccacaggctggggtcaggcaggcacttgccaggtgcacggcaccctgaccttccacaaggtatttccctcctttgacaggaagaagataaagcttttttcctgtccattctgagacgcaggctgtgctgctccatggcactttctgagtgccaccagctggcagggcatatttctctccatttatcttcactaacgtgacagtgacatagattgtccctgaggaacacaagactagcccctgaattacatccttcaggacctccagggtgcacaggaatggatgaggacctcactgagccccagaagcccctgaatgacagcatgtctcaggatgtcccaaaatgagtccagtccaatctccagcatgtgagtagccaccagtttccccaagggaactcctaagaccatctgcaggcaaagggtctaatgagcacccagaggaagaaatatatacagggatctttcctgaggaagccagaaataattctcacagctgtggagccaacgccacctgtaacagcttccctgaccccagccccatggggtcactctggacttcagggtttctaaccagccggcccttcagggccctagcccagcctgctccctccacctcaagctttacccagggcagcccccactgtcaatcataactctgcctaaacagtaccgtgttggcattcgtgaccccccccattacccaattttctttttatcagaggccttgtaaccacctgattgtttccttgattgcctgtttactgacagtgcccccacagtagaacatgagctccccgtgtgtctggttggctgctgtgtcggcagccctgggcctgcgctgtggggatgcaagggcacattccatgtgctctggaaccacacctgagacagcctgccctgctgtttataagaaatgtattctctccaaaacgggcacctagaaggcacagccacatccagcatgttccacgggcatgggatagcctcagagagccgctcagcagagaggtcagggaggttcaaggctggggagtggccaacacttaaagagggacctgaggcaggaggagagcgagcatacgtggaaggccttaccccgtgacaggtgcataacacacctgcaggtgtggcatgcctgaggatgaggacaccaagccacctcaaacgtggtgaatctagtgtcaacctaagtctctgtgaccctaaatcccatgtgcttctccacgggcacagtttcagtgaagaagaggaagcatattccaggctgtcgggaaccaactgcatgaggagggcagcagattgctagaactgaagagtgatgtgggggagccttgggcaacagtgctgccgagctggtgccatggactggtacatccttctggggtctaactgcatcccctgggccccagtagagccgtcactgactgtgcagtggcaggagctgctgtctgtcgggcacttacccaacatcaggcactgattttatctctgatctttagcattggtcgatatcattcaacaggcttatacatcatggaacctaggcccagtgaggttcagggcatccaggaagtaagtggcagaactggaattcagcttggatctgtgttttcattttgttttgttttgttttgagacaaggtctggctctatcacccaggctggagtgcagtggtatgatcttggctcactgcagcctctgtctcccggactcaagccatcctcctacctcagcttcccaagtagctgagcctacaggcatgcaccaccacacccggctggtttttgtagagatgggctttcaccatattgcccaggctaatctcgaacttgtgagctcaagcaatccacctgccttggcctcccaggtgctgggattacaggcatgagccaccgtgcccggcctcagcttggatctgactccaaagctcatgctcagctggcgatgactgctttgcacctggggggtccacattcagcaaacgagagagttccacttggcccccagccgtactaaacggggcagttctgggaggttctctaacaccactgggtccttgaacagctgtctgcatctggactgttagccttgcacttcgtctccctaccttctgctcgttcctcacaacccagctcagggaatatcttctctgggaagtatttcccaagagccctcacttcactggcctgtgagcgcctcctgcgtcccactgtgaaggtagcttaatccttccacttcccccagtgggaaaatgctaggcacgtcacccagtatctgtttctgcaagtgcctcagtggcatccttaacatggtgcgttgtggaggccaccacacagccctctctcctccgctcctgctcctcttcaagcctgagccctctccccgtatccacaggcacccacctccttatctgctagcctgcccttgttgcctgccgcagacacaggtacctgtcggagatcaccatctatgtcagtctccatcactgaccttgagcttctgggctgactgcatgtatgaacgaatgttggccaggatggaataagaagatttcaaggtgtctctttctttctgcactctcactatccagactcatgagctaagtagttgtagataaagtctttatgtacctccagactcactctactcatgcaggtcccattgacctgaaaacatggtctccctcagtctccacaccctaaggaatatttgtgtttctgttagtagtcatggtggtagcattaataagacccagagagttctttctaattctgtgacttgggttcctttcatagaaaagagtgctctgaagggaacagataccaagcaaaggtcccttggtagtatcccaaaccccagagttcccatgtcaggtggctctgagtgttccttgccatcctcaaaggcaatacttccttgaataatgccccccagagcccagtcctgcctgaggaagtctgggagtctcacggcctcatagtgtcgggggttgggggggtggggcatagaatgaatccatgggcacacagccagtggcctgtgtttaagctgctcataagtataaagttcaggatcatggccatcctgctggcactcgaggagctgatcagtgttttcgagaaagctacgttaattaaccaaatcaaagatgctttttcttcagccagggttccctctgtgaaaccattcatctccagctggagaaaagcagtggaatttttgttttgctctaaacccagggcggcatcaggcttttttagtgtggggctttgacatgaagagaccatgctcatttctgcctggtgtctctcatgccccccacctttgtttctaactcttaggttccattcctgtctctgctctaatctaatctggacccctgtagcgcagaagcacattctctctcttctgtccgtgttgttggcaaatgctttctttacacacctcagcctctacctggtggtgaacgcatggctttgcatttattgttaccaagtgtcagcacacataactaaagagagaagaccctcaggggaggtggtctaggttaatgggctagtaacctagtctttggagtcagataagcctgggtttgaatccaggatccacctcgagtggcacacggcaagttacccacttaccagcaccgccgtttccttgcctacctcgtaggactgttagaaggctgaaggacagggggcatgttgctgctggtctaagggccctcggggaacccttgtctaaactggtaaaaaacccattctgaacagccagtgcagggactgactggcccactgcagagggaactccccttgggagccttctgcatggaggcctctgtccccacaacagtctgcagtaggtcaggcatttggttatgatctgtgctggtgcggaacgtgcttccccttgtgccattatttatgtgtgatgcaagtgcttcagtgacctgctccacccagggcaataaggtgccacaagtgtccgctttatagccacgagagagcataagcacccagagagcctgacttggcacaggtgacagctccccggaagtccagccgtgccttcacgggggagagtttgaagcagtagtttcctcggggccttgttcagcacaccagaactgagtcagacctctgccctccaggccacctgcctcctcacaagtgctgtctgcggggccggccgggaagcacatgcccagctgcggggctcctgggcctggagagatgcctggaaaggccttactgggcagaggtgcagggagaccagggccaagggaggcctctccaccctttgccacctgacaatctgctgagtcacccagctcccccagacacctggcttgactcagactcagtgcagacaacgagccagatggagcccagctgggacaccttcagtcctaccactctgctgccacagctgcctggagccatgcctggcgctgggctaggaggcacagtgcggggtccccaaggcaagaagcagtctcaaggtgttatgcgagcaccagcaggcctggcagaatggcaagcagtagcttggagaggggccgttagagttcttccggtcccagcgatcccccgtgtgcaggtgaggcaagcccaggttcagagcttgtgctacagggccaggcctaggcctcacctctcctccctgctgccttccacgccattcccattcctgcacagaaccttgggcaggtgaggcatgggcagaccttccggggcccactggtacgggtaagaatcaaacttgcaaggacataaccgtagcgtggtaagggctgcctgtgtggcagccagtgcccccaatcctaggctcatggtgtcaggctaggccctgagctctccatcctgggggctcatccctccatgggagcccgttcctccatgggggccgcatcagcaccaaccttccaggcaccttcaggacggccagagaggtgttggtggctgtgttctcacatgagtctcttgatcatcttgtgagtgatcttcatgctgcacgcttccttgtataacagttaaatgaagtgaaagtaactttgattgagtccaagggttgatttttgcccaacttcagcctcaggctagccctttgtcagccctggctcaatctttatattgtctgtcttctccaaactcaggaatcccaagaccttcagagtgggcattactttgcaaagatgggcctactttctacgccaacaggctttttagaattgatgtggccagatttctagaactatcccacactctaggccacccttgtccctctttcctgtgtttatttggagagcatgttgtgcacatcaaagaagaggttcctgctggtggtttcatcaaattactgagcaagagaagcaccgaagagatgcagacattcctggaacagattcctcgtggcacgcggatctcatccctttatttctatttccgctgacattctgggaatgtctcttttctgtcgtctcctagtcctctttgtgatgaggagggctgccacggtggcaggttactctggaaatgcgacgtaggaaaagtgccttgtgaggaaagggctctaaccaaacagtagtgtcctaaagatagccccagctgagagcagagaagagcagctcccagacgcagtgctggaggtgccgaggctgggccctgcttgcctggagtggctgtgggttatgtacaaggctgtaatcagtaatttctcacatttggatagagctgtcttttccaaagcgccttcacatccaccgcagtatcattttaggcaagttggcagagtatgaaccaggctctcgtttgcatctgcagacttgagggccacaccccccggtgggctttgcacagcacagaccctcagccttgtcagtgaggctggccccgacggcaaacaaagcacctgccaagggtcgccgcacagtgtcgccctcggagtccccaccaaagctcccatcaaagtcagcctgattattttccactgcattttcctgaaaggatgttatgattttctagatgtttggtggccggcgataaatcaggcttttatgatgtcatgtgaaaggccccctctcggacttcctcctgctgcagccggaggatgaaagtgggccatgttggttgcgcagtggacacagcttgccttaaccctttcctcgcctgtcccgtggaccagggtcacggaagaagacaagctgtttcccctcagcctgcctttcacaggagcatagccaggacatgtgaaacggagcccctttcccagagctaagcagacttgctcagcagagaggctttggcctcaaatcaggatcaaaacaagaaggcgtgctccatggaatgatatgagagatcacaggtgattctctagaagtaatcttttggaagagtccctgttctctaatcttgaaatcgtgaaaaaggagatgacacgtaatgctggcagggctgtggtgagaggcacacgcagactccactaggagaacttcgcttctggcattgttgattcgtagaatgtctttgaaagcaataaaaacgttctcattcagatgaaaatcctaggagttctctgtcagtcctctttcccccaccaccgcctccaaccccagggaggccttttctgctctttctccaagatcatctcaagttcacccacgcctttccgtcgctatgtcccctccccacccctcgtgtccaggccaccatcgtctctcaccacatctgtgactggagtctcttagctggtctctcccctgctcttgcccctctttctaacccacaggcagcatctgcaggcatctttgaactcatgcatcgcagcatatgcccccagcacttaaaaccccactgtggctctaagcaaagcccagactccatattggatgtgctgggccggtaaaggatggagttcaaagtgagcgggttctcactgtaaacgagtggacttttacatagtgcacatggacacagagagacacacccagagagagacagagaaaaacacatacacacaagagtatggtaaaaatgttttcaaaacacagacaggtttcagtgctgtgcctcatcctcttgagagctactgggaaaggagaaggcctttaaccagcaaggggagctcagggtcacagcttcacttcaggcaggaggaaatgaagggtggagcggcatctcagtagccttcagaggctgagcgtgtcctcatttggccagaagagggacagccctatcacagcacaccctagcaggtgctggaataggatggccaggttactgcctctggtgatccctagtctccatgtctttcagggccagctgggtgcagtcccgctgcagtggccagcacctgagtcgccaggtgcttttaggttaggtggaccaagcacatcaaagagtggcagattttccaggggaagagggattatgtattagagttgggccatgcagggcaagaacgactcgtccacctttttaaaaagacacacagctaaatgacagtttatagtcagttccatactttcaaaaattggcaccagaaagtcagaattgtaagctccatcaggttgaggtagccagctttccaacctccagccacagcctgcaggcggtagatactccaaggcagtcactgtgaccagacagcagagccttgtgaccacgtggctttgctgggaaaggcctgggctccatggcagaaaccacccgggaggccaacagtgcctgcctctgtgtccctcccagcctcgtggtcatgggctcctctccccgtcactccccatgcccagtcacagcagccttctctccggggttcccttaaggcctttttacctgcagtgtccccaagagaccctcacaccccagatctttctgtgaccggcccgtgcacattgtgcagatctctgatccagtgacctctgtggaaggccttccccgcccagccagtacagagtgccctcccgccctccaacaagccagccccctctgcagtcgctccctcgcactcccatcagccgaaactcaggtctccgccaactcttgtgctgccagaccctagaacatgggcttcatgacagccacggccttctcttgtccacgtttgcttctccaaggcttaaagcagtaaatatgtggcaacaagcaagcaagagactgtgaaatgtttgcagaaattgagggacagcagagtacaaaatcttctacactctgttacagctattcagaaaatgattatctaaaattagaggaagggttggggtgcagggtaaaagttgcatgtaagtatcaaagaaaaactataaaacagcccacttaaaaatattacatcttcatccatgatgttactgcaagaaatgaaaagaatcgtttttcctacattttagtgataaataatagcctcaatggaaagcctgtataggatgaattagaaatggttctagctgttaaaagcagctgtgcaattttgaattctcacacaactttgcaagccttgctgtccccgttttacagatttaaaacctgaatctcagagttattaagaaagagttaagtggttgagccacgttgtgattccaggtctctccagcaatgccgccatgttggttgtgtccacgaatttttcttcctttagaggcgaagtctcattctgtcacctaggctggagtacagtggtgtaatcatagctcactgcagcctcaaactcctgggctcaagcagtcctcccacctcagcctcccaagtagctgggaccacaggcaagtgccaccacacccagctaattttttaaagttttttgtagagacagggtcctgccatactgcccaggctggtctcaaacttctggcctcaagcagtcctcctacctcagcctctcaaagcactgggattacaggcatgagctatcatgcctggccacgtttttgtgttgagataaaatctatatactgtgaaatgcacaaatgttgaactgcagtttgatctgttctgacaaacgcacacactcttgtaaccgacactcctattcatataaggagcatttcctcactccagaaagttccttggtgaaccttcccagtcagtactcctcccctgtcctccagtctcgtttctataaccatggatgcctcttctgggacctcacatacagcaaatcatacaatatgtacaatatggactcttctgtgtcagtttccatccagcattaagttgatatttctgtgtgttgataccatctattacttagagacctctttgccactcaaattaatgtgtgtaaagtgtattgtttacaacacattctacagagggttttgtcctattgagtgttgtgactgctggactaggaatggcagaacctgaccactagatgactttgtgacattctcaagtacttggctgaaatacctctgcagatacatttcggtataggactttgttcctctcatgaagatgtaaagaaggaatgccaggtgaccatgtagtatagacacctgacaaaaccctctgagccttcctgtgatgatgggtggccaaatgagtgataacagaattatagtaaacctaaagagttgtcatcatgctcatctcctctccatacctctccaaaaatttgctaacagatatcacagtaattgtcttaatcttttctccaatataaaagtccccagagaaatggccaaaaagcaagaatctggatgtggtcaggtgtttggctaggccttgagttgcttaagaagtggctgagggaatgaatatttggaggagcctgtgggtatatgtttgatagaccctgtttgaatgaccctgttacgttatttatatttggattggggagaaggaggaaggggagtgagggagggagggaggaaggaaggattattgaagtgaggtgtgttgaattggaggacttaatatactgtatacattgagaaaaaccacaaaggaaaaaaaccccatctacattgtactgtgtagtactcatgtccgaagcagtggtggtggggcggagggggggacatttctaagaggtgggtagatttcctaacaaactagaaggaaacaagcttaaggaaaattaccttcctcttatgcaattcaggatcccctgtggcctaggtaggcattcctagatgagaaggtgcggggtaaagataagccagatgacaagtactttagcttttacctccgagatactttgctttgcacagaactttcatctctaggaaagaggccacctgcaacagatacaaaatctcttaagttgcattttggatgtgattgttttgtggtttaattagctgatgtctataaagcgctttgagggtagaaagccctaagtggcaagagcacagcggccttcctcttgtatccagggtgccacttgccagcgatgtcacaagagtccctaatcggtccactcaaaggcgctttatctcctgtcctcggggttttgccacctccttccagcatgggtaaatctttacaccctagatccagttattaacagtaaccagtaatttccgaccaacatggtgctggctttgaagcctggaatgctgaggtcactgacaaccttatctccttttcattaaatggcccccgcatcacaactatgagtcagccaccccccatctcagctcgtcagagtggagatcagtgaactaaccggaaccaagagggctctagttacagtcattaatctagctttccccaggctgatgctactgtaagcaccggatcaagaaataaagctgacaaaaaattaactccacgattgcaattcagatgtagaacaggtacagacagacgcagcaccttgtaaataggtatgatgcaagatgacatccccaaagtcttatatggttatttcatttaaagaaacctgttagacacctacctatgagtaggcagctccccaaaagcttcccagcgcagcctctgagaagtgctttcctctgctcagctggctcagactgctgcctggttgaacggggaaggcctcaaagttgcacagggctggacagggcagacagtgggcatgttcctgggctgggccccactcaggaggtggggagcatgctcctctgtcccagtcaaaggccaggcagccaatgggcaggcggacacagccagggcaaccgcctggtctggggaaaggaacaagctttggggtggcataaactgcataggccacatgcggttcgtcccatggaggaaagaggaccgccgcactcatctccacacatctccagcatgtctgctagaaagggctttctccagaatatgttttaaaactttgtttaaaaggaagttaacttgcttaaatcctgtatttctcctaaataattatgttgtctgtgtagcttatgagccctttttgcttaactacaattcttgttttatgtcaactatgtcaaccatatttttaaaatataaatgaaaaaagatccatttatatgtaggttgcactatacatgccattaagttctcctttcctgaagtgaacacctgtaactttttttaccaccctaagctttattgacaagtaggcatataatgaagaccacgttctcatttactttccacgaaagctctactgtactagccggactttgtcgctggtttctggggcatgcatacggatggatgcatttctttccatttgtttagtagtgcttaacagccgctgatcccaaatgacaaattctaccgagatcccatcagaaaagtgggatcggcgagaggggtggtcagaggattttaaagtgcccattaggcaccatgcaggaggactggaccgcacgtccggagtcatctaaggaggctcccagcagaggtgacagtggcgacagtgggagtgtccagtggtggttttattccaagtctacaccgtcgctgattgccacacggcagcctccataagggtggccacggacgaggccatggtgcagggcctgctcctccctctgccacttcctctccactgcctgcaccctcctcgggccagtgctgactgactccatttccctgaggctgcctgagcattgtttgagctctgcctacggacagtcccaccgagtcccgcttcctgagcagacaggaccgcctgctgttttcttctcctctcttattgccccttgtcatgaaaggagaggtctgacttccacttcagtttgtgtggatagacagcagtaagggaacagaggggaaatgttcattaccgctgttaacaccacagcatttcttactgctcggacattcgctccctctttgggaaggattaaaccaaaggataaattcgtgagcatgtaaggcttcaagctacacccaagaagagatgtcgtatattgcaaattttctgggggatctttcagaattcattttttgttatttcccagtcttattctcaactatctggaatcttgactaggatactctgtgagacttgagagctttttcctgaggctttttgttgttgtttagcagctctgcctttctgaaaaagaaacattgccccaagagtcaagctttcctattcactctacactagcagaaagttggatcaagaaccaaattcactggcattcttttattcccttggaacctgagctattcctcaattttgcttttctaagaaaagtagaagggaaaaaaagaatattaagcgcccctcacagctctgtatcttaaattcctgaagatatttcgccaaggctttcatcagtctcggctttccttattaacatccctgtccatacatcttctcctatttagggcatcaagagtcaatttcttccaagatgtacattagaaatttaacaataatctgccaaaagatctcatactcttagaatatttctccacctaaacagatgttctttgcaaaccttataagcagacctgttgaggaaatgtggcatccaacacctagtttgaactaaatattaaagttttcccaaagcaaactcagtgaaaaggggagaaaatgaaatgagactgtgaacctcaaaaaatcatcctatgtgatacagtctgttgaatagcattccccacaatggttttagagaaagtgatatggaggtgggaggatcccaggcaataaatgtgttaaagaaggatcaaaataacatcgggggaaggaatgaaaactaaccagtgtgattttaaagctgcgttgttatctagatgggagagatctgaggaaagggacctgtcgttagggtagaagataatggcacactatggtctctccttttctggagtttgcgttaactactgtgggctcagaaacaggcttaatgacttttccagcatttggtctggcgctttatcagttcactttaacaagaacgtaagccaggaaagcctaaaaaatggctgcagccaaacatgccctcctccatgctgctgtttgcagctctgtaaatgtatgcctggatggtacagctaaaggacaactcccgaaggtcaaatgaatacacacagtccgtgagtcagaaatctggagggctgtgtggacggagacattgctcctgctgttttgctgctgtgaaatgctcagtgaaacctaattgaatttgacaattataaattacatattgaaaccgtatagttcacctaaggaatagcaatgaaaacagtgaagacaccagaagccagagttcaggaaatgtcatattcacatagaaatactttaaatttttctcaaagctttattttctcttttttcaagaaaagctccagaccacccagttgcactggtggaagtccttttgggaagctgtacataaaatcatcactttaattcagcttttgcccccattgtcatactaaggctgtaagcatatgtataatgaaggaaacgaactgtcaaaaaagaagaaaagagcacagtagataagctcattcttctctcttgtccttaggagctgattataccctattggaggggatttgtggaagttcaaaaatctttaagagggaggtaaagattaaagggacgtgtatcatggcccacgctcccctctcactcctcacagttctgtatctgagcacagcagtttggaccccgttgtatgagcatttgccaccacctaattccttctcagcccagaggaagccttatttaaggaagggaatccacatccttgctctccttctagagctgtgtgcgctttcccacacaggccctccccacgccaccctttaagtatgtcctgtgcctagaaccttgcaggatgaaccattgactatatcttttctataaatgacacaatgggaagaagtaagaaattccttcaggaacagttaagtgtaaaacaagctgggatgctcgtagtctttccttaaaagttgattggaacataagcttactgcccagtccagatgtcagcctaggaacagctggcatagagagccaatgttttgttctgaggggacctcatcctttttcttcccaaggtctcttggtctaattaaatttcagggagacagagccttggcagaaggttaaaggaagcagctagactgcagtattggagctaggctcaaaactaaattgagaagtttaactgggtgcgtctctggtttcaatgaaatacttttacagtgtatggtagcaaggtctgtttctaagcctttgaaaaacatttttctttttccttaattgtagttccctggttgtttttatattgtgagctacttgtagaaaactacaggaaacataattacaatacaaagctccatttcccaagcctaccaagattatttgaagccaaactgggttttagggttttgctgactatgagttcacagccatgaaatgcatcctatgtcgtgctggttgatttacagccagtgtgatgtgattaaacaataaccatgtttctccacaccgtctagccgctataggattgagagaggggagggatgggctgcatgactccacattgcacagcttcctctggggaaaaagaatgagtatctttgtgtgacgcttatagcaaaatagaagcctgtagaaatatatacaagtttatttagggaggggaaagaaaaataaattacttcgtttttctgcttatattgctatttccttgtagcgctatgttaaattgctaattactactttttgtattctacttttcctgaagaatctgtatatggacttttagggccagcagaaataacttgttttagtactattaacactctggggaggaaactggtacttcagtgtattgcgaaatgcaaagcgtttgaaaaagtagtgatggatgatgagaacgacagcgagagtcgctgcgtgtactgctgcagccccattgcaagcccacggtgcagacattcagcaggatccagacagcctctgctctagaaggctcagcagagaaggtgagctccaaacccagggcaaagcaggtcccacccctgccctctcgaccatcatgaatctagaacaaattccccacctgccaagtttcagggaagtctgaagaaaataagcaggaaaggctttcagtggcagcttgactggctgttactttcacacgatgaaactccttttaggctgttctttaatttgtatgtagctgaaatagaatgatcgagtatttctcacctttaaagatcggctattttcgtacggcctttgcgttcggtttatttcgaggaatcacatctgatgtgttatttgacgagtacatttgtgtatgcaaaagctaaatatttatctcacttctagcaattatgtatctcaaagtcttttttctttcttccctcctttctttcctccctttctcctttcctcctttcttccttctttcctattttgtaattcatcttgaaattctcatctcaaccttcatgtcagtcagtcttcacagagctgtaagaaagacattggtgagtaggggctgagagcaggattaagttcttctccgctggttttcttttagccagccttccttccagggaagcctcttaagtcgatggagatgaaatgcccttgtttcctcgagtggagcagttggggaaagcgggaggaggaaggcactgccagaggggacggtggcgggcagtgcggggtcctgcagagctgctggctgcagctccgctcgtggaagtacaagtgggtcgagatcggcattttcttaggaacagaatcgaaccgagtagaataggggtagaatagaatagaccgtctacagcgttcctggacgctaagcctaagaattgcttcgtgaaactccagtttcgttttatgaacgcgtgtgtgcgggaggcgacgtgaactgacttgactgtgggtacgaaaagcccaaagccaccgcccaggaagaaccgcgcttggctgcggcccgggaagaaacatccacggccgcgttagaaagagggtcgcacgctgccgccgaggtagaggggtccccgagtcctggggcctcgcgccccacagcccgagtcccttccccgcggggctggtggctttgggtaggacgcgcgcttggcgcggccagccctgcggcaggagctgagcggcgcagggacacgggcagctgggaggggcgcctggtgatttactcacttccctcctagccagagaagtgcagcaattccaaacagttctcataggagcgtccctgacaacttcatgttataaaaaaaaaaaaaaaaaaaaaaaaaaagcattaagagcccaagggacgccttggggagaagaggtgtggaggtagctgggggtggatcgcggtcacggtcctcacgggtccgcacagcacattcttaaccgcgacctagtgatttacggcgccgagagccgcaactgaacgcgcacagcagggaccgaaagcagggaaacccggagccttgtgcgcccagagggagcggaacggtgggagttcccggggctcgggacctgctgcccccacccccacgacccacgcctgcttcgtctccccctcttcttccctaggactttctgcagggcgactgcaccaaagcgaaacagaagctgaactggaagccccgggtcgctttcgatgtgagtatctcttagggcgcacgccgcccgctgcggggccccgggctgcagggcggcagctctcagggtcgggcgcctgaggcgcctgcgatgcccaaagcccggaaggcggggtgcgggagaagtgaggggagctggaacgagggacgcggaggcctctctggggccgacacccggggtggggtgtcaccaggagagagtggcagaagctcctccctcacgcccacccctgtgttgcaggagctggtgagggagatggtgcacgccgacgtggagctcatgaggacaaaccccaatgcctgagcagcgcctcggagcccggcccgccctccggctacaatccccgcagagtctccggtgcagacgcgctgcggggatggggagcggcgtgccaatctgcgggtcccctgcggcccctgctgccgctgcgctgtcccggccgcaagagcggggccgccccgccgaggtttgtagcagccgggatgtgaccctccagggtttgggtcgctttgcgtttgtcgaagcctcctctgaatggctttgtgaaatcaagatgttttaatcacattcactttacttgaaattatgttgttacacaacaaattgtggggccttcaaattgtttttctcttttcatattaaaaatggtctttctgtgaactagc

SEQ ID NO: 36672 - DNA, 91988 bp, Homo sapiens
gtaaggcctgagattctttcgaaaaggagctttgcttcccatgacgcagagggaagtgtcaactgggatatttctggtaaaactgaaagcaagaaaagcagggtgctagcccctgtgggactgagggtggaggctgggggagtttgggtgccatcctccagtgacagatggatggacctttcatctaagagaaaggaggagacacgttggcaaatcagcctcaagcctaagattgcttgtgaagcaatcataaggaggaacaaaaacagacacaaaaacagagggaaagagtgaaaagacaagaagggcgcaaactgtgacagactcaccgcttcactaactactcacttaaactggaagcaaaatgtccctaaaattgccaaggaactgggatttcaacctgaaagtggaggctgcgaaaataggtatggttggtgtcttttcgttgcctctgtgattcttacgtatactcgagcaccatttgcatgttggtctgcagggagcatagtctacttaaaaatggatctcgcagcaaatctgagtttgagggaccatttgcatttaagttggcatgccaggtccaagttctaaaatgctgggagggggttctctttcatttggacaaaacagtgggatggcactccttggtgtgcaggatctggggtacttcggatgatttaaggctacagactacacacaaaactgtgagtttttagcatattccatttccttcctgtttggaaactcatccatattttgaatggttctgaacaggagcacaaagactagagtcttttgaagtgctcaatctgtaagtaaattcaatgggtgttctgttttgtgagcccaggagtcaaggtgtattaaaaggtagtagcaaaaggtagacaacaaaaacaagacaggaacataaaaacgtactaaagtataataaagaccttacttaataaaaatataattaaaggaacagaatgggagggaattcttagatgagttggaaaagagatgtattttttattattttaagggagactggcatattttctgagatagtctggcctttaatccataccctgtccttctaatgatgatagtgatacattaagtttaatctatatattcgttatgaagttctttacatagatttcttctattgctaaattggtcacagtaattcacatcagagcaatcgggctgaaaactattgcctacatttatgtatctcacccatacatgagataacttccttgatattagatatagataagtattaaggtgtttctaacagcttggaggaattttgcttggaaaaaggtttagatttgaacctctaatggggttaagtgtgctactaaaataagtgctccattgaaaagtcacaagcggagcattaatgatgtaggtctgagaaagggtttgaaagaaaacagagtaatcagagaagccatttatcttgataactaggggagattagcgttccctaatcaagctgtgaatgattgtatgctgaggtcagttcagagaaaaggtaatgttcatacctcttacaaaagcaagagattttcctcctaactatcattgatacaaatgtacttggctaatgctcaatctatgtcatacaaattatatggttctgttcctttgaaagtgtcctgcttctacataaataaggtcattctgccttctctccacctatgtttgaacacaggttattagggtcttactctcctttggtttaaaaaacaagaaagttgagacaattaatagttaaatgatttttttcacagatataggaaattaccacactagagctcaagactgcatatactcaggtctgggatttgattgagtgaatttcatgatttttaccaatgtttcttaaagcatggtcccatagataacctatatcagactcacatcaagtgctggctaaaaatgcagatttctgggcaccatccttacaaaatcagaatctctggaggaaggcccaggatcctgcattttgacaagcaccccccactttcatcctcacctgaggaagaattcctgctgtaggtactgtggtctatgttcactagccccagcagacagttttcacccatttagtatagggcacagtgcttgttcttaactgggcacacaataaatatttgttggctgaatgaatgcttcagccaacaaaaacaagcagatgatgttatttagtattacttaatgaaaaaataataataaggacataatgaaatacagaggagcccttgtcattatccatgctatctataagtttgtcaccctgaaggactggactacagtaggatgcatttataagtgtcacatgaactagaattcagatcataatctgagtcctctgatgggggagagcccttgactcagtcacaggacttccagtcccctctccagcatcctgtgtccaggtgtaactgtaggaactggcttaccaatatatcaaagaaacttacctctattgggaagacctgtggaactgggagttatgtcaggaaagctgacaatctgtggttttaacgttttctcaacctagataccattgacatttggggttggatagttttttgttgtggggcctgtcctgtgaattataggatgtttagcagaatccttggcctctaccttctaggtgatggtaacacccccctaccactaccagttgtgacaaataaaactgtctttacatatagccaagtgttccttggggatgggggtgagggtaatatcttctctaattgagaactcctggagtagatgatcaccaaaagggtggaatataaggtcatttgggactagaacccaaatattaactcatgattcactctgtagctcaattttttggaggcttttattgagatctgtcctcagggagccaggccatagcttaggaaggacactagaatgggcccttggtgaaatagcaagacactgacccagaatgtgacccaggaaaggggccctagctttttttgatgagctatgcttccagtttccccagaatcttgtgagctggagtgaaagtgaaagtctctgagagcgaggggagggactctccactgtacttccatctcagagctgaagagggtcttgctggatggcagactcacctgagtccactaccatgagtctgacagattttcatgcagtgatgaagaaaagtcacagaacttcctgaatctgacctattgatcctggcaggaataggggttggaagaaaaaggaaaatgcagaacaaacagtcttgacttgaggtggagccaagagcacacacttcttcctgtgatcctttatcattttcaattttagaatcatgacagcctttcactgccttcacgcagttactcaaatattttgcctttttaactgaattgtcatcactggaggacaggtccagactttctggacctccagccccaggttacagggctttcttgaaagagttacatggcttcccaatgaccaggccagtctacttgagcacattttgtaccttatttgaacactgaaatgctggttccccagtttcaggagaatcctgaaactatatagcccatggtgaactgatttgtgtttgtttgatgttcagctttctgaacatcagaaagtggtgagtgctttctttacaattcattaccaaacttactatatgctaaccagaccagcctgggttatggactgaatgtggtctgtttgctgtgcccaaagtatttgctttccatgagtagcctccggtccctgatagataaaggtccccgatagataaaggtccccacacatgcaagtagagtcactgctaaaaatacaaaaaattagctgggcatggtggcgggcacctgtaatcccagctacttgggaggctgaggcaggataattgcttgaatccgggaggcggaggttgtagtgagccacgatcatgccactgcactccagcttgggcgacagagcaagactctgtctcaagaaaaaaaaaaaaaaaagaatatgaacatggccttctgtagacagtgaacagctacacaagggagctgttccttccagggcccactctatttttatgcagaggttacattgccattggttatttaagtaaaaatgtctgtccgtaatgttgctgttgacttaacatttaggcataaattaaattctctccacgaagtgcatgcttcctgttgcccaggccaacagccttctggccatttgaggaaaaaggactgatgtcacctctgggccttctgcagcagcagcagagtggggaccaacctaagtggtgatgggaaaacaggacctggttttatatccactcatgcacaaaattccccctgtacatgccagatgaggtcagcttagattctgtactttgtctgagactgtgcacttggattggcagaggctagcttgatggttcttattgcctatgtgtctgaaactaggccagggttaagatgcccaatggccctggcgtgggtatacatcactataagtcacttcattaatggtagtgctgccatctccctgtctctcacctcacagttatgaagcatcttcatgtagcatccaatgggagaactctgtggagactccaccagctggaatgtgatccttttgagtaaggcccactatgggggtgttggaaagatgctgggaccaattgagagaagtaagttgatgaaaatggtcctatcacacacaaggcagcttgaggaaagaatctggcatgaaggtgcaccccagtcgagtggtctgaacttgtgttaagatacaagacatgggagggagtgaagagcagaagcaaagtcccactggtggccacagcaattgagaccaaatagtaccggaagagcatgacggagagccacagcgaggcacaggcagattgtggggattctgtcacagaggatggcatggaaattttgtagagtccccagacaggaactgagatacaaaagttacaaagagagaaaataattgacattttttgtgttatgctttactcatcatcctttttctctttgaaagcttgtttaaaaaccaaaagtcactttgcaaagaaaaaaaaaatgatacccataggtctggcagacctagaatataactttgtcttctttgagggactgcagtgcttcctcatttctagtaagacaggagtgcaacttactgtgttctctttgtcttggctgccaggaagctgagctaaatatgaaatatgaagacagtcctgtagggcatacagttcagtgggggcagagacaaggaaacaactgcaaagcggtgagacaggtgctgtgatgatgagaacagctatgggagtcccagatggtgcctaagaggaattctggccccaccacccctgttcccatcactgccattcaccttctttaagatctaggtgcagatgttcttgagggggccccagactcgctgtctttctcacagtgattttcctgcacattgtatctacttttttggagaaacagaaggctttatactatgtatagaccctctgcatgaaggaattaaatggaaagtctttatgatctggcccttcttacctgcccacctctctcttgccaccttcccttctcctgctgcacactggagacttcagccacatcctcccttctgtagcttccagctctttctcatctgcctggagccctctctccatctgggtctcccttaccaccaccagttcctacccatgctttggtcacaatgtaaacatcttgtccacggggagtctctaggtcttctgatcactggagagagagtataaaaatcctttcccaggccatttaaacagagaagtttacagctctcaatactatggacttccttttagataagagccatgaacatttctgaacatgcatatatgagtcaaccccacaagtaactgatcctttggcttttgaacaaaatgagttgttcttaatacggtatgtaacaccagcactctaggccctcactggggagaataacctcagattgcccaaagaaaggggctaaattgtccattgactcttcttgataaaaattgtgaaagaaaggaggacgtgtgatataggaaagtgtgcatgagcttgggactctgctttaagcagtagtgaatctggggcaagttgcttagcttctacaaatgagagagtaacacatatgctgagaggaagaaaatatttcatgcgtatgacatatattaggtgctcagcaaacatctctttcctttctttataggcagtctcatttccaacctcagatcagactagaagctgtacttggattacattatcttgctaccctcgcagaatagggctcactgagttgtcttttaatgttatatcttcagtttatagcttccctgcaagtaatgatttcatgaaatctgctcctaattgtactggaaaaatgagaatgaagaatggagaacgccagcaacttctatgtataactctatgtgagaaagttgcttgggaattcagtgctcagaaaataactttgtcttctttgagggactgcagtgcttcctcctttctagtaagacaggagtgcaacttactgtgttctcctctttgtcttggctgccaggaagcagagctaaatttgaagctgagtcacaacttctaacgcccatttgattagcatacttttagtctttgtctttgatcagagtttatgtgttcattgcaaataatttccatactttaaaaaatgttattatttaaaaatatagatgggggagtctcactatgttgcccaggctggtctcgaactcctgggcccaagcagtcctcctgcctcagtctcccaaagtgctgggattatatgcatgagccaccacactcagcttcagatttcctactttttagtagtgactgagcattgcaatttatctaagaaaggttcaaggaatattaaaatgttgaaagttatttcttttagttcataaagtaaaacgcaattccatgaccactcatattctttacctagagttacataaaattatgcaatcttcagtacattcagaccagtcatttcatttcatgcactcattgagtcactcatcataaaacatgtatttgctcacttgtatgtgagaggtacttaagcagcattgccctgctgtgcctctcatgctgcaagcacccctcaccacccctccacctttctaaaagtgatgctcaactttgctactaccatctattctccttaagctgtgactgactaaggtgacagctgccgcactgtctcctttccacgccgtactatccatccacccccaaaatatgcacacatggatctcagctctggatggggctgcgataccccactgctggaattttggcctatggtggctgaaccatttgcttccttgttggtttggagtttcaaagtgaaagaggaagcagtaagatatagagttcctgagtgtgatgtgaatactttttaatattttaaaataattttataaagttgacaaaaagaattttctgacaaagtgtaaactaaccataatggaatgagccagctatcatacagtggttaaaaagctggctttggggccagaatgcctgaatttgaatcccagtatcatcgatcggtcactgtgtgacgttggacctcaggttttccaactgtaaaatgagtgcaatcctagtgctaactcatgcagttattgtgagggtaagagaagatgatctatgtcaaactttagcataagagctggtgtctagtaagtgcttcataaacactagtaattatcattattgttatggacattagctataatggagatctgatatcagctcctttgaatcaagtcattggtgaaaaccacagccagcagtgccaaggttttgtttgtcttgattaggtttagttcttcattcttttctttagacatatggtctttacaacatctgcagatatctcctttcctgcccagtgtctgctcctggctcacagcacacatgctgatctgcagttgactggttatgttctgcttcttactctttatgcttccaaatgccatgtactcacttccttctcaatttgcatgaattgtgtcaattttgtctgcatggctattcttgttttcttcctttttgctttgttttgtttgtctatttttgccagttattttccaaataagtaaaatgcctgagttgtgactttctaataaggataatgatagcttctggtaagtttcctgcagaattcctgctgtagaaatgtcattgtctctgtgctatgacaggagcagttcctcaaactttccttgctttgggtaggcaaagagtgactctgggttgtttgctgtgtggaagaccctcctccatgacttagtgcttcctcctccagagctgcccaccatctcctactgtcatgcgtacctctggccactgaagtgaggttggaagttgttagtgtgggcttcaggggctcagtgtttaactgcttgtgatcacttacatgtgggttacagcaatggcagagcagtttttcctattagctctaagagtcctgtacctggcctaccattctctttcagatcattatttgtagatataattgtgggggaagagcaggaccttcaaaatgaggctcccgcctttcttgtcctcaattctgctgttgctacccaaagattcttgtgcatgcattcttcctctttgactgtcattctgcatttgattccatgcacctggtcattcagaagccagaaatccactttattagtgagtgaggaatctccttatgcagacatctcagagtaaaaatgatagcagatgtagagttgtcacctccagtccattctcagcccagcccttgtgctctgtcctgagaccaatctgtttgatcttgattttggcactgatcttcttcctgtgagcgttcctcattctctttcccaggtagagtgacagctggcctgatttgtctgggactcagggggctcgtgggacatggaactcagtgtgaaaaccaggaaagtaaccctagaatcaggtcgctaggcccagggaaacaaagctgtaattgtgttaggtgctttgtatgtttcttgaattgaatttcctgagaagccacacaatttatggcaaaaattgatttaggagaaaatatctttaaacctggagtcattattctttctttttagtactcatggttagaaatccttccaaattcatttttcagcctccttgaaactgtcatgctagcttcctccatctgtttttatgaaatcttttagtcttgctcacattttctccagaaagatcgggagccacatctgtcagtgtattgcaaggtacttctttctaaaatcacacaaaaattcctacccttgtgggtcctatatctggcccgtaagtttgctattctgctttctggatatatatatattttttccaactctatctctccctccccattaccagggccaccacccagcttgtcctgggaaggcttcctgaattacccaggtacaattagtccctctcccttctgcgagattgtaccgttttgctcatttttcttctattctgattgacacatatttattggacacctactatgtgctggacactttactaggctcagaattaagaagatgaaaaagattaagattctgacagtctcattagagacactctgaggaagcagggctctcccactaaagggaattagacatatgcagtgtgactgtgactgtgacatttaaaaagctgacacagggtttgttctgtaacaaaagcttttcttgccccacttgagccatagcccctagatatctacaaggggcaagtttttacatgttcattcaagtctatatgctccttccaaaaagccacaaatcaagcttctaatgccacattgttattctgatttagagccagtagagagtgcccgcggacaatgcagttgcatttccaccaataaatgtggtctattttcattatttctccccagaaaaccctggatttaaccagttttctggccagcacaaaattatcccaatctcattcttctgtggcctgaaatgcccagcatggtaatgaaagtgattgataatgtagtcaactttgtgtcttcacagataaaaaataagattccagataaaaatcacttcctgaaagaaaaacaaaaaaggacacttgacttaactacgaagacatacctgaatgtagtaggcagtctttgagaatgaggcccctaaaggcagatgagcctgggtttgatttccagctcaaccttttctcacttctttgactttgggcaagtcactttaatgtctctgtgtctcagttttctcatctgaaaaatggggccggtagttccacctcctttgcagagctgttaggtaatacttcctccaaccagctcagccactcatagtcataaataaaccatgtcacctcctacaattgtaccacctctgaaatctcactttcagacttcccactctgtgcccaccacatcctatgtgcccagctcacccactccagcaattctctgacattacctcagtgagccaccattccattggtcccaccattttttcactatcagtcaccccattaggtcctccttaccatagattcataactagcattaaatctactactgaatatgcacccttaaattctctggccatttttcctcatcataacccctaaccctatttaaacctaataatccaccttcttagtgcctgtaactggacagctgaacatcgctggagaagatcacccctgagctgcctggattcactttgagtttgtgaccagtcatttgaggtgggcactcaacagagccagacaaacttactacgtctactgtcttaagagtccactagtgctgctgtaactaaatagctgagactggataatttatacagaacagacatttatttattacagttctggaggctggcaagtccaagatcaaggtgctttcaagatccatgtctggtgaaggctcattctttgtagatgatgctgacttggtggtctcacacggcagaaagggatgggagggcaaaagggaggagtgccgtgacctcacattatggaagagcagaagagggtgaacccactccttcaagcccttttacgaggatcttaataccatccatcagagcagagctgtcatgacctaatcacctcccaagggccatacctcttaatactgttgcattggagatgaagtttcaacatgaattttggagggggcaccatcatttaaactatagcacatagctagtaaattcactttcattttccccaaagcttttatgcctactttttaattttctcctcaaggtcttaacacttccttctgccgtcactctcactgataacattcatagagaaaaatatgtacaactaagtgagaattactcaattttcctaccaccaaaagttttcgtctacccacatctttatctccattgctgcccataggcctggacaacaggggcctccattggaaacatgtattttagagggtcctgctcttttcttgctccatctgtactccttcctcctcacagggcaaggagtctggtcaagcggacatgcccacctagaccctgtgccctgcctgccttctagaccatctgagattgtgaaattccctacgcagatggccaggagctgcaagaatgttttctaggtcctcccagtggtttttctgcagacggttgattgcagagaggcccagaacaaagttcggatgtctgggctggggtgtccacattcatgtgtgtaaggcccctgactgtgaaaaatggaaatggagatggagggagaaggggcatgggcatgggtttaaagacagggaccacccccctccccatccccacagggccgggcgcggtggctcacgcttgtaatcccagtactttgggaggccgaggcaggaggatcacctgaggttgggcgttcgagaccagactgaccaacatggagaaaccccatctctactaaaaatacaaaaaattagctgggtgtagtgacgcacgcctgtaatcccacctactcgggaggctgaggcaggagaatcgcttgaacccgggaggcagaggttgtggtgagccgagattgggccactgtactccagcccaggcaacaagagcgaaactccatctcaaaaaaaaaaaaaaaaaaaagacaggtgtccccatgtatcttcttgacacaggctttcaaatataagtgatagactgattccttctcactcatcagtcagcccaattaagcatctgtcctcgtcttactcaactgtcctgcagcatttgacacaatcaggcattttctccttgaaaaaaaattttttagacttccttgacactgtgccccctggctttcccttacctcattagttactcttcctgagtctgctttcatgaagtctccttctctaccagatctcttaacaatgaagtgtcccaagcaggactggccacatcattcgtggagcctagtacaaaatgaaaatgtggggtcccttgatcaaaaattattaagaatttcaacatagtgacagcaaagcattacaccaagtgcagggaccatctaagcatggagtgctgtatgagtgtacaggttttctgtgaagctggctccggtcccagggctcagtcccccgtcctcttccgtttatccaaccttaaaacctttaaagccctttccatggctttaagtcctaccttaactttcatacattagctccaacgtctcttctgggttctggatggccccacatctccacctgaatatctcacgggcttccctcccccagtgtgtccaacacagaattctgaatcatccctcttcccacccctccacacccagttcacctgccctttgcaaaaggctctactattcaccgagttgctcaggctaaaaacctagagtcatcttcattcatgttttccccttccactccagatctaatccaccagaaaagacttttggattcaccaccaatttatgtccttaatctgactatttccgttatctccaatgctgtaaacactgccatttcttgcctagtctaggaaatagttagctgacttggcttcctgcctccactcttgtcctggaccatgtattttctgcacagtggccagactcgacatcttttaaaagtggaaatcaaatgtgtcagttcctcattaaaattttcagtatacttaggattaaattcaaactcatgatctatgcccgtgggatcaggccccttcccctctgtctccacccacctgtagtcctctgctcctcccacactgtgtcccagccacaccctccttctattaacagttttctgaacatccagtgctcatagccaccatctcaaggcctgtctgctgttctccctgaaatgtgcttcccagatcttaccatggcctttcctccactccatccagttttagttcaaatattatctcttcaaagaggtctttcctgaccctagcatataattagctgtaattagcccctgcaaatccaatctctctttatcccattatcttacattttttctttatactgttatttgtgcctgaaacgatctcattcctttgcatgtttgcactagatcataagcttctgaaggcagggctttgcctgtttcatgcacttttagatagtcactgccaagaacagtttctgtcacattacaggtatcaaagagatttttgtggaatagcctgtggcctgttaacttttctgcagcccagtgaaattaagtaagttaaaatgagtccaaagcatttttttttcctgtccttattagtgattgaacaacagtttggtccagagagagatatttctgactttcttatggagagggaagtggggcttttggtttctgaagctaatttggaacagcatgtgggtgactgagcatttagctatccctgagggcggtcaggtcttaagtcattaaggcttagactactgaacagagctacaaggggtatgtcttgctcctataatcaaagtcttcttgatgattgaaactcaagtgtgggcagagaaatccttcagactcaggggccctgggaaaagtagctctgctcaggaatccaaacatgagaattaaacctcagttttgtagtatgggcagttaggtttagtgggtaactgtgattagaggcgaggatgggcaagggagaggaagaaagaaagacagagaagcttagagagagagggagagagataccagcatacaggggtgagggagaggcagatggaaggaagaaggaggaagaacaagtggaggatggatgtgggtggaagagaggaccaattacattgggccctatgcttagaagggttccacactgaatttgttattttgttgtgaccatcctaaaattcttaatgatttttgaacaaggggctctacattttcattttgcactgggctctgcaaattatgtaactgactgacattctgccaccttgtatcacaggaactaggtcatctttgagccatcccttggcctcatgacctcctccttccccaactgactgcaccgtcagtcctgtccacctcctacctagatctcacattcatccacttctcttacctccctttcaagcctagattccactgtaagcctcttaaccatttcccgtcttgcagttttcatggcctttaatttattctctgtgagcaccccagtgcttgcgagtgtcgatagctttgtcgatcagagcagtcaccctgaggctaaagggaatcatgcaaaggcagcctcagtgcttgagctgaacattctcaactcctgcactaagttagtggttaccaaacgtggctgtcctggggaggtttaaaaaaattcacctgctcaggttccactccagagacatggatttaagtaacaagggctgtggtctaggtattcgaacttttctaagctcccaagtgactggatatgcagcaaagtttgtgatctgtgccataagtgttgctaagacccagagccacagcacaatggcaacacattcccaaaatgtttgcaattttgttactttatcatagtggttttgagttttgcaaaattttcttctctaaaaatatacattaaaacattatttaatattccagagtacagctttgagtaacctggcccttttttaaattttattttttaaagagacagggtcttgctctgtcgcccagtctggagtacagctgtgtgatcacagctcactgcagcctcaacatcctgggctcaaacaatcctcccaccccagcctcccaagtagctgggaccacaggcgtgcaccgccatgcccggctgatttttttttttttctttttgtagagatgaggtcttgctctattgcccagctggtcttggactcctggccccaagtgattctcccaccttggcctccccaagtggtgggatgacagacatgagccactgcgcccagccccatgaagccactttttttttttttttttgagatagagttttattcttgtcacccaggctggagtgcaatgacatgatcttggctcactgcaacctctgcctccctagttcaagcgattctcctgcttcagcctcccaagtagctgggactacaggcacctgtcaccatgctcggcgtatttgtatttttagtagagactgggttttgctatgtcggccaggctgctctcaaactcctgacctcaggtgatcctcccgcctcggcctcccaaagtgctgggattgcaggcacgagccaccgcaccgggccgagcactttttaatttttggaaaatgtgtacctccactgtgagaggcgtctgtgtgtgtgtgttgtggtttgagtgccctgaattagttaaaggcattccttcttctctgaggttccctgcagaccggactgtctgtgattctgcagatgtcagggctgcacagaagagggtggaggccgggccggccccagatcctgctcacacagggaattagtgtcagaagtgacgtgttaaggggttactgaaaccaaaggtgaaagctttttgcttataatgtgagtagtgaggaggaggcactaataatagttattaatgccacttgtcaacagacccctggaaaataggacaatacatcctttctctcccagcaagtccagctgacatttatttcacccgctttaagcacgaattacctgtggagtatcctagaaggacttgtttttggaataacattgcagactccaaaaattgtctaccatttctgactctttcaatgtctttcacttgtacacagtgtctcattccatcctaagaggggttaaaggatgctcatcctcacgctgagcccagggagggtgcaggacttgctcactcacccagccaatggggggtgctggcctaatcccaggcagtattctgactcccaacccaaacctattgttggtccactagagactttggatagaaaccagaggagaataggaagggccaggaaaaactcaggcatgtaaaacaaggaaccaattttaagggtggaaagctaaggtggagatacatagcatgtataaatacaactaaagagccacgggcatttggcacattttagaggacagttaagactcttactatcctccagttagcagtagatttcctcctattcgcacacctgccattgccattttccctttctgttccaaacgacttcagaatggcttacaattacacccagctaacatctgtatcaggtttatattcagtgtctttccctttgtgtccatggattagcttcagtaagcccaaaaccctctagaaattgtgtgaaaaattatatgcatataggcagattctcaaaggggcctgtaatctcacaaaggttaaaaccattgctttatgtttccaagtacagaaaatctcctcattaagtaatcctgtaataattagtcttcctggtctggaccaatccaagagcgacagctaaccgggaaaatcctagaatggcctgctgaaggctggtcctggccagccacaggcctgcttcctgttcattgcgaggtgtaaactgacgctgggagtggccactagatggcggcaaactcagccaagtttggcatgggcttccgttggcgctaccaactggcaagctgtgcaggttcctggcatccatttcattagcttcaaaataacgcgaccacgaatagttgattgaattttagaccccacgtaaaattcttctggacctcacttattgtgttggggcagggatttactgttctttcaattcacttggtctttaaagcatagagggcaggcagcaaaattaccctccacgtcctgacatctctaagggaataaagcttgggactgctataaataaggaaaacttgttaaagttcatgaaatcagctatggaaattgtggaacataagtcatggttccatttgttttatagaagtgtaaaaaatgaaatctgttcttcaagatagaaaaaaaagagaaatattatgaatgccatttaaaggagacacctgccatttctgtttccaagttcccctggggcccacaaccttttatttgatagtaggtctccagaagagcagtggcattattgttatctcatagataaatgtaataggcctccttagggctgttttcccaactccacctttctaagggctcctgacccagtctccaaggatggtcactggcttgaactttggcttgaacattcccccttggacatagccaactagagcagaatgaacagctgactcaagctgtgtctatttcatttctcctcagtctgaggttcacagagaatgggcatttgtaagtgagtcctggaaatcagagggcactaagaggaaggcctttgaactctgttgagaactcaaaacctgcaaaatgtgcttgatttctactcttcctgagccatgatttccaaccccccaaatttccctagattttgtgaaataatatactatgctttaaaaattacacacacataaatattatatacatagtatatatacaaagagagagagagagaaagagagagagatatcagggattcccaatctcatcactattttgatccagataattctttattgttgggggccatcctatgcattgtagggtagtccctggactttacccagttgatgacagcatcaatcctcccagttatgacaaccaaaaatacctctagacatagcaaaatgtccacttggggtggatggggggggtgataaaaccaccccccagttgagaactattagctatctatccttctatttatctgtatctagattaaaccaacttgatttggtacctgtttcttgcaaccaagatattaactgagacaatgggaaaataaagacgtagagaaattatctgaaatgctcatatagtaacacagcaagttgctgtatggcggaatcaagactagatcccagagctcctgaacattagtgggttttctgctactttccacaagagaactcctgtgcagggtctttaaccacaccaacttgcccagcatcttgctttcctttgtattaaaacccagtactacttgaattatggaaggaaacactcctggctacattttcttatttgtttgggtcatcaaaataaataatgtgggtggggatcatggtagggctttcttcacaggaagttgaagcagtgtgggtttgttgccaggcgtggcatcgcatggctttccttagcacctgtgaaaagaacaaagctaaatgatggggtgctatctgtccactctgaaatgttactcccggatcactggggtagatttagcttgatgttgctcttgaatgtagtctttcccacgttctcatgttttttcaggttacttacctcaacaagtcgctgtagaatagtaaatatcacttaatttttttcattcagaacttcagaacttgcattatctgtggaaacatttgaaggtcaggaggaggtgagaatgtcagctctgtgtaacaaatgtgcaataaatgtgagcaaatgaaaacaatgtttttaaatggtcattcggtaagatgtattttttttttttttttgagatggagtctcgctctgtcacccaggctggagagcagtggcccaatctcggctcactgtaagctctgcctcccaggttcacgccattctcctgcctcagcctcccaagcagctgggactacaggcgcccgccaccatgcccagctaatttttttgtatttttagtagagacggggtttcaccatgttagcctggatggtctcgatctcctgaccattttgaactgcaatcaggtgggttttgttaaatacatacagccacgtaacaaccaccacaatcaagagttccatcactgtaaaaaaattttctcctctcatctatttctagtcagcccctctcacccagcccaaaccttggacaaccactcatttgttatctgttcctatgcttttgcttttttcaaaatgtcatataaatgaaatgataatgtgtgttttttgaagcctggttgcttttattcagcacaatgcatttgagattcacccatgttatgacttgtatagatagttttgtcctttttattgttgagtggtattctattgtatgaatgtatctattcatcacttgaaagatattgggattgtctctaacttttagacattacgaataaactgttgtaaatatttgcttataagtttgtgtgagcataacgttttatctcttttgggtaaatattgaggagtgctactgctggatcatatgataggtatatatttaactttataagaagctaccaaattgtttcccagaggggctgtatcattttatgttcctactggccatgtatagaaattctggctgtttctaattctcactgatccttgatattgttagttttttaaaaatttatgttagttattctaatatatttgtagtagtatctcatcttgattttaatttacattttcctaatgactaaggctgtttggcctcatttcatttggtaaagtctcagatcaaaattttgctcattaaaaaattttcttgttttcttattgttgagttttgtcctttttcagatatgtgatctgcaaatattttctcctaacatgtggcttgcttttcactctcttagtgtttgcttttcattctcttagttttaattttgatgaagtcaaatatcatgtttttcttttatggattgtgcttttggtgtcaagagttgtttttgataacctcaatccagtatattctgtaaatattgaatacatttcataaatattacagactctttgagtcttttgttcaactcctgcttgcaatggtttgcaaacattttcttttattttttctctccagcactgcccacatgaacacacccacacacttaagcattataaacacagatttcctgtgttactctgaactctcaaccctccttttccaggcctcctcccaaagatcataaaagccacattttccaaaatatcttttatcactcagagaaaagtgctggaagattgtaatgaccagtgctatttttatggcagaacactccaaaataaaaaaatatatatcatactggattctctttttcaaaattatacaagttaattcaaaatggcattctgaaaactcaccgcccgccaatccatcaatcccaggtatagcataatacatgctatgtattaactgaatttaatgttaaagtcaattaattagctacatttatctatttgcattttgaaacctcttcccatatattaaaaggaacagaaatttttgcatgcttttttcttgagtctgagtacaacttctacctaccgctcttgcgtctgattttaagttggcttgtttcacagttgatacaataagaaaatgctaagaaagaggagtgggggtaatggttgagttaaaaagttgaaagaggaaaaatttgatttgttcttgagcacacggagcaaatccctttcttttgtttctacaattttacgttaagatatttactatttcttttctaaatgtatcctaaacaagcttattataaaacatgttattttatgtttgatgaatctctatttggtatatgcattaaatttaatgaaattatacccttaaaatatagctcatagaggattatgtgtacatggcagaatctatcccgccacctagacaacaattactctttccaagtctgtctgatgtatctattttgggaccctggtgtctaatcaaaattggcaacttccagaaggaggcttggacagtgagttgtacttaatttcagtgagtttcagctcttaacacaatagtggctgcacatcctctacccctagccctgtggcaggctttccagatgtgcatacattccagtagcagcttgtgctcaacgtgcaggggccgaatgggaaaaaatgaaccctgtcctacaaataacagggatctatgttgtgatcactgatgcctgcctctgaacacaaaggtacagacaaagaaatggcaaccatgtgtttgcaactctccctattgttgtaagcacctccccctctggctgaagtgacttccaggggatttaaagagcttgtgccttttcctgtgtctccttcatttttctccttttccctttttgggagccagacattgaagactaagacattcaaaagcaaccacatatatggggtaagttggaaagacattgaacttgcccaggggaaggtgcagcctcagaaaagacctaagaagactcttaagtgtgcagttcaggctgatccttggcaacctacaacaattacaataaacaaacaaaatccagcaaatccttgaggaagggagacaatctgatttccagagttaccatatcattagattcagatatccagttgttagcaaaaaattatgaggcataaaaagaaacaaaaacgtatggcccactcaaaggggaaaacaaagaccaacagaaacagtgcctgatgaagacctgatggcacatctactagacaaagacttttaaaaaaatcttaaagatgcttaaaaaactgaaggaaaatttggagaaagtcaagaaaatggtgtatgcattaaatgaaaatatcaaaaaagagatagaaaacataagaaagaaactaaaaagaaatgcgggagctgaaaagtacaataactgaaatgaaaattttaaaagagggattcaaaggcagatttgagcaggcagaagaaagaatcaacaaacttgtagataagacagtgaaaattatcaagtatgagaaatacaaagaaaaaaatataagaaaagtgatcagagcctaagagacatctgggttaccattaagtggaccagcttactcattgtgggagtcctaaaaggaaaagagagaagggtgcagagagaatatttgaagaaataatgatggaaaacttcccaaatttgatgaaagacatgaatataaacatccaagaagttcaatgacagctgatgaactgaaagagacccacatcgagatacactataatcaaactatccaaagtcaaagagaattttgaaaacagtgagggaaaactgatttgtctcatacaaggaattttcaataagattatgggcaaatttatcgtcagaaactttgaaggccagaagtagtggtctgatatatttaaagtgctatttttttcagctgtcaactagaaattttatacgcagaaaaaatattctccaaaagcaagggagaaattaagacattctcagataaacagaagctgaaggagttttttacttgtctttgcagtaaatgctaaagggagtccttcctgcaggttgatataaaaggacactaaacaataacttgatgccatatgaagaaaaaaagatctcagcaaaggtaaatacatctatgattttaaaagtcagaattgctataatgatggtatgtaactccacctttgttttctgcatgatttaaggggcaatcattttaaaaacaattattagtctggaagctagcattattgtcagtctggtttgtaatttcacattttgttttctacacaattgtggagacatgaaaaattattagtatataaagatgtaattctgagacatctgcaacttaaaggggtggggtgcagagctgttaaaggagcagagtatttgtatgttattaaagttaagttcatataaatttaaattagaatatcatcactttaggatagtaagtgtaatcccaattgtaaccaaaagaaagtagctaaataatatagacgtacacaaacacgaaggaagaaagttaaatctttcactacaaaaaaatcaactaacacaaaagaagatagtaatgcagggaatggaggacaaaaaagctgtaaggtatgtagaaaataaatagcaaattacagaagtaagttgctgcttgccagtaattacattaaatgtaaattagactaagctcaccattaaaaagacaaagattggcagaatggataagaaaacagcccacctatacgctgtctacaagagactcactttagacccaaagatacaaatagattgaaagtgaagatagagaaggatatttcatgtaaatagtaaccaaaagagaatgagtgactatactaatatcaaagaaaatgaactttaaatttaaaaaatgctacaagaaacaaagaaaaacattatacattaatagattgctcagtacaatgagaagatataacaataataaacatttacacatcaaataacagaccataaaaatatataaagcaagcattgataaaattgaagggagaaataggcagttctataataatgttggagacttcaatactccactccaataatgaatagaacaaccagacagaagataagtgaagaaatagaggacttgaacaacacaataaaccaactagatctaagagacatatacagaacactctatccaacaacaaaatacacattcttgtcaagtgcacatggatattttctaggatagaccatatattaggacacaatttaagtctcaatcgattttaaaaggtaggtatcgtacaaagtatcttctccagccacaatgggataaaattagaaattaataaaagaaggaatagtagaaaattctgaaaattgtggaaattaaacaatacactattaaacaaacaatagatcaaggaagaagtcacaaagatggttagaaaatacttagaggtgaatgaaaacaaaaacactacatgtcaaaactatggaaaacagagaaagcaggagtaagagggaaattgatggaagaaagatcccaaatcaacaactgaactttataatttaagaaactagaaaaagaaaggataaactgaacccagagctagcagaaggaaggaaataataaagatcagaacagagacaaatgaaatatagaatataaaaataagagagaaagttaacaaaacaaaaacttagctcttcaaaaaggtcgacaaaatttacaagccttttggtagatggataatgaaaaaaaaaagaagattcaaattactaaattcagaaatgaaagtgagggtattaccacctattctacagaaataaaaagaaatataaaagtactataagcaattgtacaccaacaaatttgataacctagattcaatggaaaaattcttagaaacacaaaacctatcaagcctaaactaaaagaatagttttagtttagaaaagaataaaatctgaatatgcctctaaccaaggcaattcagtcaataatcaaaaatctcctaatgaattaaagacctgatgtcctcaccagtgtgttctaccaaacgtctaaagaagaactaataccagtcgctttgaaacttctcaaaagaattgaaaaacaagggaaacttcctaactcattctacattaccttgatattaaagccagacaacaacatatctaaagaagaactaataccagtctctttgaaaattttcaaaagaattgaaaaagaagggaaacttcccaactcattctacattaccttgatattaaagccagacaacattacaagaaaactgcagaccaatatcccttattacattgatgcaaaaatcctcaacaaaatgctacaacagaaaaatgacgcaactgcacaataaaagattataaatccagaccaaatgggatttattcttgaaatgcaagggtgattcaacgtagaagaatcagtcaatttcattaatacatctcattaacagaatgaaggggaaaaacatatgatcatctcaaatgatagtcatgtattcgacaagattcaacattctttcatgataaaaacactcaataaaccaggaatagaaggaatctacctcaatgtaataaaagtcatatgtaaataacccacagtgaacatcatactcaacgttgaaagactccaagcttttactctgagatcaagaacaaggcaaggatgtccacttttgcaacttcgatgcaatgtaatacttgaagccctagacagaggaactaggtgagggagagaaataaaaagcatccacattagaaaagaaaaagtacacttatctctatttagagataatataatcttatatgcagaaaatcctaaggattcgaccaaaaagctgttagaactaataaacccagcaaagtagcaggatacaaagtcaaagctcaaaaatcagttgcacttctatacactaacagtgatcaatctgaaaagaaaattaagagaatagtttcatttacaataccatcaaaaagaataaattaattaggaattaacttaaccaccagaaggtgaaatacttgcactacaaaactacaaaactgcaaaacatttctgaaagaaattaaagaagaacagaataatgggaagacatcccaggctccctaggttggaagacttaatactatccaaaccaacctacagatttaatgcaattcctatcaaaatcccaatgactttttgtagaaatagaaaaactcatcctaaagttcatatggaaactcaagggatcctgaatagcaaaaaaaaaaaaaaaaaatttttgaaaaagaacattgttggataactcacatttcctatttgaatcacataattcaaaaattatatgattagttacaaaatttagagtaaaccaaaacagtgtagtaatggcataaagacagaaacagatgaatggaatagaatagattgtctggaatagaatagatgtagaggtcacatacacatatatgacctcacatatatgtgtatggtcaaatgattttcaacaagggtgccacgataatttaatggggaaaagattgtcttttcaaaaatgatgctaggaaaactggatatccacatgcaaaataataaagttaggcccttacctaataccatatacaaaaattaactcaaaatggacctatgaactaaatttaagaccccaaactgtaaaactcttagaagaagacgtggggcaaaaacttcacaacactgaatttggcaatgatttcttggcttcaacatcaaaggcacaggtaacagaagaaaaaatagtcaaattagacttctgaaaatttaaaaaattacgtatcaaaagatactaccaacagagtaaaaaatcaacagaataggggaaaatatttgcaaatcatatatctaacaagggattaatatccagaatgtataaaaagctcctaaactctacaaaaaaaaaccccacaaacaactcagttcaaaaatgggcaaaggactcaaatagacatttctccaaagaagatatgcaaatggacaataaatgaaatgatgctatcaatattagtaatcattagggaaatgcaacacgaactacagcgagatagcaactcacacccattatgatggctgctattaaaaaactggaagataacaaatgttggtgaggatgtggagatattgaaacccttttgcactgttggtggaaatgttaaatgttacagctactatggaaaacagtatagcagttccacaaaaaattaaaaatagaattactatctgatcccacaattccgcatctaaatatatactcaaagaattgaaaacagagtcttgaagagatatttgtacatcacgttcatagcagcatcatttgtaataactaaaacatggaggcaacccaggtgtccattgacaaatgaactgacaaacaaaatgtggtatatacattcaatagaatgtattcagccttaaaaaggaaggacattctgcaatatgctatagcaccgatgaatcttgaggacattatgctaagtgaaataagctgcttcaaaaaagacaaatgctgtataattccacttatgtgaggtgcttagaggagacaaattcatagagacagaaagtagaatggtggttaccagggctagggaaagaaggaaaaggaagttaactctgtaatgggtacagaatttcagtttttcaagatgaaaagagttctgaaaatggatggtgatggttgtgcaataatgtgaatgtacttaatactactgaactgtacaatcaaaaataagatagtaaattttatgtgtgttttactggaataaaaataattgggaaaaaataaatcacgcaagttataatttgagaaaaatagcccaagtcaaatattacaactcatttttcatcttcaaaagctctcgtatgctattagatgtgctaagccagagggatttggaattaggaccgcatcctggggtcccggtgttagcctgttgagtcaccccctcatggttctccttcttttacctcctgtttgtgcatctctggttcctgcttcttcagcctttgcacaaaagcttagttggtccttcagtgactactggctaaaaacaaacagaaaaagaaaaaagaaacaaaaatggtgttcttctagttcttccatgagaactgtgaaggagtggccagccaaaaagaaatgtcaagcagaggctagtgtgtgggccaagaaagtccaggtcagacagaaacactacagttgctcacagatacatacaaaataagtcctgacatttttgtgaggaccttgggtgataaaagggaaaccccctaacacatttttcaggcagctgataatgtttgacagctttgaagaggaaacagaactaccagatgtcagtggctgaatcacagggaaaatactgcattctgcaaagccttactcaagcatcatgaagtgtagcccaaagttgatagaaatgctgataaataataaaattttatgaaaaagtaaaatctcgatactttttcacaagtcactagctgtaaccaagacaatgatgttggcttttttgtatttgatcatctttcatgaattttagaatgctttctttatcaaactctaaaaaatctttaacaaaattgcaaagtgtcacagcagtgaaaattttcataaacttcacagctctcaattatatgacacagtagaagtatcagaagtattctgctgtgtcattttctgtttctttgaagattctctgctgtacttcatcatttttccatatacagttaaaacaccaagcaaatatttggcctgaatcctaaaaatgtttaattcttccaattttctgtagttgcattttcagcaatacagagcgttccttcaattcttccctccccttttttcggtttgagatacactttaacacctaagaatgtgatcttctgttctttataactaacatttaatataaactaatgttgaatttatcaaaagcaagttcataatctttgaaaacataagactttttaaattattgatgggctaaaccatttactagttttttaaatattgaagtattcttgcattcctggaatattccagacatttgagtgacaaaacagtcaaaaatctctaactctgcagagtttctggcatgtttcaccacataaaaagtgtagaaaattattctcattttttctgcagaaactgttctactcttcactgtttccatggtgggttttttgtgtgtatggcagttatatatattatttagtttctaatctttcttttaaaaactttactgaggtataatttatatgccataaaattccttcattgtaagtatacaattcaatgatttttagtaaatttatagggttgtgtgatgattaccatagtccagttttaggacatttttattaccccaaaaagttctctccagccgttttgcaatcaatccctgctctcaccctcagtcctggcaaccactgtctctacagaattgccttttctggatatttcttatgcacagactcatataatttgttgtcttttgcattcaggttctttcacttagctgaatgtttttgaggttctttgtgtggcatgaatcagtcctttgctccttggtgttgccaagtagtattgcgctgtttggctttcccacattttgtttatccagtaacctgtttgtggcttctggattgttttcagttttgaccatcatctataatactgctagaaacattcacattcaaaaactgttatggacgtgtgccttcacatcccctgaatagattcccaggagtggaattgctgggtgctatggcaagcttatgtgtaactttttaagacgcatccagttaaggggttaagggagggtagctaccctctctgttgaaggaaagttcattttcttcttgtttttcttcttgtgtagctccaggttaggtggacaggcaccctctgttctcactggtatcgtgacctggttgaggagccagcaggacagagctgttactttttgtctggcctgactttgggcacccagggtaaactggaaataacatgccccagccagacctctgtgcgcacttggaaggagctctcaggtctccatctgttccctgcctccatgctgctgctgttcctctctaggtgttgttagtgcaggattttcttgggccctttccgctccctctggggcaggctgttccatatgcattgagttgtgagaccaacagctttcttcagtttagccttgcctatcctacatcttgcagaaatccgtcttccccccaaatggcatgcagatagaatccttctttacttttactttcattttagatctccccttgttattattgagctagtccctttgtcattttaatggaaatttggaaatggaagctcttgccatgaggtcacctagaattctaggtggtcattccttcctgagttccctcacagaccacccttgggctccctccggtttctgctgccctttctctctctctgccagtaagtgttggggtaaaagctgactttacaggaaatactatccatactggcagcctcagtaagtccctcagttcttcccattcatcagctgataaagtgacagtgcagggatatggaggcggatctgtctgggagggaatgtgtacgtaagtggtataacatctgtgtagtgtcattccgctgtgctctgaggagtaacaggtctgaaatgcagaccttggaaaatagacaagttgaagtttagagcaatagttgacatgtaaaaaaaaaaaaacccaacaagcctattgaatttatttttaagcctaataaaatatttaaaaagatcatttattatatcaacattccaaacacaacagagaaaatataatgaacccccatgtagacccactactgaagttcaacagaatatttcgtcacattgttttatctatccctttctttttcttttattcccttttatgctaagatattttaaaacaaatcccagacacattttccccatgcttaagtatgcatccttaaaaatatggaaattttattttctagccacattgtcctgatcacgcctaacaaaactaatcaataattcattggtatcatctatcctttatccatgatcaaattgtctcagtttttaatgaaatctttttatcaggttgtagaataggagaaacatattatgactcgtttcctgggcccaccccactgctagcattattcattggtcactttaactctcagtagtgttaaagtttaaaatcactgttccctaagacctgtagaggccccagaaactgactggagtgacgtctgttaggctgtaatggcttgtagcctcctcaagggccagtgcttgatggtagttgccagtacttgagcattgccctggaagggtccttcctgtgaattactcaggccatataattcatccatgcttatgcaatacaaatatttcaagcatcctaatgcacttatttatttatgaatgctagtgactagtgaaccaaaacctcttacctaaaataaatgactagctttggcaatggaggggtcagtacttcgattgctcttcctaatgtaacacaccactagggtgttgggcagagcttactgcactaattatcctgcagtcctacctgatgagaattgttcttccttacactaacgcctgggaaagcaggtagcttgcatatgcagttaaccagctacattgtcaaagaattttctacagagaaaatttgccctctgattgccaaatctccactttgccttgtgctgaggaagaggcagctctggggcagtgttcttccgcaagcttcttgttattacacgtggcttcctgttatgcagagacaggcggagagggctgggtaaggtgttgcaactgatggagacacacagacccacaagaggcaactgcactctaaattcctaagaaacacgaaagccacaaaacatgaacactggaggggtggccctggagaggcaccctaggtgaaacaaatttgctggcgtgcaaaaaaaccttgcaatatttgttgctggctcaggtttccagagctgctgataagaaagaagtaacagaaagccagtactcctctctctctccccttctctctctctctctctcttgttctcactctctgtcattctctctccctctctcttgttctcactctctgtcattctctctccctctctctttttctctctctcacacacacagataatttctctccctctgtctcatattgctaccaagacagcattttttacctcttcctgcagaacacatagttattggtgccaagcccctttccaaagcagattcttttcctttaggttgacatagtcacttgtcaaacaataaagggcatttctagaatccatagaacatgggaaaatgaaatctgcccaattccggagtattgaggcaggcatttagggaacaacttttagatatttctatgaattcggttatacaaatttgtctcaagggtgagtgccctgggaagacccgtgtggtttaatttcagggtacagagagaaggctcctttgctgtcatcagtctcacagtaaagatgccttttgaaggggcagtgcttttcatactaaagttaaaaacgaaactcaaaagaatgatgggtgcttttcaatgggggggtggcgtttgctttgaagacagaaaagggatacagaaagcgagcctgaagtttctgaagtcacatgtcctaatttccttctgggtggaaactgagggccatcatcccgcagtctgataacaggataggtggggggtctgcatgtatgtatgtgtgaatgtggcaggggcgttgcgtgtgtgtatgtgtgcggggtgtgggcagggacgtatgaatctgtttatcattttcaggtggtagcaatgccaggtctgctgtttcagagagctccccagtcggctccttcctcagctgtggtgtgggcctgactgccggcccacggtagcttagctcactctctctccctcccatgcctcggccacgtgggaccttgctcagaatccctaggtctctccacatgagcttgggtagcagctggtaagacgtggcaggattacctaatatgtccgttttcttgttggggtatcagcacagcctcagtggtgggcttgaggtttcagtaccatttctctgtcactgtgttttcgaggcctgctgagccttgcagagcatacactggcggaaatagcacaaaattgtttgtgcacaatctagaggcaaaatgggtggggctgaggcagctgcttcacatgataggttaggagtagtggctttgttcccagctcagtgaaaggtggcatggtctctcctgtccacttcactctggattctttaaccctgtgaattactagacatggattccatctccaatgtggatgcctctcttcaccacaagaatacatgctcctttctgggctgtggcttaggtatggatattgggctttgaaatcagatttctagttgttaactggagcagatcatttcacctctgtgagctttggttcctggtctgaaaaatgagggtgacagtatggtacttacataaagagcatgagcattaaatgacacagctctataaagtgcttgcactgtggctggctcgtggtaagtactcaatacataagtaacttgatattcattattgttagatcagggattatatcttccatcgtccactctgctcaagtggatgcagtgaacatatccagaaatcccgccaataggtaaattggccaatatttctcgcaaatacaaaatgcctgcatggtggctcacatttcgttctaaaacatttattttattaactcagcaaatatttatcaagatgcttcaattgccagatgcttttctaggaagtgtggagctttactaaaaatcccaaggaaaacagcacccttttctgtcttgcatctcagtttatccccacagcctcaagttagaaatgcttccctctgtgctggtttcctctatgccatcttttctttggttcctgaacgtctatgcaaataacttttctggtctgagattttcacgtcactcaaatcttctggctttcacttgcacctcttttctccccctagtctctttcttaattcataagccttacttatcaaaagcaaaactctcgggaagcttgaagctctcagtccaccctcacactttatcatgtccagaactggactcacctgcctgttcaaactggccttgttctctgatttcctttcttgcttccatgaatgggtctcccagatccatcagggctgtgtctggctgatctcatatcctcaggacccaaaattgttctggtgcatgtcaagtcctcaatcttgaatgaatgaatgaatgaatggggaaggctaccttaccagagccactcaaaccccagacctcacaaaaatctttgtctcctgctcctccttgttcagcagggggctgagtcctctcagtattagcctctcatattgtttcctcttccatcctaatccaggcttctggctttgcacctggaatattgtgcaatgtccagccaatctccctctataccatctctctccctcttttcatccctcccctctgtaatattctctttcttttctctcatttagaataaaattgagtccatactataataataatgttaataataatagctttcatttaatttctatgttttaagaagcaggcactggctgggacctgtccacttacccttactaatccctatggatttatcaccccataagatgcatgttattatcacagctttacagaggaggaaactggccctcagagatagaatacggcttacccaaggctgcgtatgtagaagcctgtgcacttctgctactttctccttccttctctctgttaggcactgtgttaggtgcacgatacaaggatgagcaaggccaaacatcaagggagtacccctgtcttcttagagtgcaagtggagagggaagacaggaaaagaaaaaagtaccaagcaaggcgacaaaggctacgatacacaggtgtctccactgacaagggtccagagccagggagcaactaagtctggcagggccaggaaggcttctcacaggaagtggggcctgaagggattcttgaaggataagtaagagttttccaagaggtcaaattggatgtaggtgggggtgggtagggaggacattccagcagagagaatagcatactgtcctggataaagagcaggatgggcatggagaaagagcaggaaatgcagcagaaaaagccgcaaaggactccaactccatggcagtttagacttcatcgtttaggagggagatgctgggggtcatcagaggcttttaggcaggaaggtaacatgatcagaattctgtttgagaaggctcacgtcataagcaatgctgtcagtgctgaatataaggaacaggcagccttctgtgttgattggttggctgggagaatgtcactcaagtacatcagagagaccagcggaggtaaagcaggtttgggcatgtgtgtcagtgttagccagaggaatggtagaggtgagaaggggaaaggtggtaagtttgatgaggtggtaagcatgatgagcttgacattctcatggaggtgtgttaggaagctggatggatgggtctacagctcagaaaggagggctgggggaagccatgcaaattctactcccttttcaaatccatttaaacatggttcccaaactaatgcacagctcatatcaacatactgggaaaatacctgaaattgtttccccagctctgaaagaactattcacacctcacccacacatttacagccatccaaagtggaatctagactgagtcagaattgagagcagattattttgagggttcagcggcagaagatgaagaaaggaagtgataacgtttctcagctgacttctctgttcgtacttccttctttaattttcctttgccccatcttggggcaaaaagcagctaacttctacagcagaaacaacatccctaggcatgtggcacttcttctatttctcttctttcctttccagtactctctcacacctgcagactaaaattcagcaccaacagtccagtcatacaactatattttatcatgggcctcccttgctcaggaatatgaaatagctccctactacctctctaatcaagttgaatgcctcactctgtcatctaaagcatcttcttctctgggccctccagcttgatttctctatttgataaaatgctgcctcacttttatggcccatttccaccccacgctttgtaatgatagcactcaggttctgggaagtgctgaccagcagaactttctgtgatagtggaaatgttctctatctgttgtccagtactgtagccacgaaacacacaggcttactgagtacttaaaacatggctagtatgacggaggaactcaattgtaacttaatgtaacctatttaattcatttaaatgtacacagccacttatggttagtggctactgtactagacaatgcagtgctaggggcttgctcatcctctctctactagaataatgtgaggtttctaaccttattgaggccctcatttctcacttgccccaaggtgttctgtaaacactgagcaactgccttcccacctttccccgccctggtctgcctgcagccccctctccaaccctccgcctggttcagacctgcttcctgaagggctgggaatgtgcactcagggtacaatgactggctcacaagtgaagcttatcatggttattattttcattatgagaaacagctccattaatagtaacagatctctttgtttactttatccggaacaagtcccacccacaaagaagagagactgttcaaagaacctaacaaggaaagttggtcaaaaccatgacaaactcaaggcccccagactttcttctctgctattttaatgatctcatgctaggcctggctggtgagcaacactgtgggctatggagggagatggctctgcacttgggatggaaagtgcccctgcttaatccccagctcatctgagaccccagctgtctccctaccctcagggtttgggcctaattccagcagtgtggaactttgtactgagctatccccactctctaacttataacaggtggcccagtgctcatagttacacaaactatggtgggatgttaacaggcactaaagaaacactggttggatgtagagtgagtggtatcctttatggatataaaacatggccaggcagagccttgttcatatgtaagcagacaagctggttgcctttctgctacaagggcatcaaaggtccccttggccaggtctgggaacataagatcctcgcacttactcctgcctttgccaggtcattctgcaacgcacacgtgctcctaggagggttttttgtttgtttgtttttcttatagttgtttttgccacaacaaagcatgaaaaatttcacagaactgtgaacaaaataccagcaactaatttcttctatgctgagtgaattctttccaatctgtagtatctttttctcttctgctaaccgcttcccacttcttcaatgctgttggagaccttcagtttcccctaacccccactgtggtcctaatgatgtctgtgggcctctgggggtggcccaaggggcctgagtccttctagccaccatgtggcacttcccctcactcctgagttggctccatttgatggcatcacctcagaagccaagtaaaggttcctcatatgccactgctagaagggggtcctccctatcatgtctgatgttgctacagttggatggtcacaaaagccacaccgggatagacttcactgaggctactgaagtgggggagaatgcctctgcatctgctggaatgcctcactcttcgattttctccaaaagttttgtgtgtaaactatctttttcatttttgcctactctctgccctctttctaggacagataagagtccttgcaaggtatagtctctgacttagagagatacagaactgtatacagtccttcaaattccctcctccccattgtattctgccaaaatctttctgtagttctttggggatcatttccacagccttagagcaagtgatcagcccacactggctgctttttaattacagatagaaggccttgaagatagcaagtaactgaggagcaagatctcagataaagttcttaactgggatgctaagacacactgatataaagcaaatcctttgtaagcaagctaccaaattgtcatcaaaatatcaaattatcttttctacatctgagcataagcactcttgtgatgatgtctgtccaatgggaagctgaatcaaatatgtcttgcaacgtgggatacaacctagtatgacctcaccaggtccctggtgggaggtaagaagtgactgccagatggaaccaggtataagggcatattatgggaactcagaccccttgtgagggtcaagggagcccagttacagtggagtcctcttcagacagcaatattggaccgaaggatgaaatgtggaaatagggtgataactccagatacaattggagatagctacagaaagactctgtaatgccatataaaactctggtgtttgaaagtatgccatgattataaataaagattgagaatcacaggcgtagaaggagatagaaataagagaatcagaaagaatgaaattctgtcctttgcagcaacatggatggagctggaggctatttatcctaactaactcagaaacagaaaatcaaatatcccatgttcttatttataagtgggagctaaacaataggtatacgtggacataaatatgggaataataggcactgaggactccaaaagtggggaaggcaggaggaaggtgaggattgaaaaattacctgttggttacaatgttcaatatttgggtgatggatacactagaaacccaatccccaccattaggcgatggactcatgtaacaaaccagcacgtataccccctgaatatatttttcaaaatcaatgaggagatgttggcaatttaatgcattaaagataggaaagaagaaagagaggaagcttgatgatggaatgacattttgaagtgaagagggaagttgaagaagctctcagtgatgactcccatccttttagtaggaagtaaagtcacctgttgataaaaacagcaagagtaacatatacttacctttgaccagggactgtgctaagtggtttgcgtatgtttgtttaatctctacaacaattccataaacaaggaagtattattatcctaatttagcaagtgaggaagccgaggctcagagaagcataatttatccaccgtcaaaaagtcaggaaaggtagaactagtctccaatcaggtgaaatgaaatgggtcgggagcagagttgatagcttagtttagctgtgtcatgagtggtccagggatggacaaaagctgaaaaagggggttggaagatggagccttcctccagcaacacttggcagaaggagaggggtgcagacactgggtattagcaagtgtggagggcagtgcaggccaaggagacaagggcatcattgaactggctgggaaataagatggggctcagaaggaagtgttgaatggggaccagggtgatcgatggagcgctgtggagggaaggaaaggagagcatggtcctgggtgggggttaccatggagacaagatgtggaggtacaggctggacttactcgaatgacaggcagaactcctgtgtgaaaacaaaagccaaatataccatgctgagtgcatgcaggttcaaggggctctggcttcaaatcctgcttctgagttctattggcagtgacgatctaactgtaaaggtcataggaaggcagcagcagtgagcgccttgtacagcataaagggctgggatactctccgtgggcaggggacagaatggcactgggcaggagaattcagaaggtgccaactccctgcaggctggccctgtggccgggggctggggtttgagtggggtccgctggagggggcctgcgttccacagcgaggttggagctaacagcttctgtcttgcggcccctcctctagccggccgctgtggaagagtgcccaggcagcttccggcggcctctgcagctgcgtgggactcaccccgagccttcagagtgaggcattattttctcctctctcttgtcagatactgactcccacgcaggaaaaaggaagcaccttttgtcagatgctgtggccacttcctcttcagaaggctccagccaacctttcggtttgcagaatgacggggcccgccgcggtgccggactgcctgtgcacggggccaccgactgcagcctgggttttattcttggcctggccctgaccgggagctggcccctcggctgcttctctggctcgggggggactttctctggctcagatccggacccctgaactggacctggttgtcgtccccccgcttctcagccccctctggggttcctctctcctctccgcccactctttgctcactgccccatgtccctcggtcagtcggcctgtctgttcctctctatagctcggtcaaggagtgtgatgactggcgagcagatggctgccttccatccatcgtccacccccaacccgctggagaggcccatcaagatgggctggctgaagaagcagaggtccatcgtgaagaactggcagcagaggtactttgtgctgagggcgcagcagctctactactacaaggatgaagaggacacgaagccccaggtaccagccaggctgtttgtcccgttcataaggcacggaggaggcgggcctggagcccgctgggatttcacttaaactcacaggggccttctcaataggaccagacacacccattggaaaggaaattgcttttccctttacaccattttctagatacataaactgagttgcaaagatgacagagtggtcctccaggaagcaccaggacgggcactgtggagtttcctacacatggctctgagtcaagactggcaacagggcggtgatggtagtgacactcagtcaagggctcagagagagtggatttgggttcaggaaaaccgattttgggactcattgatttgtttgttcagtaagtatttattgagcgtttattatatgccacacactgttctaggtacttgaaataaactatgagcaaaacagataaaaatctcttccatatgcagcttagaatgtggaggaaaagacacataaacataacaaataagaaaagtatgtagtttgttagagaaaagattagttctatgaggaaaaaataggatgagctagcagatgtcacgagttaagggaagatgtaattttaaaaaggatggtcaaatgacctcatgaagagggtgacactggggccgagactaaagaggagagggaataagctgggtagatctctggggaaagagtgttccaggcagagagaacggccggtgctaaggcaccaaagggagcatgtctggcctggctgcggaatagcaaggagggcactgtggtgggagcagaactagcaggtaggaatcagaggggatgaggtctgagaagcaagagggtagtcaggggtcaggggcacagactgctggggcactgcaggccactgtaaggacctgagcattcacactgagggccacagggaggcattgcagggctctgagcagagagtgacagtttttggtttaaattgtaaaaagacagctgtggctactgtgctcaaaaatagagccagaggagacgcaagtaatctaggtaaggggttatgatgtttaggggctcagtaggagttgtgggctggaggaaaatggtcagcttctggatatactttgaaagtagagcaaacaggatttcctgatgcagtggataaggctgtgagaatgggctttaatcctaaatcttgggcctaggtctcttcggccaacctcattgcttttttggccattgtggtgtgtgagaataaaagaggatgctctgaacaattacgccaggaccccaggtgcaaactggatgtctcagggcatccagcacagctgtcacccacctagaactcatgtgtgtggagatggaagtatgggcttggccagaaggagcttatttgggatgacagactctagaaccttctggagccagaacaaaatcccgagaaaggcaaggacaagaagtgtgtagatattgggggtgggtgggaccaaaatgaaaagctcattttggaagaggactgttttctttaagggcaggcttgaggatccattgcacatcagcaggacttggttaaccagttcctccacttaagggctctgaactctggagtctctgtcactgcagaggccagggaaggatcgcagggaccccaccacagatggggctcttgcctcatgttctgtgcatggtaaccagccttccttctctttataaacaccccagaccttattaaagccaagcaattccaggctaagatggcggttgatatgttaagacgatggaggaagtcctcctatctgcagagtgtaagggagacggcagtaacgctttggccaccccagatcaatgaaaggggcagctgagtgtgtttccatgaagtgtagagggtgagaggtagtttatataaaaggatgtgttcttttcctggttccaccactatttggccctgtaattatttcatttttccggaccccgctttattcttttataaaattagacaatactacctggcctgcatttgtcacaggatcaaatgatataaagcaggtataaaaaactgttttgttaaaacataaactaatgtcaaagggtaaaataaatatctgaaggttcttgcttctcctccttacttctgggaggaagaaacccaaagccttctcaggactaaattagcctgagataattaggtaacacttctaggatgacaaggataatttattttgaggaaatctattgatataatacatcggatcaataggtcaagtaagcaaaaccacacaacccttcaatagatggctgaaaaatgcattgataaaatccaacactcatttcagatatgaaaaatagaaaaataaaacctttaggaatacaataataatttcttagaaagaatagtgtattttaccacatgttgatatgtatcatttgattataaaagctttaaaaattattcacaatcccattagtaagaaatagccacctatatcccctccactttcagccttccctatacatatgtatttaggaactcatctattgtaaatgcaaaattagtataataaatattatttaatgaaaaaattaacaatatatcatgaattttgccccaacactaaatatgattctacaatataattcttagttatgtcaaagcaatctattatatgaatgttccataatttatttaattaattttccactgttaggaatttgggctgatgtttatactattatcacaaacaataattaagtagattccccacagcattgtttatattagtgatatgacaacaatgcccagtggtaggggctaacttatattaggctacatttatatatctatacaataaaatacaattcagacattgatgctcctaattaatactttttgaaatggaaaaatgtccataacattactgtctttaaaaagcagtttacaacagaagatgatgtatatactaatcccattcttgaaaaaaaaagcatgaatctgtatttatagaaaaaggcctagaaagacatacacagaagtattaaccgtggttatctctgaatactggggttacacatacaatttctaatgtctctttaaaaatatttttataattgaagtgtaatcattgtaaatttaaaaagaatgcacacaaacatcctatcccccaagataccaaaaagcagaaacatcacaataatcttggagccatcaggcgtaagggccctcacatacactgatgatgtgtgtgttggttggtacaacctttctagaaagtcatctggccagatttactaaacaccaaaaaattgtcatacccttagacacagtaattctgggtctacgaagttccaaaagaaataataagaatattcaatgctatttataatgagaaacattggacctagcgtccggcaaaggagaatgtaaataaattatggagccgtgtatgatagactttcctgtatgtgcttctggagaatcctgtggccctacacaaggcagtctgtgcattttttctttgagttctcagaaagatcctgtccagttttaacggtttaaggctgtgtaagtccatgaactagctttatataaaccattctagagagttgtttgtcagggaaattgtttcaaacagaatctcagcttatcgccctcaagtttctgttacaatgatggtctcagacaatcctagtagtagggtagacccgtggtcccattgtctcatctgcctgttttctgaggcatcgccacaagtggttgtctaccagcggtgtgctggtagatagttaacaactggccctctgatgggagagccgattgaagggcaacatttgctaatttctgtgtggcagatactcccatcatgactgatgcaagctaccaacattataccactgaactcagagttgagaagagacatgcaatagcaccacattatataggatttccaccacacagatagaatagatggaaataaccacaacagcagaaatgatagcaaaataatcagaaaggtgtacaatttaagtatcttcacctttttaatagaaaatatttcattgtaagcttatagaatttaaattttagtaatagctgtatttaactggcttaaaacttaacagttaagttctcatgagccaatataagcattttgaaaaatgctttaacaaggagttgggctaaaatgtagttctagatgaactacaaattggatttaaaagttatagctagagaattctagatattctggcacctcactgccacagctgtctccattgctttactgctgaaggacttgtggcctcctgcataaacatttctgtccttccatctttatacagagcccaccccagtcaacttgctaagtacaagtggctctgggcaacttgggcccttcccttcctggaacaattcttccttccctatcagtgtccccaccctcacccctactggtgtctcttcctcttacctgctttcttcttgccatttatgaagttcaagcctctcatgctgagcttgaggaaagggcctgcaattagtcatttacaccttggtgtgaacatgtttaactctcattgttacttctctcagcaagtgggacttgtaagtaaagccttatttgtaattctggaatcacactgactgatgctggaatcgtagatttcttattatctagcttttgtgatcctgggtcagctaattaacttccttgagctttacttcttcctttctccaatggggaagaataacagtccttccctcctagacttcttatgaagattagatgtgctgatacattcagggcaattagcatagagtcagacacctagggaatgctcaataaatggcatgtatatttttagtattttattgttactatttctgatgaaatgattttgggtgtcaaaagacagtttggagaggtacttaggggaggcagacacctctgtgtttgccctttccttctctccttaccagacagtgctccatcctgcctaaaagcaacaaggccttttattctggtgccataactcatccaaagtagctcagcagcacaacctcagggtcattttttctgaaggcatggatgtgatttattaaagatggtgaggactgtgtaggtggaggttatttttaaataataaaattagaggaatgtagaggaattgcagaattccactttctagaccgattttctttttcttctcctccttccccttcccccttctccccttccttgtctttcatcctcattctcctcctccatttgttctttctcctcttccttctcctgccctttctgttccttcccctcctcctcctcttccttcttgtcttgttctctctcagtcttaggcatttttatttctagatcctcaagaaacatttattctcttaggctcctgagtggatcttacttctgagatttccttaagactcttttgcctttatagtgttctctgccaccagtcatctccatcggtactttgttttgaaataaagacacgtgtgtttactcaactcagaatcaggcctgctaccttcaacagccagcgaggtgtaaattatgaataactagatccagtgcgcactaacgatgttactttgtgcagtcacttagacattcaaagtgtcagtttcctcatctgcaaagtggcagtgataaatcttgctatgctctggatatggagttgttgtgggggtctaatgaattatctcaagtgggccaggcacggtggctcatgcctgtaatcccagcactttgggaggctgaggtgggtggatcatgaagtcaggagatctagaccatcctggctaacactgtgaaaccccatctccactaaaaaaaatacaaaaaattagccagacgcagtggtgagcgcctgtagtgccagatactcaagaggctgagacaggagaataacttgaacccaggaggcagaggttgcaatgagctgagatcacgccactgcactccagcctgggcaacagagcgagactccgtctcaaaaagaaaccaaaagaattatcccaagtgaaatgcactgtaagtgataaagcaccatgcacacacatggtggaagtggcttgtttttctgataatatatctgtgtgtaagaggtcacaaatcctactaaaccctcagaccccttcatagatctgggcttggtggtgggaccatttcccaccacctcagctttgatggtgaagagcactggctttggactgacttctgagatgaactactattctggcacttactagctctatgactttgggtagattatagaagctttctgatctcttttcttcacctataaaatttacataatgatactttccttagaggactgctggaaggactacatgaataatacattcaaggtggttagtgaaggtgcgagcaccttctactcaataccccatcccctccaatggtcacctgagtggttcagtcctccctgaacccctctggcagcttggcaggtagtatggtctccacagcctcagcattgccttcacaaagaccaagtgtctcatttggccatcaagttgggtccttggaaaagtgggaagaggcaagtattggtgatgacaccctcttagctcattcttatatcagaaccttgtctttctctgggcacctgatttgctctggaatagctgccctttgatttgcccaaggcctgagtagcagaaggggccccattaaaactgggaggctagcttcccatgtccctatcctcctactctcctccccatcccatcattatcctatctgttgtccaacccaattttagtttatattaaattgctgcttatccttaaggcctgacttttcatctttcagggctgcatgtatctaccaggatgtacaatcaaggagatcgccacaaacccagaagaagctgggaagtttgtctttgaaatcattccaggtaggccaccacaggtaggacagaggtgcagtgcagaagtaaaattcccattttacttctggaccctagaagtcaaagctatattcggagagtaattcaactaactaaccaaccagcctattgagagcccacaatggttctttatacagttaatgaagctattgtagtttattaactagtatcaagtgcttgaataatgcccatgaaagaagtaggtgagcattttgttcaactctgtaagcatttcatgagcgtgtgctaggagccagttactgtacaaggctctgagccactgacatgaaaagtgcaccttctctactcactaaaatgaactcattgtagaaggagagtaggtcatcaaatttaacagttaaaatataaatggaaccacgtgaaattgccattttgatgggtcaaaaattataaaaattcagcagcctcagatggttccacccattgcatctcacccattgcacatgattggcacattggaggtgcctctttcaaatcaagagtttccttccttgaatgcatttggaacaaggggagtttgggtcatgctcctggatctgccacactgagatgcttctactcttctccctgtctcttgctcctctgctagccctagccctgccaggggctccaggactagaggctaatctggctgtgtagccttgctgctactgctgtactgaccacagcggaggaggccacatggcccctgagtgcctcttttcttcaccccctccttcccactcacacaaggtgactgtgtgcataagaaagttgatggagaaggcagcgtagcatagaggttagaagtgtccagtctggagctagcctgccctgaccctggcacttactatttgtgtaagaggttacttaatttctccctgccttttgattttttgtctataaaatggggacaataatgataatagtaaagatttaataaggaaataaatatgaagcatttgatacagtgcatgtcatatcagtgtttgatatttgggaataatctagagataattataatgcagaaaaaaaatcctaaacttggctatgactgtttatagaatacaaatttacaaaaatttttaagtttctagatgcttgcttgtttgttttttttgttttttgtttttgtttttttttttgagttgggacagtcttgctctgttgcccaagctggagtgcagtggcgtgatctgggctcactgcagcctctgcctccccagttcaagcaattctccttgcctcagcctcctgagtagctggaactagaggtgtgtgccgccatgcccagttaatttttgtatttttagtagagacagggtttcacatgttggccgggctgctctcgaacttctgacctcaggcaatccacctgcctcagcttcctgaagtgctgggattacagatgtgagccaccattcctagcctcccttgctttttcatctgaaggtctaacttcctctctttctcttcagaggaaaagcaggaaagcctgctttttcagtctctcctcactagaaatatctctctccctttccacaaaggttattctgttcttaggatgcttctcccagtgcaattcatgggacacaaccatccatggtaacatgtgtgtcccaaagcctgggttttcaatctagagtaaccctactgagagatccagctgaagattcactgtgggctttgcaccaaaaatacctactcttcaacattgctataccagtgcaggaggaaggtttgttctctcattatcacttatgtttgcagcagtctcctggcctgctagaggaattcacaaacagatcctttttctctctctctttcgctctctctctctctttctctctctctctctcacacacacacacacacaccacatctcataaggacaaataatactaaagtaataataagataggaaaccattttcataaagataccatcatcttccaaggttccacccaaccctaaagtgagatatccttcatgttataacatagagaatttttagttcctctttttatcatcctcttttgcaagatgattctccggagctaatgctggtgtaagaaatgggcttcccagataggatcctctctctgtgatcaccagttttagttgcacaaacgtcacatagaaacttttaattgtaggcatgctagttttttttttaattgggggcaggcaacaatttagggtaggcttccctctccctactgatctctcatagcataactatctattcttctattctcctcctaccccagggaatcaccaggaaggggttgttccttctgttgcatatgttatctcatttagttctcataccactttatgatctgttgttactcatttgtacgacaaattcattgagcacctcctatgagccaagtactattgcaggactgggaatgtggcaaagaacaaagcagcctgcatgcacgttacgtgggaagagactagcagcaaaccaaatatatgggcaaattatgtagtttttctgataggatagcaattatggggaaaattaaaccaaagagagagaaggtgctggctgaggtggttgattgattattgtgaacagagccggcagagtttgtgttattaagaaggtgacctttgggcacagatctgaaggcaatgagggagtcagctaagagcacagctggaggaagagcattccaggaagtggaaattgccagtacaaagtctctgagcctatttcatatgttcaaggaaggtcaaggaggccagtgtggttacagtgaagtgatggcaggagacaagaataggacattttctcaggggtgggcacagatttcataggcacttgcaggcaatgtgagaactttagcttttctgctagaaggatggggagccactggaaagttttgagcagaggtgtgacatgacataactcatgttttaaaattcttttgaattgaaaacaaaagtaagtagtgggggcaagggcagaacaaggagatcagtgaggaggcttttgcaagaatccaagtcagagatagcagtgatgaaggggctgtgaagtaagcagtttctgatcacattttgaaggtagggagggcttcatttgctaatgaattggatgtgggaaaaagaaatcgatgttgactccaaaagttttggcctaaacaatggaaaagatggatttgctgagatttgtgcatgtagcaagcaagttttttttcgggggtttgggggtaagggcatcagttttggacatattaaataatatctccattgtactggtaaggaaactattgctcaagataatttagctactgtagtgatagaggtaagaacaagatattaagggattatagaataaggactccccactcaacttggagtagggggaagaaaggtccctagaaaaggtaacatttgagttgggttttaaagaatgggtaggagttctttaggcagattaagaaaagaagagaggtccatttccaacaagagaaatagcccaaagggtaacacatgttgaacaggctgtgtttaagtcagataaattatgtgcctgaggtcagaggtgctgttcgtgagctttgtattaatgtcaggcaattcctgttaatgaaagtctgttctagcaccccaattatgcccaaatatttacttttttttaggacaacagaaacctttcaaaccccctttggttcttgtctcttggacctatcttaatatcatcaagcttcacattatttcaccctttgggacaacctgattttcaatcatcctgtcatcaggtcatcagctctcctaaccagaagagttagtccatggaagtcctcttcattcaggaacatcttgagagctgcgtgtttcccagtggggttgctcatgacagaacaaaaagacctcccaggaatcagggtaaactgagaagacatgttttaacaacatagtagactggagttgaggcatggtggagacggagcggggaaagacaccagataaattttgtccaaggtcaaatttaggagcaatatgggccagcggaatctttcatgggaggaaggacaccgacagacttgccctgtgtttggcagcaactcactggatactgacgaactggtgcttttgcatccctgggattcagttctattatctataaaatggaaataatactaactccttattctatttcaaagggatattgcaattcctagagggtctttttgttctgccctgagtatttttaacttaccattttacttctgaaaacatccagttctcaggatactctcaatgcccagtgctttaatggtcagaaaagctgatgacctaatgacaagatggagtcagaatcaggttatcacaaagggtgaaagaaggtgaggctcagtgatattaagataggtccaagagaccagaaccaaaggggatttgaaagtcttttcctgccctgcagggaaatacaggtttaggcacaactactcagctagaacaagctctctgagggagatggcctgccattgtgagaagaatggattgctgcttacgaaggcactttgaaatttaatatcccataattgaaagggatcactattgttttcttgtccccgctaagacctttttattttaaccaactaaagaaaataccaactttgaggatttccatttgcaagcaggtccacggatgaagttagagttcaagtctcagatctgatactaactaactgcatggtccaagacctgtgtttgatactctccttttccctctcttgcttctttcttcctttttcactttcccacattctttctcttcgtctccttctccctgctttctgttcccttcaatttctcccacctttttggtccatttgagaacaccaaccgaggaaacactacacctatctataatcttaggtttgaagtgaaaatggtaaagaaagttctaacaagtttcatgtatccattaactgagtattgagaacctacatttgaaaggtgttgtgtggccaggagagcagaaatatgatcaccaagcaccaattttgtgaaaaaagcacacatctattcactgtcactcccacctgaggttgtcatctcctaccctacccccacaactgagctcaggactagcttaggaaagtatccacggttggcgtgatgatctaaagtcttctaacttttatgggctgaccctgtctcatctatgctgaaactgcaccatgaacttccttttccttttggtaggaaatgacttctgtcctcttaaatgaaagcagctctcagcccaagctatgccaattgcaaaccattgtgttcaatgatttgtctgttgagttagagcttcagtaagagtgcccggatatccagttccactgaggataattcgacaatgcatttgtgttgtttggctggtagtgcttcattgaaccaagacatcaatttaggtctggttcccttctcttccccttgctctcatgttcttatcactctaagaccttcacaagtgctaattcttcctccagcctcatgggaccagaatcgcatgggacaggactcctatgtcctcatggccagctctcaggcggagatggaggagtgggttaaattcctcaggagagttgctggcacaccctgtggaggtaaggacccctgcaggctttcctgggcaggtgcctatgacatctcagaaagtaggaagtagctccaatgtgatagctccttgagcagtgctcaagggagacaaccagaaagcagttctctgcatgcccatggccaagtgctctgtcaaatgtggaggaaaagtgggctcagagcttctagcttcccaccccctgcggcacctgggtcatctcaaagagccatctccaaattaactggagggaaggcaagtcttttgcagtgagtaaatgtgtatgatatctggaagtagtgctttctcctctctgggccaaagtactctcatctgtaaaatgaatgggttggataagctgaccccgggtacccagcagcactggctcatgcagcaccacgagtctgcctggttctgggaactgatggcaacagctatgctgaaagcataagttagactgcataagtcagcacatgaaaataaagctactgtccaaaagagggatgatcagactggggaaggttcaggaattgtgtctgaagtcttgcaggtgtacagtgagttcagcattcaacacttttctgggtttcacaactcaagaatttgagctctctgggaatcctggtgatgtttccacatttgaggagggtcctgactaaagaaaacggatgcaaaaactatctgaaattaacaaacacgtgaatctagtaagtttccctgcctttataaaaatatgaaaaaaccgacaggtatgagttctcaagttaacattttccttcaactttttaggagcacgcctacttgtgtcaactccagataaccttaaatatatagttatgtattgactgtgtggcctgttattttggaaattatttagggaggctttcgtagtttgaatattaaatatttatttcattggcctacagcttccttcagaaatttcaagaatatcacaataattttgtggaaagtaaagaaaaaatattccaccagaggcattttatgtttatctttcatctactgtttacatctacacacttttttcagaatggcttaagcattttccccaagttgctatggaatctttttcttttttttttttccgagacggagtcttggtctgtcgcccaggatggagtgcagtggcgtgatctcggctcactgcaagctccacctcccaggttcacaccattctcctgtctcagcctcctgagtagctgggactacaggcgcctgccaccatgcctggctaatctttttttgtattttttttagtagagacggggtttcaccatgttggccaggatggtctcgatctcctggcctcgtgatccacccgcctcggcctcccaaagtgctgggattacaggcgtgagccaccgtgcccggcctggaatcttaattgatacatttcagcatttatttggttacaaatagaaattgtatccaatgatgttaaacaaccaagaaagatttgctggttagatacattagcttctcaaagcaaccaagagcaggaactgccaagaggttttataagagtctgggaccaagaaaggggacattagcattgattttatcctgtctgtttctctgggagcacatgacctgcaggtacataattaggccacatgctggaaaatcttagctgtgaccatccttattgcgctggattatgagattgtgagccacccttttctgttttctccagtccagtgctttaagctatctgcatagacaagggtagtggatgttgcctaatcatgcacctgctctctgagtcaaaatggtatccgtgtactttcactaggttctgtggctactgtgatgcttggctgagccttgccgtagtgaactgctgtactctgtcatgatacacatggggatttcaccctcaccgcaccccgagaccaccaccctgagaagcaagtcaagcatgagtcctgtaggcggtggaaagtccagcgaaggggaaatcagagtgcaacagcacttatttattcaaagaacagtgttgcctctgatacagcatctcagattattattattattattattttgagatggagtctcactctgtctcccagactggagtgcactggcatgatctcggctcactgcaacctccgcttccagggtttgagcgattctcctacctcagccttctgaacagctgggattacaggcatgtgccaccacacccagctaatttttgtatatttagtaaagacagggtttcaccttgttttggccaggctggtctcgaactcctgaccttaggtgatccaccacctcggcttcccaaagtgctgggattacaggcatgagccaccgtgcccagccacgtttaaagttactaaccaaaatcatagatcccggaatgtgagggcatttttaagacagtatagagtctcatttgaggccactggacaaatcagacatttgttcttcctatttgtaagttagggaatgttggccttaaagggacaaatgacgtgtcccgtgggcccaggaggtgaggggcagggccagggctcttttgccacagcacattaccacttggaaagaatctctaacgtgggttgactagatgggaaagacatgcctcccaaatattgtgaagtcactgagacatgtggctgccacctctttctagccctttgtgaaactttctttttccaaccagagcctgcccccttcccaccaccttcactactaccaccccaaaggagatggaatcctttcttgtcaaattacagcactaaccttgaaactcatctccacacgttcacccctgccttcttacagtctgttttcgacagagcggccagagtgagcctgttaaacctgtcttatcaagattcttctcagctcaacattctctgatagcttcctttctcactcagagtaaaagtcaaggctttataatgatcttacagtgcacagtctgcccaccgcctcccctcccgcatttcccttctgaccttctcccgtgctcatttcactctagcttcaccagcctcctcaaacatcctacccgtgttcctgcctccaggcccttgcacttgctgtttccttcgctgggaatcctctttccccaggtagctgcatggcttggtcccttaccgtcttcaggtctttgatcaaacatcaccttagtaggccttcctctatgattctgtttaacgttggaccccttccttacccctcagttctgcctcgctttgctccttggcacataacctcttctaacatgctaaatatttcactcatttgttttgttcctagctagactcccctcactggaatgaaagcttcaatctacttggcaggaattgtttttctcttttttgtgcagtaccatatcctagaatctaaacagtgctcaataaagatttattaatcgaatgggtgaaagaatcaagtcattttcccatagcagcactatgttcagctccctcagtaggctcttctctgttagatgatgatcagcttatctgagagattattcagtaaatgggttgtgtcctctataattataatatcttcctccaagtatgtcggtggtgagtctcggtggagctctttatggtgcaaagacctcccttggagaatctgatgaaagctatagagactctccccagaaaaatacctagacacaaacaattttgcttctgacagcaaaacattttcagacacctgtagcccgtctgtacaccctagggaatgaatcccaattttaaattttagaagttactctggtgacaattgtgcagagccgatgcctcttctggcttgccgtccccttttgggctccttttctcccttgactggagagatggcccacatagtcttcacggcattcccaacttcttcctcagggctcctcctgcctgtagctggctctgagtgttcctctcactttagagggcagcacattggtgtttcagcctttttcttatcagtgggctaatttcttgccacccttctctaagggcttgtgacttctgacaactcattctcagcttactcctgcccatttcctctaaactactccttccttttagtaaggcaggcatgccttctctggatctccacactgaaacctggtccctgtcccgtctccagggagcaagcagtccaaattgcaaatcatcacactctgtccagacctgcttttgtcctcttcctccagagatgagccatctgaagttttgctcaggctattgctgagtgaggaaacaatgcattacattgttctcctttacccaacccagttttaaagtcctgaaacaggtcctatgtttttgaaattattattattagtataaatttatggagtacaggtgcaaatttgttacatgcatagattatgtagtagtggccaggtcttttagggtacccatcatccagataacacatattgtacctattaagtgatttctcatcatacaccgccttccatcccctcatccttctgagtttctgttgtccataattccatactctatgtctgtgtgtacacgttacttagctcccacttataagtcagaacatgtgatatctttctgtgtctgccttgtttcacttaaaaatggcttctagttctatcgatgttgctgcaaaagacatgatttcattctttgaaatgtcatatttactattctttggctgaacagtaagtataccattgtgtatttataccatattttcttcatccgatcatctgttgatggacagttaggttgattccatatctttgccattgtaataatcatgtgagaaacattcaagtgcaggtatctttttgttataatgatttcctttccttttggtgtatacccagtagtgggattgctggatcaaatgatagttttatttttagttttctgagaaatctccatactgttttccatagaggttgagctaatttgcattcccaccaacagtgtatgtgttttcttttctctgcatcttgaccgacatctgttatttttttactttttggtaattgccattcagagtggcgtaaggtgcgatctcattgtggtttttatttgcatttctctgatgattattaatgttgaggatttttttcatatgcatgtttgtcatttgtatgtcttctttcgcaaattgtctgctcatgtcctttacccactttttaatggggttattttgtttattgttgttgagttatttgagctccttgtagattctggatattagtcttttatcatatgcatagtttgcagctattttctcccatttagtaggttgtctgttcactctgttgattcttttgctgtacagaagctttttagcttaattaagtcctatttgtttatttttatttttgcggcctgtgcttttgaggccttagtcatgaattctttgcctagaccaatgtccagaagagttttcccttgattttattctagctttactctaggttttacagtttcagatcttacatttaagtttttaatcatcttgatttttgtatatggtgagagatagggctccagtttcattcttcagcatttggcaatcagattttcccagaaccacttattgaaaagggtgtcttttctccagggtatgttcttatagactttgtcaaagatcagttgactataaatatgtggctttattgctgggttctctattctgttccattgatctgtgtgtctgtttttataccagtgacatgctgttttggttaccatagccttgtagtataatttgaagtcaagtaatatgatgcctccagccttgttctttttgcttagggtttctttggctatttgagcccttttttggttaaatataaattttaggttttttttctagttctgtgaagaaatgacgttggtattttgatagaaattgcattgaatctgtagattgctttgggtagtatgattattttaatgataatgattttcccaatgcatgagcatgggattttttttatttgtgtcatttacaatttcttttgtcagtgattctgtagttttccttgcagagatctttcatctccttggttaaatatattcctaggtattttattttctatagctattgtaaatcagaatgccttcttgattttgttttcagctagatcgttactggtgtatagaaatgctactgatttttgtatgttgattttatatcctgaaactttactgaaagcatttatcagatctaagagttttttggtggagtctttaggtttttctagatataagatcacatcatcagcgaatagggataatttgacctcctcttttccaatttggataccacttattcctttctcttgcctgattactctgggtaggacttccagtactctattgagtaggaatggtgaaagttggcatccctgttttgttccagttcttagagggaatacttttgactttctcccattcagtatgatgttggctgtgcatttgttgcatatgacctatattattttgaggcacgttcctcctatgcctagtttgttgagaatttttattatgaacagatgctgaattttatcatatgctttttctgtgtctgttgagatgatcatatggcttttgccttaattctgtttgtgtgatgtatcacatttattgatttgtgtatattgaatcatccttacattcctgatataaaacttatttgatcatggtgtgttatctttttgatgtgctgttggatttggtttgttagtattttgttgaggatttttgagtctatattcatcagggatattggtctgtagttttcttttttgttgttgttatgtccttgtctggttttggtatcacggtgatactgaccctgcagagtgagttagggagaattctctccttctcagttttttggaacagtttcaggagggttggtattagaacttctttgtatgtttggtacaattcaactgtaaatccatctggtcctgggtttttcttttttggaagatttattgttactgattcaatctcactactcactgttggtctcttcagactttctatttctttctgcttcagtcttgggaggtatatgtttctaggaatttatccatttcctctaggttttctagtttgtgggcatctagttgttaataataatctctgatgatcttttgtatttcgatggtattagttgtaatgtctcctttttcatttctgatttgtttgtttggatctctttttttcttggttagtctagctagaagtctaacaattttgtttatctttttgaaaagccaacttttcattttgttgatcccttgtattgtttctttggtttctgtttcatttagttctgctctgacctttgttatttcttttcttctgcttattttgagtttggtctgttcttgcttttctagtttcttgaggtttgaagttaggttgttaatttgtactctttctactttttgatgtaggcatttaatgctattaacatccctctttgcactgcttttgcagtagcctacaagttttggtatgtttttgtattttcatttgtttaaaaaatttttagatttctatcttaatttcttcattgacccaatgatcattcggtagcatgttatttagtttccatgtatttgtgtagtttttgaagttcctcttggtattgatttctagttttattccactgtggtctgagaagatacttgatatgatttcagtttttaaaaattttttgggacttgttttgtggcctgacatatggcctgtcttggagactgttccctgtgttgttgagaagaatgtgtattttgcaattgttatatagaatgttctgtaaaagtctattcatcccatttggtataaagtctaatttaagacttttaaatttattttctgtctagatgatctgggtaatgctgagaatggggtgttgagttcccactattactgtgttgctgtcaatctcttttttagttttaggtcagtaatatttgtttcatgaatctggatgctccgtgttgagtgcatatgtatttagaattgttatatcagttcatttatatagttccaaatgactcactttgttcattcctttttattcttttttctttatttttgcctggctggattatttcaaaatacttgtattcaggttctgaaattctgccttttgcttggtctagtctgctgttgcagcttttgaatgttttctgtaattcctccaataaatgtattttgttctagaattcctgtttggatttttaaaaagatatctatcttcttggtaaatttatcattcatatcctgaactgattttcttatttctttgtattgattttagatttctcttgcatctaattaggcttccttaaaatcaatattttggattctttatctgggattttgaggagtttttttggttaggagctattgctagagaattattgttttcctttgagggtgtcatattacattgctttttcgtgcttcctgtattgttacattgatttctgcacatctgaagcaatagtcacttcctcttatttttgaatttacattcattatggggtggggacattttttcttgaagatgtgactatgatgttggttgggtagggccatttgactttgcttcttagtgtgtgcagtggtgaagatgctgtatgatttccttggtcataaatagccttagtggtatctatggattccttagtgtgttagggtgcagttattggttactttttcaggtttcagtggtagcagtggtgggccaagtgtgtttctccttgagacctcaggcagcatatgctggcacctgtactggcagttccaggcaagtcgattcttgggcctgtggggggcttttttggatgctgattgtagtagtggtgtactgggcaggtgagtgggcttttgaccttttgggcagcgaggatggtgggggcagtgggtataaaggtggtcatgaaatgttcttctagttctcaagcacagtgcttttgtgttagccgttgtttcaagtttcaatgggctgtgtgggccagcctccaggctagtagatggtgcttgcaggtaacaacgagcggtgggggtagcatggagatttatgcccgacctctgttccccagaagaggtatttgggtaacccaggtggtagttgggttgtggaacacccaggagcctggatcccacactctgtcttggagtagggggcaaagttgggcagagctggaccaagcaagcttgtattcaggccctccaatggcatatgcatgcaccagccttgattagggggtagaggaagtccttaggccgcttgtgaaatgcttggtgaggggcaacctttgctgtcctgaagtcttaggatagggaggatagggctgtcccagtggccactgctttggcccacaggaatgagacttgctttcgtctcacaccccagtcccagcaaagttccctcctccatcctggctatggcagccaacttggccacccagtcagtcctggcaggctgcacctagtccacaactcagtcctaggccataggagatgccattcagcttaaggccaagcctccacaacaactctcctcttgcttaggacctgggatggtggtgtgcctggttgcaatgccagtggctggagcccactccacacttgcttctcagaacgggccgcaagggttcatcccccgctcaagccccagtcctgcaagcaccacccaagttctcccatgcacagcctgtaagagctccgatccagaatgttgtcccacagcagccagccaggtttcaaaaagggtgtaggacattccctggagcagttccatatcatagtcttcttgccactccccaggttaagattcgtggtgtgggagagtcaaggtgctctcctacggcctggattgtataattccccagtgggaaagtggacagcagaaaggcactcactcaccctctcccatttgggggattcgctcccctttcccagctggcctcagccacacagctttcctgttttctttcttcctggatttcaaagcttcctctcacttttttgttgaactcccaagttctttcttgaacactgcatttaaagtgcagttgtctgcacacttgcttggtttctctaagcggatgagattactggaaatgcttgtagtcagccatcttgaaaaaaaagatcttgtgttttaagcatcattgtgtgtttgccaacaggaagcatactgtatgtaaatattgaattgttatataccttggatttcttttctcctttcattcttttaagttctctgcacccttatgagcatgatttcctaatccacagcacaatttagcctggaggggtgtgcaatcattgttattccatgtgttctggtctttctcaccagctacatttgatattaaaatagatgatatttacttatttccatgaattccctcatctctcctgccctcagctcctaacaacagacagatacttatttattcatttggtcaacaactctttctttaatatgtgctatgtgcccagttctatgctaacactggggcacaacagtgagaaagagagagaaagaggagagagaaaaaaaaaaagccaaagtcttttctctcaaagagctcacaagctaggagaagacacagcaattacttttaaagagccaagggaaaacatagttacaactgtgaaaagagccatgtgggaaaaacacatgacactatatgaggaaaaaatatctttgtcaagtaggtcaaggaaggcttccttgaaatagtgatgattaagcttaactctggaaggccagcagaagctaactagacagaaaagggggaagcagaatggtgtcttagtcacagggaatagcatgtgcaaaggtcctgtgacagaaagaagaacaggctctggagtgaggggagggtaataaaaggggagatagctttgttaaggatgttggtcttcatcctaacagcaataggtagtcattggggatttcaaggaaaaaggtgaaaaaaatcagattctatttaaaagatcattctacttgctgtgtggaaaatggattgggctggaggtggcagatcagaatgaaagcaggagaccagatatgaaactcaagccattgtccaggcagaaaggacagatggtgggttggacacgggtggtggcagtggagatgcagaaaagcaaacaggtttgcacaatgttttggaggcaacattgccagggggtgggagtgaatttgatatgcagagagaatgtggagtcagatgagtccgtgattcctggcctattaatgaatggagaataaacactgggttggcagcatgagacagccccggggcccttcctgacaaccttgcctgtctctctgtaatgctgagagcctgtttgccatctcctgggtatgtctgatagggttgctgcactatttactgtatctgctcatcaggaggacaaaatcatctcagtctacccaacaaactgccttcaagatcattatctctgaaggcccccatggagccatgtgcaactctgaaagcatttccagggaatggtgggctggcttcataaacgctaagtgaaattctgtgtttctgccagacacattgatatatagaacaatgctggtaagggttcccgcgtgggattttttttaacccacctgggaggtatcccctgaacggcagttgacaattagctgctaagtaaaaggaggcacttatttttattgcggtccttgacagctttatgttcactgtttaaaagctggagagtcctgtgtgtaaaggtgagtggcgaggggaagtgctgggggaagaagggccgggagggctggggcaggtgcagacagatcccatggtttcctttttggagtcagaacctgagcagtatttgcaagcatgtgctgatctggaagtgagagaagagggttcttccagtctggggaggagggaaggcctgaggctggctcatcggaggcgtgagtcttcggccctgccatgcctcacatccccaggatgccgcggtgggaactgggctgtggctttcctgccctggcactgcttgtttgctgggatttcaggaggaaaacccccaagctccgaaagaaaggtatttcttttttattttgtagttcacttcttccactagaagactcgtttcccagagcctctaccctctcctgtcaggggtggggagcgcttctggaactgataccctgggaaggaggtatcagtgctgagcgggcaggcacagtgtgtatgggggtggggagctctccctgaggcctgggctgggctagaggcagggtggggaggggctcttgtcctgatcttaggagtgtttcagtgatgacaaaggaggaccaaggtagggagggaggtgacagttgctctttctatttccacttccccaaagcaacccagtttcctggagttttccagcaaatctaaggaaggggttgagggttaaggggtggagatggattgtggggagagctagggcagttactagtgtggtagtgaggcctcacccttctgtggttgttcaggatggggtccaaaattttaggtctgaggactggagacaaggcgaacatggtatgaggggaggtggggctggcatgggctggcatggtctggcattagaggaactcccttgagactttatgatctctgaacttttattccattagctttaaactctaaagggaaataaagcactgaatatagaatcacagggtaaatatgacctcggaaaaattcctgactcaaatctcagttttctcatctgtaaaatggaacaataatatttactttgtagagttctcatgaggactaaatgagatagcacatgtgaaagtatctggggtcagttctcagcataaaattaatgtcattaattacattggttaatagttataattatcatattacatatattataattacattatggtaattatattacttataattattataataaattcatgaaaatttatacctattaagatggaaatgctctgctaatggccaaaggggtgacaattaggacccagaggtcagacactggtataactcaggaccaggtctttggagttccagggatgtttctgattccaaactcctcatgtgatctgagattaagagtgacaaaacctgacttagccaagctaaaaaaaaacaaagatgatttttctctcatgtaagaagtgacactgttggtcctgatgtctccagagcatccagtggttggttcttgttgagagaatagctttgacggatttctaggctgcagatgtcaagttcaaagtcttcatcatatgggtgatatttaaagtggtgagactctgagaaagtgtgcagatgagggagggaggccctgggaccctccaacatgtagaggacagcaaggacaggaagaatcctcagaggaggctaaaagcatctgatgagacacacggagaaccaagagggactggtgtgccaaaagccacatgagaaagtgtcccaagaagaaggaggtggcttgctgtatcacttgctgctgatagagtagttaagatgaagacagagaatttcatctcagattttaaaatgtaaaggccattggtctccttgacaagaataggtttggggaagtactgagtagagaaaaggggcagagaatgggaggaatgggaggcagcaggtagtgacagctctctgaggtccatcacataccaggttctgaaaacagatgctgagccagatggactgtctgcctttgaggggtccacagtccagtggaagagagggatgtttaagtgaatcatcataaaattacatgacagtgataacatcgaggaacacacagggagctctatgagtagaggaaagagtgaccagttttctctgagaagacatccaaattcagaagactgggtttccaggtggagagtaggaggaagggcattctcttgagaattttttaaaagcaaaaaccatttttcattcttcctttcatactctctaactatcaaagagcctggcccacagcaaatgctcagcctacatttgttgaatgactttgtgaattctggtggaaggaatttgcaagaaacagagttgcaaaagaaaccattataacgatataggcagcagcagtgggaatagggagcttgtttaaagcatatttggaatgtaccaacctaggccgggcgcggtggctcatgcctgtaatccagcactttgagaggccaaggtgggcagatcacgaggtcaggagatcgagaccttcctggctaacacggagaaaccccgtctctactaaaaatacaaaatatcatccaggtgtggtggcacgtgcctgtagtcccagctactcgggaggcttaggcaggagaatctcttgaacccgggagaaggaagtttcagtgagccaagattgcgccactgcaccctagcctggatgacaaagcaagactccatctcaaaaaaaaaaaaaaaaaaaaaagaatgtgccaacctatttggggagagtgaagagtgttgcggataattctaatgctcacaattttgctaattgggttagttaagtgcaggtaccttgtattaatggctttgtattttcagtgcctaggagagtacctggcacttgatgatggaatgaagctattgcctttgaggaaggctacaggagaagcagtgatttagggatgggatgatagtgagattagagaagatactgggagaattgccattagacattgaacttatgggaatagaggagaaagagagagagagagagagagagagaaaagatggaaatagatatgatataactacatatacaatgataaaataaaacactttttttatgagtataatactaaagagagaaaagcaaatgttggtcatttgcatgagagctgaggtgggggattattctttcataaattatatctatcaatccatatgtacacacacatatatccatatatacacatatatccatatatacacatatgtgtgtgtatatatatacacacacatatatacacatatatatacacacatatacatacatacatatatatatatatagagagagagatctggaccagatatgcagattaataagttataagtttataggtgatatctaaatgtgtggaatcatatgcactttcctaaggagaatactagagtgagaagaaaagaagcctgagttggaatcccaggaaatgatgcaccaaacgagcaggtggaagatggagcacagtcaaagacacttgaaaggagtcatcagtgacatgagcatagaacaggaatgattggatttattgcaatgtagggagaaagtattgaagaggaaggagaattaacaacatcagtcttcagagaagatcagtaagtagggtgtggaatgaacattaggagagcactagaaatcttagtgagcagatttagtgaagaagtgcaggctaatgaaaccagattgtgatgggttgagaggctgagtagtgagtgataagtgaggaagtggggcagacatctctctagaagtagacatttttattacaagtatatggtaaagagaaggaaggcaaatgttggtcatttgcatgagaactgaggtgggagattattctttcataaatggcaaagacttagacccacgtgggatctttcaattgaaagagaaaatttcaacatacaaagagaaacagtaagtactggaagagatggaaggaatggaacccacagttcaagaaggcatcatcctagatgaaaggtagggcccttttcttcctctgggagaagacaggaacacagaggagaaaggatgggaaaggcagggactggagatgagggagttcactcgtaaccctccatttgataatggaaggaaagaggagccaagatcacctgttgagacagagaagggagggaatgggtggggagctcaacaggagtggcaaaaatttggaaccagtgtcttgcagagattggaaggataaatttccacaatatggttgtgcatggtcttttgtagttctcagtggcctgatgaagacacgcaaagggtagtaggaagcagcagggcggggatgttgaagaaaaaagtatgggtcagattaatattgaaagggctgcatttgaggcatgagagaaatagaggatgaaggcaggacaaggctgatagactgggatgaggagaaaagctagagaactagacatatattaaggtgcaagaaggagcttggccccaaatcatctgcaaggtggagcatctcctataagacctcagaaatggagcttgaatttgaaagctttgacttctctgtgcacatccttacattgtgtttgtgctatctttccccatcaagtccagtggacctctggagcctgagtttcaactgttccaagagacatctgcctctctcattgaagggcccctctctggacctctcaaaagagaattttcctgatgctatctggtctgttttaagtcggaatatttcaatcatgtcctatcaatttggtgaaaagatctgtccagctccttttacagacaaatagaaacctaattccatatggttattgaaattttctaattgtttctcaccatgttttgtgtgacccctcaaaggcagacagtccatctgttatgttattttcataacttgttggcaaactcattaaaagcaggaacaaggtcttccatgtcccttgtctgtacaacccattccatggaacctggtgctggcacatggcagggcactcaatgcatgctagtgggaagctgaattcatatatcaaggagattcctattagtgtttaaactaaagaaatgccgaataaccattagtcatgtgaaatacttgcttaaagacaaattgattcattaaatccttcagcaaaatttgttgactgtctaccttttgccaggggttacactagacattggggatgaaaacagcctttcctcctattctcagtagcagggagcttacaatcatgcagatgacacaggtacatacaaatcatgatcacagagtgcgggaaggattgggatattcaagaaacaatacggtgcacagagtaggatgtagtccctccatctggatgtcaggaaggcatggcagatatgatgatatttgagaggggccaaggaggagaaaaagaattttgtcctctttgtcctcctggtgcagccagggaagggggagagcagactggacagggaggagactgttcaaggacatggagactgcagagcattacgttttggaaacgtcagtgtgagttgcttcttggggcatggcaggacatcaggccaggaaagcaggtgggtgccaagccttgaggaatgccagccttgattctcaaactttagccacagaagtatctaatcacagtctcaccgcaatgcaataagtgaaacgaacaacagccaagcagatttggtggtagtggggaatacagaggccacctattcagctccttctagattccacactctcacctcccaacacctgatgtgatgaaagaggagtccctgatgaactgccagggctttaaatgtctatttgaaaaccatcactgtggcagttgggagagaagcagatgagtactgaaaaccaagagaaaggcgctcaagcagaatgatgctttagaaaggcaagcagcaggagggtttcgaacatgatagagagaagagactgtagcggttacaggtgagagaggaggctggcctacgctgggtagtgggtaggagcggaaaagaacatgagggtcaagagcctggtacagctctatacaggtggaatccacaggaactcgaggtgggatggaggggaccaacgtgagagagagaatcatggggagagtcaagtgactttgcaaacggatgtcctagggattgaagtgctgggtgcagcagagccctgattatggcagagggaaagtcacgcaggacaggacagaagccacggcctgtcttctgaacctccagggtatggaagcctggtgggagaatggataggcagtggttgtcctgatttgtaaatttgtcttctcacactgccggtgcggggaaactgtggagcaaagtttctccacgcagacagagctggggtggagctggcccacacttgctttgctggaggcagggtaatttgggaaaatatttttggaaagcaatttgcatgccatcaagttataaaaatgttcaaacctcttgacccagtaattctacacttgggaatttgtcctaaggaaatagttcaaaagaatgaaacgcttttgttcatgcatccaaatgttaattaattagaaattatgcattgtactgcatacattccaggatctctgccaggtgaatgaacgtgtttgctgtggcaatgtttataattaggacatagtaaacaacctaaattattttaaatgccacagtggtttagtgagatgaaacatctatgtgatagactacagtagtccctctttatccttggggggatacatttcaagaccgcagtggatgcctgagatctcaggtagtactgaaccctatacacattatgtcttttcagtcttataactgagacaactactaagtataactgagacaactactacgcgactcctgggcaagtagtgtatataacgtggatacactggacaaagggatgactcacatcttaggctggaccgagcgggaccgcgagagatttcatcatgctactcagaatgacatgcaatttaaaacttatgaactgtttgtttctggaattttgcatttaatattttcagactgcagttgaccgtggataagggaggatgccatactgtgttatgctttactactctgtgacgccagtggaactcaaaacggcctgcttgctgccgtggttaaggcatattgttgggagttcactgcctaggcctgaatcccaactgtgtcatgctctgagctgcctgactttggcaagtgtctaaggctcagtgtctttaacagtaaggtgcgtgtgacattaataccatctcatggggttgctgtcaaggttaaaggacaaaaagtgtgcaattcctagcaaaagaattcagtaaaagccaaccattattttaaatatgtaagaaatgtgggtcaatataaaaagactgataaagactgcctcaaatttacaggcccctatttatagcttcaggaaatattctgagtgatttatctcccatattttgtctagtatcattgcaataaaacctgtgaagacacaggtgacacagaaagtcaagaaatagttcatccaaggaagcacagaatgacgggcaggttctgtttgctctctcctcagcagtgtttggccagcgcttggatgagactgtggcctatgaacagaaattcggcccccatctggtgcccatcctggtggagaaatgtgcagagttcatcctggagcacggccggaatgaagagggcatcttccgtctgcctgggcaggacaacctggtgaagcagctgagagacgcttttgatgctggggagcggccctcctttgacaggtacattgccccactgcagtgtcccacctctgccctcccctctgcttggcttggctgggagggcctctccattccagttgagctatgggacttgcatagagacttctaagagccctggcttacaacagaaagagcctttgtttcgcccatgattgggaatttgggagacgggagcacagttaggagagtgtgcagatagtttatgtgacagatgatgtgaaccagaactggaaccctgctgggcagattcaggtgatgtttaaggcacaggagaaggtgatgtgcagaggaggggagaaagatgggacgttgcctgaggctcacccttcaggacagatgaggaacatggaagagctgagctgtacaaacactcagtgtagtggagaatgcaccagatctatatccaagggcaccagcggctttcgttagcattccagaagtggctagaaccaggacttcttgttagtttcctggatcacagtactacgtgattctgactcagttctgagcccttttgcaggagcacatcctgatatcttggccgcctggcattcctaagtgtggaggtctcccagccctgtttggggcatatcaggcatagtgacatttcctcccaccacccccttcctccccaccttctccagccactcagctgaggtttccttctctgccacactcagctagtaaaatccccacccgatgttgtgcaatctccaccccagttgcctgcgtgaacttgtcctgctggcataagattgactgctctttccaaattagcagcccataaaccaaggtttaataagatgggcctgaactctacccagtttccaaaaatgaaagttgctaagcttattttggacaatggggttgggttgattctgagaaaattgtgaagacctaagtgtcatcttgtgtagaagctccctcacccctcactctaatcaccaacgccgcccatttttcctccaaagcttctctgaggtctatatgtttctctccatgcttatggccacagttgtagtttggacaaccataggggtgtctttcttgcccttaataagttaatttcccatgggtgctatattttagcaccctaggaagcaagagatggggttcttattggaacaatagcccgttattggcatcaaacacagggacctttcagcagcaccataaactgcaccttgttatcaggcacttgttccattatgctcaccacctttatattcagtttctttttatgttttcagttaaccttggcctgaagaaagatacaggtgggttgttgctagagcaatgccatatagtgtgccaaaaggaatagaggtgattgctgggatatgccaaataactgccttaggctctagcctatgcactatggagttggcatgggtggtggtgtgggaatctttgattattttgaaatatttgaggctggaagaaggaaaattaccttaccttgcgacatctccacccctagaagtgaggggtagggtttttacacatccagaaataggaaaggtcatcgggggcttttcaggggcttcgcaggggcaactcttaggtccacataacccttgagaggacaagtctgatttgggaggtatgactgactcttatttgattcttattatttagttacatttgggcatatttaggagagaccaggtcttctctctcctattccactcatgattctgaaaaccctcttttcccctttttctgccctctctccacccccttttatactcccctacttctcattccatggtgtgttttggtgttgagggctgtgccccgcaatgggcagagcatagaatgccggatgcatagggtagggaaaggaggggaggggcttacagggatcaggctgactttgggatcatagaattgacaaaaccaataactcaagacaggtcaacaaaactggcaaattaactctgaagtgaaagtgaccagtgttagatgatttcctgagagtgattctggcctgggagtgggagaggaagagaccagccttgagacagtgttaacctgaattgtgtgtgggagttctgaagaggggcagtgtgaaagggggtggaaagagggcaggaaagggggaaagggagggttttcagagtcaagagcagaccaggagtgagaagctatggttgtagctttttctgcctcctataaaaggaattctaggagtcagtgggtggaagaaggggtatttgggagagcaaggagctccctcttgctgtccccaacttcacggctgtgggaactcacccagatcctctgcattggttatgtgctggattccaccccaagatgcccccattacctcactagaatgaaggtgagcaaagttgctgtttggtgagactagtgcaggtctttctggtctccttagacacaaaaatgtgaactttaaaatctccttgccaagtttctaccaggatggacactgcctggctacaaagctaacacacttctcacccctatgtgtctgtgagaaatgcacttacagacatgccacattacaagcatcaatgcccccagggaagggctggcagaaccatctgagtcttgggtaatccctagtgcatcagccgttgaacccagaagccacctggctcctgacttactcttagcccttgattaaaaaaaaaaaaaaaaaaagaatcatttaagggtgctctattgggttagaggaacagcaaactcagaaaaaataatgctacaaatttagaccataaaatagacatctgagttagccctagtacaatggggtgctcacattaaaataaaaatttatagaaataattgtttaagttccatggtgttaagtgctaaaaaggaaactcaacactatgaaaacttagaacaggggcttttcacatggtcttgtgtatttagggaggtccccaagaaaatgacatttaagctgagacccaataaacaagaatgagagttagcaaggcccagcagtgggcatggcttgtcaggattatttttggtgaaatgaactgggaagctttctgtaagtttcagtgttgtaagatgatttatatagctaattttgctcttttattataactttgaagtatccatggtgtagctgtatttataatccctttctcttttctaatgatggatgcttttgctgtctaaatttctcctgattaaactgtctaggtgtcttttttattgttgttgtttctcttcaaaagttcaaaagatccaatttcttttcttttcttctctttttttttttttttttttttgagaccaaggctagagtgcagtggtttcacccaggctagagttcagtggtgtgatcttggctcactgcaacctctgcctcctggattcaagttattctcctgcctcagcctcctgagtagctgggattaaaggcacctgccaccacgcccagccaatttttgtatttttagtagagatggggttttgtcctgttggctaggctggtctcgaactcctgacctcaagttctccacccgccttggcctcccgaagtgctgggactacagacataagccactgttcccagccaggatccagtttcttgaattatcctttacactgtttcttccctttcaaactctgttttcttcactcattccattggtgtgttttggtgttgaggactgtgccctagagtgggcagagtatagaatgctggaggcatagggtagtgaaaggaggggagaggcttacaaggatcagtgtgactttaggataatagaattgaagggatttggaagactgattggatgggggtgaaggagaggtcccaatcaaacaggagtcccaggatgctgatagagacaaatgggtggattgcagtgtagggactttaggaagatgcaacttttggactttgggagaattctgctcctgcaaattgtcagctgactgtctttctgccactttctcgggaacttctcataacatattttgacaaaagtactttttctagcctggctttgccttgggtatttttgggcagtgactcagcagggaaggattttccagaatccccatgttaaatgaatggttcctaccccagatttcctgagggcagccatggagcatagagtgggctctgtgccagcccgtgttctcctattgaggtagagttcacaggctgcaaaggggaagccttttcagagacagctacaacaactggctgtcaaaaccaaagtaaaatgcacacaaagcaccaagacagagctttacaatcaagccccagtattcttgcttctgttgcctcacatgcctcccttctcctcctcttgtccagatccacccctcccttccctcctaggaccaggagacatgttctccagcctattctatatttctcatcactgaaatcaaggagattccaaggttattctggacctcttgccacatcacagcttttcacgatgctaccagggctgctacctaagaatgccaggttttatcaatatgaaataaacaaacatttcttcaataatcagcttcaggaatatggtagtgaatcttattttcccttgtagtgttgcagaatcaatgcaatcgccttgtaagccaggggtcaacaaacttttcttaatgggccacatattaaatatttaggctttgcaggccagatggtctttattgcaactataatactctgctcagtacataaatgaacaagtgtggtggtgttcttctataattttacttacagatgctgacatctgaatttcctgtaatttttacatcacgacacactcttcttcttgtgagtgttttttcccccagctatttaaaaatgtaaaaataattcttagctcccaggctgtacaaatagaggcagtgggacagatttggctcctggcccgtggcttgccaagccctcctgtaaatggagaagctgaactgaacagccgtgcctctttcagtcaatcaggcccacggggaggcgtcctctcctcatgctccaggctgacacacatgctgcctgcctcatgccctaactcctcaccgcctttcagagttcatctgaggtactctttcatctgacaagtcacctatgtgttcccatctctgccttgggtgttctttttccatacttccataggatcctgggtcctgggcttcccatatcatggcattagccgcacagtattgtaaggacattttaatacttgagtccccagagttctgtggctcgatggggccagggctccatccctggattggatggctactgatgtcccttggattggctactgaaatcccagtgcttgacaagtatcttgcagtatcttgcacctaataggttttcttgatgcttattgattgagtgaattattgagtaaatacgtgagtgaacctcagaactattttaagcactctggaagattaaagagaagaatggaccaaggatataaaggagttaacacaagcaatattagagactaattagacaatgctaattgtgaggcactaaatgacttgaagaaagaagaaagcaataaagacgaaaatcattaaggaacgtttagtaaaaatgtagaccttgaacttacctttgaggtagttgggtggaagagacagaggaacatttattcaagaatgttgttccagaagggcgaattaacaaaaatgttttggtctgattcttctttatcagactactcctctgcaaaatttccctttgtaatttatggttctattcactgaatcatcagaatggaagagaggaacatcctaaagtttttctttcaaagagtttcacagagcgttgcttattttcttccagagacacagatgtgcacactgtggcttccctgttaaagctctacctccgagacctcccagagcccgtggttccctggagccagtacgaagggttcctgctctgtgggcagctcacgaatgcggatgaggcaaaggtttgcatcttagagttagttgtcctgccttagaagaaagtgattggttttctggacactaatccagtaggcaacagtgggtcaaggggcctgtactttttggtaagatagtcaaatgcaacttcctcagcaacaaaaggtatatgaactcaatcataatgactggcaaaccacagccttcatgagatgcaataatccaataaagaattggaccataatcaaatactgctagatcacattaaaagtagtgagaaaaggaggatacatcggaggacggtttcaagcatgatggccttgctgagacttgctgggacacaaggacaggctggaaggcaggtgtgaggtcacatagctcaagctctacagcagctgtgagtgtcaggcgtggtcatccaaggaatgcatgtgccagggagaagaaggacagggagggttttttgattgtttttcttttcagccacagctgcctgtagggtctgtaaccaccatctgcaatatgcttgtgagagtgcacaagttcactaacaagatttttgatcctgtataaatttatttctagagaggccttatagtcaacaatgaccacactgtagtcatgttattataatcaaccaaccaaccaaacaaccaaagaaactgatgaaacccaaccaacaacaataaaccttgatgatttttaaacaagattttcaaatccaagtgatccatgaagaagttgatgtttatatcgactatgttaaaagccctctctggcaaaatggtgcacagaaaaatctataatgagacctagatttaaccttgattttgccattagacaaattatgcatcttttataagactcagtttatttacttagaccaatagaactttctatggtaatggaacttttatatatctgcaccgttcaatatggtgaccaccagccacacatggctattgggcatctaaaatgtggctagtgcacctgggaagccaaattcctaattttatttaattttgatttagttaaatttaagtagttacatgtggcaagtaactgctatattagacaccacaaacttagataattttcatagtaatatcagccatgcctaggattgttttgaggacccagggatatgatactggtgggtgactttaaaatttttttcaatataagggaaggtttattatcttccacacttcaaaatttattagatagtctgcttcatagaatatatttatttaaaacgaatgaagaaatagcaccctagccctgcaagaaaacacagctgtgagaacttccatccctgactaagggtggggagagcatcatgatttgaatagatcctgacataagagaaaagctgactttatatttcaaaattaagaaaggaagagaacatgatacaggttttgtagctcttttccaaacaaaaattagattgcatggatctgaggtacgatattttgtgcgtaacttaagaattttattgggggagggagaaagggatatgaaaagtcttaacttatactggtatatctgctcaccattgtgaaagtaataaaattttatggaataaggtttaaaaggcagctaaaaagataaacgtttcagatcgcatctcacccctgggttctggggaaagtaaaggaggcagctagatgctgttctgacaataagattcccacccctgcactcactttagacttgcttctcccagctttcttaatctcagcatctttgagagtttccacatctgtggcaatgcatgtctacacacagggaccaaggtccttctcactggtgaaaacatggcagaggtggcagctaggaggggtgagtctgtagcaacctttgcaatgaatttactcgactcaactgaagaagggatctcagcatgaagctgatgctacgctaagaaggtctatatctacggaagctgctgcgtgtaggctgacaaggctggagggtgcgttttctgcaggagagctgctcaggtttgaggagtgcctgcacaccggcatgtgaattgtgtactctctttttttttttttttttttttttttgagatggagtttggctctttcgcccaggctggagtgcagtggcgcgatctcagctcactgcaatctccgccttccggtttcaagcgattcttctgcctcagcctcccgagtagctggggttacagccgtccgccaccacgcccggctagtgaattgtgtactctcacaagcaccatgttgcagatggtgattacagaccctacaggcagctgtggttgaaaagaacacggaaaagctcgctgtccctcttctctccagcacatgcattcctagtagaccttgcctgacatccacggccatccattgcagagcttgaacagtctgaccttgcaccgtcctccagcgtggtctgcctgtctctgtgtcccggcatgtctcagataggccacagtgcttgaaatccttctcagaagaatcctccttttctcaccagtcttaaagtgattctgagatatcttattgtggtcttattctttattggattgttacctctcaagcattcattcagcaaacaattaacgtatgagttgttaaacagtccttccttagagtagctcagggtcaagggtggggtgcagtggcataattacatataaataaaagtatacataacaaaaactatgacccttttaaaaaaaattctgtgagaattgagttatttccctttttttttttaaacccacagaactacaggaacaggaatgactgccaaagtgttgtttctgcacagatacaccaattctgtcccagggtctccttgctggcacatgggcaggctcatttactggtaaatgatttacttgtgtaaatctcttcccaggctcagcaggagttgatgaagcagctctccatccttcctcgtgacaactatagtctcctgagctacatctgcaggtgagaggcccctggtatcaactctgcagttttcaaccccatcagaaagaagctcctagttagaagaggagggaccacgtctgtgaacagagagattctggtctagcactttggaagatcagctgtattcacatagcactgaagtagcttcctgtataatttcaaggattctgaaaacctggttgaaccaaaaaatgaacgtgctcccccatttaggcctgcctcagcactgcccagagtcctggtacatgcaagagaacccagaatccttataatgtttctagaatgatctcccatctttgtgattctgagccgtagcttagctccagggagacattcattctgggccaccctggttattttccttcagccctttctggggacctgctgtgcgccacccctgtggcaactctagctgtggattgacccagatctggctcggctgggaactgggatcttcatcccagactgacctgaattttgtcttttattttttaaaaataatttgttgtagttcctagattataaaagtcatgcttgcttgacttggaaaccaggaagatatagcaaacagtaaatgagaaataaaaaggacccacaatcccttcaccagcaacaagcactattaacactttggcatttttccttctgggtgttttctctctgtgataaatctttacataccttaatgtaaatataggggaataatattttatactaaatcaaaattatataaaggattgtgtccttttttttggtttaatgttttattatgagcatttccctatgtcataaaattggattataaataacttcataatatttcataatgtttcatcatttggacacgtcaccaatatttaataattgctctgtatttgaaattgtgttgcttcattctatccatttttaaatggttctttgagagagtatttagaaattccctgtttttacagtgaatctgagagctttgtgcctcaaaggggtagaattttaacaaaaattcagtattagttatggagaacctgctgagaattagcaatgcttgtgctctaatcagaggatgagagcaaggaggcaccatggattccccaggcctgagatcttcttaccaataaagttttcctctctggagacttgggtgggatgagtgctgagagctgggagataagcctatcaaggcagacatgggtatgggcagatacccattttaccttttctagtccagtctgagctcctggaagtggatcttgcctcctgcttatgtgattccattcacctccccatcccccaccccagcagctgggcaggaccctcctgatttctcttccttccttggtcttgggtctttcaggatgaggctaaattcttgtgggcagagcaggctggtctcattcctgagtctgggaggaaagcattggatccatccctgagttctcattggaaccctgtagtgcttcctcctggctacttcctgctttctaccatgggatttcttggctgtctgtaggttcctacatgaaatacagctgaactgtgctgttaacaagatgagtgtggacaacctggctactgtgattggtgtgaatctcatcaggtcgaaggtcgaagaccctgccgtgatcatgagaggtatggctggtcccgtagtgaaagcaggtacccaggaaataacaattacaacattccccctgatatttgtgcactgctctgtagtttcccaagcattttaagctggttatcaatctcatctgaatcatgcaatagccttgtgaggtaggcagggcaggaattgtgtccatttttcagatcacaacaaaggacagaggtcaagggtttgcccaatggtcccacagtgcagtagactagtacaataatagctagctagtgtttgtcagtcttttattacttttaaatacccttagccagattgagcaagcaggtttcattttattttattttatttttatttaggtatttattgagttggagcctcactctgttgcctaggctggagtgcagtggtgcaaacttagctcactgtaatctctgcctccagggttcaagtgattctcctgcctcagcctcccaagtagctgggactacaggcataaacccccacacccagataatttttgtaattttagtagagacagggttttaccatgttggccaggctggtctcgaactcctgacctcaagtgatcttcccacctcggcctcccaaagtgctgggattacaggcgtgagccgctgtgcccagccagctttcattttacaagccagcccacaaaaaggctgcttaaaaagctgtgctgtgcaggcttctgaggctgtgtcctgacacagagtactgatatctgccatgggcatgggggcagaaagcctggcacatatttgctctgtgtctgataagaaaccagatatcatattgaggaccacatcaggagagaaagatatcttcattttctctgctgttttattgcctactttcctgatcaaaaactaatccagtggactattggctccctctgaaacagctccctcttttattctactcccgtgtccttctgttccatccctttcaacataatctccaactccaagcaattaaaaagggtcttttgagaagcaaaatgaggcccttctgggccctatagttttagaaccgagtttggagacatccacgggtggggatccttgaggactgactacctgcctcctacactacacaacagatctttttcttctgtctttcagggactcctcagatccaaagagtgatgactatgatgatcagagaccatgaagtcctcttccccaagtccaaggatatacccctgtcaccccctgcccagaaaaatgaccccaagaaagctccagtggcccgaagctctgtaggctgggatgccactgaagacctccgaatttctaggacagacagcttcagtagcatggtaaggtgcagagaaccttcctgcttccattgggttcttcctttagtccaggccatcccatgtaaggcctgctctcgggtggcaatttggggagttttaggtgatgcagtggcagtgggcgctgctgctacagactcatctgaacacaccttgaaagcctggcctctttccaaatctagtttctattggcatctttgaggggggtgagtgacaagtgtgccaatcacccagtgactgagcaatgaggtcctcactgaagcccactctgaaagagagactcaaatacagtccagagaagttcagtgggaaaaatgtatacaacattgtaaatgttttggtcagaattgttgaaaattctgggtgaacgtccagagaaaactggtttcctgctaacccatgaaacgtgattcctttctcagagtatgtgatgtgtttgtgtaatatttctcattcctcgataagccgtctcagccatgtcagcccccacatttgtgctgaagggttgaaactcacgttcccaatgtccaaaagctctgctgactctgaaatgtagacctcgtgaggacaataatttacaaaggtcaaatatttttatatatttataggaacaaatatttttacaaagaacatgtgaactttatatagtagcttgatctttatgtgtggccaaaaaatggatttcaaatttctagttgaccagatgattcaagttacctacagtactgttagccctgaagattgtttttaaaaggcaggtagtgggtagtggttgtagtttttcttaggataggtctttctgaaggcaatgcattctactaacactctaaaactaaaataaaatttaaaaatgctcatacttcatgtaacaagatcatcccacagtccttgagaatagctattattttactcatttaataggtttctgccatttactgatttctgtgggcaggcactatgctgggaaatttacactgatcacctctagagtcctcatattacataacattgtagggcagaatttatcattcgtattgtgttattgaggagcagaaactcagagaggttgagcagctggcccaatgtagtagcactagcttgttatagaggaggactcagatccagtcctcccttcagaacccaggtacctctaactccgggtggggtttctgaagcaagcaattggctgcaaaggttaaagggagggctcgaacctgattgtctgattttatgtttaggtctcacttgatcttagccaaaaggccgagaagtgattgattttgtgtttaggtctcatattctctctcctttttctttataatttcattaaaaaatatataatatatgcacatggttcaagtaatcaaaaagatagaaaaaggtatacgttgagaagttctgctccctcccgtatccccacccaccccatccctcactgccttagtttcttatttatccttccaatgttcctttatgaaaatataagaagacatgagtgtaaattatttacctccttttttacacaaaatgtagtataattctctctctctctacagtcacacacatacacatacagtcacacacaaactcccacacaaaactatgtatcttgcatttttgtacttagcagtatattctggagactttttcatgtcaatacataaacagctacctcatatgacctcatgttttctagaggtgtatagtgtcccattctgtagatgtaccagtccctatagatgaacacactgccttcagttcttttctttttctttcttttttttttttttttttttttgtgacagggtctcactttattgcttaagctggagtgcggtggtgcgatcacagcttactgcagccttgacctcctgctgaggcaatccttcggcctcggcctcccaagtagctgggactacaggtgcatactaccatgctgggctaaattgttttgcgtattttttgtagagacaaggtttcaacatgttgcccagcctggccttgaactcctgagctcaagtgatccaccctcctcagcctcccaaagtgctgggattacaggcatcagccgctgcacccagcctttcagttcttcatactacaaaagaagctgcaataaataactctgggacctccttttgtactcaggcagatgtatttctcaaatgcattttcagaagtgggcttgatgggtcagagggtaaatagatttgattgtatgattttgagacaaattattggagtttgtgtcattttacacttccagaagcaatgcatgaaagaactgttttcctacagtttcaccaacagagtttgttgtcaaattttgggggtttgctcatctgataagtgagaactggcatttcagtaattttaattttaatttgagtttcttgtattatgagagaggctgaacatcttttcctatgtacaaggactagtttcattttttcctctgtgagctgcctgatcttgtcctttgcccataattacattggttgttgatctctttcttcacaatttttatgaactttatctattaaggagagtaaccaattgtctgatatgcattgcaaatactttttgctagttttttttttttttttttttttggtttggcatgtggtgatttgttcttttgtttttatttttgttctttttaattttttaggtcatggaaatcaaaaggtcaaatttatcaaacttttacggcttctgggttttcagtcatagttataaagaccacccattctaagattacataaggatcctactttaggactctttaaccacaaacaaacacttgattttggtgagacttcatctctagaacatggttcctttactgcaatatccttttggaaaaaaatgctaatgcagataatcaagtaatgtgatacattaagaatttcataggtatgctaccaggaaacttttgttttggggtctctaatccataccttgggagcatgacacacagaggtgaaaaccccatgtgacatccatggccatttcttttctagacaagcgactctgatacaaccagccccaccggacagcagccgagcgatgcgtttccggaggacagcagcaaagtacccagggaaaagccaggagactggaaaatgcaatctcgtaaaaggactcaaacactccctaaccggaaatgtttcttgacatcagcttttcagggtgccaacagcagcaaaatggagatctttaaaaatgaattctggtcgccttcctcagaggctaaggcaggggaagggcacaggagaacgatgtctcaagacttgcgccaactttctgactcccaacggacttccacctacgataacgtcccttccctgccagggtcccctggggaggaagccagtgcactctcttcccaagcctgtgactccaagggagatactcttgccagtccaaactctgaaactgggcctggaaaaaagaactctggagaagaggaaattgattctttgcagaggatggtccaagagctacgaaaggaaatagaaacacagaagcaaatgtatgaggaacagattaaaaagtaagtcagacagaggggcactgagaggcacttggcttccatctttagagacaagagggattgttcccatccgccagagaagtcacatcataaagcttcaatttggggaagacagtaatctatagcaggcctagaaagaaaagagtaaagggaacaatgagatagctaaattggtgaacactctaaactttaaactagatttaggaaatgtaaatatctagcttaagtagtttaatcaataatttccaaacagtggttcaagaatcaacatgctttaattaatttaaaggaaattaattttttttatgttaaggtcattcattgattctgcaaatattcctcgagcccctcctctgtgccaggcacattccagttgttagggtatagcactgaacaaaagagacaaaagtccctgcacttacagaacttctagtggggacagatggacaatacaaatatataataaaatatatgttatgtcagctgatggcaagtgctgtggagaaaaataaagtgggtcaggaggttggaaagttcaaggaatgggttccaatgtaaaataggggggtcagggaaggcctccgtgagaaggcagcaggtaagtaaaggcctgaaggagatgaggagcaagtcaggtgtgtagatgggagatgactatggccagtgccgagccatgagaaaagagcagtcccccatggtcccacccaggaagagtggaagctgcctggggccagggagagtgattagaggagatgagggtggagaagtacaggaggccaggacgcagtagggttttgtcagccactgcaaagcctgagtaagaagcttcggggtggtttcaacctggtttatgcttcattggctcactggcttcccattgagcaccggctgcagggggcaaacagaagcgggaggccagttaggcagctattgcctctgtcacatgcaaattcccaagatctgtgcacacaatttgttctcttgggtagatagagtattttcttgaaatatttttcacactactgattggctggcaaatttgttttcaggagagaaagccttgatccagctgttcccatatcagcactagtcatgaggcagtgaaatgtgaattcgtgggctcttagatttatggctacgtcttagtccatgcagactcaggtatctgaagggaagactactttgaaccctcattcattgttccacacagagagctgccatccagaagcaaaatgtagcttgtttgtctaagaacctgaaaccaatcatttgtagaattaaagacttctgtgacatcttggcagtgatcaaagcagtcccatagaaggcacacactgccctcacatatgagtatcttcaacagggtagaaaaagaactggctgccacagatgtgtcagagtcctctgaatccatcagttggggaagcctcccatcccaggctcctgagcccacacagattctaccttccactggaacccatggtcaggatctagcacagtgcctcacttggaatttcttccagaaccagaggggtacagagaacttggagaagaaaagtagatttgtaatgagagggtcagaaggaatggccgggcgtggtggctcacgcttgtaatcccagcactttgggaggccaaggtgggtgaatcacgaggtcaggagatcgagaccatcctggctaacacggtgaaaccatgtctctcctaaaaatataaaacattagccaggcatgatggtgggtgcctgtagtcccagctactcaggaggctgaggcaggagaatggtgtgaacctgggaggcggagcttgcagtgagccgagatcatgccactgcactccagcctgggcaacagagcgagactccgtctcaaaaaaaacaaaaggaaaaaaaaaagatggaatgagatcaatttagctttaagaagagataggtgggggtaagcaaagttctgaagatggattgttacccacagaataggccaaggcccttgaagatagaacccaagttttgggctcacatgggagctcaagtctcccttgtgcaaatgggcaggccatttggggagaagggaggcacactctacagaatgaaattctgaaacaaatttccagtcacacaatcggcatgtgtacactcattcctaagggttaattcagcacagcctggcagggggccacctggcactacattaggatttgggccagtaacgattaaaatcctagcaattcaggaatcccacagatttttcacctggcatgggattcagaagtgagggtgagactgccaggaccacagctccccaaagggcagttccctctgtttctccaaatcttggtccccaggagatccttaataagaaagggtgctgatctatgctctccattgacacaggatgaggaggcactcatgagcacagaggtgtgagaaatttgaaatatggatggggcttccaggactgatacaaggtgctgtgggagtgaatatatagatctgttagaactggtccctcctttcaaagactttgttatccggttgaagatacaaaacattaaacgacatgagaaaaaacacaatagatgtcacaagatggtgttaaatgacaaatgagggggctgggtgtggtggttcatgcctgtaatctcagcactttgggaggccaaggcaggcggatcacgaggtcaggagatcaagaccatcctggctaacatggtgaaaccctgtctctactaaaaatacaaaaaaaaagaaaaaattagctgggtatggtggcgggcatctgcagtcccagctactagggaggctgaggaaggagaatggtgtgaacctgggaggcggagcttgcagtgagccgagatcgcgtcactgcactccatccagcctgggcaacagagcgagactccatccaaaaaaaaatgacaaatgaggggctcagaagtactgtggggattcaggttttctgggacatcttcatgtgggaagagggacatagctgagaggttggataagggtcttgtgatttgaaaggaaaatgagcagcaggttgtgagcaagggggaaggaagagtctagaatgaatgccacattctttcattcttttctttccttccttgtagccttgagaaggaaaattatgacgtttgggctaaagtggtgaggctcaatgaagaactggagaaggaaaagaagaagtctgcagccctagagatcagcctccgcaacatggagcgctcccgggaggatgttgagaagaggaacaaggccttggaagaagaagtcaaggaatttgtcaaatccatgaaggaacccaagaccgaggcttaagggtcccaggagtactgcagggacagccccagagaggcccaactctggcccctttctcagtgctatctgatgacggggaaacaaaattattctctgagagggaaaggacatttgagggaaacatcaaatttccccataaataaatgaatggagtttgcaggaaggtgagggtgagcagagatgtgtgtggacatctctgaccatccatcgctgtattcaaatggattgttttattccattctggtctcaggcatgaccacgtccagtgaagacatttgaggcagcacatctcaggacccaggcaatagactggccccaactcaggctggactaaggtgtgattaattctttgttttttgtgtggaacagctcaccttgtcagacagcctcagggcatctctgagacacaggggcagaaaatgacattcatcttttgagtcctcatccatggagtgctgtgtttggggggctgcatctgctgaagcgagaaccccattctgccaccccaccaggatgcccattctccaggacttctccaacttactattagactaaaccagaacaagcaacaaactgtatttatgcaagcaaaattgatgagaaaattatattcaaataaagcaaaaatt

SEQ ID NO: 36673 - DNA, 6938 bp, Homo sapiens
gtccttcccacccttagtcccaggcatctgactaccgggaacctcagccagagtccgggagccccccaccccgtccaggagccaacagagcccccgtcttgctggcgtgagaatacattgctctcctttggttgaatcagctgtccctcttcgtgggaaaatgaaccagaagacaatcctcgtgctcctcattctggccgtcatcaccatctttgccttggtttgtgtcctgctggtgggcaggggtggagatgggggtgaacccagccagcttccccattgcccctctgtatctcccagtgcccagccttggacacaccctggccagagccagctgtttgcagacctgagccgagaggagctgacggctgtgatgcgctttctgacccagcggctggggccagggctggtggatgcagcccaggcccggccctcggacaactgtgtcttctcagtggagttgcagctgcctcccaaggctgcagccctggctcacttggacagggggagccccccacctgcccgggaggcactggccatcgtcttctttggcaggcaaccccagcccaacgtgagtgagctggtggtggggccactgcctcacccctcctacatgcgggacgtgactgtggagcgtcatggaggccccctgccctatcaccgacgccccgtgctgttccaagagtacctggacatagaccagatgatcttcaacagagagctgccccaggcttctgggcttctccaccactgttgcttctacaagcaccggggacggaacctggtgacaatgaccacggctccccgtggtctgcaatcaggggaccgggccacctggtttggcctctactacaacatctcgggcgctgggttcttcctgcaccacgtgggcttggagctgctagtgaaccacaaggcccttgaccctgcccgctggactatccagaaggtgttctatcaaggccgctactacgacagcctggcccagctggaggcccagtttgaggccggcctggtgaatgtggtgctgatcccagacaatggcacaggtgggtcctggtccctgaagtcccctgtgcccccgggtccagctccccctctacagttctatccccaaggcccccgcttcagtgtccagggaagtcgagtggcctcctcactgtggactttctcctttggcctcggagcattcagtggcccaaggatctttgacgttcgcttccaaggagaaagactagtttatgagataagcctccaagaggccttggccatctatggtggaaattccccagcagcaatgacgacccgctatgtggatggaggctttggcatgggcaagtacaccacgcccctgacccgtggggtggactgcccctacttggccacctacgtggactggcacttccttttggagtcccaggcccccaagacaatacgtgatgccttttgtgtgtttgaacagaaccagggcctccccctgcggcgacaccactcagatctctactcgcactactttgggggtcttgcggaaacggtgctggtcgtcagatctatgtccaccttgctcaactatgactatgtgtgggatacggtcttccaccccagtggggccatagaaatacgattctatgccacgggctacatcagctcggcattcctctttggtgctactgggaagtacgggaaccaagtgtcagagcacaccctgggcacggtccacacccacagcgcccacttcaaggtggatctggatgtagcaggtaagacattttggtggggagaaggcttctggaagaagggctgaaaagttgtttccattagctttgggttttatgtagattatcccagaaaggaagacgtggatttttgtacttccccttttgctggatgggagagagttggctgctgagttttatttggatcttagctcactggctgggtgcaaagctgcagccttcctctacgtgacctcatccaaagatcttgggaaatggccgagctcagggaggaggcaggatttgggctaacagtgtccccattgccctcttctctcccttgtacttatatgggctctgctgctgggagcagccttctgtttgtcagctcagttctgtgtctggcctgtggtggtggtgttttggaggatctctttgcattctaccacgtccctggcatgtgcaggtcagtcattccaggttgtacatttcctttggagatggaccctcctccctgattttccttctttctctgggcacaattcacctaagtgtgaggggtcacatggatcccgtggagcattctggatagatcctggagtctggtcacagagagagccaaggctacatgatggcttggagtcttcatctttgtcttttcactgtctttccccacattgagtcagtcaccaggtgtttttttttggttttgttttattttgttttgtttctgttttgcacctgcagtatctcggcaggtcagactgtcatgccgtgcaggtgccagccctctctctgctgtttttgctcttgttgctctcagagccaagagccactctgcacccagagggcctcccatccacaccagcctgccctttactcagctctcactttcgtcatcacctgtgggatcctgtctgcagaaccccctcaaaactctttccttcacggtgcagctccaccctgccttgctgtgctctgcacagctacacccaaattctccatgtccctggacacgcacttcacatgttacagtcaggcatcctcctgtttgcttatgctttgtctctgcttagaatgtccttccatatcatcttttctggtaatgtcctttaaggccaggctgaaaagttgcccggaagggcccccttttcctgcctgcaactgtattcctgtgatccggaagttgcctaggccatgctcctctcacaggacaggccagtcagtggtttgtctgtctgcgtggaaagcaagagggtaaggatgatcattcatctctatccccagggacgagtacagtcctctctgctaatgaatgttgaaagaatgaatgagtgaaatggaatgaactccctgatgaagtattttaatttacaggtcaacagctttggctaaaggattggaggtatcctggggagagggaagagaaggaggggcacactcagttctgggctgctctttggcccccactctgaagccagatgggggcagagtccagaggggccagggcagttgcctgacaggccctcccctatcccaccctgagcaggactggagaactgggtctgggccgaggatatggtctttgtccccatggctgtgccctggagccctgagcaccagctgcagaggctgcaggtgacccggaagctgctggagatggaggagcaggccgccttcctcgtgggaagcgccacccctcgctacctgtacctggccagcaaccacagcaacaagtggggtcacccccggggctaccgcatccagatgctcagctttgctggagagccgctgccccaaaacagctccatggcgagaggcttcagctgggagaggtgagtggcgggcagtcagagaggaggggggcagtgagagtgggaaaggagtgttggcggacactcagctcacactgtaggtgaggggagagctctctcaggaaggcttttcttttccttttttttttttttttttgagatggagttttgctctgttgcccaggccggagtgcagtggagcaatctcactgcatcctccgcctcccagtttcaagcgattctcctgcctcagcctccccagtagctgggattacaggtgcacgccaccacacatggctaatttttgtatttttagtagagatagggtttcaccatgttggccaggctggtctcgaactcctgacctcatgatccaccctccttggtctcccaaagtgctgtgattacaggcatgagccacaatgcctggccaaaggtttttctagttatccaaagaaaccatgatgggcacattttccccttggaggctaaagcccaggagtgagaactctcttctgttttggatgggagaggggttgtactgttaaatggctggggataaacaggaggacttgaccccccttagggtgacgtcggggattctgtagcgccgagtcagttgtgtgactgcaattggggaagctgagctctgagcactcagttccctttcatcataatcaggcagcaggatggggtcaatggccatggaggcctgaccagtgcctccctaggtaccagctggctgtgacccagcggaaggaggaggagcccagtagcagcagcgttttcaatcagaatgacccttgggcccccactgtggatttcagtgacttcatcaacaatgagaccattgctggaaaggtcagctggccggggtagagggtacaggatgagccttgctttctcttgggagggtccctgaaaaccacctgcacttctcaggggtggtgctgattcctgccttctgcacttcagtatatctgatcattatcctttgagggaaccttcctgagctgggtgtccatatgcagacactgagtgaggccctgggcctgtccttgagatcttagagccctcttagttccagtttcatggactgagtcctttccaggctccaggactcaggagggatggaagttaccagggaaaatgacatctcctgtatctgaagcttctcccattcctgacttgatgaatttcacaatgttggcctggttctgcttcccaagcgctggttctttttcctccacccttctttcctcagttgtggggaactcttggagagttaggggaagaggagctgaagtagcctgtgggtgtcaccctctgggggtagataggcaatgggcgatatgatgggaaatgtcagagatggaggctgcaagccagggacagggaagcaggtgttcctaatatgaaatggactacttatgctttgactcctacccagcaggaaaaaatgtttaaagactcatgatccttgggctggtgagctgaatccctaccagggcatgtcctcagcaaagccagacctcgtgatcctctttcttctcccctgctaggatttggtggcctgggtgacagctggttttctgcatatcccacatgcagaggacattcctaacacagtgactgtggggaacggcgtgggcttcttcctccgaccctataacttctttgacgaagacccctccttctactctgccgactccatctacttccgaggggaccaggatgctggggcctgcgaggtcaaccccctagcttgcctgccccaggctgctgcctgtgcccccgacctccctgccttctcccacgggggcttctctcacaactaggcggtcctgggatggggcatgtggccaagggctccagggccagggtgtgagggatggggagcagctgggcactgggccggcagcctggttccctctttcctgtgccaggactctctttcttccactaccctccctcgcatccgcctctgagccaggagcctcctgaccctgtgatgcctgacacaggggacactgaaccttgttgatgccagctgtactgagttctcatccacagaggccaggcatggcccagcctggagccgtggccgagggcttccctagatggttccctttgttgctgtctggctttcccgaatctttttaggccacctccaaggactctaaaagggggctattccctggagaccccagagtagggttgccagtcctgcaagtccatagctgagctggaaaggatgcttctgctcacattccctctcatccaggtcctttccttctcgtcttcctctctctcacctacttcctcctcctcctcctgttcctgccttctcttctatcctgcaatttctcccgaatcctgaggggatatccctatgtcccagcccctggtactcccccagccctcagttttcagtcaagttccgtctcctctccagccctatggaagtctcaaggtcacgggacccctaatcagagtggccaatccctgtgtgtcgttcccttgtgtctgttgcttattgggagtaggagttgctcctacccctgtcctggggctgggtgtgtttcaggacagctgcttctgtgcatttgtgtctgcctgcctcatgctctctatagaggaggatggtcatcgtgacagcagcagctcaagttagcatttcaagtgatttgggggtgcaatgataatgaagaatggccattttgtaccagggctctgtattctgcaacagcctgtttgggaggctggagtggaaacaaagggtgggcatcaaagatgagaagccaaagcccctacaactccagccacccagccaggaggggctgtccaatcacattcaggcatgcgaatgagctgggccctgggtgaggtgggggtctggcctagtggggaggggcctggcctgggtggggcagggcctggcctggtccaggcttgggctccattcccatcactgctgtccctcctgaggtctggattggggatggggacaaagaaatagcaagagatgagaaacaacagaaacttttttctctaaaggactggttaaatcaattctgatacagccttacaatacaatagtatgcagctaaaaaataattgtatgtctttatatactaatatgtaataatcttcaggtgaaaaaggcaagccacagaaatgtgtatagcgcacttcccatttgtgtttcagaaaggagtagaatataaacacataattgcttatgtatgcctattcagaataaatgggtaacactgattacttttgggaggggaaccagtaggttgaggacaggagagggaagggtcttaacacttacacccttttgtacattttgaattttgaaccatgtgactgtattacctattcaaaataaacaataaatgggccc

SEQ ID NO: 36674 - DNA, 203249 bp, Homo sapiens
agaggtaagagagggcggggggaaggaagaggaggcgggatccgggcgctgcgttggctgcggcctggcaccaaaggggcggccccggcggagagcggacccagtggcctcggcgattatggacccggccgaggcggtgctgcaagagaaggcactcaagtttatggtgaggagacggtggaggccggggaacggtggaggcgctggcgttggcggcgtcgctggcctgggccgcccgcccactgcgggaccgggcagcgggaccctgggccgaggctggcggcggagcggctggagggatgggatgggagctccagaaaggaggctgggggttgcggagcggacccaggggtgggggcagcggctccgccatcttgtggatgagaggccaagtgacagcgggagcttaatcgaggagggggctccaggcggcgcgcggggccctggagggaaaggggcgtggggactgttactgaaaagcggaggaagctctctggagaaacgccgtgaggccgctggcggggccttcctggtgtcagggttaccggtaaggcccgggagaggaggtgcattcacgactggggaagggagcgcgggatagagtgaagacagatacggtgggtagaggggaacgggcagggctggatgcagatggatttaagggtggaggagggaacgctagggctggtgagaggcttatagttttgtagaatgaggagggaggatagcctttgccttgagggtggaatcccagcttggccaaactactgttgacaaactctggaagggaagaggcctcactaaagaagataaggactgggaatgaggacctagggctataatgacagtccctgggaggggaaaagggtgttgactgtaagctagaattacaaatgtcagggaggggtacataacgctactttgaaaggagaagctaaatactgtaataaggacaaggtgatgaaaagtaagagcagattgtcagggaaacatgggtacaggagattggggcaaaatgagtatctaatagggtaagcaaaacaaaatttaaaggtaaattgtgggacggtaaaatgtggaggccaggtgctttgtatcattttctgggaaaggaaaggccgtggagatgagagttgcaaagacccataagaagtgatgagatcagttgagaaatttaggagataaaaagggtggaggttggtagagggaagtaagtcagggataagtcaggatttgtggttacccgtcagttttaggttgaagcacagtgtgagcaaagattggattttgtgggtgtgcttaaaccccttggaacatatttctttaactttgtatcacgcttttctttttgctgtgcttatctttggcaaactcgtatagtctgatatttgatgcttttaatctgatgctttttgtatttcctaggtgtaaaaccagactttgtggttacaactaaagaatgatggaatgcatagattttaagcttaacaggtggccttagggacattgatattatttgcagtccagtcttgctttttcagaagttattgtgacttgtcactccaaatcttactcctttgcttaaaaaaatagctattttgtatctttgcctaaaataccgtaacaaatccagataaacatggatactaacaaaattgaattttagactttaaactgccccatttataagaatacttttttggaatctagtcaaattcactaaaactttatcttgcattagtgttttcgaaaacacctaattaaaattcaggggtatcattaacaaaatttcattgagcctgaagaaggttcttggatttctgcccaacattaaaattctaaatatgaagaagagaccttgaacttttactggactttagaagtaagtgaaagttactacacttaagttagaaaactgttactgcttatttttgttttcctacttagagggttgactcctttttttcttcttttgagatggagtcttgctttgtcgcccaggctggagtgcagtggtgcagcctccgcctcctgggttcaagcgattctcctgcctcagcctcccgagtagctagaactacaggtgtgggccaccacgcccatctaattttttatttttagtagagtcggggtttcactatgttggccaggatggtctcatctcctgacctcgtgatccgcccaccttggcctcccaaagtgctgggatttcaggtgtgagccacagcgcccagcagagggttgactcttaatcctaatcctgacatttgtgtcagatttatggaataatgtgatttacagatcataaagagacattatgagatcatcctttttactctcagttagacttcagcctagtaacattctcagctacttaatctctgctttgtaccagtgagttatgttttgataatggcctccctggttgagttaaagtggacttggagatgaccatatagtagttgcagcttttagagcaccacacattattaaatcttgaatcagttttcatagggagaagccaattttttcttttaattttagttactttcattattgaccttgcctgctgttttggctgccatttgagaaaaggtcaactagaagagggtcaccagaatgacaccttaataaaagaaacagagaatggagagtttgagattgggtattctctttcagtgcagtaacagtcttatgaatctgagtaagtcacaacttccctttggtgccatttaccctgctataacatgtctgtttattcagagtcagttttaagaaaggaagataggccgggtgcggtggctcatgcctgtaatccaggactttgggaggccgaggcaggcggatcacgaggtcaggagatcgagaccatcctggctaacatggtgaaactccgtctctctaaaaatacaaaaaattaggcgggtgtggcagcgtgcgcctgtagtcccagctactcgggaggctgaggcaggagaatggcgtgaacccgggaggtggagcttgcagtgagccaagatcgcgccactgcactccagcctgggcgacagagcaagactccgtctcaaaaaaacaaacaaacaaaaaaggaagatattggccaggcgtggtggctcatgcctgtaatcccagcactttgggaggctgaggcgggcggaacacgaggtcaggagattgagaccatcctggccaacatggtgaaaccctgtctctactaaaaatacaaaaattagccaggcctggtggcgcgcacctgtagtcccagctactcgggaggctgaggcagtagaatcacttgaacccaggaggtggaggttgcagtgagctgagatcgtgccattacactccagcctgggtgacagagcgagactctgtctcaaaaaaaaaaaaaaaaaaaaaggaagctatttgagctagcatcaaataattagtgcacagtacacatggaagaactatccttttaatcaaacgggcatttttattactatttggctttgttctggtcttaacctttccctcaattgtgaatcgctaatgacaacttttatacagatgtcatgatttccatggtttaaacaaatgtaaaattagtttaaaatgccagaatgaaatggatactctcacaaatttgctcattgctatactaaagtgccttgataaagaattttacaataaaatcctgttaataagactgctgattcagagatgaccataattcacacgtgatcgagacttaaagcttattgttttacttgtgaaaaaagtttaagcagaatgtttaacttttaaaaacaaataaatgatattgaaagcaacggtttacattaacttacgtgctaatgtctctcattcagctttagcaggtcctcaaggacctttcttaatacttttttggttaacaaaagtataaatggaaacttgaagagaacctaagaagagaaatgaaaatgattgagggaatatagaccccaaaacacacaaacacacacacacaagcacgtttaagataggggttgaaaagacatactgaggaggaatttgaactttatttttgttttcacctttgagacagggtctcactatgttgcccaggctagagtgcagtcatagcttgctgcagcctcaaactcccaggctcacatgatcctcctgcctcggcgtctcaagtggctacaggcacacaccactatgctggctattttttttttcttttttgtttttgtagagacaagggtcgccctttgttgacaggggtggtttttgaactcctgggctcaaggggtcctcctgccttggcctcccattgttgggattacaggcgtgagccaccttgccaagccacgtttatttttaaaaacaggataaatatattcttgtccagccaatcccagaatcaagtacagtagcttgaaatagatgaaataattttagaatgtattgttttatttatagagctgatagataaatgaaacagtataaagggtaaatatttgctgtttaacagacaacctcaaaacttagcttaaaaaaaacaattatttttcccctcaaatctgatggtttttctgcttcacttggtattggctgaggtgtgggaaagaccttcacttctcctctatatgggcctttctctacctggctgcttggatttccttaaagtgtggtggcaaggttctaagaagggacattccaggagacaggaggtagagactgccagtcttctaaatcctagatttggaagtccaagaatgtcactgtgggtcaaagccagtcaaggccaactacagagggaggagaaataatgtctacctattgataggaagggtggcgtgcataaacaaggaagggggaattgctgggggccaccttttgagacttgctaccgtaggtgctatgctagttggatgttaaggctaaaaataaaaatggtatcggccaagtttgtgggtcataatgctaggaatgtttaggaggcatctctttttttgaggttaacttcggaaggcactaacatgatctcctgcgtgacttcccttaatgatgtcactgttgacataatactgggtgaattaatgtgattaagtaaacttgcttacttacttcaggaaacagaggtatctaaacagattacattttaaaataaattgtcagatgtttcactgtaatggaattttctttacatcagtgaaattgattaccaggtagtgggatgaacatctgaaactagttcttagtttaagttgtctgagtttttgtgtatactttacctattcccagtttaaattggctttcaaacagtttgttttctgggtactcttataggtgttggggtatgaaattagtggtaattctttttgcctattttctttttttttgtctgagataccctgagtctcgctctgttgcccagactggagtgcagtggcacaatttcggttcactgcaacctccgcctcctgggttcaaatgattctcctgcctcagcctcctaagtagctggaattacaggcgtgtaccaccttgcctggctaattttgttgtatttttttttttttgagatggagttttggtcttgttgcccaggctggagtgcaatggtgcaaactcagttcactgcaacctctgcttctgaggttcaagtgattctccttcctcagcctcccctgtagctgggattacaggcatgcaccaccacacccagctaattttgtatttttggtagagacagggcttttccatgttggtcaggctggtctcgaactcccaacctcaggtgatctgcccgccttggcctcccaaagtgctgagattacaggcgtgagctgccgtgtccggcctctttttgctaattttctaaatttatgtttatagtagattttcataaattatcaaaagtgaattattagatgtggagtaaaaattcaactttgagtagttttagaaattatttattgctaaattagaaaataaactttcaaaagagatctcttttttttaaaaaaacttaattgagacagggtctcactctgtcacccaggctggagtacagtggtgcaaccttggctcactgcagcccctacctcctgggttcaagcaattcttgtgcctcagcctcccaggtagctgggaatacaggcatgtgccaccacgcccagctaaattttgtgtttttagtagagacagggtttcaccgtgttgcccgggctggtctcgaactcctgacttcaagtgatccgcccaccttggcctcccaaagtgctgggattacaggcgtgagtcactatgcctggcctagagatgggatctgctttttttttttttttttttttgagatggagtcttgctctgtcacccaggctggagtgcaatggcacgatctcaactcactgcaacctccgcttcccaggttcaggcaattctcctgtctcagcctcctaagtagctgggattacaggcacctgccatcatccctgactaatttttgtatttttgtagacggggtttcaccatgttggccaggctattcttgaactcctgacctcaggtgatccgaccgcctcggcctcccaaagtgctgggattataggcattagctaccgcgtctggcctctagagatgggatcttgcttgctctgttgccaggttggccttgaactcaggctagggttaagtgatctttgtgcctcggcctctccagtagctgggactacaggtgcgtgccaccactcgcagcctaaaatactttttaaatctcacctactttctagcagtattttattttatttgggcgcagctctgccatcagtaggctgagctccctgcagcctcaaactcctgggctgaagcaatgcctctgcctcagcctcctgagtagctgggactacaggtttgtgccaccacacctggctatatttttatttttttgtagagatggggtcttgctgtgttgcccaggctggtctggaactcctggcctcaagttattctcctgcatcagccttccaaattgctgggattacaggcttgagccaccatgcccagctttagcaattttttttttttgagacggagtctcgctctattgcccaagctggagtgcagtggtgcgatctcagctcactgcaacctcagcttcctgggttcaaacagttctcctgcctcagcctcccaaatagctgggattacaggcacgtgtcaccacacctggctaattttttgtatttttagtagagatggggtttcaccgtgttagccaggatggtctcgatctcctgaccttgtgatccaaccgcctcagcctccctaagtgctgggattacaggcatgtgccaccgcacctggccagcaatattttaatatagcacagaagtcctttctaaatgtgtatagtgagaatccattgaggatgaaatagaaaatatttaccaaagtttaacaacttagtcaataaaaataaaactttctctttccgtaataagtcaatctcagcattctaaaataggcaatggaggggggaagaaatctctatgggaagggtccactggatcttaacagtttcaactagtgttccacaatatttctgctgtacttggggagaatttctggataattagaatagtctgaggcttattccttttagtttcccatagcctgattgagatagagctataagaccagctataacattgtacagaagactcagagataaacaagtgaaaaagataactgagattaatgttgaactaagaatatgattgttctctgaggcactacctgctagttcctggattacctttatatgtggccaaggtggggattgggaagcaagggagcaaaagccctagagctaagggagagagaatttctgcctgcctaagatgaaccttctgagttggatatttttttttcttcccccttgagacggagtctcactctgtcgccagactggagtgcagtggcatgatctcagctcactgcaacccccgactccctggttcaaatgattttcctgcctcagcctcccgagtagctgggattacaggcacgtaccaccacacccagctcatttttgtgtttttagtagggatggggtttcaccatgttggccaggacagtctcgatctcctccttgtgattcgcccgccttggcctcccaaagtgctgggattacagctgtgagccaccgtgcccggccttgagttggaatttctttctaaagtcttgctcctttctgtagtttggctttcctttcagggtatctgattttgccttcctgctcctaggcttgtgacctgacctgatgctgtcaattacaggagaatgcagaggtgcaagaaatttttttttttttgagatggagtttcgctcttgttgcccaggttggggtgcaatggcacaatctcggctcacagcaacctccgcctcccgggttcaagctattctcctgcctcagcctcccgagtagctgggattacaggcatgcggcaccacacccagctaattttgtatttttagtagagacggagtttttccatgttggtcaggctggtcttgaactcccgaccttaggtgatccgcccgcctctgcctcccaaagtgctgggattacaggtgtgagccaccacgcccggccagaagaaattttttgtgttttgttaatacagtcagccacgaatagctaacagctaacagctggtccctcatatttgtgggttccatatctgctaattcaaccattgattgaaaatattcagaaaaagagaccacaataaaaaataacaatataacaataaaagtgggaattaaaaacaatacgtataacaactacttacataacatttacattgcattattatatgtaatctagagatgatttgaaatatatgggaggatgtgtgtaggttatgtgccgtttaaggcactataagagacttttgagtatctgtggattttggtatccgatgggaggatcctggaaccagttccctgcagctatggaggtttgactataattatttagcatgtactatttgctgttctaaatatactgttctaagctctttatatatattatttcatttaatcctcccagtaatcctgtgagatagattcagtattattattatccccatttctcatttaaggaaaattattccagagaggttaagtaacttgctcaaagtcatgctagcaggtatcctgagattaaatccaggcagtctgacttgagagccttacttacgtgcagtatacttcctctttgaagagcaggaaaactgtgggatatggtggcatgtttccttaatatctgttaaggcacactttggtaaatgctaaaatagaagcacaaagtgctatagaatttaagggaggggaagttcgtttttgtttttgtttttgttttttcttttttttgagatggagtcttactctgtcacccaggctggagtgcagtagcgcaatctcagctcactgccacctccacctcccgggttcaagtgattctcctgcctcagcctcccgagtagctgggactacaggtgtgcaccaccacgcccggctaagttttgtattttttagtagtgctgggattacaggtgtgagccactgtgcctggccgggaagttcgttttaactgaagagctctttagcagctttgtagaagaaagcttcatattagatcttgatgaatagatagattttgacagatatctctctgaggtaggcagtcaagcggtggccagagtggaagaattactgtccagatttacatataggtttcctgattatttaaattaccgatgaagtgcagtaagactctactgttgtcacagtatcatttcagttagctattggcgtttagaatcacaaaataccagcatcttacagtgataggtatttattctcttgaaattgtgggtttgctgggtagtggatgatctaaacttggcttactcaaagtcaaaagcccaaagtcaagcagggcagggagtaacttgcacaatactatagtgacagtaatctactgcagtgatctagtacagttgatttagagaagaatggtaagatgcttattatgacaactattgtgctttcttctttctgctctctattgttgacactctcctgatagcactttttcattttggttgctgaataatacctgttgattggatactcctagaatcataatgtaatacagcagatttcttctcttcatgttatgtagaaaaaaagcataaagaaataatcagaatcttgactattccacagtgatgccctgaaaagttcagcaatatcatggtgctattcttctatctttgggactgataagcttgatgtcactggaatggcatttgtaacagaatttgaactgtaacagagtttacatcaaggtcatacataataacccaacaactcctttgttaacagttttaacagctttccatctcttcgctgcacctaaacttaaggttgcaaagatcaggtgctgatatatttagatgtctggaaaactttcatgctttcactgaaaagtcatagagacagatatccaggaattatagcatgtggataaatatttttgtagcacagattcataaatccttgtatgcaggaagtactacaccaaactgttaatgtggttatttgtgagttgctgaattatgggtaatatttcaaaatatttaatggtattctgaaaatatactagtaaatacacagaaaagcattatttaggtgatatttcttttaattcttttttttttttttttgtatccccggagcgagtgcaccgttcctggaggtactgcaataccaggtcgatgcatggagtggacggagcaagctcctattccatctccctgctccaaaaatctatttaatatattgtcctcagatagaggacatatcagatactaaactgatgagaacagatactacacttgatcttagccaaaaggccgagaagtgattttaattctttttctttttttctttttaaaatttttttatttttattttttttttaagatggagtttcgctcttggtgcccaggctggaatacaatggcgcgatctcggctcaccgcaacctccacctcccgggttcaagtgattctcctgccttagcttcctgagtagctgggattacaggcatgcaccaccacacccagctaattttgcagttttagtagagatggggtttctccatgttggccaggctggtcttgaactccggatctcaggtgatctgcccgcctcagccttccaaagtgctgggattactggcgtgagccaccgcgcttggccctttttttttttaattttttgagacagtctcactcactctgtcacccaggctgggtgatatttcttttctttaattctttttctttttaaaaattttttatttttatttttattttttttgagacgaagtttcgctcttgttgcacaggctggagtgcagtggtgcagtctcagctcactgcaacctctgccttccgggttcaagcaattctcctgcctcagcttcctgagtagctgggactacaggtgtgcatcaccacactcagctaatttttgtgatttttattagagacagggtttcaccatgttggccaggctggtcttatactcctgaacttaagtgatccacctgtcttggcctcccaaagtgctgggattataggcatgagccaccatgcctagacttctttcaattcttttatgttttacggattttctacagtgaatatatatcataatcggaaaaagtaaaatttagtatattgagtatatgcatttataaaacaaaatgatcatggactacattgtagcaagtgtactggccagtgggctgacagtggctgcttaaacgactccttactctgagctccagttttcttaaccagaaaatcagctattgttaattttacctacttagggtctctctctatttttcctttcagttcatgttaatttctaaattgccatgtataagtaaggggttgtcaatttacaccataaaacccctttatgtatccaaggttttcataggaaatttaggactgtatgatcctaaattgtgctggagtaccacattttctgttaagtagtacttggcaataaagtataggaaaaaaaaatcagtgggttgacaaagagaggtcatgatagtgtacctgtaatgtaatttgataaaaaatgtgagcctgaactgattgcaaagcattgttacatataggggaagacattatgggggcagaggggggtgaagatacaaagttgaataaaacttctctagagcttcacaatctaataagataggcatttataaatatctcttaaggcgcactttgttaagtgctaaaatagtggcacaaagagctatagaatttaagagaggcgacaggaaaaaaaagtaaattgagttaaaggaaggagaaattagttttaatgagagattttttagaagctttaaagaagaaagttttgtattggaccttgaagagtagatagattttgacagacttgtgtctgaggtgggcaattccaagaataggaagtaacttgggtaaaggccaggagatcagaagttgggcaggtgcagtgagttataggtgggtagatagatataatttgagtatagcagataaggaaaatataaattggaggcccagggagtttggacttaatctagttatatatatatatatatatatatttttacatttatatatatatttatatatattaatatatatttatatatatttatgtatattaatatatatttatatattaatatatatttatatatatttatatatatttatatatattaatatatatttatatatatttatatatatttatatatatttatatatatatttatataaatatatatttatatatttatatatattaatatatatatttatatatatatttatatttatatatttatatatataaatatatatatatataaatataaatatatatatatatatttttttcgagctagagtctcgctctgtcgcccaggctggagtgcagtggcgcgatcttggctcactgcatcgtctgcctcccaggttcaagccattctcctacctcagcctccccagtggctgggactacatgcgcgcaccaccacgccagctaatttttgtatttttagtagagacaaggtttcgccatgttggccaggatggtctctatctcttgaccttgtgatctgcctgcctcggcctcccaaagtgctgggattacaggcgtgagccactcactgcgcctggcctaggtctatatttaagaagaatgttctagtgtactttatgtatgtgttaatgtgagcttttttactaaagtaaaatatatatacaaatagttacatatttttaatatgtacaaataattatatatagctcagtgagtttttacctagtgaacacatcttcgtaaccattatctagatcaggaatagaactttgccagcactccacaagttgccttcatgctccctttagttactaactccctaatcccaagggaaaccactctcttataatatctgtagattagttttactgttattggtatgtaagctcatctaaatggaatcattccagggtgtattctttggtgactggtatcttttgtcccacattgttcgtaagatgattcattcaggttgttgtgggaggtgtggtgtgtttattcttgttaatgtattccactgtgattaatcattcagattagtcattctatttttgatggacacttgggttatttccagttttgggctactttaaattgtgctattataaataatcttgtacagtttttccttaaacatatgtacatatttctgttgggtaggtacctgagaatggaatcgctgggtcacagggtatgaaaatgtttagctttatgctatggtttgaatatagcttgtttggccctgccaagtctcatgttgaaatttgatctccagtgttggaggtggggcctggtgggaggtgtttggattatggaggtgcgttcctcatgaagggcttggtgccatccttttggaaataagtgagttctcgctccattagttcctgccagagttggtagtttaagagtctggcacctcccttttctctcttttggtttctctcttggcgtgtgatttctgcacatgcagctcctcttcgccctccaccgtgagtggaagccgcttgagactcttaccaggagcagatgctagcaccatgcttcttgtacagcctgcagaactgtgagccaaataaacctttttttattatgaattacccaccctcaggtattccattatagcaacgtaaatggactaagacactttagtagaacctatgcaactgtttttcttttttttttttttttttttttttttttttttagagacagggtctcactctgttgcccaggccggagtgcagtggcatgatcatgggtcactgcacccttgaactcctgggttcaagctgtcttcccattttagcctcctgagtaactaggactacaggcatgtgccaccacagtcagccaatgtttttcattttatactttctttagcagtgtatgggagtcccagttgctgaacattcttgcagtgctcacttaatatcgtcttttttgaggccgggtatagtggctcatgcctgtaatcccagcactttgggaggctggggcaggtagatcgcttgaggccaggagttcgagtctagcctggctaacgtggtgaaacctcgcttctactaaaggtacaaaagttagctggatgtggtggcgggcacctgtaatcccagctactcaggaggctgacgcacgagaatcgcttgaacctgggaggcggaggttgcagtgagctgagatggtactactggactccagctttggcgacagagcgagactccatcttaaataataataataataacatcgtctttttcgttgttgccactgtagtggatgatggtactatcccaccgttttaatttgtgtttccttaatgactactgtaaacaagcacctttttaggtttgttgactgtttagacatagtcttttgttgaagtgtttattcaagtcttggccttttttcccctattggagtattattatttttttttttttaaagagatgggttcttgccctcttgtccaggctctcgagtacactggtgtgatcatagctcactgcagcctccaactcctgggctcaaacatcctcccacctgggcctcccaaagtgctgagaggcatgagcctcattattttttgtgtgccaggactccttatttattttgatgcttgaattgttccctatttggccagtgggaagtgcattcaaactgcttcctctgttttttggtgtcattgagcattttcttgtttactgaaagatactccaggctcttcttatactttttttgccctagccctggaattagtgatttctctgagaagctcttttagaagtttcttttagtagagaatgacatgtagaagtccagatctgggtgttaagcgtgctcattgctattggggtgtcactgctcacaagccatcatactggacacaccacacacacaggtgcacattgcacatttacgttgttattttatcttacatattatttaaaaccatgagttcacactgatatccccaattccagtctaataccacagggttcgttcgataatttcataattgtaactccattttctgacagtgagtaacttggctttcattatcctcaaaatattttcttagtcaatcagcccctttctatgtgaccactctcatgttgctgctgttccccacacccactatatagatgccgtccttgacttacttaggctccaaaaccccatgtcagattgctggcctacacccttccatgaacacccttgtccgatacctgtgctagattgcttttcacatcacatttggacttcaacactctgtgcagggctgccatgttacctgccatatttctgtatggacatatcccttatcctgtttttttgtttgttttgagacaaggtctcactcttttgcccaggctgcagtgcagtggcacaatcacagctcacagcagcctcactcaacctcctgggctcaggtgatcctcctgcctcagtctcctgagcatctgggactacaggtgcttgccaccacgcctggctaattttttgtagagatggggtttccccatgttgccctggctggtctcaaactcctggactcaagtgatcctctggcctcggcctcccaaagtgctggtattacaggtgtgagccatcgggcccgccccttcttccttatcctgatggtactctgtcatcctgtactaagacctctgctgatcctgcagatgtctgttttgcctggccctgacaaaatgagtagaggtttattgtagtcaaaatgtagtcaagattttcaatttttaaatttatggttagcactttttctctttgcttatcccaagatcatacagatccttccctccctccctccctccctttctcccatctaggctcactgcagccttgacctcctgggctcaagcgatcctcccacctcaacttccccgtagctgggactacaggcatgtaccaccaaacatcggctaatttttttgcatttttagtggagatgaggtttcttcatgttgtccaggctggtctcaagctcctgggctcaagtgattcacctgcctctgcctccccaagtgctgggatgctggggttacaggtgtgcaccacttcactgggccaagatgttgattttatttatctgcacacacagacacacatacatatgtacctatatacatacacacacatataagcttcatttaaacattttttattgtggtaaaatacatgtaaaatttaccattttaactatttaaaatgtatagttaagtagtgttaagtatattcacactgttttgcatatataatctttagaacttttttgtcttgcaaaactgaaactctatacccattagacaaactatcgatgtctcccttatcccagccactggcaaccactattcttttttttttgtttgtttggtgttttttttttcccccagagacggagtcttgctctgttgcccagactggagtgcaatgaatggcaccatcttggctcactgcagactccgccaagcaattctcctgcctcagcctcctgagtagctgggactacaggtgtgtgccaccatgccagctaatttttgtatttttagtagagacgaagttcaccatgttggccaggctggtcttgaactcctgatctcaggtgatccgcccgcctcggcctcccaaagtgctgggattacaggcatgagccactgagcccagccttctattttttttcctatgaatttgattcctctagatacctcatttaagtagaatcatacagtgtttgcctttttgtgactagcttattttacttgatgtcctcaggtttcatccatgttcttccttttttaaggctgaataacatttaattgtatgtatataccacattttatttgttgtcaatggacacttgggaagcttgtacgttttgacctttgtgaataatgctgctatttgtatatgttacaagtacctcttcaagtccgtgagaagttttatttaccatttgcatttagctctgcaatccatctggaattaatttttgcatatggtgtgaggtagacgtcagcattctttttttttttctttctccatgccagacaggtaatgtgcctatgtaacaaggtttgagggaggcacacctcacacatgaggctgaaaacccaatcgtcatgcttacaaactacaaaaggatcagaattctttttttccttttctttctatagccagcttattcagcactatttattgaaaagattgttctttttctattgcagggtcatttttgtcatattaatgtctatatatgtatgtaggcctgcttttgggattttctcagtagctccattggtctattcttgtgccaataccacactgtcttaatttctatatttttatataataacatttcttgatatctgatagtatatgcccctcagcttccccttcccccaagattgcattggctatcttggccttttgcgttttctttttctttttctttttctttttttttttaaatggagtttcgctctttcactcaggctgcagtgcagtggcgcaatcttggctcactgcaacatctgcctcctgggttcaagtgattctcctgcctcagcctcgagtagctgggattacaggcacacaccaccacgcccggctaatttttgtatttttagtagagacggggtttcaccatgttggtcaggctggtctcgaactccctgacctcgtgatctgcccgcctcggcctcccaaagtgttgggattacaggtgtgagccactgtgcctggcctgcattttcatgtgtattagaatcagctaggccggttgcggtggctcacacctgtaatcccagcactttgggaggccgaggcgggcggatcacctgaggtcaggagttggagaacagcctgaccaacatggtgaaatcccgtctctactaaaaatacaaaaattagccgggcatggtggggcatgcctgtaatcccaggtactccaggttgaggcaggagaatcgcttgaacctgggaggcagaggttgcagtgtgtgatcatgccactgcactgcagcctgggcaacagagcgagactgtttccaaaaaaataaaaaagaattagctagtcagtttccacaaaacatacttttatgatttttattggaattgcattgaatccatatataagttttgggagagctgagatcttaacactattgagtttcatagtccacaaaaatgatgtgtctttccatttatttaggtttgaatttctctgtttagaggtctttatatatcttttgttaaattattcctaggaagcagatgtttttaggtgttatttaaaaaatttaatcctctttgttgctgatagtgcagaggctttaaatctgtggtctgtggcccctgtacaagctataaacatgtgaatactttttcctgaaagatctgtaatttacatttgaatctgattcccactgggagcaataacaacaaagatgaaagagcacttagtgctttagagtggattagactagggaggggtaccagagaggcagggaggccatttaaagtatgtaatagtctacgcaagagactgggcttgagctagggcagtaggtatggaaaaggaggaaagacattcaaggatattctggagacagaatgaagaaggttgctgagagtagggtagaacaaatgaagaaaaagagtaaaatatagctggcatcagtcatgttaagggcaattagagggttatcaaagcagtaggtaggtaagggaaaatgagtgtttggtgggtgaagatattgggatggtccctaactataataaggagactttgaatttaagatatattcgtataaataaagatgggcagggccgggcgcggtggttcacgcctgtaatcccagcactttgggaggccgaggtgggcggatcacgaggtcaggagatcgagaccatcctggctaacatgatgaaactcagtctttactaaaaaatacaaaaaattagccaggcatggtggtgggcgcctgtagtcccagctactcgggaggctgaggcaggagaatggcatgaaccagggaggtggagtttgcaatgagccgagatcgtgccactgcacttcagcctgggtgacagagcaagactccatctccaaaacaaaacaaacaagacagaaaaaaaaaaaaaagatggtcaaagtgatagaatatatgagacttggaaggtggaaagctgggtgatgattagatggagattatatattattctgtacttttttgtatatttaaaagtatccatgataagaggttaagaaaagtttatctgctgggccaaatggtatttccagttctagatcccggaggaatcgccacactgacttccacaatggttgaactagtttacagtcccaccaacagtgtaaaagtgttcctatttctccacatcctctccagcacttgttgtttcctgactttttaatgattgccattctgactggtgtgagatggtatctcatagtggttttgatttgcatttctctgatggccagtgatgatgagcattttttcatgtgtttattgcggcattattcacaatagcaaagacttggaaccaacccaaatgtccaacaacgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgttgtggggtggggggaggggggagggatagcattgggagatatacctaatgctagatgacgagttagtgggtgcagtgcaccagcatggcacatgtatacatatgtatgtaacctgcacaatgtgcacatgtaccctaaaacttaaagtataataaataaaaaaaaaaaaaagaaaagtttatccgcataaaaagtaggctgaactgaagattgaagatctctggaccagctgtactcaaattgttatgtgagagaaatatcaggatttggttttgagtaatttcataaccgctgtctattgggaacacagttttatcaagatctgccagttaaggaggcacaaagctacagaggccaggtgctgcagggtggctaggagttggggaaaagaaattgactaggtgtctgttggcaactcaaccaggtgtgtggacgcaggggaacttagcaagggaaggtgatatgatttggctctgtacccacccaaatctcatgtctaattataatccccagtgttggaggtggggcctggtaggaggtgtttggatcatgggggcggatttccgccttttgtgctgttttcgtgatagagttctcacaagttctggttgtttaaaagtgtgtggcaccttctctgcccccctctcttccccccttctcttcttcctgcttcggccatataagatgcacctgcttcccctttgccttctcccgtgattttaagtttcctgaggcctccccagaagcagaaaccatcagaagcagaattcactacgcttcttgtacagcctgcagaaccgtgagccaatgaaacctcttttcttataaattacccagtctcaggcatttctttatagcagtgcaaaaatggactcatatacaagggtatacattcagcaggagaataatggcagggagtctggggcagatattctggggagatcaataggcagaaagcatcagtgaatactagaaacaggtagcaaagcgttgcttcaagcttgaactcaaaagtggaactgggaaacctagcaaggaactaaataattgattcattcagcctatactgattagtgtctattgtaatagttctacactttaccctgtataggaattatttggaatgcatgttaaaatgtagtacagattcttagttctttttcccccctcttcccttttacttggtacgcctaaaaaattggcatgttcagcaagcatatcagatgtttctgatgctggtgtttctcaggatcatgctttgacaaaatatctagtccactgtgtgctggccagtgtatcaacacaggggaagtgggggaaatgatgtggctagaaccagagtaaaaggtgaggccttgtacttgggaaacacagcaggaaggagctgaattaactggaatcaaaagtgatggcaggccagttgcagtggctcacgcctgtaatcctagcacttcgggaggctgaggcaggcggatcacctgaggtcaggagtttgagaccagtctggccaatgtggtgaaaccccgtctctactaaaaataaaaaaattagccgctcatggtggcccaggcctgtagtctagctacttgggtggctgaggccagagaatcgcttgaaaccaggaggcggaggtttcagtgagccaagattatgccactgcactccagcatgtgtgacagagcaagactccatctcaacaacaacaacaacaagtgatggcagaatgagacaaatctcatggccaaggcttggactctctgaattccaactagttggtagtaagttggtttcagaaaacaatttacttctgtaggctgtttgcagctagagaaatagtgaaccatgggagtaggaatataagcaagctgtgacacttagaagaggtatatctagtggaaggacaatagcaacatcccagaatgtggccactgaggtactacattaaaatcacatcacaataaaactggtagtttttcctagtactatgaacagattgtgtatcatcttcatttattttaaagatgctgtggctggtccctcagctcataatcaccatcagccatggcatctttacatagaggaaaaggatgtaattcagtacaattaaataaggtaaatgtaaaggtgctttgtaggtcatagggtaaggtggtggtggtggtggtgctttcacaacaacattctaacacaaagcaattcatacagactcccaaagtttattgaataggcattccactctcattccattttactctttaaatatatatttattcatgcctgctgtatgcaaatttttgattccaatttttttaatggacatacagtaaaatggatttttcttaatgtacacagttttaggaattctaatatgtgtagtagattcatgtaaaccacaatcaggataagaacaattgtatcactcccccgcaaaaaactcttatactcttcctccacctctaaccccctcttcctcacttcattttatgtttttgagaatgtcatataaatggaaccgtgcaatatgaaatcttctgttactgacctcttccgttcagcataatgcctttgagctagattaatccatgtttttgcatgtatcaggagttcacgtcttactattgttgattagtattttattgtgtagtgtaccagactgtttattcactcctgaaggacatttgggttgtttctggttttggtgattataaataaagctgctataaataaacacttgtgtatagattttgtgtgaacattttcatttctctaaatacccatgagggagaattgcgtgataaatgtaggtttaacctttttagaaattgctattttccagagtgattgtaccagttggcattcccacaagcaatgggtgagagttctagttgatctacatccgtgtcagcatttgggattatcagtatttttaattttagccattctaataggtgtatagggatatcctattgtggtttcaatttgtatttccctaatgcattcctcgattcttgatgcttttattgatggaggatccaacacaaaagataatgcatggtcatgagaacaaaatatttgatatgcctaactttaacattctatgaaagacttcattaatatttttaaaaaggagtttgtactattgaatattcatggtttttcagtgaagtttgaggtactctgaagcctatctacaaagttttaagtaagccatgtgacagtgtggataagagagtgacttcagagcattttttttttttctggtgacctttggtgtgtagaacacttgtggcctttaataaactgaggagataggatgaccaaaattttttttatatgcctgtaatttttttaaagcagaaataagtgagaaacgcttatggacactgtgatcaagatcgtgaacaagatcatgatctacatttactgatttcatgttcctagtagcatagatcaatggtatgattttaataattcttattcagggaagtaatttagatggaggcaaggaaggctttcccttgagtaatatattaatttggccccatctatctcttctcctttgtagatcatcccaagcagcagtctgtattataagaagcaaacttaaatgattgctaattaaatgtttagtgttttttttgagttggttattagcttgaggttaaatttgtttaatgagtaaatatggaagaattatgtttttcacatttggaatgcatacttgctgatcattggtatgttactcccattttatgaagctggaacataatttccttctttttaatgactgtgagttttacagttatttaatctttgttttggtggtgttagtcatgtcagtactttatttgctaccgagttctcagttaggaaataggctcccaattataattttttttttttttttttttttgagacgaagtctcactctgtcacccaggctggagtgcagtggcgcgatcttggtgcactgcaacccctacctcccatgttcaagcgattctcctgcctcagcctcccaagtagctgggactacaggaatgagccaccacgcccggctaatttttgtatttttagtggagatggggtttcaccatgttggccaggctggtctcgaactcccaacctcaagtgatccgcccacttcggcctcccaaagtgctagaattgaaccactgtgcccagccccagttataacttgtttccatgggaaaacatccgctttgaagcagtattcagtaatatattgaaatgagaaataggcggtcaagcagtgattcaggtttagtgttcagtgtaattaagaaaaggtgacttaagttgaagaacattgatgtatctgtttttaaattgcacctaattataatgacaacttacaagatctctttccttccttctctcttggaatgttgactataaatttcacataatttaaaaacaatttaaaagctagtcaaattaattgagaagaatcctgctttatcaaattttgcctgtaatcatatccagacatggcattttgaaaatcagaaaggattgcttccacttatatcagagtttgaaagtagaaactcttttcatgtaggtatgggtcacctttgattatatggtagtcttctgaatatggtcctcttacctgacacatatgcacctcatcaataaactacatacaattcttaggtttatatgtggtcatgttacaaaggatttcttaagtactcttaaatgtgttctactaatgtcttgtggaaaaatataatcttttgaaagcattcgtgttaaaaagaattagacgtgatttatctcatttagacctgttctttttcaatgtgtctttaaaatgtaggtacagtatataagaattcatactaaaggatcaactgagactttgatttaaatatgttataaattatagtatggaggcctgcataatatactacatatttttttttcctaagaagcttatttaaatggttctgttaagtgtaggaatgttctgatgattatctttttaattaaaatgagaaatctttgtttaaagtggcactcgtttttttatggcctgttacagtctctgtaacaatcatttcttaagtctgaacgttttatttccaggaatccatttatataaaactatgtttagacttaattaaggaacgattcttacaaagcttgtaaatagccaggaaaaaagggacagaaaataaaactgacattcacatttaacaaaatgattgttacaaggtatgtaataagctataaaaatacaataaagccctttttataagagttcatattttttgatccttgttttcaaaggtatttaagaaaaatatcaaagctttgcaaagtgacatctgtttgctgaatggactagttataacttcttttgtttataactgacaatacgagaattctacctgttttgttagtgtgtcttctttgaaataccttgtaattagtttagattggtaggtaaattttacgttgtaccatagtgaaaacaagacctggttttcaggttctgcttcctagatgtcatagatattgggcatgttgcttaacctccttgagtctcactttcctcatatagaaagcaaagataatatctacttttgtacctcaaagagctgttatgaggagtaaatgaaattattataaatagagcaaatattttggaaattataaaggactgtaagcatccagatcatgtgtctcttaaagatgaattagatttaacaacctcttttttttttttaattaaaaagtaaactttaatgtcaaaaatgcaaacttggggagggcagaaagatcacacacaaggctgtgccttcacacttggagggttgcacagcagccgggcagaggtactcctcacttcccagacggtggggcggctgggcagaggcactccccacttcccagacagggcagcggctattaagaacctcttttaattagcaaacttccttctcttgttcatgcattctgtcaagtacatacatgtacatcctttttgaaatgacacttatttttccatttccttgtctaagtataagtgattgaaaccactattggcatagtggaaattacacaagaattggagtcagaagaactggtttcaagtcctgtcttaactacagtcatgcattgcttaacaatatgtgatacattatgagaaatacattgttaggtgattaagtggttgtgtgagcttcacagagtgtacatagacaaatctagatagtataccttactatacacaaatgccatgtgatataacctgttgcttgtgcagtttgttactgtacactgaatcctgtaagccattgtaacacaatggtatttgtatatctaaacatagaaagggtacggtaaaaatacagtgttataattttatgagaccactgttgcatatctgaccatacttgactgaagtgtcagggggtgcatgactgtatttttacttattctctgaccttattcttgggtggtgataataataacaataataatggcagccaacacttgtagctcagtatataccgtgcaggattctagacactatatatattaactcatttgatcctctcatcttattaggtgtgtattattattatcatcctgatttacaaatgtggaaactgaggcacagacaggttgttactttttccagatcaaacagtttgtgaatggcacagctggtattccagctcagacattctagctccagagtgagtgtggttaatcattgtgctatactaaccatgttccttaatttcctcttctctaaaatgagaataacaataactgttctatctactgggttgaagatccagtaagagagtacacataaaagcactttgacatcacagtgtaccataaatagaagttatatgtgaactgtagaattagcatgcaccttagagtaggtattttatagttttttggtgggtgagggatgttatcttttgacttatttttgagaaatataattttgaagagaggtgttgatggtgtcattcttttttcaactcctcagaaaaattatgagaaacacacgatgataactcatatatccctcacctgaattatctaattgttaacattttgccacatttgacttttcctagtatatactttctttctaaattatttgagagttgcagacatgatattttaccttctgcatgtattttctaagaacaagagcatccttattcctaacctcaatacaagatcccactcaggaaatttaacactgatcactgataaccttttattatttaatatacagttcatatccagaacccctagttatcctaagaatgtcttttttttttttttttttttttttttttttttttttttgagatggcgtcttgctctgttgcctaggctggagtgcagtggcgtgatctcagctcactgcaaccttcgcctcccaggttcaagtgattcttctgcctcagcttcctgagtagctgttattacaggcacctgccaccacgcccggttaatttttgtatttttagtagagatggggtttcaccatgctggccaggctggtctcgaactcccgacctcaggtgatccacctgcctcagcctcccaaagtgctgggattacaggcatgagccaccgcgtccggcccctaagaatgtcttttacagctctttaaaaaaaaatccaggatccaatcatgttatatataatatctctttagtttcctttaatttacagtagttccctaatggtttttattcatgaaattgacatttttgaagagtttgaggtagttttacagaatgtccctcatttgtttttgtctgattgtttttccatgattagatcagggtaaaaaatttggcaggagtataatatatgctgtgttttttttttcttagtgcactactacatcagaaggcatataatgtcagtttgttccattattggagatattgtttgatcatttattaaggttgtattcactagatttctctgttgtaaaggtatatttgtaagtattcagaggagcaaacttggagactgtgtaaatatcttatttcacaacattgtttcacgcagtagttttaccatccattggtgattcttctgtggtagttgtaaaatcaacctatttatttttaggtagttctaaataatttttttctttctcaattttgaaatggtgagtgtttcctattttggaaagacattacatgggctttatcctctttatttcatttttgaacttagaccaattaaagtgtactttttacattgtaaaaaagataaagataacttttatctttagtgcaacacactactaaagctgcttagagaattgagttaagtttttaagggctttttgtaacaaaaagtatgtctgaattccctggaggacttgttgggccttccctggagattttttttttttttttttttttctgagacagggtctcactctttctcccaggttggagtgctgtggtgctatcacagctcattgcagccttgacctcccaggctcaagtgatcctcccacctcagcctccttagtagctgggactacaggcgtgcaccaccacgcccagctaatttttttatttttcacagagatagggttttgcccatgctgagtttgccattctttaggcctgggttggggtctgagaatttgcatttctaactagtttataggtgatgctgctggttctgggactacactttgaggactgctgtggcttctataagtcttcctttttaaaaaaaaaaaaaaaggctagtcaagttctgaagcaattggttgtgaacacctgcacttgccattcgagcagatattttgctcatgattatttggaccgttttcttcctttcttcttttctttcttcctttctttccttctttccaggctggagtgcagtggttcgatcctagcttattgcaactttgaatgcctaggcctagggaaccctctcgcctcagccttctaaagtgctggggttacaggcatgagccactgtgctgaccttgggatacttttctacttgtttgctttctttaatagatatgagaataatatggatatagtatagcagagtaaattgaagtttgtattaggggattttgatgaatgttgggaaaattttggcaattggctaaattactgaataggatctcattaacctagctaattcaaaattatctatgttgtaatgaaaatggttatagggtattttatctatttatttatttattttttagagatggagtcttgctatgttgcccaggctggactcaaactcctgggctcaaaagtgattcttccgtctcagcctcccaaatagttgccggtaccacaggcttgtatcaccatgccctgtctaggttattgtaaaacatatttgtagcatttatatttgtcgaattttctttactttgctcaatgaagtaaccaaattaggtatccatagtgatcagtttgtgctttcagtatttaagtaatctctgttatactttagcaactggttttgttaagtctgtgcaattagtaaagcaagtggcaaatttgttacgtcatagagattattttcacttttacagaagttggccatcagccctccttctttgagtctcctattagaaatactataaacatcagagagaagaggatgaccttaatatttgcttcccaggctaaatcacagccttgaagcagctatttctttccgaataaaaagtttaatttcacgccctgattagtgccagtacgtgcaggtagatacttatgttatgtagctaaactgatgtgcctttgcaaattacttgccagtcagcagaactatagtttcttatgagtagtttatggtaaattatagttctagttagtaagttctgtgtgtttttttaaagtgtgtatttattagatacgagtaggaatcagtcactaaattttggccagactagcagttgactaacagcttttttcaaaggctcaggtttggactaacagtccagccaattagcagtaggaaagagtgagatcttattttcagttgatttgaaaatatacacaggacctagaaagagtggtttctgatggaaaagacctaaggagagattatttttcttattgagaagtaaaatacattgtagttaaaaattgagacctttgagaggcttaaaagataggaagatcaactgaggacaagacatagaaggttttgaaatcgtgggacactacttaactgaatttttaattgcttaattgaaactatggagttttaaaaacttttaagatgaactggggccaggtttggtggctgtcacctgtaatcccagcactttgggaggctgaggtgggaggattgcttgaggccaggagtttgagaccagcctggtcaacttagcaagacccatgtctctacaaacagaacaaaacagaacaaaattagcgtggcatggtggtgcacacctgtagtcccagctacttgctttgaggctgcagtgggctatgattcctccgctgcattccagcctgggacacagagtgagatcctgtctctaaaaaaaagaaaaaaaaaattagccgggcgtggtggcgggcacctgtagtcccagctactcaggaggctgaggcaggagaatggcgtgaacccgggaggtggagcttgcagtgagccgaaatcgcgccactgcactccagcctaggtgacagaacgagactctgtctcaaaaaaaaaaaaaaaaaagaaaagaaaaaaagtgaaactgactttttttgaacttggatgaaggatagatgagatgaattagaaggaagaaaaatactgtttccttaataaatgtatcatttgtcttatctaaaatgtcactaaatttgcatggagtcataggatttaagagtctagaaggaccatctaattcaaggcttttttttttaatttagtttttctattttctttgttctttctttcttcttcttctttttttttttttttgtgtgttcttctacttgataattcaaggcttcttaacctttttttggttatggacttcactgaaaatctggtatcacaggatccttcctcttcccagacacacacacacacatatgttttgtacaaaatttcaggaggttcagagatccctgaatcctatctatggaccctgggttaagaaccctgatctagcttgttttttttttgattcttgcatagtatatttttatttaaaaggttttgctgataattattattttaatataactaagttgtgacctgttttaataagggtctgactgtaaaacttgagcttcatcataaagtgccattttgagaagctaatgaaatgttgagtatgttgcctagtagtgtcaggaaaaatggtacagagatgacttggctggtagttatcaaaaatcctcccagaacatcctgttctcattcccctagctattcaggcaaggggccacaattaatccctgtctatgatgatgtaattttacttttcaggatatatggacagatacacttaaatcctttgattattattctactgatatttccaggacctttctatttttataagttttattaaagatgtggtataaccaagcaaatgcccagcaaggtcagtttactctagtaagtacactctgcatctagaagcatgtggaataaactctgttctgtcaaggtcagccttaaacattgtcaacatgttcacttatttatgctctgcagttctggggaggcctgggaaacatttatcttcttttctttttcttcatcctcttaaggtatcaacactgacaatgctatctatctaattagctcattcaagaaagacttttttgtgataattttagatcagcagtacactttggccagaaaacctggtttggattttatcttatgttatcccacatgctacttagaaaaagagtttttatgagatatcgataaaaagtattgtggaatacttcttctttttaaaaatgagcacatgaagaaccaaggacttgtttgacttgccagtgtcacaattgatgacagcctgaattagagcccacatttcctaagtccaagtctagttggtgcttttccgagtctttgttttgtttgtggtttagcttgtgtttcttctactgataggtgaattggtggggggtgtttttaattagtacttttgtgatttgtttaagaaagcctcccctaatttaagatcatgaaaatagcctcatattttctactagagactttttgagttttggtttttacgtttagaattttagtctttctagaattgatttttgggtttgatgtgacgaagggattccgtttcacttttttccatatggatttacaatggcccccagcatcatttattggaagaacatgcattctccatcaatctgcagtgttatctccctcataaatcatgtcattacatgcattgatcagtttttggactcattctgttctattgttcatttatttatatcagtgccatactatcttattcatatagcttttttttgggcaaatcttttctattttaaaaaattcatattaaaaatttaacataataagtgtacatatttatggggtatatactgatattgtgatacatatagtgatcagattagtaattagtgtatgtatctcagtcatttatttttttttgtattgggaacattcaatattctcctagctatttgaactatatagtattttattgttaattattgtcattctacagtgctgtagaacactaggacttattcctcctatatagctcacactgctttataatacaccttttttatggtagttaaggtctcataccttattttcttcttggctatttgtggctttttataccttcatgggacttttttttttttttttttgagatagcctcactctgttgcccaggctggagtgcaatggtgcgatcttggctcactgcaacctctgcctcctgggttcaagcgattctcctgcctcaccttcccgagttgttgggattacaggtgcccaccaccacacccggctgatttttttttttcttgagacggagtcttgctctgtcgcccaggctgaagtgcggtggcgcgatctctgcttactgcaaactctgcctcccaggttcaagcgattctcctgcctcagcctcctgagtagctgggattacaggtgtgtgccaccatgcccagctaatttttgtatttttaggagagacggggctttgccatgttggtcaggctggtcttgaactcctgacctcaggtgatctgcctgcctcggcctcccaaagtgctgggatttcaggtgtgagccaccatgcccggcctttggaaatttttatagatagcttgtcaagttcaaaagcaacaaatatctaaaggcaaaaatatactaaacctattgggattcaggttagttgattcttgatagaaaccaaagtatggagttacttcaaaattaaaaactaaaatttgagaacttttagctaggaaagatggctttcttttgttttgtttagaggagaatcttgctctgttgcccaggctagagggtagtggtacaatcatagctcattgtaacatcaacctcctgggctcaagtgatcctcctgcctcagccttccaagtagctaggactacaggtaacaccacaccacacccagctaatttttattttattttattttattttattttatttatttatttttgtagagacagggtctctctctgttgcccagctgttctcgaactcttggcctgaaacaatcttcctgctgtggcctccgaaagtgctgggattacaggcaggtgccaccgccccacctgtgtttattgattgattgagacagggtctcattctgttgcccaggctggagggcagtggcatgatctcagctcactgctgcctcgacctcctgggttcaagtgatcctcccacctcagcttcccaagtagctgggactacgggtgcccaccaccacgcttggctaatttttttgcatttttgtagaggtggggttttgccatgttgcctaggctagtcttgaactcctggcctcaagcaatctgcccacctcagcctctcaaagtgctgggattacaggcatgagcgactgcacccagcccagcctgttttattcttaatgttaagagatagttggatatgatgaaagagcactttattgagccagatcacttaagcatttgacctttagacaagtcttttatttatgttagagtttcttagcccttgggccttggccctcttctctttcctgtctacactttgttcctagatgatcatctattccttttgctttgaaataccatctgtgggctgatgatttctaatgggctaatagtctctaacccatccttttactgtgacttctacctttatgtattcaactgattatccacttgaatgttgcataattgtgattttttgtgtgtgtttttttttttttttttttttttttttttgctgatcttcccatactaataaatggtgccaccatttatccagttactgaagcctgaaacctggaatcatcattggctcctcactttttcttatgccgatatgcaattcacaagattttatctgttctacttccaaaatacatctcaaattcgtctacccctctctgcctacactgctatcaacttactttgggttattatcatttcttttatggaaaagtttaacagttttctagctactctcccctttaaatctagtctgtctccacacaatagccagagtgatctttcagagatctaaaatgttctaatatcttccttttggactaaagctatgcatggtaaactttgttgttttgcctggcagagctggtcctttcccacctatgtctttgaccctgttaggtcattactcccagtcttcagttacagtcaagttacactggccttttgccaaacacctttttttttttttttttttttttttttgagacagggtctttctctgttgcccaggctggagtgccatggaataaacacagcacagctcactgcagtcttgacctcctgggctcaagtgatccttctgcctcagcctctggagtatctgagaccacaggtgcacgccaccatgcctggctaatttttaaattttttgtacagacagggtctcactatgttgcccagcctggtcttgacctcttgggttcaagcgatctgtctacctcagccttccaaagtgttgagattataggtatgagctaaatttgccaaactcttgcaagaccactataaggcctttgcattggctgttttctccaactctgactttttggttgagtccttcgtttatcctttatatctcagttctaatcacctacttagagcctaccctatctaaagtaaatgcccctttccttatttgtctattatttctactagaaaagaaaataaagcccatgatagtaaaattttgtgttttactcttgagtatatcccagtgcatgacatgtggtagacaataaatacttgtgaagtcactcactttcttttttttcattttgtaaaatagaagctgatgataaactgcccatcctgcttcctggagtcattgtagggaataaatcaaacaatgtttatgggaataaatcaaacaatgtttatcagttttgatgtcctggtatgatttttttttttttttttttccgagacggagtctcgctttgttccccaggctggagtgcagtggtgcaatctctgctcactgcaagcttcgcctcccgggttcacgccattctcctgcctcagtctcctgagtagctgggattacaggtgcccgccaccacgcctaattttttgtattttagtagagacggggtttcaccatgttagccaggatggtctcaacctcctgacctcgtgatcctcccgcctcggtctcccaaagcgctaggattacaggcgtgagccaccatgcctggcctggtatgataattttcaataaatgagctttagttttttaaaagacattagagcaaatttgagaaagtacaaaataaaaaaaaagcagcctgccatcccacacaaccacttttatttaattttgtttgtcttaaaaaagaaagaaagaaagaaagaaaaacaacaacttttaagggtgaatgtactgtccagcactctcttctttctaattttcctgtcccaagcagcttccaaacactttaaggaggtgcatcagttaagatagattaattttatactttttaagacttgtagggaattcatttatgtattttgaaacttgcgtggaaagaagtaaatacaaatggttctttatcaaatttagaaattttactcttgataattaaagtttttataagaattttgcctaaagaacttttcttgaaactagcctgtatataatcaggatttcttgatatggaatacaatctgatttgtcttttaaaacaacttgtacaggttactatttatcctgtgtggtaactaccgctcctgctgtgattcaaatatttcagcccttaagcagttatattaggcttggggaatagtgtaatttgaagcccttggaacatctttttgaattagaaaaggaattctctaaataaatatattcaactgggagaactacttttttgaaatttattactttggaatatataaagtttggtcatctttggaagtagagatctaatttaccagcaaatggagtttataatactaaaatatagtattgtttgcaaataaaattctttgtttttgtgtcttaggttaataaattgtctctgagtcaattgttacaacaaataccaaatggaaaaattgctttcatttcttagcataggcacaaccttcgtagttcagccttcccaaaatgctctttgttcatctgatgtatgttggagagactctttataaaaatggcaatgttgacatgtaccttaatttgctatgttcttttaaaaataaatttgggaaatttgctctctagaacagtagcctcctaacccatcagaaacattttaaggatttatcctaaatatttttacttcttaatttgcaaattgcaaattgtactcatgccctgccatcattagctactatattaaggcacaatatatacacttagggtaaataaatataaataagtaaatatatatgtgtaaattgtgtccagatagttgtaatgataatgtctttggtttattcacatatggttagttcaatattatttttaccttgtaaagtgactaatgaagggcttgtgcaaagaattagagaagagtcaattgacagtttacttaaaactaactaatattctttttttttttgagacggaggcttgctctgtcgcccaggctggagtgcagtgccgctatctcagctcactgcaacttctgcctcccgggttcaagtgtttctcttgcctaagcctcccatgtagctgggattactggcgtgcgccaccacgcccagctaatttttgtatttttgatagcgactgggtttcaccatgttggtcagggtggtctcaaactcttgacctcgtgatctgcccgccttggcctcccaaactgctgggattacaggcatgagccactgcacccagtgaaaacattcttaaattctgagcacacttaagttttttgcaatatgcccaaagagaatgaatgagggaagaaaccattggcaacccctttgtgttgtggaattcccaatcttcagtaagtgacatttaaccatttaacatcagattaagggaacacgtatcaaaaaaaattttaaagattattttttaaactaaaaattaattgaaagttttttgttgttgttgttgttttctttttgagacagagtttcgttcttgttgcccaggctagagtgcagtggcggcatggtcttggctcactgcaacctccgcctcccaggttcaagcgattctcttacctcagcctcccaaatagttgggattacgggtgcccaccaccacacctggctaatttttttgtagttttagtagagacagggtttcaccatagtagagacagggtttcaccatgttggccagactggtctcgaactcctgacctcaggcgatccacctgcctcggcctcccaaagtgctggaattataggtgtaagcttccgcacccgaccaattaaaagttttaatattccccctgtggtgctatatatgtatacataggttttcatccatggtcctggttcataactcccatatccctttttatggtcttttgttaataatgttgggtgtgttaggcctcagccgcagacctcaggaaatagtctgtctcctgcccttctttcacctgccccagggcaggactctaatctcccaccacctcctttctgattgtggatcttaagaccctccactgagagggtcccacctcataccctcgtgggaggaaggaatgcttccataaaaactcaagaggactgggtttggaaagcttctggatagctgaacacatggagatccctggagggtggtgtgcccagggagtcatggcagctctgagccccttcgcccataccttgttctatgggtctcttcatttgtattctttgcaatatccttcataataaaccagcagatataagtaagtgtttccctcagttctgtgagccacttcagcaaattaattgaacccacagaggggatcatggtaaccccaacttgaagccagtcagtcagaagctccagaggcccagagttgtgactgatatctagggatatgggggacaatcttggagctctcaagatgaggcccgaggctctcttttaaggggtgttctggataagtcatagcagttaacaagaatgctaggacatacagggacacataattcatcagtcctgtcaaagtacatcacaaaaatccagtatcatgattccaacagcatttcagtcttggggttagggttgaagttagacaaaacaaaaacaaaaacaacccacatttggtcacagagaagtcttctgtgttgatgattattgtagtatgagagtagtggaaaaacacgaggttggaaagagtctttccctacacactcccccaccctggaggatcatcttgcctacctcctggcatgtgcacaccctgctttggaaaccaccttgcctcacacaagggatgaaaatgcattgtggcagaattgagttctttgtcttttctcattttctctccagatttcatatattgtggaaaagcagttgaatgagaaaactaatctttcaaacaagcatagccagtgtaatgcagacttcgtagactgtagagcatgtccctctaaaactgagtgtataattgagtctgtacctaggacttccagggcttttagtaattaaatgatagattttatagaacgcagacattgtttagctaaaaagagatatttccatctcaattctatttagaagatattatggagctagaggtggagatctatgactaagggcatgttgaatttttttatgaaagaaggggactctggtaattaattttttatgataatgtattctttcaatttggaaatggttcgagtacgaactcaattattttcaaatataaattttggaaatgggatatttttagatctaattgccgatgactaatataatgaatctttataaaaatactattttgtatcttggaggttgggggacatgtagatgttgcttaaaatcattgaaaaagtattctttttgcagcatcctgcttgcctggcttgtggatttcaccttgtttctgctggggatattagtttgtttcttaaataaggatttttgtctatttaaagactcagttgtctagtttcaaaggtaaagcttaaagcaggtccttcttccgcttccctactccacaaaatacatagtcacagactgactagtaatgagtaaaacaaaagcaaactgcctcttaatctaggaacagagaagaaataaagaagtccctatttcagagagagtaagggttaaaattcttagcagtcggggcagggtataacactcttgagaagagtgataagggctttcccagtagcctgcagttccctgtagagtagtacatggctagacttgtcagattagggcaagaatagcaatttgaccagtgagttccagcaggtgtagcagcaaaagcacagatttcttacacatacatgtaatgcatgtctgcttatagcggacagcccttgagatgaggtctgaggtgttctgaatgagtcatagcagttaccaagaatgctaggacatgcatgcacagataattcaccaatcctgtcaacatgcatcacaaaaatccagtctcacatgattccaacagcagtagcgcctaaattcacgttattgcactgtaacaaaattgtatcatcttgtgtatagcctaggatctactggcttcagctaatgtagaagtcattatcactaggtggcatttgcttggggagttgaggcctcacacagagggattttcctgaggtttcctaccaatacagcaaactctaaggaaagaagaaggtagggttggagagagatggggttttgtatattatttcaacccattccgttggtttaattttcgtgtgagagtctagccaggcaggctaggataggaaattattttgtctgactctttgccccccttttttcccaacaccctctgtgctgctgttcttcctcccttgactgtaagtagtgtaaccctcccttttgctccagctgctttattttcattattattgtctaggagttcctcattttcctgagtgtggaaaagattctaaagaaaagaccttgatccagtaattaattttgctcttaacatttacagacccttcctctccttaataaaaatggctaaaatacaaattgttaaattgttatttcagaatttgaaataacagtggatttttttctttaaaaaatgaacttaaaatgatcatgctatgaaagatcttagatttatttttggttctcaggtttgattaataaattatatttttcagttcattgcatactacaaaatttattaaattatctcagctgtgattaaaattaaaatgtatcttgttacattagtatgtgaaaattagttctatcctgtaaaaatactaccatattatgaataatcttttacatgcctgtaggggactaatgggaaatttagtaatatttgcatattttttccttaaatagtagtaatatttccatgttttgtttgtaagcgacaaatatgtatatatatattcataggtattttttatatgatgggagaaggttttgtatttttgttttttgcctcagcttttcccagctctagggagaggtttttaatatatctttgtagttgatcaaagttataagggatctgaacttattgatttaagctattaaagataacctttgcatacacaaagttctgttatagcgaatactggtacaacaaagagtcataacaatagagttctttaaaaaaacacactgtctttgctctcatttcccaacatgatggacctagtaatggatatggtgatctagtagccagaatattttaaaatttttatactgccaattagaataatgcttttctttaatttttgtcaatgaatgtgagtttttataaatgctcattttatactgtaaaagtagttgaactttatgaatttctgcaagattctgccactatgcgaaaacttgaatgggaggtgaagatttttttttttttttttttggtagagacatggtctcactgtgttgcccaggctggtctcgagcgaggtaaagattttaaatggagttcagctagtattaagcccactactcacttgttctgtggtactcttaacaaataatgttggattacgacagcaaaatatgtggtatagaactattttcatttttgatctacttaggacaggtattaatggacactttctcatagctcataatcatgttggtattgctgtctcttgtttgtgaaagtctgtggaaacatcagtcactactaacggtagacagtctttagatttcagcagatattcgtcagggtttgttgatgtttgtttttacatgatgaaagtccctatcaaagtaattctatctccaaaagattttttttttttttttgagacagagtctcactctgtcacccaggctagagtgcagtggcatgatcttggctcaccggaacctccgcctcccggattcaagcaattctcctgcctcagcctccaaagtaactgggattacaggcatctgccacctcgcctggctaatttttggtatttttagtagagacgaggtttcaccatgttggccaggttggtctcaaagtcctgaccacaggtgatccactcgcctcggcctcccaaagtgctgagattacaggcatgagccactgcgcccagcctgtccaaaagattttaaagttgggtgttatgttattgaaataaaattcttatataaattctcttatttactttgttagtggggaaatccagtatccttaagaatacaatcctaaaataaagttgttacatattgcagaaaggcagagtgattgtgttgttatggcaactcaaatggggaaaatgaaaacagcccagataagctgcatcctgttgtcatggcaaccacagttgtggaaatgattaaagctagcctagaaaggatgtattgcagctttagtccactgaaagtaaatagtgtaagaaaagacagggagaattggtttttgacaaaagttaaatccctctggtgccacaagttgctagtaccaccatgtgtagacagatctctgtcctttctaattgtgtttcaactcaattttattgcctcagatcataattgtgctatggaggaaagaaatgtaataactatgaaaagcttgtgaataatgatttttttggtagcaaatttagaaagcaaagttaggaaatttatttattgaaaatgacttttaaaaaatagggtgttttcctttcctctttcccccatttctcacccagtgcttaattttcatttttttcataccctgttactgtatcattttagtcttaagtgttgaattgtaatgtaaatatctaataccatggcaattggtaaggcatcacatgcagcattatgattgcctatgaacagatggatttgatgataaatgataaacatcctgtaagtgtgaataaatttattttagctctatctttcaaactttctctgtaatcaaagcttcttaagtgtttttaaaaatgccattatttccttcccaaattccacttgctcatcacagcaagatatttcatcctagtggagtggagacatgttaggaataaacctgatgaaaaccgtggtctttgttcagcagctggctgcttgcacaggtttttgtggtaatggcattggcatctctgtattagagtattgatctgctgcttggtaggtactgtgtaaaataagtcttctagtaaagatgtattaagtggtttaagagcagtttatattacaaataaggtggaagaaggtggagttctgtaagaccggacacatgctataaatatccataaaattaagtattttatctaaaaatgtgtgttgaaaatttctttttttctttttttctttttttgtttttttgagacggactcttgctctgtcgctggagtacagtggcgcgatctcagctcgctgcaagctctgccttccgggttcacaccattctcctgcctcagcctcccgagtagctgggactacaggtgcccgacactgtgcccagataatgttttgtattttttagtagagactgggtttcatcgtgttagccaggatgttctcaatctcctgacctcgtgatctgcctgccttgacctcccaaagtgctgggattataggcatgagcaactgcgcccagctgaaattttcttattttaattcatatttaattgcacatagttgaacattatctgagtgtgagttgcgtacactaataccatcatcctttgccctttagtggaggattttatatttgatgttcctgtgttgtggttgaaaactgtgttgtaaactcgtcagttataagaaataatattgaccataggaacagtgttttaaagtaatccgttgaatattttcatgaaaatccaggttgattttgcctgagcataagttggtcttcatcaataacctcttcactgtatacattgcctggttttgcctggctaaccgaaatctggcctttcatgtaggtatagagaagaaaccttttttgttttttttcttttgagatagagtctcactctgttgcccagactggaatgcagtggtgccatcttggctcactgcaacgtccgcctcctgggctcaagcgattctcctgcatcagcctcctgagtaactgggactacaggcatgcgccaccatccccggctaatttttttgtatttttagtagagatggggtttcaccatgttggccaagctggtcttgaattcctgacctcaaatgatccacccacctcggcctcccaaagtgctgggattacaggcgtgagccatcatgcctatccagaaacctatttttaaaaagaagaaaaagatggaggaggagaagggagaactataactagaatcacctttttttttttttttttttttttagaatttttaaaaagctcattcccttttgctgttatttaatggtagcaggtcatgtatgactcatgacttaggtcatacaacttaggatattaaatggttcagatacccagcaaacagttcaaagattgcattaacaagctagctaacattttgtaaaggagttcaaaatgaaagactgtcagtacctatattccgtgtgcctagctgttgttgccccactggaatgtcacaatgcaaggatgtgaatctccctttctcctaacagaagtttttaaagctaacagattttaatagatttgcaaacagaagtttgcaagcagaagtttgtaaatctgttaaaatgttttacattaaaatttgatgcactgatttttagattggtgtctaaagtaggcaatatcatcaggttgtgcatttgagatttaccagtttacatcttggcttatgataaattggattggaagatcaggtactttattttcctggaagaaaaaaaaattaggtatattcatcattcccatttcacaatttcttgtcatatctcacttgcttcagaaatactcattttggatccttcttgtgaatatgtaactcttaatactaatgtcctgagagaaaggagaatttcttgtctaacctcagtaataaccataccatcacaaaagaaggcctcacaatgtatcaggcaatcaaatagccaataacctattctcctgctaaattccataaactggatggggagggtagataatgttcatttttgttacttaccagggaacatgacacttggtctttgaaattgttatttatttcatatattgtagctgccaatcagtcagtgatttgcaaatagcaaagtaaatacactgctgaaaatgagtttcttctttgtgctgatctgtgatgtgcgggaaatcagatgtaatatggttgcatttatttatgtaggcatctattctctttcttaatgagcaagtaattttcttttctctacttctacacaaaagttaaattaaggagtacccaagagggctgggaaacttggtttgcagtcattgaaatactgctgagtatcgggatcctttcatgagtggagtttccctctccttaagaagaaagctccagatagctcccttttgaactcattgttagagcaaacacatctgtagaggaagatgatccataagtctaatgctaaggatttgcctcctctccctatcaatgagaagggtttgcctcctctccctgtcaaaggattttactctggcttatttggctgtttttgcctgggaagtgaggggcaagagctctgatctttcctatgacggccagcctggccttaatatgtagattattaacatgataccagcctctgttgagtcatagcaactgctatgaacaaacatgtaaatccatctaggggaagaaaagagtgttgcaaatgcctttcatcaaaatggaagactacttcaacttctatttgctcttcttgttataaccaagctttttcttttttcattttcctctgcctttctttccctccttttttccgtccccactatcctccatctttcagaaatatcaaaagctgaatcttcccaccgaacactgcaatcatttgaaatttgtgtataggccagcttcacatcatcagaaattgtgtaaccccatgattcccaggcctcagctggtagtgtagttatttcaaataatatttaatacaataaattctatggcaataaaagaatttggacagtcccttcgaacttattgcaatgagatttgacttgaatttaatacaatgaagtttcagaatagccaagtaattttgttgtggcatgatttaaagggtatttaagtacaggtataggtgattgagtttgtaaaacctaatcagaggtaaattgcagttttactcttatcacgtgaatgagcattcaaaaatacagaaattctttacttagcataaggtgatttttaacagtgtggcaaagagtgtaagtgaacatccttaactttttgttctgtcaaggggagaataaagataccacctggctgtatgtataaatttgcttactaagatggttgattgatttcttttaggtgggtattaaaagtggcttttttggtatagaaaacatgtagcatcaaagcagtgttgtgatgccctgctgtcttctgatgttgaatattttatgggattaaaaacaattgtttttatcttactctttcagattcaacaatcttatagtaaaagcagccatagactaaatatttagaatttattatgctgatacaaatgaaagaaacataaaatacaaatattgagtgaattaagaaaaagaggctgcttgcagtggctcacacgtgtaatcctggcactttctgaggctgagtcgggaggatctcttgaggccaggagtttgaggctgcagtgagctatgattatgccactgcactccagcctgggtgacagagcgagacctcatctcaaaaaaaaaaaaaaaaagaaaaagaaaaacaatgtttctttctagagtgcttagcagggcaaaaaaagaaggaaaaaagaaaaacagaatgttgatgttagaaaaatttggttattgtcttatgctctggagttcttacctcaagccagtgacttttaagatctgttgttttctgtactgaagcagaatagtgaaaatgtttttataggaagttatgaaaaaaagtctatattaatttgctttgggtcattctagtctctctggtaaattcataattaggaaggcctttttaaggctgtatgctagtctcacaggtacacagctacttcatatctgataaatctaaattcatatgtgaggaggttatgtttttttaaagcatattatttacacaattcactggaatggctcctttggaagttgggtgactctcttatgtaattatatacttagtaaccctgctctacaaagcagtagaaattcaagtaagaataatttactgcttatgcatagttattagaattttaaagcatttgtttgttcaaaattctagtttatcagtgttgtatttgactaattgcctacttaataaataatgaatataatttattttagaaggcacccaaattttaacaattgtaaataaacattaggagctgctccccctcttcgctttcttgtttaaagggattctcatccctttagtccaagtttcgtggagaaaataattcctatcttaaaaattctatattagaagtattatagatggacttaaattacagaattgtggaattttattgctgtaaggtagttagaaatatcttattctatccattttaccagcaaagaaggtgaagtgtatagaaattaagtgaacttctcaaagtcatacaattggtttgaggacaagtctgttccacaacctgatatgtcatgccttctcagttgtcatgataattcagcagttcatttcaccagggattccttgaacactgctgtgtgtacaacagtgggctaagcatccagaggttataacaatagtgtgagtttatatggtctaacaataatgatatcagactagtaatattttacatttgaatctcagttttatctggtgttttctaatgtttataaatgttaatgtgtggtggctaaacctttaaatctctttttctctactagattataacctctttaaaagcagggactcatttagcttttgtaaagtcaatccagtttcatttttaaagacttaaattaaaatttctaagcattgatggcattgttggaataaatgtagcttcctgaggtgtcttctctggggacgatacacattttaaaattgtatttctgttttcatcaagtactttccatttcaagtaacagattgcttcattccccctttaagcaagaagggagagtattttaagggtacagagatagctcatggaactaaagggaaaaagatggccagtaaggccccataaggacttggaaccaggcattggaatacctttaggacacaaggcagccgcccttgcattcctaagataaatcctacttagtcatggtgtatattcctttttctgtgttgctggattttatttgccattattttgttgaggatttttgcctatatggccataagggatattggtctgtaatctccattctgctgttgagaccatccagtgagtttaaaaattttattttcagttttctcattcccatttagttcttcccctgaccccctttttttacttccccactttgagacaggtctagctctgttgcccaaaccagagtgcagtagcatgatcatggctcactgcagcctcgacctctcaggctcaagagatcttcccacctcagcccctcaagtagctgggactacaggaatgtgccaccaggcttggctaattttgtaagaaattttctgtagagacagggtcttaccctgtttttcaggcttgtctggaactcctgggctgaagcaatcctcctgccttggcttcccaaagtgctgggattataggtgtgagctactgcacctggcccatttagttctttatatctgttgtttctttgctggtactctctttctttcaagagtgtttttagttattggaacattttaatcctatctatgtgtatgtgtgtgtgtgtatatatatatatatatatatatatatatttttttttttttttttttgagacagagtctcgctctgtcacccaggctggagtgcagtggcgcatctcagctcactgcaagctccgcctaccgggttcacgccattctcctgcctcagcctctcgagtagctgggactacaggtgcccgccatcatgcctgactaattttttgtatttttggtagagacggggtttcaccgtgttagccaggagggtctcaatctcctgaccttatgatccgccctcctcggcctcccaaagtgctgggattacaggtgtgagccaccgcgcccagccaatcctagctatattacagtctttgcctttaaagttaatttcaccgtctgtgccatcttggtattggcatctgttgataccagttgaagttttcccctttttagtataccaagtaatttttgcgttatatccttggcttttttaatattatgcaactcagttttgtttaaattgtattgaaaatgttgatatttttgtcaggcattcaacccagttggcttcagtctacaagttgagatttctgtaggattgtggtttcaatgtctgttacattttgaaagcctttgcagttctattgagatatattccatgcgtgtgccacttgatggccattgtggaatctggatgatagtccatcttgtagttcagttctcaaagtctatgcctggccgagtgcagtggctcacgcctgtaatcccagcactttgggaggccgaggtgggcggatcacgaggtcaggagatcgagaccatcctggctaatatggtgaaactccatctctactaaaaatacaaaaaattagccgggcgtggtggcgggtgcctgtagtcccagctactcaggaggctgaggcaggagaatgggatgaacccaggagacagagcttgcagtgagcctagatggtgccactgcactccagcctgggtaacagagctagaatccatcttaaaaaaaaaaaaaaaaaaaaagtctatgccttactgttttgggttatatccacccatgtgcagcttgggggtgaacataggagttcattaaccactttatggggccattttcttgagttcctccctctgtacaatctccccagtactatctggttccctggggccgcctttttcagtcctccagccagaaagctaggactttatttaatcctgcatctgttactgcatatggggctacgcaatgggaggctagaggaaaaaaaaaaagcaatgaggttttgtctcacccttttaggatcacaactcctctgatcagagaggaaggtttccttacttcagagttttagccttctttgggtctctgcttctgctgtggctttcctcatggaattgctttgagagaatagcaagaactttaaagaaaaatgggagatttttgccattctctctgagtgttacgatactccttctgcactccttaagctagaactagagggcttttcctggagctctctttactgacaccaatacccacttgtgggtttcaggcagcagtccaggctggtggatactggaggaataataaaaagataaattcattattggttcagtgttatgtaaaagtcttctccaattacctgctagtatttaattttttgagtcttcaaatagttgttctatatgttctgtccatttcttagtggttgccttcagtgggaaatacaggatggagtgcacttactccatcttacatggaactagaaccccttctagttaattatccttttgatattgatttatgctagtcaacaacatacactgcaagttcagtcctttgaacttccttcatggcccatcttaaggtctgttttggtaaagtgtagcaagtgtgcttgaaaagaatgtgtgtgtatactgcagttgttgggtgaagtgttctagataaatcattacatcaagtttattattactgtgcttgtcacttctttgttgcttattctatcaatagctgagagagttatgttaggctctcaaactatgtagatttgtgtattttccctttagttctgagttttttgcttattttgaaattgttagtagtggtacatatacttttaggattattctcgatgaattaacctttttataattatgaaatagtcctctttattactgcttatacttttttttttttttgagatggagtctcgctctgtctcccaggctggagtgcagtggcgctatctcagctcactgcaagctccgcctcccgggttcatgccattctcctgcctcagcctcccgagtagctgggactacaggcgcccgccactacgcccggctaacattttgtatttttagtagagacggggtttcaccgtggtcttgatctcctgacctcgtgatccgcccgcctcagcctcccaaagtgctgggattacaggcgtgagccactgcacccggcctactgcttatactctttgttccgaggtaaactttcatgttaacatagccatctcaggtttcttttttttttttttttttttttttttttgagacggagtctcactctttcacccaggctggagtgcagtggtgtgatcttggctcactgcacctccacctcctgggttcaagtgattctcctgcctcagcctcccaagtagctggagttacaggcacgtgccatcacagctagctaatttttgtgtttttaatatagacagggttttgccatgttggccaggctggtcttgaactcctgacctcaggtgatccacccacctcagcctcgcaaagtgctgggattacaggcgtgagccaccgtgcccggcctcagctttcttatgactgtttttatgatacagcttctttaagctttttacttttaatttattggtatacattaatagataattgtgtcggtttttaaattaatcatctgtcctgatcatctgtcctgatcatctgtccttctttgtttatacttgcactgtccaatagaaacatttaccacagatgccaaccaagtatatacttttaaattttcttgtagccacattgaaaatgtgaaatgaagctgggcaaggtggctcatgcttgtaatcccagcgttttaggaggccgaggtgggaggatcagttgaggccaggagtatgagacctgcctgggtaatatagcaagaacttgtctgtaccaaaaaaattaggcgtagtggtatacacctgtagtcccatctacttggaaggctgaggcaggaggatctcttgagctcaggagtttgaggttctagggagctgtgatcataccactgcactccatcctggttgacaatgagaccatgtctcttacaaaaaagtgaaaagaaagttgaaattttcataatgtattttatttaacacaccgtaattttttatttttgtttttatttctttggaaacagtctcgctttgttgcccaggctggagtgaagtggcgtgatcttggctcactgcaaactccgcctctggcttcaagtgattctcgtggactacaggtatgcgccactacacccagctaatttctgtatttttagtagagatggggttttgccatgttgcccaagctggtcttgaactcccgagctcaggcaatccgcccaccttggcctcccaaagtgcaagatgacaggcctgagccactgtgcccagcctaacacagtgtagtttaaacattaatttttttctttttctttttttttttttgtgagacagtctcgttctgtcgccaggctggagtgcagtggcgcaatctcggctcattgcaacctccacctcccaggttcaagcaattttcctgcctcagcctcccaagaagctgggactacaggtgcgtaccaccatgcccagctaattttttgtatttttagtagagacagggttttaccatgttggccaggatggcctcgatctcttgacctcatgatctgcccacctcggcctcccaaagtgctgggattacaggcgtgagccactgcgcctggcctaaacattatttcaaaatataattaatatagaattatgaattagatatttcacttttttgtattaagtttttaaaaatcaatgggtattttaaagttgtaacatatttcaatttggactagccaccattcaagtgctcagtagccgtatgtgactagtggttattgtattggagagtatgtttagaccatacatttagtgtagtgatcagtatggttaaatttaaattgatcattttgctatttatttgttttttcccatctgttctttttcttctttttttttaaatttattttctttttctgagacagggtctcactctgtcacccaggctgaaatgcagtggagtgatctctgttcactgcagccttgccctcccagcctcaagtgatcctctcatctcagcctcctgagtagctgggactataggcatgcaccactatgcctggctaatttttgtattttttacagagacagagttttgccatgttgcccaggctggtctccaactcatggacgcaagcgatctgccacctgggcctcccaaagtgttagaattacagttatgagtcactgggcctggccctttttgcctttaaaaaaattttcctgctttcttttggatttattttttgttactatttaagtattccattttatgccttctattggcttactaggtacctttgttttgttttaatgattgctttagaggtgacaatttgcatggtaaaatattgaggttggccgggcacagtggcccacccctgtaatcccagcatttgggaggctgaggcaggtggatcatctgaggtcaggagttcaagaccagcctagccaacacggtgaaaccctgactctactaaaaatacaaaaaaattagctgggcgtggtggtgggcgcatgaaagcccagctatttgggaggctgaggcagggcaatcgcttgaaccggggagacggaggttgcagtgaaccaagattgtgccactgcactccagcctgggcgacaagagcaaaactccatctcaaaacaaaaacaaaaaacaaaaaaagccacacaaaacattgaggtaaagttcacataatataaaattaaccattttaaagtgaacaattctgtgtagtttagcaactactacctctatgtagttgaaagacatttacatcattccaagtaaaagcttttatccagtaagcagtttctttctattcccttccttcagcccttggcaatcaccaatctgcattctgcccatatgaatttatctattctggacatttcatataaatggaagcatacaatatgtgactttttgtgtatgacttctttcacttaccatatttttgaggtttagtcatgttatagcatttattagtagtttatttttatggctgaataatattccattgtatgtacatacagtcatgtgtcacttgatggggatacattctgagaaatgtgccattaggtgagttcaacattgtgtgaacgtcatctagtgtacttacacaaacctaggtagtatagcctactatatacctgggctatatgttatagcttgttgctcccaggctacctggacagcatgttactgtactgaatattgtaggcagttgttacacaatagggagtatttgtgtatctaaacatacttagacatagaaaagatgtagttaaaatgttggtattatcatctgtgggaccaccatggtatatgcagttcattgttgactaaaaatgtcattgtgcagtgcgtgagttaccagaatttgtttatctgtttattcgttgataagtatttttgggctgttttcaaccttttgccaattttgaataatgctactatgaacatgtgtatacatgtatttgtttacctgtttttaattctttggatatatacctagaagtaggtatataccaaaattgctatggtagttctgtgttttattttttgagacactgccaaattgtttcccgtggttactgaactattttatattcccaccagcaatgtatgaaggttccagtttctccacatccttgtcagcacttgttattttctgttgtgggttttcttgttttaattgtaacgtcaaaagcttttgagactggacaggagtttactgataaagcttcttctagtacatctggatttcctggtatgcttctctcctaatatatctggatggctgctttttagctttctttagttctttttttaaacttaccatactagtgggtgtgaagggtacattatcgtggttttgattttcattttcccaatgaccgctgatgtcaagaagagtaccctggctgcgcagggtggctcacacctgtaattccagcacttttggaggccaaggtgggcggatcatgaggtcaggagttggagaccagcctggccaacatggtgaaaccccgtctctactaaaaatacaaatattagccaggcacgatgatgcgtgcctgtaatcccagctgcttggaggctgaggcaggagaattgcttgaatctgggagtcggagattgcagtgagccgagatcatgccactgcactccaacctgggtgacagagcaagactctgtcttggacaaaaaaaaggaagagtacccttttaatgtgctgttgagagtaatatcttttcagttattttgcccattttttaattgagttgtctttttttatttttttgagttgtaaaagtatattctggatagtcaactgttcttagagatatgatttacaaaacaatatgcatctttaacttaacacagcctggaaatatttcacttcacatatactgtattttcagttttctacattcctatcctttgtgttattattgtcatacgttttgttttcatgtatattatgaacactgtaacttattatttttgcttaaattgcttactttttaaaaaaattttaaatgaaacaattttaaaaatattgacatttgtatttctggcactttttttttttttttttttgagacagtgtcactctgtcgcccaggctaaagtgcactggggcaatctcagctcactgcaacctctgcctcctgggttcaagcagttctcctgcttcagcctcctgagtagctggcattacaggtgcaggcccctacgcctggctattttgttttttcagtagagatgggatttcaccatgttggccaggctggtctcgaactcctgacctcaagaaatctacctgcctcggcctcccaaagtgctgggattacaggcatgagccactgcacctggccatttctggcactttttatagttttgtatgggttggtctattatcattcttcagatatatttggaaatatgcattttccaaatatattttctgcttctgcccatccctgttctctaattttcttttgagacaccagatatgcatgtgttagaccacttacaatttcctataggtcactgaagctttgttcagtttgtttccttagtcttttttctcttagtgctttatttttgcttcctcgggttcactgatcttctacagagtttaaatgtgctgctagtcctatttcatgaaattatcatttcaaacattgtatttttcattctggaactttttatttcattctttttttataccctacatcactatgttcatgttattatagctgttttaatttttaggtctgctaatttcattgtcagtttttttctgggtctgcttccattgactgatagtcctcctagttatgaatcatattttgtgcctcttgtcttgtaattttagatttagttgtagacattgtgatattacatttttgaatatttgtattttaaaaatctttttaaaaggatgttgagtttattttggtgctcttaagttttttgcagatcaacttgatgctcttgtggctgattttaagctttattctgatagttttagtgtagcttttattctagtgtagttcatcccagcaactgagatgtgagctttctaaggctcctagtgaatgtcataagtattcattaggcttctgaaatctgaccagtcagaacagaaatgtgccccaggtctgtgtagtttctagttgctgagcttatagttctgttgtagttttttgcctagtgttgtggaatttcactgtatgtatacaggacttagtattcaggaactgagtcaggggtgtcctattcaggtatttggaacctttttctacataattcattcttcagtattctgcctcactaattctttttagccttcatgtattttgtttcctcaagtaagtggtcccattgtactctgtttgagttcccctttcttgtgcagcagcctggacagtaccttcgggtagaagactaggataattttaagggtcaccttatttgtttcccgtcattcagggattacattctggcattgtttgttgttcagtgtcttgaaatatatgtttcacatattttgttcagtttcttgatggtaggaagataagtttgataccaattattgccttatggtagaatctaaagtctagtgcttgtttttactttagagtttaattttatttaaacttaatgtactagaagtcctcatattacatatttctaatgtgcataaatttcagttagcacaatttagttaagtgacactagtcacccaataccatggttccaatttcagttaccatagtatattaactatgagtaactatgtaaagtacaaacttcattgctagtactccagtccacacatgactatgtgaaaaacagatacacactagtctatttacttcaaggtctgttggcgattaagtttatatacagacaataaagtgtctagttgtattgtctttcccaatgttaagcccacatgatattttatagaaatagataatcaaaagtggaaattggccaacagatatgaaacaaagtaacaaaaaatgataaccctttcattgaaatttgagagaaatgtaaatgaagttatagaagaaatagttgaccataggaaaattgacactgtcaccatttgatagactctagatatgcagccagaggaacttattgaaggtgaacttattaacataaatgagggaagtggtttttttgtttgtttgttttgggtttgtttttgagatggagtcttgctctgtcgcccaggctagagtgcagtggtgcaatctcggctcactgcaacctctgcctctcactgcaacctctgcctcctgtgttcaggcaattctcctgcctcagcctcctgagtagctgggattataggtgcccaccaccacgcctggctaatttttgttttgttttgtttttttgacagagtctcgctctgttgcccaggctggagtgcagtggtgcaatctcggctcactgcaggctccgcctccagggtttacaccattctcctggctcagcctcccgagtagctgggactacaggcacctgccaccacgcctggctaatttttgtatttttagtagagatggggtttcaccatcttggccaggctggtctcaaacacctggcctcaggtgatccacccgccttggcctcccaaagtactgggattacaggtgtgagccactgcacccagcctgagggaagtggttttgatgcaaaagatgaagatgtcccagaggaaatctttacattaaaggaaaaaaaaactttatattaaaagaccttgagatatttcacaaaattgaaagtacaaaggataaaatgttagattgtgaccttgctttgtttctaatcttctcttaaaccaatctaatgaattcttaatttcaactttcgtgtttttttatatacaggattttcatgttatatattttaaattttagattccaattttctggtgtaactttttaatctgttttgttgaatatcttaaatatggttattttaaagtctgtgattacttatcacattgggggctgttgtttttaactgtgttaatatgtacataccataaaattgaccatcttaaccatttttaagtgtacaattcagtagttttagcacattcacatcattgtgcaaccagtcttcagaactttttcctcttgcaaaactgaaattctatactcattaaataacaactccccattacccatcacctctcagctcctggcaaccaccatcctactttctgaatttgactactctaggtaactcatataagtggatttatacagtacaggcatgcactgtataatgacatttcagtcagtgatggactgtgtacacgatggtggtcccttgagattataatggagctgaaaaattcctatcacctagtgacattgtagccaatgtaacgtcatataatgcaaggcattattcaggtgtttgtgttgatactggtgtaaatgaacctgctgcactgctagtcataaaaaagtgtagtacatactattatgtacagtacataatacttgataataaacaactatgttactggtttatgtacttactgtacagtattttttattgttattttagagtgggctacttctacttattaaaaaaaattaactgtaaaacagcgttaggcaggtccttcaggaggtattccagaaaaaggcattgatgtcataggagatgacaggtccatagatgttaattgctcccaaagaccttccagtgccataagctatgaaggtagaagacagtgatattgatgatccttgctctctgtgggcctaggctaatgtaatgtgtgtgttcatgtgttggttttcaacaaagatgtttaaataatatatataatatatattttttaaataggaaacaacttataaagatgtaaggaaaaatatttttgtactgctgtacaatatgtttgtgttttgagctaaatgttattacaaaagagtcaaaaagtttttaaaaactaaaaaaatttataaagtgaaaaagtcacagtaagctaagtttattactaaagagacaaaagtatgttttaataaatttagtctagcctaagtgcacagagtttattggccatcttaaccattataaagtctatagtagtgtacaataatgtcctagaccttcacgtttattgaccactcattcagtaactcacccagagcaacttgcaatcctgcaacctccattcatggttaagtgccctatataggtgtaccattttttatctttttgtctttttttttgagacaaggtcttctgttgcctgggctggagtgcagtggtgagatctcggcttacttcagcctccacattccaggctgaaatgatcctcctgctgcagtctcccgagtagctgggactacaggcatgtgccaccatgcctggctaatttaagtattttttgtagagatggggtttcaccatgttgcccaggctggtcttgaactcctggactcaagggatctgcccacctcagcctcccaaagccaccacacccagccaccacttttattttattttattttattttattttatgttatgttatgttatgttatgttatgttatgttatgttatgttatgttatgttatgttatgttattttgagacagagtttcactcttgttgcccatgctggagtgcaatggcgtgatctcggctcactgcaacctctgcctcctgagttcaagcgattctcctgcctcaaccttctgagtagctgggattacaggcatgcgccaccatgcctggctaattttgtatttttagtagagacagggtttcatcatgttggccaggctggtctgggactcctgacctcaggcgatctgcccgcctcagcctcccaaagtgctgggattacaggcatgagccactgcgcctggcccttttaatcttttatactgtatttttactgtactttttctgtttagatacacaaatactttccactatattgcagttgcctacagtattcggtacagtaacatgctgtccctgcttgtagcacaggagcaatatgctctacctatagtctaggcgtgtggtagtaccttctagatttgtgtaagtacactgtgatcacacagccgagaaatcacctagtgatgcatttctcagaatgtatcccctttgttaagtgtcacatgactgtatttgtctttttgtgactggcttatttcactcagcataatgtcctcaaggttcatccatgttgcagcatgtgtcagattttccatcctttattaggctgaataatattccattgtatgcatatactagattttagttatctacccatctgttgatggccatttgaatctgtctactttattgtttgccttttcccctggtttttgtttgttttttaatttggccatttgatccctttgctttgaatgcttcgtaattattcattgagagctagatattttttaatgaaaatgttagagactctgaaatcattcttcacagggtgttgaatattcttttcacagacatatccctttggttcagttgaggcatctctgtttttggtgcccttcattgttctggttcatgtgactcttccatggtgtcaattgaaagcctgagttgttgttgttgttattgttgttgttgttttttaccagggtaccttgtcctatatgcaccctatactccagtctttggctccacagcatcatgagactgctgaaatacacttcagacttagtttttcagcatcttactctctgcgtgtaaaatttaggagtcaggaaatgccgtaggggaaaaattatacccagaatatcaggttaaccgtaatgcatttcccttctgcctaggatctttgcccctaaagttttggctgtattagttgttctctctctcatggcttccattttctatattttatttagcttctataattttctgcatgaaatttagtctgataataattactacattatgaccaaaagcaaaatcccagtatgtatttttattaatttatattccatgttttatttttaaacattctcaaactacagaagagttgtaagtaaaatgcaaattgtttttttttcataaaccacttgagaataaggttctgacatgatgtcccatcacctctgaattctctgtgtatttcctgcaaaccagaacattctcccatataacccaataacaaccatcagaattaaggaaattattattggcatattattttgtcatctaatccacagatcccattcaagtttctctagtaatctcagtcaatgtcctttatataatagaataaatatctagttcaggatcacatgatacatttagtagtcatacctctttagtctcgtttactctggaacagttcttcagtctttccttggctttcataacattgacatttttgaggattacacgccagtatcttgcagaacatttttcaaattgggtttttctgatgtattctcatgattagatccaaattaggtatcttcgacaggaatatcacagaggtgatgttgtgtttttattgaatagtatcaggtgacacataatgtgaatttcttccaatattagtgatattaatgttgattacttgattaagatatcagggtttttttcccactatagaattaactttatatttttccaattaaaacgaagtagtattttgtggggaggtattttgagactatttaagtatcctcctccttatcaaacttacagtttatattttgtttcattttattttatttcattttagagatagggtcttgttctttcactcagggtggagtgcagtggcgtgatcctcattgtaactcctgggctcaagtgatcttcctgctcagtctcccaagtagctggaactacagatgcgtgtcaccatggcttctttttttcctgttaattctttttgtagaggcaggatctcaaaatgttgctctgactggtctctaattcttggcctcaggcaatctgctgggttacaggtgtgacccaccacacttgtccccagtttattttttatgtcattaatggagtcatagatttcaactttattcagtggcttattttattagttatctattattacataacaaattacctcaaattgagtggcttataataacacatacatttaggctgggcacagtggctcacaccagtaatcccagcactttgagaggccgaggcaggtgggtcatttgaggccaggagttcaagaccagcctggccaatatggtgaaactccatctctactaaaaatacaaaaaattagctgggtgtggtggcgggtgcctgtagtcccagctactcaggaggctgaggcaggagaatcgcttgaacctgagaggcggaggttgcagtgagccaatattgtgccactgcactccagcctgggtgacagagcaagactctgtctcaaaaaaaaacaaaaacacagacatttatatttttttgggggggtgatttacaagtgagttgtatttaaactttaaatggcgaatagttattacaatattaaatttttcaaaaatatatagaaaaatgaatacttaatacttattttcaataaatttttatgagctccagtatttcagagtgccacctcccaaaatgacagcatgatataccttggcaatagtttagacctcttctagaattttctcacatctgctttttttttgccaaacatatatatgtttatattttttctccctggctgtattgctgtataattggcaaacaaaaattattattattattatttttttattctggggtacatgtgcaggatgtgcaggtttggtacgtaggtaaacatgccatggtgttttgttgcacctatcaacccatcacctaggtatcaagcccagcatgcatcagctcttttccctaatgctctcccctgacccgccctcctggcaaacaaaaattacatttaaggtgtacaacatgttgttttcatatacatattcattgtaaaatgcttgtctcaatcaagctaattaacatatctgtaacctagcatacatgtaacatctcacagtttcttttctttctttctttcttttttttttttttgatacagagtctcgctctgtcacccaggctggagtgcagtggcacgatcttggctcactgcaacctctgcctcccaggttctggcaattctcctgcctcagcctctggagtagctggaattataggcacacaccaccatgcctggctaatttttatatttttagtagagacagggtttcaccatgttgaccaggctggtctcgaactcctgacctcaggcgatccacccacgtcggcctcccaaagtgctgggattacaggtgtgaaccacttcgtctggccagtacctcacagtttctttcaatcaggagtctgggcacagctgacctgggccttctgctttagaatctctctcacaaggccataatcaaggtggtgtctagggctgaggtctcatttgaaggttttatttcgagaaaaagccacttccaagcttattgttgttggtggtggtggaattcttttcttcaagggctgttggactgagcctcaattcttagttgtttgttgactgggtcaccgccaggtctgtgccatggggacatctacagtatgactgcttgtttcatcaaagcgtgcaaaccaagaaggcaatagagtctgttagcaagatggaagttgcagtcttaacctaattaggaaaatggcatcacatcacctttaccaagggcatgcataccaagcggtgggaaacatcggggggcatgttagagtttgcctgctaccgttatccattattatcattatttagtttgatattctaattttctcaaatgtagcctgcctcagtctttcactctggcccctgtattattttgacatgtctctgtcattcattgagcacctcaagaagatattccaagctcctcttaaactttcctgtccaagccctcgcattgttctaaggagctctggttccttttagtggagagtgatattttgaatcattaaatgtgtttgttgctattaggttgctcctaggccctctcagttggtagtcagtctgtgtgtgtctgtgggtatatgtgtacatatatatatatatatcatgaatatattatttacctaggaatttctcggtgtaatacattgtaagatttcagcttacaacaacatcctcaattctagttcagcaatgtaatattcattctagttttctttctttctatacttgtaacttgtttttctgattatgagaaacctagctcttattatcctttgtatttgatctgccacctttatttgatcaatcttcctgtataatccatctcctgttgctgacatatctctcgctccatttctcaccccatacttcatatgcatgcctccctcacccttttgggatccgacagcttgcacttggctgccccttccaccctcctcactccactgggtctgaaactcactgctggaccactgcctctccctctcttaatgcatgccttcttctgccgacatgggcaaccctcactgccatccccccaccctccactgccctgtgtggatgtggacatcctcatcattctgctcactgctgttacagttcctacgtggtagccttccttgttccattagggctctgtcacctcatgctgggtccccctcccagcagattttttcctatcactctgcttagtccctgaaactctgtgccctgtccttttccctctcgggaatacccttttcctactacttggactccaaaagcctgttttgggccactgtagtcaactctctgccacttagcttgatgcctcctttgcctgtactcacctattgaactgttcaggtaggaaaggagaagagggagaggtatcagttaaattttatttttgaaaaactcactggtatttttacaacaaatgcttttaacttagtttgttattacttacatagaagtcagttactcccacatctctgtaatcgctacaggtttatactcatattttcatgccatatttttcttacatactagatagaggtttactatcacatcagattcatgatttctgaacttggttactccctgcaccctccaaacgagtttcagtttaccagtgtctgtcactaccactactgttcttctagtcattcaagtttgaaatgttgaagttaattcatttttccttatgatcagttatccagtcctgttgatccttcttttgatgtacgttatcttctccatggccattactttaatgaatataataacctcttgggtgcgatttctttatttagtttgtgtagtcattcctgtgcccctaaaccattttggcttcccatttcttaatgagtgaagtaactccatgtttaacttttaaagtgccattttaatgtaacactattctagatagtcagaatatctagttttgactcccatctttgttgcttactaactactcatcaacgtgtaatttatttaacctccctgggtctgtttatttttattttattatactttaagttctagggtacatgtgcacaacgtgcaggtttgttacatatgtatacatgtgccatgttggtgtgctgcacccattaactcgtcatttacattaggtatatctcctaatgctatccctcccccctcccccctccccccaccccacaacaggccctgatgtgtgatgttcctcttctgtgtccaagtgttttcattgttcaattcccaccaagagtgagaacgtgcagtgtttggttttttgtccttgtgatagtttgctgagaatgatggtttccagcttcatccatgtccctacaaagggcatgaacttatccttttttatggctggctactattccatggtgtatatgtgccacattttcttaatccagtctatcattgttggacatttgggttggttccaagtctttgctattgtgaatagtgccacagtaaacatacgtgtgcatgtgtctttagagcagcatgatttataatcctctgggtatatacccagtaatgggatggctgggtcaaatggtatttctagttctagatccctgaggaattgccacactgtcttccacaatggttgaactagtttacagtcccaccaacagtgtaaaagtgttcctcttctccacatcctctccagcacctgttgtttcctgactttttaatgatcaccattctaactggcgtgagatggtatctcattgtggttttgatttgcatttctctgatggccagtgatgatgagcattttttcatgtgtctgttggctgcataaatgtcttcttctgagaagtgtctgttcatatccttcacccacttgttgatggggttgtttgtttttttcttgtaaatttgtttgagttctttgtagattctggatattagccctttgtcagaggagtagattgcaaaaattttcttccattctgtaggttgcctgttcactctgatggtagtttcttttgctgtgcagctctttagtttaattagatcccatttgtcaattttggcttttgttgctatggcttttggtgttttagacatgaagtccttgcccatgcctatgtcctgaatggtattgcctaggttttcttctagggtttttatggttttaggtctaacatttaagtctttactccaccttgaattaatttttgtgtaaggtgtaaggaagagatccagtttcagctttctatatatggctagccagttttcccagcaccatttattaaatagggaatcctttccccatttcttgtttttgtcaggtttgtcaaagatcagatagttgtagatgtgtgttattatttctgagggctctgttctgttccattggtctatatctctgttttggtaccagtaccatgccgttttggttactgttgccttgtagtatagtttgaagtcaggtagcatgatgcctccagctttgttcttttggcttaggattgacttggcaatgcgggctcttttttggttccatatgaactttaaagtagttttttccaattctgtgaagaaagtcattggtattgatattgattcttcctatccatgagttttttttaattaagttaaattttttttattttccagtttttcataaaaatagagatggggtctagttatgttgaccaggctggtcttgaactcctggtctcaagcagtcctcccaccttggcctcccaaagtggtgggattatacacatgagccaccttgcctgaccctctctgggtcttatttaccttactagtttattatacaggtgaatgaattggggaagagcttgttccgcaattcattgccaaacaatgaattgttagactgacaaagctaactaacaaagcttgttagtttgttatacagagaatgttatacagatgcagcttgttagtttgttatacatatagtaacaagtgctacaataaaattaaagtctgtgactgagcttttctaaatatttgaaaatttacctaaacttatagtagctgttgtctaatgcaatttagtacattgttaaattttttcttgtagttactatttgttagtagtttatctccttgaaatagagtgtaaactacttgagtctgtggatttgtggagacaaacacatttgagtattatttctgccattgtcatttaggcactataacttcactgaacttgagtgtactctcttgttaaggcaaaagtactaataattctttgacaagaaggtaatgcttaaatgaaataatgtacttaagggatctagtacaatgcctggcagacagtttattcccggtaaactttacttatcctctttttgtactccacctgtgcccactttggtaatgaaaaaataaatggcttcccagaacagtttgaaatgcaagtggcattcacagaagcctattcctggtgatgatgccatttatatttttttcttttgcactttgcagcttttagaatccttattttagccgggtgaggtggctcgtgcctgtaatcccagcactttgggaggccaaggcaggtggatcacctgagttcaggagttcgagaccagcctggctaacatggagaaaccctgcctgtctctaccaaaaatacaaaaattagtcaggcgtggtggtgcatgccggcagtcccagctactcaggaggcttagtcaggaaaatcacttgaacctgggaggcggaggttgcagtgagccgagatcatggcattgcactccaacctgggcaacaaaagtaaaactctgtctcaaagaaaaaaaaagaatccttgttttagttttaccacaaccttgtgcaataaggctgggcagatatgattatcctatctgacaggtgggagttttgtttttggagtgaactaaattgggattcttaagaggcaatcattggatttgtaggtaaagtctgaatgtattacatgattatggtatactgcatttctctgaatttcttagttgatatagtagtgaaaagggaattcttctattccatggcttaaggatacgtaaactctcagtacagcaatctttttattgttgattattatagcttctgttactcctagaagttgaccaacagggaccttaatttaggagattttgtcattcagctttcgtatagtaaatgctgaggctagccctttgcctgcagggctatcagtgaagaggatctgtgacattactccagacagccaagtgtagggggaagagttgagattttcagtgttctctgtgtaaatgaattgtgccattgaacctgatgggcactagatactatattcttcttgaagcactggaggcccttcattgcaatcttgttttttcaacttttattttaaaattggggtatatgtgcaggtttgttacagagatatactgcacgatgctgaggtttggagtctgagtgaatctcacccaggtagagagtgcaaagtacccataggtagttttttcaagctttaccccctttgtcctcccaccttttgtattcctcagtgtctgttcccttctttatgtccatgtgtactcaaggttttgttcctatgtataagtgagaaaatgtggcatttggttttctgtttctgcattagttcgcttaggataatggcttctagctgcatccatgttctgcagaggacatgatttcattattttttatggctacttagtattccatggtatatgtgtactgcattttctttatccagtcttccgttgatgggtacctgggttgattctgtgtctttactatcgcattgcagcatttcaattttttttctgattcaggtagtagaaaacatgttcagtcttatttttttctgtgctgtgtatgctttttaaaggctagtgaagtcattcagttggataacaacaattataatacattgttatactcttcaactttctttgattttgcaaaggagagtcaattggggtgacgttaggtgggaactgagctgaagaaactaatatgtgctgtgcagggctggatttgtgtaggatgcagtcattatctgttaactttgtcatagcttttgagactgcatgtaaggagtaggtgatttgcaagttatttaacagttaacagaaggtaaatatttaaacaggagaatgcgtagttgctgcttagtttaaaacctgcttttttttttttttttaattaaaaaaaatgttttttagccaggcgtggtggtgcacgcctgtagtcccagctactgggcaggctgaggcagaaggattgcttaagtccaggaggtcaagggtgcagtgagctgtgatcgtgccactgcactccagcctgggcaagagagtgagactctgtctcaataaaaggaaagaaagggaaaaaaaattaagtatagaaagaaaattttaggaatttaaatataatttgcaaggaaaaacaacaaaaacagtccaaactttaagtagaaaactatgtgcttttcaggtattttaaaggtaaattttaaagggcattatttattaaatgttgaaggacagaaaacatcttacatatttgtcagaaactgaccaatcagaatggccctgaaatgtatagacttaataaggatagtaaccaaaatgacagtcctttccactttgttcctcattgcccaaatttgctattttctccttcttttacgaaatgcttctaaatgtgaagatagaagggaaacaggtagagtaaaagttatagcccactccatttattttgtaataatattttttctcagtgttaagtggcatttaccagtatagataagattaattgttacaaaacaaaccaatttgaagattagtttttaaattgagccataatatataaaatcttatggtaatgtgcagatctgactatattcaagtatagttttcatacccataccaattgtcttgtaataatcgggaatgcatcctctgtgtggtgtttgcaaattaatgctattttggaaatcacaccggtatatctagtggctttcctgggtgtatgtggctcattactgattataattttctttgggaattttagtttaaggggatggggtaagcactttcaaattctttgttgttagtagttttgatggaggatagggataaatgaatgaggaagtgtgttagaacgagtaagtaaactcagataatttatcaagtacatactacaaaaataacgcagatttttatgtaaaacggaggagacaaatcattcacaagaggaaagccttaaaaacttaccaaggagcattcacaaaaataaatatgtatattttaattttaaaaagagccccaagtctgtgaatgaaagggttctggttggtttctagacccagctgtgcttgctgtatgccatgcaggtggctttagtatggttaaaagtgtcgcctgccctcttgtgaagggaagcaggagaagcgacaagctaccttccagtgcctcctcgattttcttccactatttcctttgtccttttcctgtgttttcatgctctatttatttacacccacttctgacttctcttttttctcagattcaatctttccttccgaatgactgtgagatttttttctacccagcacacacagaaacttaaccaattgcgtatgtacagcatttccatttcttttttctttctttttttttttttttttttttttgagacggagtcttgttctgtcgccaggctggagtgcagtggcacaatctcagctcactgcaacctccgccttccgggttcaagcgattctcctgcctcagcctcctgagtagctgggactataggcgtgcaccaccatacccagcttatttttgtatttttagtagagatggggtttcaccgtgttggccaggatggtcttgatctcttgaccttgtgttccacccaccttggcctcccaaagtgctgggattacaggcgtgagccaccgtgcccagcctgtgtacagcatttcttataacaatgagttacttttatgttaaggatttttttttttttttttgagacgggtcccttccttccttccttcttctctttcttctcttactttcttttctttcttctttctttccacagggtcttgctttgttgcccaggctggtgtgcagtggcatgatcaccgctcattgctgccctgatatccctggctcaagcagtcctcccatctcagcctccccaagtagctaggaccacaggcatgtgccaccatgcccagctattttttaaattttttgtagagatggggtctcccacattactgaggctggtcttgaacttctaggctcaagggatccacctgcctcgccctcccaaagtgctgggattataggattgagccaccacatctggctccaggacagtgtctactaccagaacagcatttaataagtatttattgaataaatgattaaaatattagccttaagaaaattttagtatcatttacttaaaaaattagcaaagcattcttaatacgtataaagaagtaatatgagtagaatgtgattctcaacagcaaggaagctttttttaccctattttctccattctctttctgttgccttctccttccaatgtgagaatctctgctattaagaaccgctggcagagactgaaattagtatacataattctaaggagatattgatgtaaatggtcgatatggattggcaggatgacagggagaaggaaattataagtttaaagacaggggtaagatgagtatttgaacaaaatatcaaggtaggtagttagctagagtgccagggccaattagaagattagagaaggtgagttgatgttggcagtgggggaaatgtcagattgacagagtgcttggatttcatacagtagatatctcatcatgaattattgatgagagtgacatgataacaaagtgaagacaattatttttctatttagctgctgtttataaaatggatcgtagcttgaggtgaggaaacgttgaaaacagtgaacaaagttcagagattgttggagtaattcaaagcagtttagctgttttgcttggtatgttatctggtgatgcctttagcagatacccttcttttgaagcccagtgtccactttatgactgagggatggatggaggcaggaggaagaattctgcactagaaagcaacaggccaagattctagtccctacttccctactttgtaaattcataatcatggataaatacttaatttttcctgggcatcagtcaccttacctataaaatgaggataatgtattaagcgtagtcctatgggtggtaaataaaatgaggataataatctaaaatcaggggatatacatagatctcctttggatttatttgcagcccattatctatctatctttatttagataagagacgggatcttgctgtgctgcccaggctggatttgaactcctgggctcaagcgatccacccatctcagtcttctgagtagcttggaccacaggcacaaacctcttgcatggctctcattgtccatttatcaattttagatggtgtaaacagtgaataccatattttgtttcccaatattactttctacaactatattgttttaaggagaaaaaagtctatgacaatataaaatatttcaaagtctgtaattttaaggtttaatgttacctatattgactactatattttaaaatatgtatccctgtttttatatgtgccatgattaggtatttagttttttagttattattagactgtaatagcactcaagttgatggataaaatttcatcctgggatacttttagagaaacatgaagaatataaaaatagttttgaaaagtatggtttctttcttacaaagctgtagctgcaataatactaatgtcagttacttagagctactagaaatgtgtaatttctaccttttttgactactgaatataccatatgtattatatatatgtacattcttaggtatttttgtttgtttgtttagaaggttttaataccaacagctttctaggtgtcgtcttcttcctcttcctctcccctccccccctcccctccctcccttcctcctcctcctcctcctcctttttcttcttcttctctctctctcctttctctctcttttctctctcctttttctctgtctctcctttctctctctctgtgtccctgtctctctttgttgttgttttcccttctgtttgggttgtttcttcccctcgccttataccccccaccccccacagaccccaatccatctggaaagatgaagaggcagctgctatggtaactgtgcattttggttaatgaatagcagactaacaagatacataaaacatacgcaaactgtgcagagtttgttgctgtcaaagccgtagggatacaatactttttcttttccttctaaaaaaaaaaaaaactctcttaactgtggtgttttgttttctaatttaccattcctaatattgtaatgtttctgtgaactcctcctctttctgcttagtctgcacagtattacaccctgtggtgagtttatgggagctgagttgaggtgcatagaggaaaataattgatcaactggattaagaagtagatttcctttagactgatacatagaagaatagggacaaaatgtttttgactaaatgtttggttttttgaacgataacttctttttttacctcctttccttttggccactactgccccttttgggattctctctggggttaaagccagtaagtagtgtgtttcttaaagatgtttctatcataaaggtcagctgcaactggaatattgcgttcagccaagccttaaaaattcctgtaatctgtgccatcctgtctcatactgtcccatctcatagttgtcctctctctgcagtgctctatgcccaggtctctgtggctgggctgctccagcctggcggacagcatgccttcgctgcgatgcctgtataacccagggactggcgcactcacagctttccaggtactttctctgtctctgtgggttatttgcgggcattagtgtatgtgtctaattcattagtatgtgcctcctcctttcccatactttacttatattcatcttttctccttcatattgcctgtatctcacatcactcagtactcctttaatgattagtttataatgtagacccagactgatccactcttaagacaatgtcatcatgattggttacaaaaattgacatagtacagcttgactgttggctttcagatcaagtagaagtatgatagtagattttaaagtaatctcaataaatagcagttcaatacgtaatatttgctctggacctacataaagccaattagtataatcaatcaattaattacaatcagtttcctgaacattttcttattttttttaaatgattactcaaagtataaagtgccctcttcagagtatctcctggtaattatactactaagtatatattttttataactgttttatttatatcttgattaacatttctaatttctaggtggaaaaacctttgagacctttaggtacagtattcaccttgagacactctagctagtgtttcatgaattaacagattccagttcccctcagcctttcttttttttttttttttttttttttgagacggagtcttgcttcatggcgcaagctggagtgcagtggcgtgatctcagctcactgcatcctgcgcctcctgggttcaagcaattctcctgcctcagcctcctgagtagttgggattacagttacgcgccaccacgcctggctaatttttgtatttttagtagagactgggtttcaccatgttggccaggctggtctcgaactcctgacctcaggtaatccacccatctcggcttcccaaagtgctggaattacaggcaagaaccaccgcacacagacccctcagcctttcttagaggccaggatgtcagttccaggatgtgcgagaaacttatagagaaataatgtggaaaattgtagacaaaaacgtaggaaagagtttggtgctcattgcttacagattagggtaccatacatgattgttttcttgactgagtcttatctgcgtacctcaggtatttggaatttgtgtttagcattttatagtaatacacaacaaattagtttttatattaatatttgcctgcttttaacctgttgttcatatctatttagaagaatttcaaagataggctgtaagtgtcagaaggcttgtgactaaattttagctaaaagaggggaacttaggttttccacattcctaacctatgctaagagttgttaatttttaatgatactatttagtgatcataaagctggatattttcatttttcctttacaaaatttaatatcttaagattttcagttttcctttacaaaatttaatattaaacttccttggcttatactatgagatacaatatagtaaagcatgcaggttctaaaattagctaaatcaagtcttgaatattgtctttgtcactagtggtatgatcctgaacttatttccttatctgtaaatggatactatagtaagggcatgcagtgatggtagctgcttttatcatgatcgttataaacattattgctattattggagagtaattgatatcctgagactgcttatttatttcaaagtgaaatatcttttttttcctttttttttttttgagacagtcttgctctgttgtccaggctagagtgcagtggcacaatctcgactcacagcaacctctgcctactgggctctagttgccctcctacctcaaacttccgggtagctgagactacaggcacacgaccacacttggctcatttttctattttttttgtggagatagggtttcaccatgttgtccaggctggtatcgaactccccagctcaagtgatctgcctgcctcagcctcccaaagtgctgggattacagatgtgagccactgcacttggctatatcctatatttttaactacatatcatactgacaaggttctgccattgaagaatccatagtctagtttgttggtttttttgttttgttttgttttttaaccttttcggggttgcagttagtttaggcgatctgcaaagtctgagggaattgtagtgcctaaaaggctgctcctacttcagaaactagtttcatgtttagaggcccccacaaccactcttaggtttgataacttgctagaaaggacttagaattcactgaaaacaattatactcacagtttattacaggaaaaggacacaggttaaaattagccaaaagaagagacacatagggcagaatctcggaaggatccaattgtagaacttcctgtcatcctctccccatggagtcatggatggcattactgcctcccagccgcagtgtgtgacaatactcacagagtattaccaaccatgaaattgacctgagcctttggtgtccaggtattcactggggctctatcacatactgctcacatggctgacttctagtctcttatttcctcctggtgttgaaacttataggtatggtttagtgcccccaacatgaatcacatttgtccagtcgctaaatctctcaggcaagcagagatactctcaccagacaagaagttccaggggcccagagaccgctttccagtagccaagaggaaaggccattcctttctttggtgaagagtaattcttcactacacaggggtcatggatctctttgggaatctgatgagaactattgatcttgggtatttggcaacattgtgttgaatactttacatacatatatagatgtttattatatttctattttgtgaaatgattgagagctattaaatcacataattctgaaagtgtaatctcccaagctgataaattctaggaagggaatgttcaaggagctgtaagaatatataaaagggggacccaatctaacctgaagtttgaggtaaagaagatcaggtaatcaatgtttaagagctgaaggatgaataggaattaactcgataacagggaggaatggaggagaaggaggacatttcaggcctaaggaagagtcagtgcaaaggccccaagagccagtgaggcttggtgcatttaaggaccctactgaaaacaagactgttgtttcagagaataaagagaaaggggagaatagagtgagaaaagactggggaagcttgatcactgaggtcttatgggccattcaaagtgtgtagtttagtcttgattctaagaatagtaagtcactgaaaggatttaagcacaagttttacctgatctgatttgcattactctggctataagaagatgcatttagatatgttactctggctataaaaaggataatttcagtagttgaagagagagatgatggcagcttggttttggacccaggatctttaaattcttaaaaaattattgaggaccccaaagtgcttttgtttatatggcttatatctattgatattcactatatttgtaataggaattaagaaaaaaaaattaaatattctttaattcacctaaagactataataaacctgtggcatataatgcaaataacatttttatgaaaaatatatttttcaaaaaaaattaagactagtgtattacatttttatgaatctctttaatgtctggattaagaaaagacagctggattctcatgtctgcttctgcactcaatctattgtggtttgttattttggttgacatatgtgagtaatatctgacctggcataggtatatagtttgaaagggaaagatattttaataccattttcaggtagttgcagtttcttgaagattagttgcagtatggtatctgaagccttatcaatgaacttcctctgttattgtattaaaatccattggtctcagtttttttcaataaattatgctggaacaattggatatccttgtgcaaaacaatgaacctcaacggttatactgcactatatacataaattaatttgaaatggatcatagacctaaatcggagttaacatgtataaaactaatagaaaatgtggcaaaaataatcattgtgactttgggttaggcagagatttcttagctaagatacaaaaaatatgaaccataaaagaaataactgataaattggacttcatcactgtttaaaaattctgcttttcaaaagacactttaaaaaaatgagcaggaaccaggtacagcagtgcatgcctgtagtcccagctactcaggaagctgaggcgggaggattgcttaagcccaggagttcagggctatagtgcctgtgaaaaaccactgcttaagaacagcctgaccaacatggctgaaaccccgtctctactaaaaacgcaaatttagtagagacggggtttcagccatgttggccaggctgttcttaaactcctgtcttcaggtgatctgcccacctcggcctcctaaagtcctgggattactggcatgagccactgcacctggcctcaacaagattattattatgtcttatgtagcaaaaatgggcttatgtactggttttaccctatcaattcaataatttgttctatgtcaggttcagcacacacaggtgcttgataatactggttgactaataggcagaaactggatttgaatctagtatcttctctgcccacctactggaattacagcagtcttagtgcatttgcatccttctggtttaggttttattttatttacctagatttttatttaggtaaattatttacttagatttttatttaggtaaaatttacatacagtgagatacatggatcataagtgtactcttaggtgagttttgacaaatgcatacttttgtgtaaccttcaatttcaagatacacaacagtttcataatctgagtttcctcatactcctttccagtctgtacccatcccccatatgcaattactgttctgatttgtcaccaagaatttgtgttgcctattcttgaacttacttcatataaatgccatcatatagtgtacattctttgtgtctgttttctttcaatcagtatgatgtttttaagatttatccatgttacgtatatcagtagttctcttttattgttaaatatatttcattatattagtacaccacaatttgtttatccattcatttattgataggtatttggattgtttccaattttggcctattattaataaagctactataaacagttttgtataagtcttttttttggcatgtatttttatttctcttaggtacatgtctaagaatggaatttgttgggtcatagagtaagtgtatttttaactttaaaagagacagtgaagcaattcttcaaagtggttgtcacaggaatacccatttttactaatattgacaaatatgttaatgaaatgtctcatttaatgtaatggcttcatgactttttttttttgatcattggattcttttagtaagtttgaagcatcttaagtcaaaattcttatggcaataaagaaggagaagctatggagtcattgctgaatttgttggattattcccagtagctcaaattgaaaccacagcattgagatggtttgaaaactagtgacagggaagatgctgaaaaaagttgttagaataaattctatggggatatgtttagtttgaggatatttttattttcatcattccattgatttatcctggaaagtgtatgagtgattagaagatttctgttgattaccagtagatatatttgatggaatcatttgctcattcccagcaaatggtgatcctataatctataatattaaatgagaatgagcaatagagttaaagtaattaaaaatagctgagtaattaagattctttattttgctttagatattgaaagagaagagaaatgaaattctgactgtaagaatataagtaaggggccgggcacggtgatgcacgcttataatctcagcactttggaaggccagggctggcggatcacatgagcccaggagttcgagaccagcctgggcaacatagtgagaccctgtctctacaaaaaattagctgggtgtggtggtactcacctgtcccagctatctggaaggccaaggtgggaggtcaaggctgcagtgagccatgattgcgacactgcattctagcctgggtgacagagtgagaccctgtttcaattaaaaaaaatagatagatagatagatagatagatagatagatagatagatagatttatatggccctagaatactttagctatcaagtgtaaccagtaattttaggaaaatcttgagctaagtgaaacgtgatattttaacattagctagggttccatgtcaaaggttgaaattgtattgaattcaggagagatgttgtattttattccttaagaatgcttacaagtctactgaattttaccatgtacaaagtgaaatgttaaaatggaacaatacaggaaaattaggcattattcattatatatatggaaaacttaattttacatttgagattttagaggaatatggattatcgaattgaatatacattaacattcaaattctattacaaaacaataccataaggaaaattatcctgtgacagaaatgcttctcattctgtagctgataccctctctattgtatatgaataatttctgtgtagcacaatttctgtataataaatgtagttattttttatgtatatgttaacatttgacttgtatttatcccagctacacccttcaccttaggggtttgcagggaatgacaaatcaaacatgtttttgtttgtttgtgcagaaatgttttgttctcctaataaaatgaattattgtttattatggaatatgtacattatttggtaaatatataaacaagagtatcacccatatgccttccactttaagataattattgctagattaacatgttagtgtcctttgatctgaaatgacttatccatccatgtgtgcctgtgcgtgcacacacacacacgcccaaataatggtttcatttttaagtattttattacatttaattaaattatgagatatacagttaaaacatttaatattcattgtagaaaatagaagtagaaagaaggaaggattttaaatgtcctcccagagattaccgtttcagtgatactagtaatttctgaatttcacctatatcatattgctcaaattctacattcatcatctggtaatactgattttggtcactgtttatctcatagatagctgctcacatgtttttgaattgaacaaagtttgaatttggcttatatctgaccaccacctccctctcatgtaattgttagtcatttcaaattttgcagttccccaaaggtgcagtgtgttcttttatatatctgtgtctttgcatataccgttctgcttacctgaaaaaacccctccacaaacacctattgtcccttacccactctctgcctttgtctacctaatcttcaagattcagctcaagctgagctagaattaaagtcttccctgatctttatctttgctctcttaaactagtcagaggatctgtacccagagcatgcatggaattctgtgccctgtaaaattgacatgaagaaaaggagtattcattttcgtacttgattctttaacaaaaaattcctgattgggtctaactttttacgtgtgttggattagatggtcatatacagaagggaaagaatagcaatataagtcttctcacgtctgtaatcccagcactttgggaggccaaggagggcagatcacaaagtcaggagattgagaccatcctggctaatgcggtgaaaccccgtctttactaaaaatacaaaaattagccgggcgtggtggtgggcgcctgtagtcccagctcctcgggaggctgaggcaggagaatggcatgaacccgggaggcagagcttgcagtgagccgagatcgcgccactacactccagcctgggcgacagagcgagactgcctcaaaaaaaaaaaaaaaaaaaaaaaaaaaagtcttctcattagcaatataagtaatctaattttatgtttttatgtctcacacatacacatacatatatactacattgtgtcaaattagtaagtacaaaacttttgtgtatgaatttcagttttctatttaaaagaaagtacataattagttttaccaaaatatagttgctactgttcattgtagtttctaccctttatatgagccattgtttgggggagtacttgttttgttactggtaataaactacaagggaaatttgtaatataatattagtatatttcccctagatttttaaaaagcaggtcattatttttttaagcacttcaactgcagcacagtgcaatcttttggggagaattggtaaaatgaggataaaattagtacaggattccagcagcttgaaaataacacaatatttgaccaaaatctcttttgtattccctactctggttcaattccagtagtcctggaaatgtgcctatggactatttacagtgagattataaaactgaatcatgattttggtgaatagaagccagagcatgtggctacagcaccccagctggcagtaagctctccctaggtttatgaatgtagttagatggtccccaactgtttacaagacagcagaggtgagatatttgattgacaagtcagaaatgcattagatcattctctctgccagtctctggttcatgctgttaaaaatgtcagcctccaagtttgaatggcagcctgagggccttagaagctttttgttttctgagatggaaacacaaattggatgtgtgcctgagcgcttcatcctgggctgtaatttcatcttttagctaagaaccacaaggtacacgagcaaagcaccctgtaaacaataatactgtggaaaaaaaataaacaaggtcgtgtttctggtacgttgatccgatggtgtcctgacctctatcacgttgaacatctccactctgattgctgttccctttggcattacaatgagagaaagagagactgacatactatgaagaaaagatttaaagttgcagtatcgttgcacattccttgtattggctatgaaatattgaactgtcagaatgtgacacttggttttttaagcaacctttcttgtttgaggtgtttgcagttcattcctttctcccccatttgtctgctttcattgatagggttggaagtagttgccttaaatgcatgaaaagggacagtgttaaagagaagtggtgctgatggagccaaacaaacttaacactagaaaataaatgcaggctgtggggcaaaggagataaagttgggttagtgtattattaatagtggaatttatggaacaccctattgtaaggaagaatcaggttaggtcccatttctgtttttgtggaggcaggaagttgggaaggtggtattgggtaaagagatgcagtgacatagtttgttaaactgatagcctactatatggcagtattgccaggccaatcagaattcacccagctattttatttattgctcttattatccagtgtctttaacaagtggtgaaattatagaagactttaaaatttggggaagaaaaatatttttttaatgtggaaaatgtgtatttatagtaagaaagctcattaggtaatatggaagaaacattatgcttatattagtccagcttatgccaaatgaatagaaaatcttccttataaaaccaccatatatttcttggaaaatattttgtagtaataaaatgagttttctattatgttttaaattacatcttttttttcaagctatgagtaggagtttataaattacaatacatcttaaaacaacatatatattttttcttctaaggaagcactattgatgtatgctttcattttcatcccttttggggcattgaatttacaagtaaagttttaactgagaatgaatggccttttgcagttcttctggagtatggaaaagagtttgtattgaaagttcctcaatggctgggcactgtggctcatacctataatctcaatactttgggaagctgaggtgggtggatcacttgagctcagaaattcgagaccagcctgggaaacatggtgaaaccccatctttaccaaaaatacaaaaaattagccagtcatggtggtgccagtctgtggtcccagctactcgggaggctgaggtgggaggatcgcttaagccttggaggtggtggttgcagtgagccgaaatcatatcactacactccagcctgggttgacagagtgagactccatctaaaaaagaaaaaaaaaggcaactatttagcttagccctctcctctgaaaatgtgaaaggcaagagctgttctgcatcagtctagtgaaatgcactggaaaaatggtgttggtaattcctgctttgaggtcatgctagaaagagagaagataatacttgtaaaatataagtcctgctcctttgtagccagatttttgtccttacttaaaaatattgtgctcagaaagtaataccaaaaggagggatattaagaactagttattgttgtttttaagtattgctctgaatttttaaagcataaacattgatgtagatttgcatttaagctatgagaacccactgtcttgactcagtgggggagttttcaaaaatcattcttgtagaaattgatttctcattggctgatttctacaggatgaatgaaaacaaaccattttttgcagtcttagaagaataagaggaatgcaagtgtttaagaaatgagactgaaatatgctttatggagttttctaaatctggtacaaagaaactacaaaatttcttcttatgtattatgcatcaatacagtgaaaatgcctcacagcttatgggctttttacaaccacaccttcacaattaatgattagctttattatttaaactccaggcttgcctcatgagcaaacatcagtgtattcatagaaccatagaatttcagcattggaccagacatcagaggccatctagtcacatacgtctcataatgtagaaatcctttatgaaatgtgtttggaagggagtcatctaatctctccctgatcactaccattattggtgaatcaaacttcttgaagcatcttgcttttactttgttggttctactagaaagttttttcttggccgggcgtggtggctcatgcctataatcccagcactgtgggaggctgaggcgggcggattgcctgagctcacgaatttgagaccagcctgggtagcatggtgaaacccagtcactactaaaaatccaaaaaattagccaggcgtggtagtacatgcctgtgatcccagctgcttgggaggctaaggcacgcgaatcgcttgaacctgggaggcggagatagcagtcagccgagatcacacccactgcactgcagcctgggtgacagagtgagactgtctcaaaaaaaaaaaaaaaaaaaaagtgtaataagtcagaatacaatgtagacacgtcttgttttgaacacaatttaaataatgtaatttaattactgcctaagattgcatatacttctttgatttgaatgatggaaaaatttctaggaacttagcctgggtttgtttcctcatcttttctttgaagccagaaaagcatagaaaagcatatgtaagcactttgacaaatgacataatgtagcggcatatcagagtggcacaggtattttaaacctagctccagttcctgaagatggtgaacatctgcttagaggtactgtagagctccacaatgcactaattgaattactcttttctggagttgcgactgcactaattgaattagaatctctctctctctctctctctgtctctgtgtgtatgtgtgtgtgtgtgtgtgtgtgtaaatgagataattccaaccttaacgggagagactatgagagacatgactgatggtgtgtactgtgctgctatctaatggcagcctatggaactactacgtggtctccagggaagagaaaatacagcgtgacctcagtctaaccccatccagtttagttcagaaggtcccaggatgtaattttgtaattctaaattgaaaaggaaagaatgtgataaatttctgtattaaaaattaagatatattttattaggcataaagtttttaagtactaagttacaaatattcaactgaattaaaaatttcctttaactggtgaaaaaaaatcgagttggtgggtcatcttttttctcattttgtccttcagtgacataaacgtaaaaaggaattaacgtttttgaaatgtcttagcatcatagaaaggataaatgatacagggcttgttcatatttttaaatacaatttttttcctggttgttagaaataaggtgttaccagattttgcttgtatgtgattatgcttatattaattatagcagtatcaaagtaagttgtacagatctcacttgctcttttttttttttttttttttgagacggagtctcgctctgtcacccagggtggtgccatctcggctcactgcaagctctgcctctcgggttcacaccattcccctgcctcagcctctcgagtagctgggactacaggcacccgccaccatgcccggctaatttttttgtatttttagtagagacggggtttcaccatgttagccaggatggtctggatctcctgacctcgtgatccgcctgcctcggcctcccaaagtgctgggattacgagcatgagccaccgtgcctggcctctgttgttctacttaatagtttaaaaattaagtttaccacaaatttgggcaagttttaaaccctcctaagtgaagtcagttattttgttcctttaaaagaaaaaaagaatcttagtcacaatttactgatttttgtaaaacatgcaaatgtagtcctgcgcaacattaaaagcaaataaatacactgaggacaactcaacatgaaatatattttgattcagtttaactctaggcattctaacttgtaaaaatggcccttaacagaaaaatacatatgtataatcacttgatttatagaatgtgtatgtgtgcatacaaaaccacttcagtaaaagtgctgttggttaccattctgagcatttaaaacgatcactttccatttgatcatattaaagatatagaaacaagtatatagcatagaaaagttttaatttcttctatgtaatcttcattattaaaatatgtttgaatatgccattattttgtaggctaatttgttcttcattgtgagattgaggtacttagatttcttgtatgaatagctctcactaaaatgactataatttgtactttttatattgtccttagggacattttactgatttagaaaatccttttgacatcaagtagatgtaaggctttacaaataacatggccattcacaactagccacaactccgattcgattcacagagtaccttttatttgccaattactgtacaaagtcttaggcataaattaagattcagaacctatcctcaaggagcttatagttatttgttatacatgtattaagtacttatataccagtcactgtgcatataattactagtgttaaccattagtcatatgtatttttttctgatttattgagctagaggtctggcttagtagcagtcctaaggaaatggtatacttatgttcatatcagatatatctcatctcagcaaaaaagtgataatgtatatttcagactagtctgtgtcttaaatggttttctcttgcctttacataccttctaagggaacagtgatgtttgtgatagctgtacatgtagcttaaaaagagatgataatatttgttacaatgcctcctactggttgatcatagattttcaatccttgttgtcttcagaactggtagttcccactggtgatttgatagtttggggcttctactgaggctataactgagaaagagtctattgcatacaaggtataaagtgcttctttaaacagtctgtttctagaacctaaattgtcctgggaccagctcttgatataaaaattcatagaaacctgtttttcacagagtgtggtaactccttgccatagtgctgtagtgttaaaattcacattggccaggttgttctgtaaattaaacactgacagctaccctcaggggaacagccaatgtatttatgatgatgtgctgattacacaaaatacactgcaagcagaaaacagctgcagagaataaacctcttaaaaagaatacaattacaaatagcaccctcagtatttctagtggtgagtgtagaatacagcatgctaatgcaagtttcttactagtccgcctgaaaacaaaaaatctgaaggagataaattatggttgaatgcacatgcggtgccagcatagcagtgaacaaatttcctttctcaagagcatggctgtaagtgcacagatttcaggtgtggagtagtctaaccaccctccctcattttgttaggttttattagtggttttctcatatatagtagggcatggccttgaggttataggggctctagacatttgaaagatattacacaatgaatggggcaggagggtaactaaattgtggttacaaatttctggtagaaactcgatatgttagggtttagttatcgacatttcatttgaagatacgactatatattttcagtgttattaatggcattgaagatggtgcccttggaattaataaaaggagtcatgactctctggtaagatctttctgatttcttagattctgtttttcaagaataatggtgttttaggacattggaatagctgattgtatatttgtaggagtatcagctctcaaatatgtcccttttcattcctgcatcttactggtcacatgcatacaggtaagaagattagaaaaaaaattttgttttccctatttgagattctctctgttagagcttagggtcagtatctataaaatatatttcaactgctgagcatgctagcttctgtttaaatcagtagaaaatatgttgatctttcaagacataaatttactcaagccaactgtaaggtatagcgcagggacatagtgattggagacagttcacttcacccgcctgaaactaagaatcaactcttcagtgtatggatcactggtatgtaataatcgactattatcggtctgtctattggtctctttttaaatcagtttggaacctcctggagttattttcttgctctactgacatcaatcccatgtggcagaggagttgtgtataatcgctttggtttaatcaatagaataattgataaaccagataagatttaaactgattatagccccagcagaattccccagaggccttggactctcttaattttgacatgtgtgttgtgtaccctgaggatgaagtgcagtttgaattatctgcttttatttgcttaatgacggggagggtgttaaagtcaaatgtttaattaacccagcaatgggctgcgttgtcacttacacacagctgattgagatatctcatggagaatactgaataggaatgataatgtggcactgggacggaagattgctttttcaatccatttgctgggtcactgctttgaatgtcttattggatgaaaggcattcagcctggagaaaaaattcagcatttaagtacattttgttctcttccccccccacccccccaaccccctccgtgctcagaagttaactaaaacagatatgttctaggtttattaagccatccatgtactagtaagagatcaggatagccagtagcctcaagctacataatttcctgtggaaacggaaaaatcctactagcctctaaggtattctaaatgtgagctcttttgtccctcacatcctgtgtcccttgccattattgtgaggttgtctttggttacttgtctcttgcctttttctgtagtgtttgctagatgtgcagctacctctagggccaaaggcagaccttttcctcccaaagaagcaaattatccagtacattttttgctatttgatatacctggcttctatttggttgtaattgtgactaagaattataatgagactgttgaactattcagagagatgaaaatttgaggcattacaaattcttgcttttttggctactgctattgtaaaaacagttgatgctgtgtatatttcattttgttgagaggcactttgctttctatatggactaaaaaattaggccaggaaagattgcaatattcaacaccatcaaaaatgaagtctaggcaactggagttttaatgacttgctgcccacaaaatatccctgactagctttataatggaatgtaaaaactcattgaaggcatatgagcaaaactttaaaaaaaattaaccatgactttccttctctgtagttcttatgtttcttccctctatcccccaaagatctaaaccaggaatttactaatttttttctttgctttagtcatttgtattccagagagcacaatagggagaaggatacaagattgatttttttatgtgtgtcctcttgaaagcagagtctggggcatgaatactgtggggggtggtgggggggccggttacaaagcaatagaagcatgcagctagtgttcgcgtgcaggttggactttttgcgggtcaaggcagaccagacgagtagcttatcttgagggacgcaagtaatagaccaaatatagagcagctatttcaggaatcatgtaggtcatttaattatccattatgattgagtggctaatgctcttttggcaattacatgacctctgttattcttgaaacctatccaggccctcgtgggtcaagtgacccacaagtcagtgctctcagacttgattccactcagaaagaaaggagatgttgggaaccactggcatttagaaatggccatgttttctttactgaccactacccagaatgtcctttgtacagcagtgataggcaactggttttgaagtcaactattccttcattgtatataggagcaaaagatgcattatacattggtttccacaagagggtattttggcaggagatactttaataccacaattagctattatggtattcactaattctgtactgtaagaacaactactatgatattaaaattaatgtttgatatctgtcaaaccaattatctattaccaaactctgtagtggtattttccattccataacgcaacaagtgctattgatgatagctaataacagatattagtatattattaattactaatagtaattatagtaacagattagtaataataacaaaatgccattgatgatagctaataacagattttaaaatatcattcattaaaattagcctaatttgaatttcagtgctacaacgattattaaattaaaaggccactttaaaattaggttctggtcaaagacagaataagttggaaacatcttgattgtttatcactttttttctttaatcaaccaagtattattaatatttccaaaaaaaaccaatttctgctaaatgatagtaaaattttctataattcagtgacttgtggggtaattttgagaacagaaaatgtacatttcttgtgattctttaaatcgaagatagttacggtgtggaaagcaatggcagcataatcaaattaattgtaggatttgtcagaaatgcacaaaattctgcatagttagcaaagtggtagattagaggtatacagccattctctagcattccagtaacttaagaccttaggcttaagagaaataattttggtattctttaagtagaaactatttgcattgctatagaaaaaggcagttccttctattggagaaaaaacatcttttaaaaatttgttacttacacatcaaagagcattgctttaaaacaacaacaacaacaaaaactcaacaaggttgtttatccctggagcagtaaaattagccatccttcccaataaatttattaaattacccctggtagaactccaagctaatctgttttggttttattttcattttgttgtttggtgatgttaacaaatgaaaaattgaagacatgaattggtgtgtataacctttgacccttcagaaatagaagacttctcactcaaattttaaatccttaagccaatactaccttagggtctggctacttagagacccatgagaatgcagttaatctgagttatatttgctgttttctgtttaaaaacatattttctctcattctagttttttcatttctgtggtggagatgaacagaaaatggaaagcaggatttacagcagaagttacagattaaactcaagtatcccaaataaggagtataattagtctgcttaccattttaagaggaaagcaagggatataatgtatggtgtataattttttttttctccctatatattacttttctttaaggcatacccttcaatatctatgctgagacatgtttttcagccttgggaaccaaaaatttatagaaataagtgagaggaatggtatttgtaattttaaagacccgaagagacattaaggcagtatcattagttgggaaggacacagtataataataagcctatataataatttcttaattaggaaaaaaaataatgattaaacaagaccagtccatattagagacatacacctaaacacagatcttaatctagcccagtctagctttcagaaatgtagtttatttacttgggatggttttacgtctcgggatattagcttttatcaagtttaaaggaatcttaaatttctttcaagatattgttgaattgtaataaaatggtaataccaaagcaaggaagatatccaaggggatgaaagtcatttagcaaaaagaaacaaaaaaccaggaaacaaggatgacagaaaaaaaaaattcatcagagagaaagaattttgtcatacgtcctaagggttctatagttctcagtcctattttgataaaaaaactacttaagaaaatctacagaggtcgagttacaaaaataaccagatgtccttattagtggaagcaaatgtttgcctcttaatttacacaaaactatatgcagaggatctctggatgaaatatttttgtaaatatggcagcaaagaaaatcatggcacaaaaaaatctgtccaaaacacataatcgtgaaggtaatgtcttaaagaggaaagcagttttttaaaagattcctatagatttaaaggtaaaaggtaagttaagctagttatattttggtttacatgatacgtattcttggctttttattatgtatgtctttctatctgaaatccccctggtgaattttaattcattttgccttgcgtatttctctactttgtacattgttgttgcattttgaacagtgtaaacgtatgtgtggattgcttttttttttccctgaaagaatggttgtccttttagttccatcacgaaaaacacaacctacagtggtataagatgcctgctttgcaagcctgtttgggattttaaaatattaacccacattttaataagtagatgtagttttgtaattgcattcgtacattaagcaggataaaaatgtaaaaaaaaaaaactacttgaaagggtaaggtaggaagtgtttttttttgtttgtttttaaattaaggctttagagccaaaaaaaaaaacctgtaaagtttaaatggactattacttctgatgtggagcatattagcataattacaaactcttttatatactcatagtcattgctaagttgatgttcaaacctttgattaagaagtcacaaagctgactgtgttcagacagctgtgtaatatcgctcctattcacaaaacagataactgttttagccccctcccttttttggtccccatatttattgctacaaatttgtctttctcctatagctagacttttaattaatggtgaaacattaaaatgttgtattgtgatattttcggtgacttgaaagttaagagaaagcagcactgctcattcatgcccttgccttgtcactccctggtgcagttcatctcttctatccttcttatcagagtatctcagtgcttagttgagcttgtttatcttaaaagagcaggaggcaggcttttagggaataagctacatgttccagtataacaggcaccaatgctgtttgacttgaaaaacatttgatctcttacattaacagcccatgtcactgtaataggtagtacagccgagttgttcagttttctattattttagctttgaaataactgttagtgctgccccaaaatcttcgtgtataaaattgtatattggctgccccccaggactcgtaagtaaacaaggtgatatgtgtggccagaggggagggtatttgttggctttgttttagataataactgatcctatctaaagatgttttctgtctgatccctgatagtgggtgctgcatgacgttgtgtaaattcgcagacctagcaatattttaaggcagatttctgtttgttattaatatatgtgctcagtaactattaattatgaactttcatttttttctctgataatgaaacatttagtttttatgaagcttaatgtcaaagatcctgcacaatttgcctaagtatagcagtttgcacagcagtttttgaaaatgggcaagcaagaatttaaagggaatgtttgttagacttaaaatattactttatttaaaaataattcagttgtgggtataatttctgtgccaggaatagtttgacagttgtaatcaggtagcagtattaaaagaacagaaaacaaaattcgtataatcaggttgatgttttcttcctctttaagagcacttctccttttaatagtggtagaatggcagcaaataattttaatccttcctttcttccttcctctattttcaagaatctgatttttctcattcttatttttttctgttacagcattaccaggccacccagttactttcttagaatttaacctaaattagatacatcagccagaacaagcataattggttgaaaggcagccatctatctagggagttcttctaaatactgaatgtgtcatgcgctttgacataacatatctgtaatctctgaatacagaaagcactttctgtgttagctgtaggtgttaaagcagtagtgtgttttaagaatgtgtgctgtgcaaattctggcttgtgaggtaatgacaagtgtttgcctgcatagacaatatattttttcccccctgaggtccccacacacctagtttccctcaagctcatcatctctgtcaggttaatcaataggcaccgtatggcagagggtcagtaatcagtgtcatcgtgcctttaaatcgtgttgaaaatttgcttaaagcctgggccaattaacatcgagatgatgaatggatgggaagatgggaagagcctgccgctcaggggctttgtgaggaggagatgctcagctgttgagcagcagacaccagcgaataaaatcagccattcatgtgagctcagtccacccactcttaatgataatgtcaatctagcaaaatatatacacattggagttgtcacgagttcataaatcaaaggagtttgtcaaaggcattcagattaacgaggcagcagcaataacaagtcaaatttgcatagagaattgctcgaatctcagtaaattatgatcctgtttttcatttgattatttgctaatgtctcaagagggagaatgattatattagcatgcaaaatctactccagaagtagaaatctgaggtgtagaagaccagtgcactatgacaattaatcagtttctgcatactagcataaatgcacaaggcccagaaatgaacttcttttttattattatttctctttgctactgatccaaatggttcagcttgacagagactttatattgctttaacagtgttctgaattgtgcctgcaggcaagacatagttatgcagctataaccaacctatccatctgccaaccagattggaattctcctatccaaggcttccattaacccccactgacagctccaaacaggattaagaatttggaagcataaaaaatagttgttctttgcaaatatacacaatccctctgcattttgagaaaggatgcatctgtagtgttatatgattagtgtcggacagtgtggcggggagaaagcctgcttggcagttttttgacttctgtcacagggagtaaggcagtgctaatggaagtcctctttggttgtcccagagaatgttgtccattctatctagttgttagcactgtgcttggaattggtatattactagaaaagagcactccttgaaagccttaactggtgaatctgttgagtttagcagtatagggaggccttgatgtggttgtggtttaatagagtatgtcaaatgataaacatgctggagaagcaatgtgcatgaaaacatgccagagaatatcttaggaggacactttaggtcctccctaaaatgagtccttgaataggattttccgaacagcttctgaacttaaatgacctaagttttccccattgtatcctaaaaggattaattaaaatttgtttaaacacacacacagtgtttttttttaatgtcacctttcatacaagagtttgagtgattttgtccatgtagctaaaatatctgttaaccttgtaaaataataatttctgtttttgtaaattgtaaatttatatttggaagctaaattagctccaagtcacataataagttaatgggaaaaagtattaatccaattactaatttaccattgaagttcactatactgtgtttgcaattagttactagaaatcggtctcaggattttttccttcaggtgggttgtcattctatacgatgatgagcagatgatttcatttttaaaatgtgttcaaaatcagttataatccaccacaatttacctgctttgctaaaatgatagaattatcccagttacagagtccttcaaatcctccaatggtaaattagtgaagtatgtggcattggtgtgaaatgttcgcttgtagctttggagctggttattttatttataacagatgtctcttcaaacaggttcaggctctgttgcaccatccaaccttgagcaagatgcttactcaaagattattgtaagtcattatgagtggcttgacttttcatcactgtgtaaattagtttaattttttatttgattatataatcaactcttaattatccattttatcaggagttgtgtgttcaaatagataactgaaaatagtaaataagccacttactaggtcatggggaatattgccccagctatgaacctgctgtgtgctgccatcaaaacatctttacttcttgaattggacagtcaaaaatacaaacagcctcaaagttaggaatgctttggttaagggttgccaaactttgtctgtaaaggggcagataataaacatttgaggctttgtgggagataggatctttcttgtggccacttacctcttccgttgtagtgtgaaagcagccacagacaaatcgtaaatggatgggcatggctatgggccagttaaactttatttgcaaaaatatgtgtcaggccagagcttgtaagtgctgttaactgatcatactggcattataagtagtgggacagtaggactgcagttgggctgccactgaagttcctctgctattaaaaacaaaacaaaacaaaacttttttttaagctagctggacagtctgggtttagggtttcaattattcattgagcatctgttatctgtatacttacgtaatgtgttagtgggtagagggagctacaaagacttttcccagtaatctttcaatcttactggttagtcgaaagtaacagtgcagacatttatctaattaagtgcctgttgtgtggatcaagattaaaatttagttagggaatttccagtagagtaaggtggagtagttttatggtttcttggagaagatgacagttaaacctcattttaagaatgtgtaagacttgaatagatgagataatcttgtgtttataattgttgagtgaactagactggagttaagaatccttccaggccagactctgtggctcatgcctgtaatcccagcactttgggaaacggaggtgggaggattgcttgaggctgtgagtttgagaccagctgggtaatatagtgagaacccctgtatctacaaaaaaacagaaaaattagcctggtgtagtggcgtatacctgtagtcttagctagtagggagcctgaggcaggaggattacttgagcccaggagttggaggttacaaggagctatgatcatgtcattacactccagcctgatgtgatagagcaagaccctgtctttaaaaaacaatcctttcaaccccgaaatttcaagatcatatcacctgttggtgagactatgaagaaacttgcttaactggggcagaaaagatgtgttgtgggaaataacttggtgtaatatagtagggaattctggatggtcctgaaaaccaggcctagaacttcatatttgatttcatagaaataaagagccactaaaaatattttagggaaagaccattacgacagtagcagtgttaagaaagattaacctggcaataatattcaatccaagaaactttttttttttttttctttgagacagggtctcactctgtcgcccaggctagagcacaatggcatgattacaccccaaactcctgggcttaagcgatcctcccgccttagcctcctgagtagctaggacgacaagcatgtgccactatgcccagctaattttttttttttttttttatgtagaggtagggtcttgctatgttacccaggctggtcttgaactcctggccccaagcaatcctcctgtctctacctcccgacaagaaaacattttaaaattcacattatattctctagctttgtgctgaacctctgaaatataagatgaaacagaaactggccctgccttgaaggaatttacagtagtgtggggtgggaagcatgttcatgtagagatataaagagatataaagaattaagtgccaattggaagtgaagtttttcttcggagtaattaattctaactgcaggttaggcgtaaggggataaaggcttctcagagaaggtatcattttagctgactcttgaatcaggatttttagtagataaagagattgggaaagaagcctgttacatgttaagggactagaattaacaaaaacacagagatgaaagagtggtttccttattttggtgaatgataaataatgtcatgtaaatggtacagagactttgatgaagtgttaagttggctgtcttatggatgctgtactaagaagtttgggtttatcctgttattgccaaaaagctataaaaggcttttgaacaggaaagtaacctttttagaatgatgattctaatggccgggcatggtggcttacgcctgtaatcccaggactttgggaggccgaggtgggtggatcacttgaggttaggagttcgaggctagcctggccaacatggtgaaactctgtctctactaaaaacacacacacacacacacacacacacacacacacaaaattagctgggcatggtggcgcatgcctgtaatcccagctactcgggaggctgaggcaggagaatcacttgaacccaggaggcagaagttgtaatgagccgaggtcgccactgtcctccagcctgggtgacagaacgagactctgtttcaaaaaaaaaaaaagaatgatgattgccactctagtgtatagaatatatcatttggatttaggcaaggatgtcaatgtcagaaggctgtctcaatagtaatagcactggtaagaggtgttgtgggtctggactagagtagaagcagtggaaatgcaaaagtagggtcagatgtattaaaatagatgattcaaagaaaaagtttatagactgaaaattagctagatatgttcaaagaaaaaaaaggaatgagtaaaaactgactctgaggatttaagtctaggataaaaagaaaagttgggaggaaaagagctgacctagaaatgagtggagatggtaaaagagtgctttaaatttagatgtgttgattttgagacagtttaagcttatcacctgaatacttttttaatataattactttcttttttattcgcccagtttggttgtggaaacattttatccaaaatgcatccctgaggtctaatgcaggagctttagcagtatttcctttattgaccttttcctacccaaatctctgttactgtatctgcaggtgttacagcccaaatgcatctagtttggagttaaattcaaagttgacagggagactttcattctgccctttcaattctaagctagtaagcactgagctaagaaataaatatttgagttaatataaaaggtaacaagttgtgcactgggctaagaaataaatatttgagttaatataaaaggtaacaagttgtgtagaatcttttacaaaaatattttaatatactatagtccccacttattcatagggggtatgttccccagtggatgcctaaaccacagatagttctgaactccatgtatactatgttttttcctatggacacatacctatgataaagtttaatttataaattagtcatagtaagagattaacaacaataagaataaaatagaacagttataactatactgtaataaaagttacatgaatatgctctctcaaaatatcttactgtactgtactcacccttcttatgatgatgtgagacagtaaaatgtctatgtgatgagatgaagtgaggtaaatgacctaggcattgtgacacagcattaggttactactgaccctttgacagcatgctacctgctttaggtgatcctggattattgagccatgaagatgttggtggtgggatgtcaggagcagacaatgtcaatgactcatggtcaagtagcatgtacagtgtggatacactggaccaagggataattcacatcctgggcaggacagagctaccagaaaggtgcacaattgaaaactatttctaaaaatttccattcaatattttaggacctcagttgactgtagtaactgaaattgcgtgagtgaaactgtggataagggaggactactgtaatgctattcatagactattattactcaaggactacaaacacattctgcaatttatttactataatgaaactttccatctgagtattgggaatctgttgttctgagcagtcaagtttgcttagggttggtttaaagttaagcagtagaatataacgttaattacatttgatggaattttccccctaaaatttatttttcacttaacttttctcccatttcttaacattttattatggatttaattaattaattttttattttgacataacttcagatttatagacaagtgaaaagaatagcacaaagaatctccttacaccctttcacatagatttacctaatgttaacatgttaccatatttgtattatatctgcttataaatacatatacacacgcacatacatccatttatgtattattttttctgaacaatttgaaagttacagacgtaatgttccatcccccctaaatgtttcagtgcgtgtttccagaaaaacaaagacattttaataaaaataatcacagtacaaattatcaaaaccaggaaattgaatggataaacaaaactgtggcacatccatacagtagataatactacttggcaataaaaggaaaagaaatactagtatttacaacaacatgagtagatctcagatattttatgctaagtgataaaagccagattcaaaggttacgtacgatataattccatttatatgacattctgaaaatggcacaaattattgagccaacaaatcagtgattttcagtggggagagggttgactattaaggagaatttcaagagaattttgggagtggtggaatttttcattttttaatggcggtgttatacaactgtatgtttttgtcaaaacttacagagctgtataccaaaaagggtaaatttttctgtatgtaaattttaatggtggggaaacaatcaggaaattaatattgatacagtgttattagttcacctacagaacttactaaaaagtttccaattgcctcaacagtgtgtgctatacctctttagtttcctttaatctgaaacaattccttagtctatttcatggccttgacatttcttaggtacaaactagtaactttatggaatgaaatactcatttttgggttagcctgatgttttcttataagtagatttaagttttgtggttttgacaaggatacctcacaagtgatgtgctgttttcagtacatcatattaaaaggcacataatcttaaggtggcatctgctggatttctccactatgaggttactcttttttcattgtaactatcaagtatcttatagaaaaaatattttgagattatgtgaccatcctgttaacttgtcaaactttcactcacttattgtagttttaaattttacttaggtttttgagatggtgtcttgctgtgatgcccagactgctctcaaactcctggactcaggcagtccctctgcctccacctcctgagcagctgggattacacgcatatgccaaagtactaggctcacttgctaattttagcacccaatgatgattcttccttatattaatcacttatccttaaatagaatttattggatataatttagcctgatgatctaggaaaattatgcacatagcttattgggaatcctcatagataaagatgcaaggaataactgtgttgctgagctttcctgggtgatgttggacaggctttgagaactgttgaggtgactacttaggtatacatggctatttcatcattaccccttaccctcaagactgtagacctagtaatctcattcactggcattctgcttctactctttagtattaggagggttcctaatccttgttcctgatatcatgactgtttaatgtccctacctctatttttttgtaacaacattataagttggattttttgtttgatttgatttctcatgatggatggcccagagtaaaagtgttgggttaatctgtattaaaagaacataccaatgtttatgggtttcccccattttttgtttaagagttatttttaacaataccatttaaatattctttgccctagtgggatagaaaggggaaaggaactcctaagaagctctgtgttctatgttaggttagtaacaccctttaagctccctttgtgttttcattctttagacattttcataatacccacccagtggttatccatctaaatctgataaaatagagggtcagtaaaaagaaaattgtgagtatgggctagtcaatactcaggctgttaaggttgagatgactatttttcactttataattcagtatagaggagtttgccagcaattgtgtatcagcccaagtacctgtataataaaaatgtgatttatagtatctttggtatgacaaacttccagcaaaaagtaattaggctccaagttatatgataacatttcaaaaaacataattaattttgaaatacaggatcttacactgaattaaacaggtttagtttatctgatctttttatttatttatttaaaggaggaatttcatgacctgaaagagagttacttgcaaattctaagtttataattggatactggcttaagcttctattatataaggcatttaattttggtatttaaaacattgatctttacatttaaaaaaaaaaagttaaacatacaacttgatgttatggggtaaataaatgttgacctttccctttctttgtttgatactcttacatagcatgtattgccagtcgcctcatttgtcaagctttgtagtcattaattcaattatatccttcctccattttttggtagatgatctccattcctttttttccaaacagggaggaaaagaagttagaactctgaagttcttgagtctctgtccctttctttgtaatatagcatgctttttctttaattttagggacttttacaagggatcatcacaaatgtaaaatatcaagttaaacctcataagatatttctgcccaaaagaaacacattagggtactggcctgtcaggcttactaaaggtgacacacaggtgtcagccacagaggtgaaagggcctcagaatgacacagtacgttttttatctctcagtatctttcaaaatgtaatatctaatagaaaccaaaaaagtgaaatttacatgtaggtttagaacacagtaatgattgtatattaataatttcatgcttgtatgaaaattttcagataaactctcatgttaaaaataatttctgaacctacaaataaactaaccctcctgttagaacgttatgactatatgtaatgtaaggaatatattaactgtaagttttttgttgttgttgttttgagacggaaccttgctctgtcactcaggctggagtgcagtggtgtgatctcggctcactgcaacctcggcctcctgggttcaggcgattctcctgcctcagactctcgagtagctgggattacaggcacccaccaccacacttggctaattttgtatttttagtagagacacagtttcagcatgttggccaggctggtctcaaactcctgacctcagatgatctgcccgccttggcctcccaaagtgctgggattacaagtgtgagccaccgcacctagcacaactgcagggttttaaatattaatgttattaatgttactaatgttgttgctgaaaatggaactcaaataatatgtaatttggattttctgtattttgccttgtagatagtgatttacatatattgactagcagatttttagtacttatgaactcattttcagttggattgttgtttttttccccctcctaagtatataaaaaccccactgacattttagggcctctagctgctgtttgaggtgacagtgccaaggaatggactctaatcctaaactactgagtaaatgtttttttaagtcctatgctacttttatcaaagaaaataaaatcaaatctgagaagagggggaagagaaataactatttttaggacccagacttggagatctgtgccaaccaaacatctactataatcgagagaaggtaataatcatggttttagttgtcatcagctaagtgtgggctggaactttcttgtatccagtgtcaacctgtgtcaaagtgcaagctagagatctaatgaatatgatctcctacacaatgcttaaagatacatgaaatacttcccatctaaatccttacataatttatttatatacatgggcatatgttttcttttacatatgtgtatatctgtatgtatacaaatcttcaagtgaataattgtataaatatatgtatgttctaacttacagaattagaaatgtaattcagtttactcccaaaggataagattgaagataatgagaactgaattaaagcttactttctttcacagaattcctcagagagagaagactgtaataatggcgaaccccctaggaagataataccagagaagaattcacttagacaggtatgaaattcagccttacttaaaataaaaagctaccaacagcaaaacaaaagacaggaggaaacccttgatttgccattctttaagcactggagcttatattaagagtactcggacgttggcctggccatagccatcactttcaatcaggtgacatggttttcccagttatttaaaaaacattctaggtatacatgtacaggacagctggttggcatttttaaaaaagtataaaaacagatctgcctgtaataaagttagcccttttagtatgagcaatattttgtttgctttttctagaagaaaaggccattgttaataataacttaaaaaaacagcagccgggcaaggtggctaacgcctataatcccaccactttgggaggctgaggcaggcgaatacctgaagtcgggagttcgagaccagcctgaccaacatggagaaacccagtctctactaaaaatacaaaaatttgctgggcatgctggcgcatgcctgtaatcccagctactcaggaggctgaggcaggagaatcacttgaaccccagaggcagaggttgcggtgagctgagattgcgccattgcactccagcctgggcaacaagagcaaaactccgtctcaaaaaaaaaaaaaaaaaatagctcaccactgtgccccaatagaaggtaacacattttacttgtgaaagttcaataccattgtgttcttgtaaaaattagaatgtccttggcaaaaacaagaaacgcaagttcttatgatgttgccagagaataagtgtgccacctattcatttttatttttattattttattttatttttatttttgagacaaagcctcactctgtcgcccaggctggagtgcagtggcgtgatctcggctcactgcaacctctgccttctgggttcaagcgattctcctgcctcagcctcctgagtagctggaattacaggtgcctgccaccatgcctggctaatttttgtattttggggtttttttttttttgagacacagtcttgctctatcgcccaggctggagtgcagtggtgtgatcttggctcaccacaacctccacctccagggttcaagcgactcttctgcctcagcctcctgcgtaactgggactacaggtgcccactaccacaccgggctaatttttgtatttttagtagaaacggggtttcaccatgttggccaggctggtcgcaaactcttgaccttgtgatctgcccacctaagcctcccaaagtgctgggattacaggcatgagccactgttcccgacctaatttttgtatttttagtagagacagggtttcaccatgttggccaggctgttctcagacccctgacctcaggtgatctgcccagcttggcctcccaaagtgctgggattacagacatgagccaccacacctggccctgtattcatttttaatataaaattggatacaatgagcctgagcagcagtaaaaataattctaatttacttggatttatagcattgttctaggaaataggagatctaatatttgttgagcacccaccgtgaacatgatgcttatttgatttaaccctcacaataaccctgtaaagtttttagatatgatgtgacttccaatttatagatgaagaaaatggagggttagagaggttagatgacttgtctagctaattagtgatttgatactcagatctcagtgtttccaaagcgtttctacttgtgccttctgacttcagtttatatatagtgtttagagggaaagtacttgaaactgtgacacattcattttttaatttactatatgttaaatgttttttggatgaacacttcttttttttataaaaataattgtttagtaaatagaattgaatcatccaggaagctttaaaaaaaaaaacaaacaaaaatccacaaatgatcagtaattgatgttgagacagttacaattttaactgtttggagaatcaacacctgatctgttcatctaaaccaataggacaatactgaataagataaattgggaagtaggaacactctgcccactatacagaaacaactgtcggaaaacaatgacacaacaaaagttttggcaactttatttaagctaacaaacgaattttctctctgcaaagttataaattaattttaataggctgatccagatggtccatttggaaaatggataggctgatctgttgaaaattaaactaaatttatctctctcatacttcaaactgaagcaagagagagaatcatgcctattaagtccagcacatacagatggaccagcaggtcacacatgggactaatctgattcattttaaaaataaatgcatacattattgaatcattttctacttgcaagatctgttgtgtgcaatattcgaaagagatttaatgttgtttttttcattgccgttttagcaggttctcttccccactccccctgcccactttaatttaacaaccttcccccccaccccccccatggtgctttgaaatgatttttctaatatctgtcattcagtgttgagatccaagctctggagattaattaggtcatgaggctttttctcctcccttctttgtaaagggttttatctccattctctttgtgaagagcatgaactcaatgttcttggaaagagaaatggcctttagaaacagggaagtaggagatcctcctggggccctcagagtcttttagcttctgggtgttttagcagccccatgaatgcagatttgtaaatttattgcagtgccatctggttttttgctcgaaccagattactgttggcttgtgtctgtctattgtggtggtcactccctaggagcttgccctctctatcttagggaagagtgatgaatagcaggggtcaatagaagcgggtcacagggcagctgtccaggactgccctgaacttgattaccccattgctgattttttttaaggtaggacatagtatataagctgtttaaactccctcttttctctattgcatatgacaataatgaagtgccatttgctattttgtttttttgtttttgttttgttttgtttttcctgtagtcaacttctgtagacaaaaagatgtcaaggccgccttatacctagtattgatacaagtaggatttgcatctcattaacttgagattcttttgcagatatttctaatgggatttcagaaactcactattgattataaaaagttcagttatcttctagcaatttaacattgtttttaactaatattatagttgacatatattattcaaaaatagcgttttgccattgttgataggacataactactgcatgttaatttggagagctatttaaatattggaggagcaaacaactttataccaaaaatttggcaagttgaacaaattccttgaaaaatacaacttaccaaaactcttaacacagggtgaagcaaaatttgaatagcctgatgtctattaaataaatttaattaatcatcagaagggacatgtggttttactggtgaattcaacaaatatttaaggaagaaatgatacgaattttatgccagaccctttcacagaatagagaaggaaagaacactccttgacttaaaaatccaccataacagtaattccaaaacccgacaaagatattaccagaacaagaaataatgaaggtggaaattaagagacactgttccctgtgtctgtcaccaagtcattttgtatacctgctttttcgtttcatttccagcatctgaagatggaagagtttggggtagggagaggaagtagagcagtgtatccttgtaaagaaagttaattttcttagtttcagaataatctcatttcttggcattaaatatgaacttttatttaaaggatgtacaaaatagctacaatttttgttttactcctaaaaatgtgaagtcaaggaaaggatagccactgttttcctaccttttattcctatctgcaatcaagggcaaaggcctgggaggatacatgaaagtactcattactttttgaaaattgtggcattacaacgttcaactctttgcttctcattggtgctaataggatctgtcagccctgcctttctctgtaattgagtaaattgtgaccgttgtctaatccctctcccatcccccatttcctttgtgtatgtgtccacttaccatcctgagaacgtgggcagtgataaataaagcattgagtagagctctctcaactctctgaaagcagcatgatgccagccctctagttatatttctttaagtgtttaggtttttctgtattctttctcttgtgtagctggaaccctggggatgcaaagccatgagagaggccaagaagctaacaaagtagctgtctcccttgttagcttgttcctttattctttaaaaacaagataaaaaccatctggctcagggcattacattttcctcccccatgcacctctatagatggagacttcacctgcagtgagggtttacattgattagggagggagcagtaattcaagcttccatcctcttcaaggatactttgcagtctttaaaggtgctgacccactgagttagactgtcaagggaggataaaaaagtatcttcatcccaggaggtaacagctgccaggttttcaacaccttgcacgctgctggaaaaatgtcacaattgtcagctgaaagaaaaatgactgtgttgtcatcttctgttaatgactgggccttataaaaggaactacataagtcttttagaaggaataagtagctgttttccttttctaccatattcccctcccctgaaaaaattcctgcgttctaaacattgccttggagtagatccacaaaaaacagcagtgaagaacttaaatcagccagtataagcatggaagtctgatgggcatagctcctttatacagttggatgagtaggaggaaaaagcacatcactgacacagaaaatgacattatagtgtgtattaacaaaacaaccacaacaacaaaaagtcattcataagccagtgaactgagagaaaacatactgtatttctgttctttggaggacaatttattttcaagcagcatccagatgggtaaataccaagacatttcttttttcaagagagctccttttcttcctttaaaaaaaaaaaaaacacagaatttgcttcctttaatagctctgtaatgttcatatatgatggcattcccttctttctgatttgattgatgagggaaaaaggtttaatgaagtccctgatatcaggcaggcagggttttttttttttttttctctctatttgttttaggttagtcactttaattgtattgagtaattagaaggtacacacagccaagggagctttgttctgataattgctcgagaaaacccattccctatctgccgttgctttgtgttaagacacttctccctctagtggcaatagtaagcactttggcttggcagtaggcaaggtgtaattgcaatatgacaaactatgcttaagggactgtcttgtaaatactttcgtttggggtttgcattatttcattatatatgtgtggttggttgttgttggttttttttactctataaaacttgctacctctttttgccctcctaaagtgctttgggctttgggtaaaaaaaaaattgcctgagatgtttattaataaaaaaaatcacaatgcattctgggtaatgttttgcagcttgacttaattttagtcatctgttttaattacctatttataaaaatgcctttgcatttgtagacattatttaatactttggaagaagcacctcatttgaaataaataaataaattgtacttattttaaatagtccatgtaaaagatcttaaaggtaattaatgtaggtctcttaagtaagacaaaagtgatctttccaaatctgacgaagtgatttgtttatataacttcccacttctgttgaatcctttagagtctaataacttttttaagaaaacacggtttggcaatttgtgcctagctacaaaaacccttcttcaaaaaggagcaatttaataaccggctttcttaaaattactttgaggaaggaagaccgtatggggggttggtgctttgttttatttgtattttaatgtaatcattctttgataaattgtgtaatcactgacttagtaggaaaaatattattgaactcctgggttgcaatgaccataaagagtgtattttcatatagagagttgtgatactgggaataaattataaaggaaacagtttatatgctggtcaaagtccatatgggcccaattcattttgttttcagtgcttactctggatgtaccattaaaaaaggcggggggtggggtgggaggaagcctgttgtgctcatctgcatgagccctaaaaaaaaaatctgccctaaaaacaacacggaatgatagcagatgcagctttgcatctattgaacaagattcagtagcatctgtgtggcatttttaaaacccacttccagcttccttagatattgctttttggtttgctttttctataccatattcttgtgtgggacatgatttgatgttaccatgtatctggaagtccctgtcttcctatacccccactcccagtcactaacgattttcattatactatatcttgttatgctatagggctgctgaacagatttctaagcagctttttgcaaggttaaaacaatgcagcccagtaacaagtttgtgtaattttaaatatataccttctagtaaataagggcaagtctggcaatcaatcccttttagtgtgttatatgtttcacctgacaactaaaccttctattgattagccattactttgttagataatcctatgtcattgaatccattgtaaaaaattaaactctttaaaatgttttaccctagcagcagtgtgaaaattgaaaacttgttcagaattacagcctgctttcacaaagaaggtagttttcagcaaggcatcttactagtttatgcttatgtgctttatatgcgatataaaaacgtattaaagtactccaacgcaaaactctctgcctctggttcagcaatgaagctaccttttcaagtgttgcatggggacagaacctatcttgcctgtggctattatattcactagttggatttcaaactggagagagtcttacaggaaaatattgaatggaaaatattgaatgttttagccttttaattgcagagtggtaaaggaactatgacaaattttagtttattgatctgtgttacttccttgggagatcagcaaagtcatttacccattttacagatggaatgtctagaaaataaagtcctatatatagccctactctggaaactccctcaggcctggcacagagtttctgaatctatctaatggtcccctaaatatgttattacatattcattcatgaagggaaaagagggtaattttgaaggaaaataaattttctttttataacttagtattttcagaaaaatagcatgatacatttattgatgactggacaaacctctgtaaaaaatttactcctaagatacttctattggaagttttcatacagtgaattttacagatattaattgtataagtctgaatttttgataaatctaaccacctgtgtaaccaccaccctaattaaactatagaatattttcataacctaggaatgtctcttgttctcctttctacttattttctgcaccaccaatggatcaaatactgatcagcttactgtcactgtaattttgccttttctagaattttgtgtaatggaatgctatatttttggggtctgacattcactttgcataatgtttgtgagattcctctatgttgctgtgtatatcagtagtttattctctttcattgagttgaataaatatatcgcagtttgttttctgtctccttttggtggatatctgagccatttccatcattataagtgaagttactatgaacgttcttctataaaggtttttggtgagcatatgttaagtactttttcatgtgcttattggttattcagacattttctttgtgaagtatcttttaagtttttagccatttttaaaaattgcattgtttgcctttttattattgagttgtagactcaactgtattgaattctggataccattcatttgtcagatatatgtactctgattatatctcacagtctatggtttgcctgtttatggtatgttttgatgagaagtttctaatagttggatgaaatccagtttaccaatttttctttctttttttttttttttttttttgagacggagtctcgctgtgtcgcccaggctggagtgcagtgacacaatctcggctcactgcaacctctgcctcccaggttcaagcaattcttgtgcctcagcctcctgagtagatgggattacaggcatgcgccaccacatgctaatttttgtatttttagtagagacggggtttcaccatgttggctaggctggtctcgaactccagacctcaggtgatccgaccgcctcagcctcccaaagtgctgggattacaggcgcgagccaccgcgcctagccggttttttcttttagaagggatacttcctttggtcctacctaagaaatctttgtctaccccatgattgtgaagatattcttctaagttttcttctgggagctttataagtttactatttatacttaattctatgatccatctcaaattaattcttatacgtgccatgaagtagagtttgggcttcattatttttgccgtaatttcattcagttgtttcagcaccattgttgaaaagactttcttttcccccattgaattacatgaattcatttgtccaaaccatttagttatataagagttatattctcaaacctcctgaagaaaacgttgctgctggacccagagcagtgggtgacagtgcctaaggtactgacccatccctattttatgtccctgtagacaaggcggacaagaaaaatgataggtgtctatccttgcaccaaataccatagtgtcttgattattgtcattttatataatgggccatgaaatcaggtagtgtgagttctctagatttgttgttttattttttgttattccagatagttcacatttctatataaattttagaatcaaccttgcactttctattaaaaagcagtctgtgaggggctgggtgtggtggctccctcctgtaatcccaacactttgggaggccgaagtgggaggatcgctggagcccactgagttggaggctacagtgagttatgatcacaccactgcactccagcctgggcaacagaaagagaaactatctccaaaaatagacagacagatagataactactttttttttcatctgagatatataggattttgcccccgttattctgttaatacgacaaattaccttgatttttgttaagagtttttgtgtctgtttcatgtgaggtactggtttgcagttttcttttttaagtgtttgccaggttttggtatcagagttatgctggtcttataaaatgaattgggaaatcttcctcccatcctcctctgttttctaaaagcacttgtgtataatcctggtggtgtttcttccttcagatttcatagaattcacaaaccacttgggcctgtagttttctttgtgaaagattttttaaacttattatttaaatttatgtggcaagatgttttagagcaatttgaatttcttttagaggtatagagctgttcagattttctgtttcatgtgtcaattttggtaatttgtgtttttgaagaaatgtttcctgtttattcaacagattataatatgttaatatcttttattttaatactgtgattgtttcatattgggctactgaaagcctctttcggcaggcttccatgccccctttgacgtatcttcatcgttctgagtatttccatcttatagtttccctggtcagtcctggagtcaaccatatttccatgaatgtatgattccctttagtgcagaatggtatttaaaaaccaagattcaaacactgacttttcttttacatctatatttatatactttgaaaccattagttcacattgataactccaattctaattcaaccccacagggtttgttctagatttctttctttccatatttcatttttctcccttccttccttccttccccttccttcctttttcttttcttttcttttcctctcttctcttctcttctcttctcttctcttctcttctcttctcttctctctcttctttctttcttgtttttggtagagatggggtctctccctatgttgtccaggctggtcttgaattccagagctcaagcaatcctcctgcattggcttcccaaaatgttgggattataggcatgagccaccccacccctttcctaacataggaaacctggtttaagatttttttcctttcagcactttaaaaatattgttcccagctgggcgtggtggctcatgcctataatcccagcactttgggaggccaaggttgggtggatcacctgaggtcaggagttcgagaccagcctggccaatatggtgaaaccctgtctctactaaaaatacaaaaattatctgggcatggtggcgcacacctgtagtcccagctacttgggaggctgaggcaggagaattgcttgaacccgggagacggaggttgcggtgaaataaaaatattattcgcttgtctcctagccttcatttttttatgaaaagcctgacattatttatatcgttactcctagatacctaacatcccctttttccttggctccgttcaaggttttatctttatcactcgttttcagcagttctgactgtgatgggcctatatgtgttgttttctttgtatttttaacatgactggggtttgctgatctgaaatcagaaagccgctagttttcacaaaatttggggaagtatttgatcactatttttataacttctttgctgtaccgttctcttctcccttccttggactccagccacgcatatattctagataatccagaattgtcccacacagtgactaagaccgatcttttttttttcttttcttaatctcctttttttctctctgttcttcagtttatatgatttcagtttatctatctttttttttttcggtttatctgtcttcattgaccttttcttctgtcacttccagtctgctttttaagcctctccagtaaattttttgatttttttgagatagggtctcactctgttgctcaggctgaagtgcagtggcatgaacatggctcactgcagccttgaccttctgggctcaagcaaccgcccaccccagcctcctgagtagctgggactacaggtgtgcaccactatacccaactaatttttcttttttctctttttttttttttttttttttttgagacagaatctcaatctgttgcccaggctggagaacagtggtgcaatctcagcttactgcaacctccgtctcccgggttcaagcgattctcctccctctgcctcccaagtagctgggattacaggcacttgccaccatgcccagctaatttttgtatttttggtagagatggggtttcaccatgtttgctaggctggtctcaaactcctgacctcaggtgatctgcccgcctcggcctccaaagtgctaggtgtaagtcactgggcctggccaattttttctattttttgtagagacaggatctcactacgttgcccaggctggtcctgaactcctgagctcaagctatcctcctgcctcggcttcccaaagtgctgggattacaggcatgagccaccatgcgcagcctgaatttttcatttcagataatgcacttttcagttctagaatttctatttagtttatttttggtttttcattttctggtagaatttttcatctgtttattcattgtgatcatatcttttattgctatgttcaagtttgaacatatctattatagcttctttagagctataatatgtgctaatttctacaactaggtcttctcagggttggtttttggttcatttttctcttgacaatggatcccatttatctcctttttctcatttttagtaatttttgatcatataaccaacattataaatggtacattgcagaaactctgaattcattttttcttcctctgattaaattactggctgatcactatgaccttgtggaggcttggttttgtatttgttaaggtcaggtgtattttggttttgcccttagtcctaagacatactcttgaatctaaactcatggtctctttgaatttttaatggaaagcctaagatgttattacatccctctaacttgatagaagtcaaactctaaactctttctccccccatgagcagcagctggaatatctgcacaggcctttcaaccctccagctgttgctctccattgaaatccttggaatctccccttcatgtacgtagtttgggtgttagccatagatttgaggggaatttatatgtaattttttagtcttcctccttcccctgtggttctctttcatttctgggatttctgttctctattgccagccactatggcagttttgaactcttatcacttgatatctcaagccaatagactgtggctttcagattgaattctagtcaccctgcaccaagtggactcgtgagtgccttcaggggaaaagcacataaacacacatctcacccagtgtggttctcttctttcaagatcaggccactccttccccattttccgtcttttttaagtcgatctccagtgcctttatgtagctttaaaatgtttttcctatctgcaagagggtttatctgatacaaacatttctgccattactggaagcggaactctttgagtcaagttatatttttttcagcaaatactgattacttcataaatttatctttaaaacatagtgaattttattttaaaaatatttatgtttgtgtgtgtatgaatagtaaatgtttgtggaattagacaacgcaaaagaaataacaaatctagagcccagaatttacatgcaccaatatttaaatctgtacactaatttctaatgctctattttttcatatatattttgaaataatttttacttaaattataagaataaaacaagttggtaaattttttaaggtttagcctgtttaaaagaaaaacagctgggcgtggtggctcacgcctgcaatcccagcactttgggaggccaaggcaggtggatcaattaaggtcaggagttcaagaccagcctggccaacatggtaaaaccctgtctctactaaaaatacaaaaattagccggccgtggtggcacatgtctgtaatcccagctacttggtaggctgaggcaggagaatcactcgaacctgggaggtgcaggttacagtgagccgagattgcaccactgtactccagcctgggagacagagtgagactccgtctcaaaacaaaaacaaaaacaaaaacagaactgactttataatatcgatggggagttatatatctctactattttccccattttttcttaaattttatctattttctttccaaagaatgatagttgaccaaaatcagattctttaaaatatctcttcatgctgatataaacaaatgagtaaataaataaatgaggggtgaaatcacatcttttccttacagaagaattccagttaatgtggaaggaaagacaaaaataataaattcactattagaatacacagtaaaaattaccataggcatgattagcacccaatggatgctaaaattagcaagctgagatgcaagtagaaacagaatatttgcatagtctccaagtattttgccatatatatatatatatatatatatatatatattcagtaattcctaaggggaaaataatgtttatactggagaatcttggcagacatgtccttagctgtataatcaaggctaacatcaccagaaataccagcataccttctgatttgatgcagtgagaggggcacatcacctctaaagtatctttccccaaaataacctcaatctgatcatgagaaaatatcagacaaacccaacttgaggcacagtctgtagattaactgatcagtgctgtttagcagtgtcagtcatgaaagacaaggaaagactgagggattgttgaaaataagaggagccctaagagacatgacaaataaatgccatgtgggatcctagattagatgctgaacagaaaaaggacattagtggaaaaactggtgaaacctgagtaagttctgtactttatatagtaccaagttaatttcttagtttcgataaatgttctgtaattatgtaagatattaacatatggagaagctgggtgacaagtatataggaaatctttactttttctttctttctttttttaaagagatgatgtcttgatttgttgcccaggctggagtgcaatggcataatcatagctccctgcagtcttcaactccagggctcagtcagtcctcctgagtagccaggactacaggcctgtgctgccacgcccagttaatttttttttttttttaaatagaaatgtgggcttgtatggaactcccggtttcaagtagccctcctgcctctacctcccaaagtgctgggattataggcatgagccactgtgcttgaactttactatttttgtacttgttctataaatctaaaattatctcaaaatgttaaaaaattgaattctttgttactgttggttttgagtgtcttaagatttttcttcttaaatccaacacaagtatttatagcaatggttctcgaagagtgttcctggatcagcagcactaacgtcaactggggccttgttaaaaatgcaaatgttcagaagctctggggatggaaacctagcaatctgtgtttgttttgttttgagacagagtcttgctctgtcacccacgctggagtgccgtggcacgatctaggcttactgcagcctctgcctcccgggttcaagcgattcttctgcctcagcctcccgagtagctgggattacaggcatgcaccaccacgcctggctaaatttttttatttttttattttctttttttgtatttttagtagagacggggtttcaccatgttggtcaggctggtctcaaacttctgatctcaagtgatcctcctgccttcgccccccaaagtgctgggattacaggtgttagccaccaggccccaccgtgatctgtgttttaacaagccctccttccagatgattctgatgcgcactaaagtttgataaacataatttataccatcagtaaaaacttaagactaaaaggaaacatttctattaatatattgtccagtaattaataagtttgcttttcataaagtataactatagtattaccaatgttttgttttgtttttggtagagacagggcctcgctgtgctgcccaggctgatctcaaactcctaggctcaagtgattcccctgcctcggcctcccaaagtgctgggatcacaggcatgagccactgtgcccagctatcaccagtttttaaaatccatttcctatgatttttttctttcttttttatttggagacaatgtcttgctctgttgcccaggctggagtgcagtggcgtgatctcagctcactacaacctccatctcctgggctcaagcgattctcgtccctcagcctcctgagtagctggaactacaggcacccaccaccatgcctggctaatattttgtattttagtagagacagggtttcaccatgttgcccagggtggcctcaaactcctgagctcaggcgatcttcccacctcggcttcccaaagtgttaggattacaggtatgagccaccgcacctggcctgatttttctattttatctcttcaacattaccagatgtacttaagggataacttctaaggtctagataggcccagtgaggctgctcttgcctgtaatcccagcactttgggaggccgaggcgggtgggtcacctgaggtcagtagttcaagaccagcctggccaacatgatgaaaccccatctctactaaaaatacaaaaaattagctgggcatggtggcaggcgcctgtaagcccagctactcgggagactcaggtgggagaatcacttgaacctgggaggcggaggttgtagtgagccgagattgtgccactgcactccagcctgggcagcagagcaagactccatctcaaaaaaaaaaaaaataggtaagtgttggtttatcttttttcaatgttctttcaattttggtttatttctcttttctttttaaagccaaaagtcaaagcttgtattgagattcttttataaaaatatttcatgattagttttaaaataattttttttttctggatggtttaaaattttttcatttattgttctgaataagaaacatgtcagctgagcacaatggctcgtccctgtaatcccagcacattagaaggctgaggcaggaggatcacttgagctcaggagttcaagaccagtttaggcaacatggcaaaaccccatctctacaaaaaatacaaaaaattagctgggcgtggtagcgtgcccctgtagtcccccacctactctggaggatcacttgagtcccagaggcatagattgcagagagccaagatctcaccactgtacttccagctggggtgacagagtaagaccctatctcaaaaaaaaaaaaaaagaaaagaaaaaaagagaaagaaacatgtcctctgtgggaggctgaggcaggagaatcgcttgaaccccggaggcggaggttgcagtgagccgagatcacgccactgcaccccagcctgggtgacagagcaagactccatctggggaaaaaaaaaaaaaaaaaagaaacatgccctctaactaccttcagatcttgatggttttgaaagtttagaaggaaaaacaacaaaaataaatcttttctcagaacggtaactgctgttttaaacagaactaagctcttccaatttgcattttaaaatgctacataatcagtacccccagcttccattaatcattaatacagtgaagccactgctgcttacatacttgttcatgggcacatcagtggcttttgtagcctctatctttgccctcctccttttctaacttacctctcagttcccataagtcttaacttatagataaaatctatttgtgttttgacttgagaaatagagcagaatttgaaaacaggatatggcagtatttcaatattttaaaaacctgtttccaacaaattctctttacagacatacaacagctgtgccagactctgcttaaaccaagaaacagtatgtttagcaagcactgctatgaagactgagaattgtgtggccaaagtaagtaatattgctcatcaatgtatattacaccacaccataacagtgccatatctgtaggcatctttactcagtattgcttaaggattattacaggattatatagttaagaaaaaaatacaaacaggcatcattttatctagaacagattgcaagttagattctccacctcttaattgcaacagaatgttttgcttatgaattctggtcactctttagactgattcacatttgtttcttgacactagttgtagattatcacatatcagtaggatttgtataagataatgtacaattgttttgataagtttatggtttttaaatacagttacgtatagagtacatcacatcattgcaaggactgtgaaatatgctatagacaacccaattattatatcactattattatttattgagtggctaatgttggaaatactgcttttgttgatcttgatccacatggacaagtatgtttagtcatgtgtatgggctacctctttttcatgtatatatgtcatctctatagcctagatgtaaaattaatcttaaatattagagatctgatgctttttatatctatcataactcacattttccaaatatctgtaattactgaggaattttgactaaaattcaagtgtcagacattttaggaataagtactattaagtatgggctttgtttcttttacttgaattatctgcaaaaatattgcctttatatctattcatagatttgctactgttacaacattcccaacttgaactattttagtttaacctattttattatagatccaggccctcagtttcttactgttattattagagcttaggactggtgtcatgtcattgctatctttgctacaaaaatctaatgacagttgtcttagtccatgtgagctgctataacaaaaatactgtaagctgggtggcttataaacaaaactaatttttttcttataggggctgagaagtccaagatgagagcactagcagattcagtgtctggtgagggcttgctctctgcctcatagatggtgccttctcactgcatcctcacatgatagaagagactagctagatatccgaggtctcttttttttaagggcactaatcccacttacaaggggtctgccttcatgaattttggagaacacaaacgttcagaccatagcaaaagcagagtttttgtttatttttccttaaaacatgcagtagtctctgggcctgctctatcaactggaaatgtatcacacaaaatataaccatcgaaatcatacatataagaaatatcagaatttatttaaaattacagtttaaaaaggtagagttcatcagttaaatgtctcaaatccaaatatgttaatattttgctataaaatgtaattataaattacatatttttcagtcatttagtcacaactaacaagtgctaattgaccctattttattttgttttgttttattttatttttagagacagagtcttgctctgttgcccagggtagagtgcaatggcactaatcctagctcaatgcagcctttacctccagggctcaagccctgatcttcctgcctcagcctcccgagtagctgaaaacatgagtgcatgccaccacacccagctaatttttggttttcggttttttagagttgttttgttttgtagagatgaggtgtcgctgtattgcctaggctggtctcgaactcctggcctcgagtaatcctccccactaggcctgccaaagagttgggattacaagcgtgagccactgcacccagcccaagtctactttatatcctgcttttgtgcatggaaacagggatacacagttatttgggcctttaaaaatattctttctttctttttttcttttttttgtttttggccatgctgctcttagtttcatcacaagtgggtgacttctggctaaataaggtaaaattttagcatgagcaccaatccaaggacagggtgatgattttaatgagtttcactgagagctggccaagtgagcatctgttccttttgttttctccatactttgtaagccaggatctctaatctaaataggttggtgtgtgtctatatgatgtggagttttttttttttaattgtttttttctcccaccctctgctttattggtacatggttaaaaatcttctgccatctagcacaattatttaatttcttccatgcttttggatcttgagtgagaaagtaagtttgctcattgctgctcatcagtgtgtttcacttgctcccaggtggtgaccttctcattgcattgttgcttattttaacattattctgacacctatatcctttcgtcatcctcttaaataatctaatttaatgatgatgtctatcatttcctattggaacccagttaaatcactggttccttttattggcccacatcctgtcttctggttcattgcttcagatttgagccaaataatcagttggtcaatgtcaaataaaaacacatagctgaaaaattttctttcttgcaacagtctccagtgaggtacccatagcatgagaatactgaaaaaggttttccttttttttgtgagatggagtctcactttgtcacccaggctggagtgcggtggtgccatcttggcttactacaacctccacctcctgggttcaagccattatcctgcctcagcctcccgagtggctgggattacagaagtgtgtcaccacacccagctaatttttatatttttaagtagagacagggtttcgccatgttggccaggctggtctcgagcttctgacctcaggtgatctctctgcctcagcctcccaaagtgctgggattacaggtgtgagccactgtgcctggccaagttttttcttttttatttacatgtgttttgtgtgtctcatgatccctgtttcttttttgtttgtttgtttcttttttttttttttttttttgagacggagtcttgctctgtcacccaggttggagtgcagtggcatgatctcggctcactgcaagctccgcctcccggtttcacgccattttcctgcctcagcctcctgagtagctgggactataggcgcccgccaccacgcccggctaattttttgtatttttagtagagacggggtttcaccgcgttggccgggatggtcttgatctcctgacgtcgtgatccgcttgcctcagcctcccaaagcaatgggattacagtcgtgagctgccgcatccggccaactgtttctattggcctctattgcttgacctttgaatggaatgacttgtcattatttttgttggtctgcaagcttgtccctatttcctgttcttcacctttagcccttaactgaatagtttcatctgctgcattgatatggctgcagtgttttctcaacttggtacaagtgtctgttgttgattcagattgtactccattgtggcctgaatctgtaaccatttccatgtgagaacaactgtaatattgtgatatcaaccatttttgtcctttagttcaaagagtgactttggcttggctagagatactaattataggccaaaaccttattatttattgaatatggttcatgtaagttttagagaagacattaatactatttatttccctaaaagcagcaatggtattatgtttggacccctataataccttgattgtaactctttgccagaaatatcatagtcttatgatagctctatacgaagggtaccaattagtcctctgtagaatacaagaaacaaagctgtaaaacaaattacaaccaccctaagttggcaataatcttgttagtctttaacttgaagaaagaggcctaagaaaaaatttaaaactaaaaatggccgggcacggtggctcacacctgtaatcccagtactttgggaggccgagacgggtggatcacgaggtcaggagttcaagaccagcccaaccaacatggtgaaaccctgtctatactaaaagtataaaaattagctgggcgtggtggcacatgcctataatcccagctactcaggaggctgaggcaggagaatcacttgaacctgggaggcagaggttgcagtaagctgagatcgtgccacagcactccagcctgggcgacagagtgagactcagtctcaaaaaaaaaactgaaaatgtaggagggtctattttatccctataacttaatccaagtaatatttggaggcattgagatacctttttgttttttttcagaattctttctcctggttatggccctgtgtttcatgagatttgtgtttggagcatgatgagctctgtgtttattgtagctttaaatggacagtcattattaactgtcaacttagtctttaaaatccataatcacattgtgcttattacttgtcaaccttcatgattttttttaattggtaaagaaaactcactggaaggctgaaaagcattacttttttatgttatcttgctattggctttattaaactattactgcaaattttggtcttaggtttttttccctaatttacccttacccacacccacagatacacaaatacatgcagttaaaattgaattgtttgaatacatctatccagattcctggcccagataagagaagtttttcctctttatgtttgggaaataaaccccttcagtagccctttgtggatgttctgtattttagttgttattggttgttgtcactgtttttttatttgagactaataatctgtttgaaactgactgagacagaaaaatgtgatgttcctttccactcactccagattttgatagaagacttgttttatttatttccaaaattatatccgcaggaaacaagctgtttaaattcagattatgctgaagcaaaatggtcctggtatgagaagcaacgtgctgttttacgagcacagagtcccttttctcataactgattgatagtaaatattttcctgaagaattattgccaaccatgaacagtgcaactgtttcactttttttccatgctacttgctgtaccagccattgtcggtaattaagatctacaattcacaatgcagacgtttgcacttcctctgggtctgtgctatttataaggcatttcagctgttcagagtttcttttgagttttaaactacatgttaacaggcttctttaagatactgttccacaagtagcatgtcatatggtccgttcttcacacaggcgcctctgtcaggtctaaacattagctttacagagaacatactaagatataaccacgtcattgaggctgatgtggttggaaaaactgtggagtataatgtgttacacattgggcttattgctctttcaaaaagataggaaggaacttcagatgtaatattctttttgaaaatcttaatattcatatgagcttaatgtgttaattgggttacagagatatacacagttaaatgacttttccaagttcactttgcattaataagagaagccaggacccctcttatagacaagagtttgtgtgtttgtcagattaaggatgtaagaatacattttcttctagatgtgcgtgccgtttaagaaaaatacagacatggggcaccaaaacggatcagcagattgactgcacatttgttgtgtaatcagcttcaggaaccctaagtagcatatgccattggttgaggaaagtgtaaacaggaatcttggtctgtgttaaagttggtaaaatttaaaccattttcaaccaaaaagagacttaaaaaaaaaagtccagaccccagcccagaatctttatgaattatgccctaaaataagagtaattgcttgtgcagtcttcttgctaccggcactcattgttaaacatacaagaaaaagaaacaagaaactgaaagctgtcaacaaaatgtgtttaaaactttgccctgagtgggcatcagactggctgtttttaagcctgaagtccagccgcattgattaggcacgttggccatcagcatcttccagcagagcagatctgcagagaaaggcaggacccaggttttagtgctgattctggatggcccttgaatatagacagaatatagacagcttataacaaagccattccaaggcagttttattttacaaatctaaaactttcggtagttcttttgaactaccgtgtttctgtaaatttcttcagtgaactctatgaaccgttttttttgtttttgtttttgtttttaaatagcagcggttcagctgttgggaaccactgatatatctgactgaggcacttcaagatgctagaatttattcatatttctatctagccagggagctaataggctcgagcttgtctttgtggattgatctagattagcatgaaatgagcccagtcagtgtcttcctcagtgaaaagggagaggttaggggaaagagggatgaaagaagaaagttcttcatcaagaattgactgcagtattgcctgctgatgcatgtcggatcacccgcacagagagatcacatggcttctccaaaagtcaaacgatcaattcgcctcgttttggctctgtacttaatgcacaaacagtgcgatctgcggggctgtaattgcattgttagggccaaggaacaaggctgtgccttttcagcagacagctggcagggagagaggcatgttgttaggaaagagagaggcaaggcaaataaaattactgctaacgctcagagatcggcaggagtcctacttgcctaatcttaccggtgggagcaagcggctgttgtaatccaattatagcagcataagcaatttgttagacactccgcataatgtaacaatttcccaataaactctgacttgtaataacgtcggcaagagtccgcataaatctgcccgaatggtgggggctggagcattcggctgggggcttgtaattggcgccatcagcacgttttgcggagtgcagtatggtgcagtcttttagtgcaggaattttaaggagaaaagcgtggcacatttctcagggaaaaaaaaaaaagtggccattaaaaggggaacagcaagaagggcatactcttgccgtcacattacctaggaatcttagtgtagaaagaaaacaggaggaagccatgtttcctcctaatactaaagaggggaggtggggaaaagagtgtgtgaattagttaaatttctttatttaaaaggcatcggtttctattatttataccttcatctccagccccctaaaatgctgttcaggcagggtttagctaacatttttataaaatggtcatactcaagacaagcctagaaatgccaagttaaaatctgttttcttctggagttagcattttctttacaacatgaaatatatattctttatgaccaggacaaatcttttgaagatattatctcactgaatatcagacctttctgtggtgttctgacttctgctttaagaaactgtcacttactgaagggtttaaatctcagcttgtttgcttagctgcactgcttcttttctcattctgaaacatattgtgaatatctatgatactaggattagtaatcaatcttattgaaacattacattttataagaacatatcatttaaatttatacttgtgtgatcattatagaaataattttgattcctaagtaataaaatttctgttttggaaaaaatatttgttgttatatgggacaaaataaaatcacccttattaattgattagcatttgtagtcacagaatagggtttcttgttatataaggtataggaggtgaagcgtgcttatggatttgagttaatagattttcatgctactcaatgtttattaaatgttacctactttcttatgccaacccatttcttcattgctatataatttgtgtcaaaaccaactatatgaagaacaggatttttcagaatatcctgttgctgtgggtattaccacaataaatacttacttgcagacttaaacatttccttttgctgaaacaaatgcagccttctttgactggagctacatcaataaactgcagtgcctctaataaagccactcagtgtctgggtttaactaatggctgattttcatggctttgacagtgagctgtgtgcgttattttctcctgatattgtaaaaataatgagagcaaattagaacaatcagtttacacagatagctcctgattggaggcgatgggcaatatggcagcaggtaatccatctttggactcctgtcacattaacttcaacagtgtgaaaagatcaggtggggtaagcagggatcctacccagtcggaacactgaaattaatgagaagaacagtgttctgtgatcaaccttttaattagcaagagtggaaacagagggaatgatgaagggagcaccacagctgcacaatgccaggctcagtttctgaaaaggaaagcaaaaaaatctgtgttttatgttactttttttcttgctgtgtacaggcattatctttccattctagagctggttgcaggcttaagaaatactgcctactttccaaagtaatgccacaaatatggttgatatattaataatctatagactgtaattctatcaggagtcatttgattttgattaccagcatactttctttggcattgtactctgggttttaagcttgatttttctaaaaatcaggtaaccagaggaattacattttttaaagttctgccttgtcagcctcctctctcctcatcactccaatttagagttttccttgcaagtaacatgagagttttctggtttggagcatttctgtcactttgagttatttaaaagaggagcaaaatccaggcagccagctatgtcatatttaaattatattcctttcctgattctgtttattagaaatttgctgttttgtttttctattacctgtgctattgacttctcagtgttgggctgtgttatttcaatttatgtaattgagaactgaatatcaatcaagtaaggtgtttataggaggaagaaggagaaaatctaggcattaactgagactaaaggttgattcatccattcaaagctcagatatactaaaattgtaaccttgttaatcaaatggtattaggctatagaagacataaatgagcaaaattttctgagccaaatcagcttctgtttcctagaccttttttggaaggctttaattttgggaaagtatatgaagccatcatgatttgcagcgtgttagtctttacatattagacttagtggcttactgtaaaagcaagtaatatgttataggctatgtaaatgaattcaaatatcttctaaagatacacaaaatatttttttcttgatactaataattaggcatttatttgaagtactaatatgcaaaagctggttaccaggtacccacctgggtacagaattggtaggaaagagcctaaagttagtgtgaaatatttaggttaggtatgaggtgatcttttctcataggactttttttcacaatatttataactaatgtagattatatgtatcataataggtataactctctaggctttcagtgctaagatactgcatttacagaaacttaagtctctaatattatgcctctacttaaaactcattgtacaaaagtacctcacttccccctagtaccatctccctaccctcttccctgaaaaaacttaggattctgttagaacagaaatctgattttttgtcatgttttattttgactgatagtgagcttttcctgaaaacattcatttagacttgtatgtaccaatattttagaatcagtgatgtaataccaaatagtatctaggactccccccagacaactctttttttttctttcccagaatcaagaataaaagcaacccagacaactctttaatagtctgatgctactgtgcatattaatatttaaagtccacttgttattattttgcagatccttttctgcattccttaatctgaaagagagatttttattcttaatacttgtatggatttttgtggctttttatgggtgtaaatattctcctctctcgtttgacagtttcaaaagcctaggttcataagctctccatgaataaatatgttcttagtcatgtgatgtaaaaagatcgcttacaaagcttgtgaaacctgagccttccttttgaaccttttactacccatgagctcaggaaccatacatgcaaaattttattcttgcgtcatgacttcagcttatgagggaaatgagctatgaatttaaatgactcttctactctataccaagtttctatgaaaataaaattgtattttttcctttttcctaaaaggaaagtttcatctgactagtgtttctgccggtatttgttcccattgttaaaagatttgtttcttaagattagcattaaaatagacatcctgtttttgaaggcatctttttttgtttatactgtaatcccaaaaatgtccaactggctgaatggccaagaaactcccttgtaatttcctaatagagctaaagttaacaagtcaccttaaagtctactaattccaattaagttcaccttggagaaattttcattagtctagtcctttggcacttacccaatacacccttaattaaagttcttatgcatgggaccagttgtatctattataaagattatcataattctaagttttctctcccacccccatttttttttcagggtgtgtttccatataaagatcgaaaaagtccattttcttttcatgtatcttcaagatggaagatcttttccttcccttccttcctcccttcttccctccctcactccctccttccctccctcactccctgcctccctcccttccttcctttcttcttccttccttccttttcagttttatactactcagaagtttgaggaggagagagaatacattaaaatgtattcagccccagtgttcaggcactatatagtgctagctatgtgttacttatttggattctcatgtgaacctggtgagatggactggatcccactttacaaacgaggaacgagaagcttagataagttaaaccttttccaaattttcacatctttaaatgatagagtcaagttttgaactaagatctgacttcagagttcttgctcactagattgcctttcaggtagtatttggaggcctctgcacctctcctaccaggatacttcccccatcgcattgtgtagcttttctccatttcatttctatagcactttgacatctagcaaatgttattttctcatcttcctcctcttcctacctcttgctgcttgtataaatatcttgttcaggctgaactgagagaagtagtgtattcagaaaacttactatctcttttcggctgggtgtggtgcctcacacctgtaatcccagcactttgggaggcctaggtgggcggatcacttgaggtcaggagttcaaggccagcctggccaacaggatgaaactttgtctctactaaaaatacaaaaattaggtggatgtggtggctgcacctgttgtcccagctactcaggaagctgaggtggggagactcacttgaacctgggaggcagaggttgcagtaggccaagattgcgccactgtactccagcctgggtgaaggagcaagactctgtctcaaaaaaaaaaaaaaactctcttttctgggttacctagtcagtaattccatgtaacttaaatagtcacctgccttattaacatagtatacagatctttcaaggatctaagttgacttcttggctccatattacattgttctgtatataaaatgactgagataatattagacaactggttcagggtggtgacttactttagtaattgttttagaagttgttttggaatacagattttatcctgttgtctgtgtcacaatttgtagtgtaagcatgcactggcagtcctttcataccaacacatttgtttttcccacttaaacttggttattaattttgtcaattaaaaatgtgtcccttggcctggttcggctcacacttgtaatcccagtactttgggaggctgaggtgggaggaacacctgaggtcaggagttcaagaccagcctggccaatgtgctgaaacccagtttctactaaaactacaaaaaaattagctgggtgtggtggcaggcgcctataagcccagctgctcaggaggctgaggcaggagaattgcttgaacccaggaggcggaggttgcagtgagccaagatcgcgcctctgcactccagcctgggtgacagagtaagactccatctcaaaaaaaaaaaaagtctcttaaggcttcaggtctgtctgattacacttcagtaaatatttttatattttgattcatgcttctagatggttcggtgattgtgaagacatgatgaggtcatgagaatgtagctggaccttgaaatcctctgtctcggagaaaaggcttgggacagggatgagtgattagaagaaataggttttttttaaagcaaatgaaaacaaagcagacaaacaccaatattactattttgtgtgtatgtgtagttgttgttgttttttttttaactccctggatattctctaatggaaaggttagaaatgcttgacagttaagggtggcataaatttttcacacagactcataaagtatgtaagaaacacttgctcaacatggagcactaagaccatgacaaacaggaacagcaaaatatttctagaagaatgaacataaatttatgttttatacctcaaacatcacttctctaatttaatccacattttctaggagtatctaagagcataagaaatttaattatacagttttgggtttgtttgtttgttttcaatgtgggagcaagccaaaagggaaatatagagagaaaaccatgtttaaaaagaaatggttcctacagtgttaactatggagtctgtagcgtgactctgtaatggaatatcatggcagggggtataatactgtaaataagatgaatatgccacttgtggattaatgggcaacctaaagagtgcttttatttacatctatgtgtgacgttcattttcagtttgtatatttttctcttattcttgtgattatagtatttacaaatctgacattttaattacggaactttctactgattttttaaaaaatctgtttccatgaatcttgctccatatttatttttgtagtattaatatagtgtcattttggactttaaaattgatagattgaaggcgttttctttaaccctttctttagataataaggagacaaggtagtttctgaaatgtattgaattcataaaatacagctatttttaattgtttttcttacgaaagatggagtatagataccacgagtgtccagattatagcagattccatttgcagtgatagttttgtggatatggtatgcttttcaaaggtttaggtactaattaatataaacttgaatacatctagcctgggacactagaggagctactgtctcaacattataacattataacatgcaataaaggtaagtactaagtgagattttataaaactgattttttagtcagcagtttaggttgctgttgattgcaaattactagtattatttagtgcccttgaaacttctgaagttggaggtttcaattgttagttactccctgctttccttcaatagaaaatgtgtagtaaaggttatttataaaagactaattgtatccaaagctaaatggtcttattatagagtttgtataggatttattttcacttgcacgggtaggttctcaaaatgtatttgaatgtgaatgacttcaaacaaaaaaaagtgaaaaatttttaaaaagtactaaaatccaaagattttgtcatcaaatttgacagcctttttgcaccattacaggtatttattgaatgtttatgatgtactaggcatatacattttcactgaaatcatcacaatagtctcattgtgtttacacacaaatgaagtagaattcagattaagtaatttgcccaaggtcatactgtatgttgcagaactggaatttgaacccagaccatctggccccatggccttgtgctttcaaaccactgtgtttgtgaattttaatacatagaaattagggtagatgtagcaaatggggggattatctaaaacattctctgtggtgtctattgaatgttaacaatttactaacaactagccaggatttggaaatcgcagaagtatgcaaattggttatataaaattatgatagagtaatacatcttaggtttgtttttcttctcttgcacttatagtattttcctttctagcattccatatgagatgataaaaattaaaaacgcctcaattagcagccacaaaaaagtaaaactgttaattgaaccttgtaatctcttactgtctgttaggcttttcttttcaagctttgattgtgtgtaataaaactgtggcttaattaatgccagggttctgaagcctttggatgccacaaaagagagtgaagtggagaaaccaaggggcagcatcaaatagcttttctgtcatgttaatttagccctgtcggtcttgttctagttcatgatgtacagctcccaccagatactcacttggtgaattgaaagaggagctgtagtgaaaatactgtcttaggaaaaacacagctcttgattgaggctatcagcaggttaatgaataactgttttcagacaacatttcacccctagtttgagctgctcttagaatgaatgtggccaggttaatgtgaccagcagacataatgcaaaaccaaactaaggtggtaaattggcatcttggctttgttgcacatgcaggaaagatccaggactggtgtcagaggtatactgtctttggcagaagagtgcttgtccataaccagagtacaagagaggaagtcatactgatttatattaatcttcatttcatatgctaaaaaacaaaatggcaaccatttctctaggaaattgctaaagctgactttatagacatactttttgagggatccatatgctttaaataagttgataggaaatgtttgctatatcataactcaaaaaatattttcttaattttgagaatgcggaatattgagcaagacataattatcttccctaaaatgaatttacttttaaggtgactctgcattttcttctttttctttctctcattttccctccctgattcaaggaacttattaattagctggttttatacacgtattgattttaacaagaatatggaaaagccatgtttctttcaggatgagaaagatttgaaatccaaccatgaaaaatgaagccccttgtatttctggctgcattcccagaatagttgtgtgtagtataattattgaacttttaatacctgctcaaattctgtctggattgcagaggattacagcatcacatctaaattatactttctgataatattcaaatgtgaaatagacattgttgtgtggaggcagtgacatcatcataattttcaatgttttaaagtgtcagtggtaaagggagtttacaagcataggaagagaacacaggctttacgttgaaaaaggtctctgtcatccagggggttatttaatgctaataaatacttgttttggaatggatggaactaggttaagtgtttacagccaaaactttctattttcctctaccaaagagcagggttctcctaatactgacctactttgctcttagacaatactacaggtacagtggttatacatccatgaagagaaaaataaatgagaccagaaagattttttggtaggaagtgtttggtaacatgttgctttgttggtggaacataatgttgccacaaaccatgaataaatattctgaattatctaatattatagcagttataaccatttttaagcctcctttctaagtagatatttctctcctggcttcctgtgctgtgaactttgcaaaactggcataggcagcctattaattattcatatcatagcaacaattaaagcaaattaaaaataaaaatcaccgtattgcatttaaccgtgggcagcaccaaactgtgtcagctctgtaagggcctgtggtgtttccttagttaaaagtgctagagggagctctaaccttgttcagagtggtggcatatgggaacaattgtctgtatgtggccataggtttgcaagtgaagatatagtctcaggctcttctgtggcaaaaatttaaatcttttttattagaagtccctgtttcctttatatctgaaaataagggctaggacagtctatctatagccaaacagaactgtgttcatccttattgccctttctgtgaatacaatcatagtgaattttcacgaagtgaacatacctgtgtgattaccatcagattttatttttatttttaaaaaattccagattaagttcacatccacccagattttaataggaaaagagaaatgaaaagaccattaccggagcccactactaccctctttaagtcactaccctttcaagggtaaacattatcctcacttctaacaccatacattagttctgcctggttttgagcctcatataaatggaatcatatagtatttttttttttttactgtctgaattatttcactgtttttgagagtcatttatattgttatgtatgtatagttataatttgttattgatatgtaatatttcattatacatatatgccataatttatccattttactataagtgaacattgggtttctttcagattttcataactacaaaaaattattttacatatattttcctgaatatatacaatgagtgtatttgaatgggtatattaaccagcagaggaattggaatttccaaactagcaccaatttttatacagcagtgaataaaagttccatcattcctttttctcaccaaccaacacttggtgttgtctacctttttcattgtagcattctggtgatacgtagtagtattatgtatgacattttggattttgttttaagtttttattttagaggcatggcttcactctgtcacccagtctggagtgcatcagcgcaatcatagctcactgtaacctcgagctcctggcctcaggcagtcctcttgcctcagcctcccaaagtgctggaattactgactttttttaaaattgcaatttaaaaaataataataatataaaatttaccatcttactatttttaagtatacagtttattagctttaagtgtattcacattgttgtcacattgtttttcattcacatttctctgaacactattaaaattgagcattttttttatgttgattggccatttggatgtgaagttcttgttcaacgcatttgccctttttttaattgggttttatgtatttttcttaaagatttataagagttctttataaattctggatacaggttatttgtctgatgtatgtattgcatatatttctcctaaactgtgacttgccttttcactttttaaatgatgtctgtgatgaacagaggttcttaatttaagagtccaatttatggatctttgccttatacaattagtgtttttacattctacttaagaaatctgcctgtcccaatgtcttaaagacattgttttatctagtttttatggttttacatttcatgtttaattcgtttgatttttgtatatgatgcgtggtagaggtgagaattctttgttttccagtgtgatacccagttgacctagcaccatttattgaaatgtgtagttcccattataccggattgttttctttgaccatatgcttataggtctttatcaaaatcttgaactctgatagtaagtgccctagctttgttgttactcttcaagattatcttggttattcttggttattttcatttccatataaattttagaatcgccaatatttaccagctgtgtgatccacgccttgtgtactacagcacttgaacgtggaacagtcttcatatatttgtttaaatatgaatatattaaagctgggcatggtagtttatgcctgtaatcctggcactttggaatgcccaggtggaaggattgagcctaggagtttgagaccagcctggtcaacaaagtgagacccctgtctctacaaataaaaaatataaaaaaaatttatccaggcatggtggtgcgcacctgtagtcccagctattcaggaggctgaggtgagaagatcacttgagcttgggaggttgaggctgcagtgaaccgtgatcatgccactgcactccaggctgggtgatagagtgagaccctgtctatcagtcaatcaacccataataaataaacgaagttggctgggcgtgatgactcatgcctgtaatcccagcactttgggaggccaacgcgggcatgtcacaaggtcaagagatcaagaacatcttggccaacatggtgaaaccccatctctacgaaaaacacaaaaattaactgggcatggtggcacgtgcctgtagtccaagctactcaggaggctgaggcaggagaattgcttgaacctgggaggcagagcctgcagtgagccgtgatcgttccactgcactccagcctggtgacagagcgagactccgtctcttaattaattaattaattaaagttgagatatatattgacatatacagagagagtgattttgtgtgacatatacacacaaaaattccctaagttgtagtttcttctgattttgcccagagccttttaacctggctttcttaagctgctttttttgagatggagtctcatcctgtcgcccaggctggagtgcggtggcgtgatctcagctcactgcaacctctgcttcctggattcaagcaattcccctgcctcagcctccctagtagctgggaccacagacatgtgccaccacgcacagctaatttttgtatttttagtagagatgggggtttcactattttggccaggctggtctcgaactcctgaactcaggtgatctgccccccttggcctcccaaagtgctgtgattacaggtgtgagccaccacacccggcctccgaagctgctgttacgatctaaatcacatcataactcttttttcttttcttcacaattctatcctcagtcccataagctaatggtggccacacaggttagcacatttttaaagtattttagtcataattcccctcctggggaatttggcattaagtttctattaaaactacagttttaaagtttagtgggcacgtcctaatacagcctgaattgttgagatggtttcttggtgctagaaaataataatagcaggccagccgtggtggttcacgcctgtattcccagcactttgggaagccaaggcaggcagatgaccgaaggtcaggagttcgagaccagcctgaccaacatggtgaaaccccgtctctactaaaaatacaaaaaaagtagctgggtgtagtggtgcgcgcctgtaatcccagctactcaggaggctgaggcaggagaatcacttaaacccaggaggcggaggttgcagtgagctgagatcatgccattgcactccagcctgggcaacaagagcgagactctgtctcaaaaaaaaaacagaaaaaaataataataatagccacctttagtaaccatgtacatgctagatcctgttccaagtatttcatatacataatctgttatttcatatgacaattgtaggaagtaggtggtattagttttgtttacagggggaaaaagtgaagcttaaagaaggcaactaacttgttcaggtctatatagcttgtacatggcagacacttggcctgtacctgggcttgtctgacactatgcagtactaccttttttttgagacaggagtctcgttctgtcgggctggagtgcagtggtgcgatctgggctcactgcaacctccgccttctgggctcaagcaattctcgtgagtagccgggattataggcatgcaccaccatgcccagctaaatttttttgtatttttagtagaggtggggtttcaccatgttgcccaggctgctgtcaaactcctggcctcaaagtgatctgcccacctcggcctcccaaagtgctaggattacaggtatgagccaccatgcttggccactatgcagtactaccttttaaataattatgtatcttaccacctccataaataaagccctgggtccttcatattatatttaagaatataccctccaaaatgtcttgattctgtctttgtcacacccctaacccccattctcactgctgctctcctagttcatgtctattctgatatcagcccactcttccatccttactatgtaggcctacgagattgctcactatcaaaaaatgctatcaccacagaaagatgaggttacaaattctgcttctaccttccattgaaacttaattctttcaaatggaaatcaagcctcagtgcttgtccatattcatttagttattacaatagctagtatgccaccttggtcttgagggcacttgatggactttcgaatctgaaagaaaaagctctctgcaatacagcaggctatggactataatgctgaaaatacaactggcaaagaacagtggccatctgatcatgagctcttaataaagttttgagaggattccaatgggttttttatatctagttgcagacttttcttgtggccctactgtggttgtgcactgcttaatgatggggatatgtatgaaaatgtgtcattaggcaattttgttgtattgcaaacattatagagtgtacttccgcaaatctaaatggtacagcctcctatacacctaggctatatggtatacctattactcctaggcaacaaacctgtacaccatgtcagcatactgaatactgtacgcaatcataacatgatggtgtttgtgtatctaaacatttctaaacatagaaaaggtatagtaagaatacaatactataatcttagggaccgtagttgtatatgcagttattgactaaaatatcatcacatggtgcatgactgtactttgatttggccctaatggagaccagttggtgtatataactttttgccttcttatgaagcaaagggattattaataaagagatagattcatgtatagacagttttctgaaagcctttattaaatactggaaactgtggggagggatagttggggtaattatcagaagagttgatgtgaaagaaatgaggcatattgaaacagaaaacttcaagaaggcattactagggcttcagatcctagtgtcagccatgaagaaggctaaaaccttaaagcttttaagattttaaattattaattttaaagtcagcatgtagaaaagtcagagaataataatattacctgtgtacctgtcactcagaatgatagcatttctttgcattaaaaattcaattgtttaagaaaagtttgacctattcttggggttatagaatatcttgcttgcccaaataatattgtgaaaaatgttttttaaaattcgagggccaggcacagtggctcaagtctgtaatcccagcactttgggaggccaaggcaggtggatcacctgaggtcaaggagttcaagaccagcctggccaacatggcaaaaccccgcctccactaaaaatacaaaaaattagccaggcatggtggcacacgcctgtagtcccagctactcaggaggctgaggcagaattgcctgaacctgcggggcagaggttgcagtgagtggagtacactgcactccagcctgggcaacagagtgagactgcgtctcaaaaaaaaaaaaagaggtgtatgcttaaacgccaatatgatgggttttaagtaagaacatgtgaagaatgaatctctatttttaaatttatgtacgcaattttattttaacttacagtagaactggattatagactcaaagtttaagagccagactgagcttcagataatcccatccactcactcatgttacacatgaactcccatgccagcagatacttcccccaggttgtatggctaattagtgatttagactgggcctaaatctctttagcatcgtgttgcctcacttttgctttcaggctacattaaaacatttatgtcaactataagaaaactttttgatgaatggtttgtttccagagcatcaaagttcagtatgtattccttaaatggaaaatagaaataaactacagtgtttgatacatagaaaaattccatgggaaagagttattagtactcttgagcctcgtatttatagtgctccatatgaacttaaaccactcccaggtaaaataaaaaggttaggtagtaaaccagaaaatgtctttatagaaactatttcatgctctaagaaaagccaagttcttcaaagaaaggatacaagtcctaattttaaatcagatgcataaattttatggaggtgactgtcttcctgattttcattttcttattacaacccctcttcccagaaaacacctacacaaaacccctggtggaagtttgtcccattctaggttaaacaaacaaacaaaccatttttagtgaccctcaaaattctatgtcttttctcagaaagaccaaaaatctgcaatctctggtctatgaaaccccattaaaaatggtgcccatgtaggggacatataaataacctccaaagttacagggtagtagagtttttctgcctatttctgagagaaaggaaagtggatgctgacaacagccagaattttagtctggtttctgccctggctcttgtctttgctgattctaaaacaatgccacaaatcagaaggaagcaaaatatactctgtgccctacaggatgttagctctttggtagaaattgttcaagtggattttaaaaattagagtaatgcactgagagtcttgttaccattctgataatttccttactgttcttccttccctgaagttgggtgttatgggaaaacattgtagcaatagctctgaaagattgaaaatgaaaaaaaaaaatcaatggcaaatgtcttttattccatattgtagaagatctttgagggcttccttttgctcttttctgtcttcaattattaagtttcatgaaacattaacctactgttagtcttcattccttttgggagttcagttttactttggttcttaaatttttgcataccaatcttagaaaatggattagattgccaaatttgagtgcctatggacaaagcatcaatatagtgatagtagcatccttcttggtgagagaaggggactccaaatatgtttacaccacaagacattttaccactgtactcacaaaaagcaatacccacctcctcgttcatttagattaacagttcagtttatcaaatatttttgagctgctgttatatagatactgaaaacttatgtgataatctattttaaagtgaaagtttctggacataatattattgtaaaagcaaagaagagtatatttaaatatagtgaagcattaagctaattataataagtaactatgtagattacaatcctttttagttaaaactcatcacaacttatgcccttactatgtgccaggtactctttctgaatacctttatatgtattattttaatcttaacattagcccttctagctaagtattgtaactatcaccattttatagatgaggaatttgaagcccagagaagttaattaatttactgaagatcacactccaggtaaatagtagagctgggatagaatcagtgtcaaattatgattttttaatgatattctattacataaactccttcagaaagacatttaagcttgcttcagtgtggcactttgagtctcagtgcatatgtaaacctcttttggttatagaaatgcatttatccatctatgcaaagcagtcctggtcttctacatttagtcatagtcattgacttggagcttcattgtcattgaaaagaggaagaggaccagaatttcattttagaaaaactgttcagcttatataataactgcattttgaaatctgaactttactaacttgtgtgaatctgagcaagttattttgatcacctgtgctgaaaaaacagatgctgcatctaaactaagcttttcctggataaattaagaaaacaattaccaaagtattccagagagaaatgtcttcagtcccttgatgttcccagggttattaaagttttacctgaagataaccaagacttccagaaattacaagtcatttacttcattcactgcagctaagagaagcttgtgctgctgcctcatagaattatttcttgctgcatttaacatgcattaacaagcatttgaaaagagttgaatttcttctagaaagttgagttggcttcttgagatcctatccaaaaaactttgtattttcctaatcccagttttagataaagccttctcaaaggcttttttcaggagcaagttttaccaagttgttgaggcctttttatagaacacagaaattgaaggattagagcacaaagaagagcagggtagttttttccttctttatttaaacccgactgtatttttcccatacactttttaactgttttacatgtgcctctgtgttttgctctgacatctgatgcattccctgctaatgttagaactgaattttctgatgctaactgaagggagaagggtgttgggggtaagttgggcagaagactctcagtttcaactttcagcatcacagaaattttattctggtaatcttaacataatttgacatctaggtgaacaacctccacctgaggaagttacacagaaagaacaaccagattccagacaattaaactttattactccgcctgaaacattaagtagtggttttaaaaaatagttttttatctcctctccctcttgatgtttattgtgtgggagaggatgtttgtccaacaagcatattgctcctcttagagcaggtgagcttggtaatgctgggtcccttttgcatttggttatattcattctcccccttcccacctatttctcacttcatctctcctgtagccatctccctccatctcttccccagctcatcatctctccccatccctatctttcccctagacctgcttatccctcttccttcatccttatcccatctctcaccaaccccactgcctagtatccactgtcctttccccaatcctcggtcacttttgtcattcctcttcctcttctaccctcttctctagccctagcccttcctctccttgcgttcctccttctgctttcccattttcccccttccatttcccttttctttctctcctcactttctctccctttgactctctttcttttctcctctttcctcccctcctttcagctcccctcatcacaataacctataattctctgtcctccaggatcagatcttgacttctctaacagcaaagattaattttgcttgctctgatcaatttgatattatgaacaaagaattctctagatggcacagatacactccccctcccccatattcttcaaatatttgactaataaattttaaaaaaattttgttttctttttgagatgaagtcttactctgtcacccaggctggagtgcagtggtacaatctcagctcactgcaacttctgcctcccgtgttcaagcaatcctcctgcctcagcctcccaagtagctgggattacaggcgtgcaccactgcacctgagtatatatttatatatatatatgtgtatatatatgtatatatatatgtatatgtatatatatatatatatatattttttagtagacacgaggtttcaccatgttggccaggctggtctaagactcttgaccttaagtgatccgcctgcctcagcctcccaaagtgctgggattacaggcatgagccaccatgcctggccgttgactaatacatttttaaataaacagaaagatggccgggcgcggtggcttacgcctgtaatcccagcactctgggaggccgaggcgggcggatcatgaggtcaggagatcaagaccatcctggttaacacggtgaaaccccgtctctactaaaaattcaaaaaaattagccgggcgtggtggcaggcgcctgtagtcccagctgctcaggaagctgaggcaggagaatggcgtgaacctaggaggtggagcttgcagtgagcagagattgtgccactgcactccaacctgggcgacagagcgagactccgtctcaaaaaaataaaaaaaaaaaaataataataaaaaaacaaatatacccaccaaaatgtgaacattatgtctttgttgatagttgaaattatgggcaatttccatgttttttgtgtatctgaatttttcatatttactaaaatgtgtctactgtaaatgctatttttagaaaatgaattaaacattctttgcttgaccccccccatagatctttatttaatcaaagtgaaaacaaaatgactcagatttgatcctttttgaagatgaatttggtttgctattttgatgttcagttttccaatttttttttttttttgagacggagtctcgctgtgtcgcccaggctggagtgcagtggcacaatctcagctcactgcaacctccgcctccaggattcaagcaattctcctgcctcagcctcccattagctgggactaccggtgccggccaccatgcactgctaatttttctatttttagtagagacggggtttcaccatgttggtcaggctgatctcgaactcccaacctcaggtgatccgccgcctcagcctcccaaagtgctggggttacaggcgtgagccacctgtagttttcgcgcctggctagttttccaaatttttttacctttcaaaatgggtggccctttgaactgaagcatgaagccatcagctcattggcactattgtagcacatggtgaatgttaaatacagttgctcaagttaggcttcaactctaagtcctataagacctttcctgcctttctctgtcctcccaaaatttagctcatgtttttttgtaatatttcaatattagagtgttcagtctgatagacttggcaatttttatacagatttgttttcagccctgttatcagtcttgggggtggggaggacaggcattgatgagcagcagttctattatataccttgtttattgtccttggtagtgttggttataaaaagtgtaacagtcatgctgtaccaagccaagatgccaactctgccatagttaaatgttaaaattccaagctcagattcaaaattgactgaaaggaaatctttcagcagactatttcaatctcagttgactaaccctaggtatgcaaggtggatggcaaggctagatgaagtgctctaaacaactgaagtttacttatttcctagctatagtgtactcattgtttcacaaagggttaaattatgtagttagtgaatgcttttctagctgcaggggtttttgaaaagagatctaggaattctgcagttaattgaattcttcaggcatggactcagggtctctgaaaaaatttgagtgagcaaaattctcttgctttgctcctagatatagttcataccatgtcttaggaatccagaattattttttgaaggattttatgcctatatatgctgactgaacatttaataagataaccacgacattttaaaagattttatacaatgtacttgtttccttgcattgcccttctccctgttttttcttctcttacttccccaagtctgtatcactggggcttttttcccattttttcccatcttgtgagcaaagttttaacagtacgtagaaagttaactgcctggagtcttttaaatataagtaacacgcaaccagtaataagctgtcggttgattttttgctgcctgcaaagaaacataaacacagcgctcatttctggcaggtttttactgtcagagtttctcctattatatttatcttacaatttgccagggggtgaagttattaagttttagcagcagccatcgatcaagttcacaagttaacacgataaaggctctgtgccgctccgatccggggaaatgatgatcctcactcggtaattaactaaatgagaaagttaaatcttacttgagagctgggagagatgaaagagaggtgtttgtcagcttctcagtggaaattagaagcagttttctgcaattccctaagctgctgctctgtcatattttacataagcactgggaaaatgtcttgtaattagtgctgtcatggaagatttttttttgctgaaggatgttggaataattcattagattatcaagaaaggctgtgtcctgaaatgattagcacagtgaaatttaaaccattaacgataacaagtttagagcttgctgcagtgcagaggcaccccgggtatgtctgtgcctatttcaatcatttcttataattaaacattatgtcctttttttttccctcaccactaggacccatccaaaaatccttttaaggtggcactatctacatcagtgggtttaccagccttggaggtgtgtgtagttagtagctataataatgcaacagtaaattaaactgctgtgaatttcttggtttagaacaaaagaacctatcaccctggaagctataaagttgcatgagggggccaataaagaagcttgagtttcagttttgaaacctaaaaatgttaaatgactatcctgtccctttaactatgtcagaaatcagaaaataatgaaaaactgctttgttctgaatttgatgaattttatatatgacttttcctatagttagtaaataggaaaaaaagattggcaagtgtccagtcattaaataatcatatatactgggcaatgtcagttcatttcctactgggctttatttaaaggaattggaatgactgcaagctttttcttgttggttattagaaatcattcagattcataatgtgaactttccctctactgacaaatctgccccttcctgtcttccatgttcactaatcagatttgacatgtttatgagttcacctaatatgtaatcatatttagtagaggctgttaaaatattaatataataatcccactgagaaatatgatgtttacttctgttgaaatgtgtgccccattctatatgtaccattttcttttcatttgcactcccacttcccaccctactccaaaaaaaggaatggactactcctttgatcactgagagttataaagtttaagaactaaaagtaggctgggcgtggtggctcacgcctgtaatcccagcactttgggaggccgaggcgggcagatcacgaggtcaggagatcaagaccaccctggctaacacggtgataccccgtctctactaaaaatacaaaaaaatagccaggtgtggtggcaggcgcctgtagtcccagctactggggaggctgaggcaggagaatggcgtgaacccaggaggcggagcttgcagtgagccaagattgtgccactgcactccagtctgggcaacaatgcaagactccatcttaaaaaaaaaaaaaaaaaaaaaaactaaaagtagaatgttaaaagttattatcccacttttgaacattaatttccttttttctgcatgttcaatttgtagctaaattctttcagtttatcttgaaatctccttgtaaaaggatgctcaggtgccaatgggcgctagcccttcggggttccttttcttttccattctagctctttagaaatctaggtctccctgctatcaccatcttcatcactaggtgtgcttacttatctctttccattctaatcaaagtgtaaacaatcctatttcctctcaattcaagcatgacagtggcaatgtggatttttttttttttttttttttttttttttgagacagagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccagcctttttttttttttttttgagacaaggtctctctctgttgtttaggctgaagtgcagtggcatgaccacggctcactgcaggctcaacctcccaggctcaagtaatcctcccacctcagcctcccaagtaactgagactacaggcatgcaccaccacacacagctaattttttttttttttttttttttggtagagatggagtctcactatgctgccaaagctggtctcagactcctgggttcaagcagtccttctgccctggcgtcccaaaattctgggattacaggcatgagccaccatgcctgactggctttttttttaaagatgcttttggccgggtgcgatggctcatgcctgtaatccaagcactttgggaggccaagacaggtggatcacgagatcaggagtttgagaccaacctggccagcatggtaaaaccctgtctctactaaaaacacaaaaattagctgcgcgtggtgttacatgtctgtaatcccagctacctgggaggcggaggttgcagtgagccgagattgcaccattgcactccagcctaggtgacaggcaagactctgtctcaaaaaaagaaaaaaagaaaagaaaaagaaagatgcttttacaaagaaatcaaaggaaaataatcggaaaaagatcttttaaagtcattatttttggccgggtgcagtggctcacgcctgtaatcccagcactttaggaggcagaggtgggtggatcacgaggtcaggagatcgagaccatcctggctaacatggtgaaaccccgtctctactaaaaatacaaaaaaatttagccgagcgtggtggtgggtgcctgtagtcccagctactccggaggctgaggcaggagaatggcgtgaacccaggagttggagcttgcagtgagccgagatcgcgccactgcactccaacctgagcgacagattgagactccatcttaaaaaaaaacaaaaaaaaaagtcgttgttagatgtttatttaattaaaacctgacaacagcctctagagagtataatatagacttttaaaaaatctcttcctttccccctcaaaatccttgtaagttttgccttgtttctcctggccgcaggagcaagaacactgttgtatccccatccagattaatgtaccagactaaatatctaaaggatcagccttaatgaggtagtaaagtattatactaaaataaatgtatattatgacccagacttacaattctcaacaggggatttctcctcctttggtttctcctccttcatcctctgtcatgagagttaaaatacctttcttttaaacatttcctaatctgcctaatctaatcctagccatagtcacattttgcctggattattttatcagccttctaattgatctttcttcctctgcttttgcaacttgctcttattatcccctccccacctttccagcccctgctccattctctgtgtggcagctagtataaatatttgtaaggcacaaatcagacaatgccatatgtgactatttcaaaacctccaggggctctcctttacacttcagatgaaatctaaactctgtaggatggcctagaaggccttatgtgatcttagccccagccaccttaattcccaccatttttccttaattcccaccattttcttattcattctgcccagccacattggccttctgtctttcacttgaacataccattgcactagctcttccttctatctagaaggatcttccccaagatcttcacaagactgacatgtcattcaaatctcagctcaggtgtcacttcctttagaggcatttcttgaccactccagttaaagtaggctgcactctttacttcttttctttttcttttctttttaaacatgatctcactctgttgcccaggcgttcaagcagttctcgtgcctcagactcccaagtagctggaaccacatgtgcgcaccaccatgcccagctaatttttgtattttgggttttttgttttgttttgttttgttttgttttgcgacagagtctcactctgttgcccagactggagtgcagtgggcaatctcaggtcactgtaacctctgcctcccgggttcaagcgagggttcacacaccatcaagcccagctaatttttgtatttttaatagagacaggatttcgctatgtatgcctggccaggctggccttgaactcctgacctcaagtgatccacccaccttggccttccaaagtgctgggattacaggcgtgagccaccgtgctggctgtattaatagagacgaagtttcactatgttgaccaggctggtctcgaactcctaacctcaagtgatctgtccgcctcagcctcccaaagtgctgggattacaggcatgagctgctaccatgcctgcctttactccttattttatctttctttgttttcttcacaatccttactggtttgtgaaattaacatatttatatatgttctttctccactcctcttcagagaaggcaaagacactttgtatgcctgttcacagcagtttccctattacctggtaaagtgcccagcatagagtagtcactcaataaactgttgttggttgattgataccactaaagttccaggtttagtcaaaattgttgtcctgcccctcctaggctacagccttatcccctgcaaaacccttgcctattttattcttaaattaattcagcatttaatcattatatcccctttccccccatagttctcaatgccagagcctttccttaaagcctttctcaaagccaaatggaatccttagatatcttttatcatttgcatctttcttgtcataaatactttgttcatctagtccttgcaaccccagtactaaagagtgtcctatgtctggaatgtctttctctacttactatacccttccttttggttaaagcagatttggatgcaaactagaaatacttgtcatttcaccataaagttcagtcagtccactatgtatttcccaacctatacataatacagttagtaaagtcagcatacttagtattacaatgatagttgatgatcaagccagttggtgtctgcaagtgtctatttttccctcctggcccaggctgcagcttcagagaaattcatggtaattttgaaagtggtacgtgaaatatgttttcggagaggaaactagtccctagcctttgagaactaagctgaaggacagttccagaaatacttaactcctttcattttgtgtgcttgtcacctgacagcttctttctttcttgtggagacaactgttcactataaacaaaaaagaagagggagatgtgcaggggtggcagaaatttagtgttaccattaagctgaggctgtttgtcagctttccaagacacttgaacagtagtggttgagtcatcaggcttttgttgggaaagccaaatcaattctactgcaaccagtaaccattatatctctcatacactctaatatacaaccttttgattttttaataattgaactttttcattgtgtccttgtagattttcagaagttctcaaattggaattttgctgaatttactttagataattgtagaaaaatctgtattggagaatggtagaagaaaggggcatgacaacaaagacctttagatttctctacaaacataataccttagttacaaataaaattcatattacagtggatttatcagtaggaatactgtactcttagaagtttttttaaaataactttattaaaatataatttacatacaataaaatacacccattttaagtatatagttcaatgaatgttggcaactggcgtaacaatcaagttagagaacattttcattgtcccaaaaacatcccttgtacccttccccagtcagtcccatctctacatccagcctcaggcaaccactgatctgtttttctaacaattagaattactgttcctagagtttcatacgagtagaatcataatggactcatttgtacctggcttctttgattcagcatgtttttgaggttcatctttaccattttgtgtgtctgtggtttattctttttgttgctgagtactattccattctacagcagcatcacagtttgtttaccagttaatcttttgatggacatttggattattaccattttggatttttattaatatggaagcaaaaaacattaaagtaccagtctttgtgttgaactgtgtttcgttttaaggaggtaagtacctaaagtggaattgctgggttgtttggtaagtatatgtttaactttacaaaaaactgtcaacttgttttccaaagtagttgtaccattaaacgtgactgccaacaatgtgtgagagacccagttgttcctcattcttgtccacacttagtattgtcagtcttttaaattttagccattctaataagtgtgtcataatgtcttgatattttaatttgcatttccctaatgactaataatgttgaacatcttttcatatgcttattggcatctgtggatctttttttgtgaagtatctgttcaaatcttttgcctatttaataaaacaggattttttaaaaattattattgagttctaagagttctttatagatgctggatacaagtcctttgtgaaatacatttattgcaaatgttaataaaaatgacaaatcatttttggaaatcatgttttgaacatgccaatttactgacttttttttccttttataatgtttgcctattccaagaacgtcaaggttttctcctgtgttttcttttagaagttttatagttttagctcctatatataaatctagaattaagttaatttttgtatatgatgtgaagttaggaacagacttcatttcctctatggatatccaattgttgaaagacaatcctttccctatttaattttttttttttttgagaaagctctgtcacccaatctagagtgcagtagcacaatctaggctcactataacctccacctcccaggttcaagtgattcttgtgtctcagctgccctagtagctaggattataggcgtgtgccatgatgtccagctaatttttgtatttttagtagagatggggtttcaccatgttggccaggctggtctcgatttcctgacctcaggtgatctgcctgcctcagcctcccaaagtgctgggattacaggcatgagccaccgtgcctggcctccccattgaattatcttggcatctttcttgaaagtcagttggctgtatgtatttctggactcactattcctttccattgatctacacttgtgtccttacaccaaagccacactatcttgattactattacatatcttgaaatttactagtctgagtcttccatcttttttcaaagggttttgtggttttttagggttttgtttgttttgttttgttttgtttgagacagttttactctgtaatccaggctggagtgcagtggcacgatctcggctcactgcagcctccacctcccgggttcaagcaatgctcctgcctcagccttcagggtagctgggattacaggcatgcaccaccacacccggcaaatttttgtatttttagtagagacagggttttaccctgtcagccaggctggtctcaaactcctgacttcaagtgatccactcacctcagactcccaaagtgctgggattacaggtgtgagccaccacacctaaccgttttttttattttcaggaatattttggttaagtttaggtcctttgcttttctttacaaattttagaatcagcgagttaatttgcctgctgagactttgatattgcactaactctataggttgatttggaaagaataaacatcttaatagatccaatttctgaatacagtgtatctctccatttatttaagtctttttaaaatttccctcagcaatgttttatagttttcaatttataagtattacacaaattttatccattttttttttttttgagatggagtctagctctgtatcccaggctagagtgcagtggcgtgatctcagctcactgcaatctccacctcccgggttcaagtgattctcctgcctcagcctccagagtagctagggctacaggcatgtaccaccacgcccggctaattttttgtacttttagtagagacgaggtttcaccttgttagccaggatggtcttgatctcctgacctcgtgatccgcccatctctgcctcccaaagtgcttggattataggcgtgagccactgctcccaggctaaactttatcaaatttatttctgagaattttatgtttttatggtactacaaattgtataggtggatggttttcaaaaaatgtattcttttttaataggtgtaggagtcactctcagggtgactagtgacctgaaaagggacacaaagggggctagtgagtctcgtgatgatctgtttcttgatctgggtgttggttatgtgagtatgttcaccttgtgaaaattagttgagtacatttaagattaagcatttctatttatgttatactttaatgaaaattaaaatagaaaaaatatatagtgaaaaagaagaatgtactttcaaaaagagagggaaggctcagctccaacagtgttataagctcattaagagtgttgattgacggaacacttgactgtatgctaggtggtgtgctaagcatgcttttcatgagggttttttaatttgttccttacaaaaacccaatgaaatagaacctattatattattttcccagttttatagatgagagaattagactcagaaggatcaagttatttattccatgtcacacagctgctaaattgaagagctagaatttgaaaccaggtctttttactccagggccaaagcttttaaaacaatacagtatggggtagtggttgagagtaacccatttgttaatggatctcaggtatgtgtctttctgcctcatcaaaaaaatactcgttttgaggggtggtgactaaaatgtataccagctagaatagcccagaacagttgataaatacgtgaaatctcagtttatactttatgtctaataaccaaatgtgtaattcccacttatgacttgatcattgaaagtatcacaaagtcttatctttagcttctgcagtaggatacccagactttttaaatccttaggcagttttacctaacagtctgatagccactgatcaaagcatgactccttatgattatagcaatatctcgtttatttaatgtataagtggaataatttcattaagctgctgattgttcttctctgttactggcattctggtctttatccagaaaacagtactccagtagcacccaactcatgtccatttccaccttttaaaagacaaagggtgcattttaaaaggcaaatatataaaaaatgatagagtttgggaggttttcattattgggattagaagtggcatttagtcaagcttataagcctgcctgtgtgttagttctctaaatcttcacatttcatgagttttcatttctgagatacaaactaataacttacacaaaaagcagccctaaactcccccaaggcctgtgtccaacaaggttcttagtaatcatttttagtctgtatcataggcaacagtggcatttatgctagaaaacatccacctcaacacaccaggattacaggtgtcagctccttctgtgtatataaaatggcctaatgccattcttgaaaatatgctttcagctgtgtatctttactttgtaaagagccctgtgtataggatttaacatctagaaaataagcaagcctcaagagttcagggctgcagtgagctatgatcacaccactgcactctagcctgagtgacagaacaagaccctgtttctaaaaataaaagtaaataaataaaagaaaataaggcaagcctgagccttgaaatgaattatctaaatgtggtacagttttatagcatgttccacattgagtatgtctgagcagggatgaactctatggtaacatgggtctttctgccacatttgggttgccttaagtaaatatgccaaagatccatcaaattactttgaaaagtacccagttgtacccatttgtgattatcctttaaagaaatactttcttcagagtagcaaaagtttctattgatttctgaatcttttcccagtgtcccccagcttcaaacttgggtgtgattttgtctccttttttctcatactcatatccagtcgatcagcaaattcagtaggatctgtcttcagaatatacactgaatcccaattatttctcaccacctccatagctaccactgtggtccaagagattgttctgtcttccatggactgttgaagtagtgtctttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgaagtagtgtcttaattggcctccttctatttatgtcccatatagttttaaaggaccacatagcagtggtccttttaaacggtgtcagattgtgtcgctattatgcttctgggtgtttgcccatgtggcccctctgtatggcttctcatcctccatacctgtctctttctcagattagcctgagtttcttacatggtagctcagcgctctaaggagtaagcagaagttgcctgggcttagaagtcccagaatggaatgcaactttctccccattctcttagtcaaagcccagattcacagaataggacataatctccgccttttgatgggaggagtagcattcatgtagagggagggctggagttgctggggccaatctgtggagattagttaccaccaccggaatgaccaggatgatttgaccctggctacttctccagccttaacttttccttgctcactctgttccagccacaccaggccctcttgttccttgaacatcccaggccgactgccacccaggacctagggtctcaaaatttccattgcctagaccattcttcctcgctgtctagtcctcatttccttcatgtctgagttaaaatgtcacctttttcaggaaatgatctctaaccacttaaataatcctattagttttttgttaattgctgcctaatcaccacaaacttagcaagttaaaacaatacgtatttattaattctgtgtgtagttctgagggtcagaagtgtggcacatagtggctgggttctctgctgagagcatctcaaggcttaaatcaatcaaggtgttgggctggactgagttctcatctggaagctcagagggaaaatcctcttctcagctttttttttttttttttttttgagatggagtttcgctctcgttgcccaggctggagtgcaatggcgtgatctctcctcactgcaatctccacctcctgggttcaagtgattctcctgcctcagcctcccaagtagctgggattacaggcacccgccaccacacctggctaattttttgtatttttagtagagatagggtttcacgatgttggccaggctgttgtcaaactcctgaccttaggtgatccacccacctcatcctcccaaagtgctgggattacagacatgagccaccacacccggccctcagctcattcttgtagtaggcagaattcagttccttgctgttgtaggactgaggcccccattttcttactggctgtcagctgggggctcctttcagcagctagagactgaccacattccttgccagctgtcccccttcctcttctgtaacccgttgaagcaaactctgtgcttgtaaagcctcatacgattaggtcagatccacctgagtaatctccttatcttaaggtcagctgatttggatccctcttttaatgacagcaatacctacattactgtttgaataactcagagaaggtatgtgtacaccaggggccaagagtcttggggaccagccaggtgcagtggctcacgcctgtgatcccagcactttgggaggccaaggcgggcagctcacctgaggttgggagttcgagaacagcctgaccaacatggagaaaccccgtctttactaaaaatacagaattagctgggcatggggttgtgcacctgtaatcccagctactcaggaggctgaagcaggagaatcacttgaacccgggaggcagaggttgcagtgagccgagatcacgctattgcactccagtgtgggcaacaagactgaaactctgtctcaaaacaaacaaacaaaaaagaatcttggggaccatcttagaattttgcctaccacaataacatacttttttcctgtccccttatcctgctttttcttcatagcactacctacattatattttctaagtatttgcttgtattttgtttgtttgtttgtttgtttggggggacagagtctcgccctgttgcccaggctggagggaagtggtgcaatctcagctcactgcaacctctgcctcctgggttcaagcgattctcctgcctcagcctcctgagtagctgggattacaggtgtgttctcctcacctttgcctcccaaaatgctgggattacaggtataagctactgcacctggctgcttctgtttttaatgtgcctttcacactaagagtatatgttagtgatgttagagactgtcatttttgttcactgttatattcctagtaccaaggacagtgtttggcacattatagaggttcagtaaatacttattgaatgaatcaattaataaaaaagacttcatgggaaatacggaatattttatgttatggaaaaaggtaaattgagcatatgagtgttattttagctttatgtccaaaaaggtaccacagagtctcagaatattcattggtttcttttcatgaggaacttcttatttgacaattaaaaaccaagttgttggccgggcacggtggctcatgcctgtaatcccagtactttgggaggctgaagtgggcagatcatttgatgtcaggagttcaagaccagcctgtccaacatgatgaaaccctgtctctactaaaaatataaaacttagccaggcgtggtggtgggcacctgtagtcccaatacttgggaggctgaggcaggagaatcgcttgattctccgcctgggaggtggaagttgcagtgagccaagatcatgccagtgcactccagcctgggcgacagagcaagactgtctccaaaaacaaaaaaaaagttgtgatgacggagcacaatagctcacacctgttaatcccagcactttggaaagccaaggcaggaaaattgcttgaagccaggagtttgagaccagcctgggcaacaaaagaagactccatctctacaaaaaaaaatgttaaaaattagcaggacatgatagtgtgtacctatatagtcccagctactctggaggctaaggtgggaggatcgcttgagcccaggagctggaggctgcagtgagctatgatctcaccactgcactccagcctgggtgacagagtgagaccttgtctcaaaaaaaagttgtgagcaagtaattgtataaatgtccaacaactgttgtatacaagaaaaagcaaattagatttttggcttgctagtaataacatgctttcagcttttggtttttatttgtgtatcttcaaatattaagaatgtcttctgcaaacttttggaaatggatgcttagtcttctagtattatagctgatttaccaactttctatggtatttctgtggttttccacgtaattgctaatagaataacagagtgggctcaatcatgtagacataatatagcatgccataccagaaaatcatatatatttccctcattttcaatactaatcattttatgtttcttttaacccccttctacagacaaaacttgccaatggcacttccagtatgattgtgcccaagcaacggaaactctcagcaagctatgaaaaggaaaaggaactgtgtgtcaaatactttgagcagtggtcagagtcagatcaagtggaatttgtggaacatcttatatcccaaatgtgtcattaccaacatgggcacataaactcgtatcttaaacctatgttgcagagagatttcataactgctctgccaggtatgtctacaagtgtttgtaaaccattaatttgctatgatgataagagaactagatctccagctatatatctctctttaaaagtctttattggcttgatttttacaaattaagttccttaactgtacctttttgatataaagcttttttttttttttttttttttttttttttttttttgagatggagtcttgccctgtcgcccaggctggaatgcagtggtgtgatctcagctcactgcaacactgcaagctccacctcccggcttaacgccattctcctgcctcagccttctgagtagctgggactacaggcgcccgccaccacactgggctaattttttgtatttttagtagagatggggtttcaccatgttagccaggatggtctggatctcctgacctcgtggtccacctgcctcggcctcccaaagtgctgggattacaggcgtgagccaccacgcccagctggtataaagctttaaaaaaaaaaaaaacaaaaaaaaacaaaaaaaaaaaaactctagaaataaagactccttttttttttttttttttttttttttttgagacaaagtctcactcttgtcacccaggctggagtgcagtggcgcgatctcggctcattgcaacctctgcctcccagattcaagcaattctcctgcctcagcctcccgagtagctgggactacaggcacctaccaccatgcctggctaatttttgtatttttagtagaggcggggtttcaccatattggccaggctggtctcaaactcttgacctcaaatgattcacccgccttggcctcccaaagtgttgggattacaggtgtgagccaccgtacccagccaagactccttttacctatcttcttactcatgcccttctattcaacctatttttacccatacataggtccaaataaaatcttttctgaggtgttacctggtgtaagatgtgtcttttataataacacgtcttagttcatgtttatgtacttggatttgtatttctatgagaatatatcaacagaatatttaaattctacagatgggttgggcacggtggctcaggcctgtaattccagcactttgggaggccgaagtggatggatcacgaggtcaagagttcgagaccagcatgaccaacatagtgaaaccctgtctctactaaaaatacaaaaattagctgggtgtagtagcacacacctgttatctcagctacttgggagactggggcaggagaatcgcttgaacccaggaggcagaggttgcagtcagctgagatcacacccctgcattccagactgggcgacagggcgagactccatctcagaaaataaataaataaataaatagataaataaattctacagatgactaagaaacgtttttagttgaagtttttagaaagaaggatatctcataagccttgttgtggtgttaaataaatataaaatgatacataaaatcatttttttggaggatgctgtggtttttctgaatgcttaagggcagacaagaacactgccaaggtgtcagtatttggggggaatgctatttcaggaaaataggagtcttgtgtattcaaagtttattttaagagaaaaaaatcataccagcatgaatgaatcttatattaaatatcattaccttgttaggggaggggttttggttgttgttttccaattatagaagttataggaaacttagaaaatatttaaaaacatttcctagaaccccaccattcagaaagaactactgatttgctaagttattaatattttggcaggtagcctgttttctctacgtatgtgtatttgcctataaagctttgatcataaatgttttgtgaccattttttcttaatacattctcttaatgtatttttctaaatttgtgttctcaaaacatacttttcagttgttgcataatattcttcacaatggttgaagcacatattatttaacccctttattgaacatttaggtagtttcaaaattttttcatattataaaccatatgatgatgaatttttatacattaatcttgtaggaatcctaggggaaaaaatacagacatagaatcactatatattaaggaatgtgaacattttaaggcttttaatacatggtgccaaactatcccctaataaaaatataccagctcatagcctcccaactattaatactactttgttttatatttgccaattatacctttttaaaatttttgtttttctaaactaggaatttaagttgctgtttaaaacaaaagaagtacctatttatatcttaggaataaccactataaaaactgaattttacctatatcttttgttaaacagaatagatttttgccccctctttactcattggattttgttttagccataggcaaatagttttctttgtacaaaacagtctgtgtgtacctcattactttgttctccccagtcactgagacatgttactatctcaagcttataccactaagaattgaacaggagttgattagacctgtgtatcctttacctaatattgatccctggtttgtatccactgaccactctatgaggtattaaatcatcaatctaatgctttatggccatttaaacttataaacctatataccatctggctatgtttagtaaaccaaactacttcaaaaagtgcctgtagtccattaatgtaatgggtttgtttggagtgttaggtgaaattacttccaaagacttatttataggtacatggtgaaatgatcaggaacaatttgatggcacccattaaaaacacaggactgcattttggaaatttctgatggtgtagaaagttttaatataaattgtaccattactgtatttaacatgaagaactaattattatatctttaattggcttttgttcatgttcctttaataagaattgggtaatgcatgtctccatctgcttatgcttacatacgaacatgtgatgccagccaaacaaaatccatttaatgctttctttctcaagtctgctgaaaagtgtgactgatatccatacaatctttataattaaaatgatatgattcaggggaaaggcccaaaatgaaatgccatgttctctttcttgttaagtttgtgcctacgggagtgagagtatgaaggaatccttctgaactatttaagtctgtagaaaacctctgatatgtactttgtaaacagaaataactttgaatgtttttatctcagttgtaaatgtagaacagcaggcaaaagaagtttttttagtgagatcatcctattttataggatcttttcttctgagacctcagtacagatttgggtggtggagaactttaattgggaagcccttctggtttacactccccaagatctgttctccactgttttcctctgcacctcctacaaaatattctctgaaatgctaaccaagttatcttttggtctggaattttttttcatttttgcccaactgtcatttaggttttatagcagcagctactctcaaatatagtttttttaaatctgaaattaaacccattcttgaacttaaacatacatctctgtctttctcttgggatatttccatgccattctgtatttccttcttctctcctttctgcatgcccaaaattctataacccagcacattctgacttagtgcctctcccctagtacatttaaaggacatttcttttaccgaacagctttggaactacagcagtaatagaaacagaatgagaaatggacctaatatagagatttgggggggtctgaatcatagagtttgagatgccatccatagaacatcccctagtgctgaaatccatatagatagatgtgaattgttttctggaatcctttttatttttaatgtcttggggggtttgctggttgttagctttaacttccttatctaaaggaagatggaaaatactgttcatttctgtaaccttatggaaaaattattgacactcattttacccaagcctctgtttgaaaaagaaactggaccacactagggacaatgatgtgccttcatagcagaacaaatgctgttctgttttaaaggaccttttgtaaaaaatcattcgccaccttctgtgttctttttctttgcctcctccccctactgaaagctcggggattggatcatattgctgagaacattctgtcatacctggatgccaaatcactatgtgctgctgaacttgtgtgcaaggaatggtaccgagtgacctctgatggcatgctgtggaagaagcttatcgagagaatggtcaggacagattctctgtggagaggcctggcagaacgaagaggatggtgagcctttaacttttcttactcttatacggcttcaggacctggccattcacagtcactgaaagatttttggggagccaatgagaccacttctcatttaatatggtgattttgttgatttctagcttaaaatgtaacagagaacaaatgttcatatactcagcagtttttcttcttacctgtcactcacaaaatgacatgatattgtattaatactgctttgcaaaaaataatggaaagctgatcagccctcctgtttaaaacattctgttatctgggcagaagttggtatcctgtggctgggcacagtgcgttcacgcctgcaatcccagcactttcggaggccaaggtgggcagatcactcgaggccaggagtttgagaccagcctggccaacgtggcgaaaccccaactctactaaaaatacaaaatttagccgagtatggtggcgtgcacctgtaatcccagctactgtagaggctgaggcaggagaatcgcatgaaccctaggtttctttcagaaaatttcttgcctttatcttatgcctctggtgttttgtcacctttgtaatcaaaaattatttttaagcccaagtggaataagaactctagccatcagaaaaagtgaaaatgaaattaagtataaatcattgtttcttcttaagacttctgtttttcaagattttctgacttaattccgaattccccaaagcatcatatagttagcagtctaagagacttcactaatttttttgttgttctcttaacagtactatttcattagaacttctgaaagatatctttctttaaatacttttctctcagagtatgtctctagaatgtcactataggaaagctacgtagtaatagttcacaaataaaggtgacatattaaatattctcattgacagaaaaaattataataggcatgtgtgtgcttagtgatgtccttccaaattaattttatcagttgtttatcttggatcataaagaggaaaacagttaaaagtagagaacacttttaaaagataaatattcatgggccagctttcctttgaattttcatgaaaaagtagttggctctctttctttttttctatctttgaaatttattaacacataataaatacaatgacctataaatattataccaaatgcctcagatttttatcattctggctattaggaagactgtttaaatttttctctcaaattgaattaaaggaacaaaaaaactaggcaatttttaggctgtgtaacaaagaatattgttggccgggtggggtggctcacgcctgtaatcccaacagttttggaggccaaggcaagaggatcgtttgagcccaggagtttgataccaggctgggcaacatattgagacctcatctctacaaaaaaatcaaaaaattagctgggcctggtggcgcatgcctgtaatcccagccactcaggaggctaaggtgggaggatggcttgagtctgggaagttgaggctgcagtgagctgtggtcatgccactgcactccagcctgggcaacagagcaagaccctgtctctttctctgtctctctctctctctctctctctctctctcacatacacacacacacacacacacacacaaaagaatattattactacttctcaaatatgttttttaattcttatttcgctacatagaaaaatagaaatctttcataacctacttcatactttggaaataaactctttaatagtacaacaaagcaaataaaaatggagttatatggtattcggggtccatcattttgctaagagtgctgggaccagccttggggatacagcaggcagttgcttacatgagaaaattttagggcagctgagaagatttctgtatccctcagaaaaaaagaatctcgtctccaaataactcctgaaatttcagttaaggagattcattcctttagctataaaggttctgttacctgttaaaatacattgtgttcccatttggactgtaaatgacagtaaaccttcatcataaattgggagtttactgagtccttttttgaaggcagaaagatcaagaagtaagtgggcagttcttggcagatggatgtgaaaatgccaaaggtaaaaggctccacagttttgcttgggattggcactaaatggcaagatcttttatgttagttacaaagaaaaaacaatcattgagaagatggcttttgagcctttctaaagggtaggtgaagtaatccaggatccagcactaattaccacttttttcccctatctctttatccacagaaacccattcccgctcttttgagtatccttcagagttctgactatatccccttgtctttgggcatgtttatcctcttaatcccatgataaacccatgaaattccaaatacttatacatcccgtgtcaacttcctccattattccctcgactttcttgttgctgcttctgtttttacatgttgactttattcctgtgtcagttttcttcccttttttaaaaaaaaatttactccatcagtttctcattttcttctttcaagttgtcttaccaagcctaatacgtcaataaagtctttctgtgttatacttttccccatatgctagctttgaaaggttcttccatttctactaaccaaaaatagtaagtaaatacagttttctaataaagcttttatctctaagttttaacttggtatttgatgttgtattttatatctagatggatttgacagtcttcccctgggacatgaactctgtagttttctctcttgaataatactgaatatgctgtctgctcagtaatggtaactcttaaaagtataataaaagaccacttgggaaaagtcaattttcttaatcagcagatcacattttatgataacattctgaatttaatatttaacgtttatcatgtactcacattcttgtaggtactaggcatttcacatagaagtagtccctgttttcaaagatcttccatcataaaaggttttgacttaaaacataaagacagaagccagttttcagtacctagccacctctttctgtaacactttgatttgaagaaattcagatactttaccaagacatggtaaatgcagtgaggtggaaaacaagatcagaagcttatgtgagttctctttccttagaatgtagatagtatcattgcataggaagaaagtcttggagtgctagagattaaaagaagacaggaatctcaggaatggtgggcattgagaaacaataaagtagttaagaatgtgggtgggctcaggagtcagacttaaaatcttcacattcaaaatctattatttgcctgcaaagtgtttgtagaataatattgtacagagaaatgtaccattaatctggaattctttcataacgcatcttgtttccccttttgtttatgctggtgtatcatgtttcattaatccccctttttataagtattattttcacttctctatttcagattttcttttctgtattaacacagaagttagagccatctaccttcctgataggaaattttctcaactaattttcagggtatataacagggagagggcaggggagaaacactcctggagacaccaaacaattaattatattgtaatggagctatagagggaggagtggatgactggcccagagaaaacatgatttctctggtgccaggattacactcagaggcatttctgcctctctccactttgcaaggcacggtgccagtgagaacagcagttagtacacccatagtggggtttactagcttccacaccgtgtttggtgggttcttaacttccggatgaggaattaaattttttacccagcaggaagtgattgccatttactgattttttttttgtagcaaagatctagcttgggatacgagtattccagagatgtgctgtcataaggaaggagatactaacaaatgttgctcactggaatcagggaaggcagttaagtacatgtgtatgtacacagccaggaacacacctgtgaaagtcagtttcatgccttagacttgatagcagtgctcttaggcatttcttttttttcttcttccctagctgctgctggacacacctgtgatccttttgttttctgatgaaatgaactgaattgctcctttcaaagcatagttgcactgattagcagcagcctgggtgactgagcagccaccacaccttaccctgtacaaataaagacctagcaaaagtgatctccatgccagaggcattgctgctgtctacaatgctggggaccactgacacagtaaaagggaaaaaaaaaaaaacctatagggcatgtgctagttcaaaggtaatagttaccattactaacaaaatttccaaaagatgaggccagtgaatctaagcagtagtcttaatagagcaatagatgaattctgattgtacatattccatttgtttactgatattataatattcctaaaggcttggtactccgatgttctacactggaaataatcatgttttacccaaaagcaaatcagtgttggtcagattctttagagcccagaaggttactctttgacatgggactcctgaaatcaggcttacctttgctcctccgcagacagctatggagagtatatggaatggtaaccgtgaaaacactttcaaaatatatgaagttccttataaatatataatgtcggccgggtgtgatggctcacgcctgtaatcccagcactttgggaggccaagcaggcgggtcatttgaggccaggagttcaagaccagcctgaccaacatggtgaaaccccatctctactaaaatacaaaaattagccagcatggtggcagatgactgtaatcacagctactcaggaggctgaggcaggagaatcacttgaacccaggaagcggaggttgcagtgagccaacatcacactgctgcactccagcctgggcaacagagcgagactctgtctcaaaatatatatgtatttaaatatataatgtcatgattttcactgggaaatatttgttattttttaggggacagtatttattcaaaaacaaacctcctgacgggaatgctcctcccaactctttttatagagcactttatcctaaaattatacaagacattgaggtaagaatctatgtattttggggtattgcccaagggcacagaattatcagcattcttcagtcacagtatggttacagcaagcccattaaggtttattgacatgagttgggaatcaatctcttagctggccatggtggctcacacctgtaatcccagcatttttggaggctgaggtcaggagtttgagaccagcctggctaacatggtgagacccctgtctctactaaaaatacaaaaattagccaggcatggtggcacacacctgtaattccagctactcaggaggctgagataggagaatcacttgaacctgggaggcacatgttgcagtgagccaagatcgcaccactgcactccctcctgaacgacagagcgagactccatcaaaaaaaaagaaaaggaaaagaaaatcaatctctttacaggcgagtagggtaggtaaaataaattgctaggcaaaattttaaagctttaaaaaatggtttactaataagtagatgagagagttaaagagattgatcccttcatacatagcagtgtgactggtaaacttgtactcataagctcatatttaaatatcttctgaattgaacctccttagaagttcatcagtagcaatcagtagcaatggccatcacatatgtaagagcactgagtgtataacctcacgtagttcgtagcttttcttctcttgatgagtagtctctttccaccagatttattatttaattgaacaaattataggcagggaagttctaggaaacaacctttaattaccttgcaaaaggaagaatattttataaatatagatagtagccttttaaagacattttttagttttccctaagttgtgtatatcccatagagtaaagcattgagccattgattgtcattaaagcctaaaaagagtttgattctaggtgtttcctaacactgcctctttcccattccttcttctcagacaatagaatctaattggagatgtggaagacatagtttacagagaattcactgccgaagtgaaacaagcaaaggagtttactgtttacagtatgatgatcagaaaatagtaagcggccttcgagacaacacaatcaaggtgaggtctattcagttgtagaaaggtagcagagggagcaagagtgaccacattcatagcgcagtctaaagcataaactctaagcattatttctagaaagtaagtgaagattttagattgtttccagtcccaaagccaaaatcatttccttaaaggacagacatcagcttccccactatacaaacgggtagtcctagggttaaattctcttcttgaaatgcactgaatgggctgttactcttttggccatcacataattatagactaccctgttccttaatgaaaaggataaaagtttgcattagtactgaagctatatgtgtgtgtgtgtgtgtgtgtgtgtgtgtgtgtgtgtgtgcgcgtgtgcgcgcgcgcgcgcttagctatacctatagaaaatgcattccacactactctgggctttgattattttgggggatcagacacgtaataggaccaacaagtctccacagcaccccatcatcacattgatcaaaaggatcttatttgccatcctagatctgggataaaaacacattggaatgcaagcgaattctcacaggccatacaggttcagtcctctgtctccagtatgatgagagagtgatcataacaggatcatcggattccacggtcaggtagaaaatttcaaatgcttttttgaactctgaaatatcagctctgctctgttctttgtcatagatagtaattttgtatatatcggcacagttctgaaactaaagaagaataaaccaccaggtccccatcatttctgtcagtctagaactagaaaacttgatttagaaatgcttgaggtaagtttacattttcgcacattgaagaaactacacattctattttaatttggaggatcatctattacagaaacttttcttatccttatggtaaactttgcattccttacaaaaaccacctcacgggggaatgatatgaatgcaatgaagccttcctttcaggtagtggtaactgtagtgcaggtctgtattatctcctttgaaacatgtacaggtgagctgtgctctctttgccagcccctcccctgccatccctgcagtttttaattgcaagcttcactcaggtaggggccctcaatttccagaggcattagtgatttgatgacacagccattatactgctggagtccaggatagcttgagttctgggtaccagcagcactgctgggaacctctgttaggaattttgccgtaagctaaaggatttagcaaacataatgcatcaaaagtaactttaaaaaaaaaatagacctaggaaaaaagcggttaagtgcattgttagatactctgaagttaaatgtttaccattccaagttatcctctgtgaatagaaaagacggttcctgttttttgtcttttgacttaaaggcatagcaaggcatagcaaacttggcccttgtagttactgacatttaacatttattggtgcttgtggagtgagtgccccacagaatctaaaacactgcaggtgctaacatcatttataagataaagaaaaaatgatattctataaaagggggctaaactggaaaaaaggaaataacatgttataaaaccttaagtaaatacacaaaaatagaataatcaaaatatataatcacacaaaattctcaagctatccaagggccccacactctgctgtgaagcccatatttacaatggggggtctattttaaacccctacccacttcagaacacagaaatgggggcttagaattagagtcatggttatcttggcctttgacctttatgataaaacctgagatccagggtaatcaaactcaaattcacattactaagtatgtgacagaagcatcttggcctatttcatttctggctcctgagggctatcattggaatgggcactaatgctattgttattaatcagattcctcatttaaaatgtatcttactaatggtatcaaattgaatgtgagaagttttacagtcttcaagtctgggccaaattattaggtgacagtggctgccacttcatccttgccctccacaacttgcccatatttcaagcagtatgtcttaaggacacactggcagcatcccatccccttccttctcccactctcccagtctggccctctctctaaatataaggggtggaagggcgcatgatggtcaaatataggtaacagattgtagcttgagtaccatctaaatctcatctatcacttccagagtgtgggatgtaaatacaggtgaaatgctaaacacgttgattcaccattgtgaagcagttctgcacttgcgtttcaataatggcatgatggtgacctgctccaaagatcgttccattgctgtatgggatatggcctccccaactgacattaccctccggagggtgctggtcggacaccgagctgctgtcaatgttgtagactttgatgacaagtacattgtttctgcatctggggatagaactataaaggtaataaggcatttttcagtaagtttccaacttagaatgggggaattcatatgaaaatttgatcaagggcaatttcatatttaaacgttgctacagaaaaatgtaatatttaattcagagactagtctacaagtgaaaaggtgtaataagtgagacgttgtgtgacaatttatcctagatattttattcctataaatagtggtgagtgtgagaagagactaaccctagaagagtaaatcaatctgaggaattctcatgtggtaacagccaactgcaaattagcctctgttaccatgaatttaaattgtcctttgttttatttgtttgagaagacttccctctaatggttcagtcctgttttctgcttctctaagactccatttgccatagattttaccaataaaagcaccaaatcaactgctcaatgccattttctttttcaggtatggaacacaagtacttgtgaatttgtaaggaccttaaatggacacaaacgaggcattgcctgtttgcagtacagggacaggctggtagtgagtggctcatctgacaacactatcaggtgagcagcaagtgccttgtatcataagggatcaatattatgctcccattcattattaatgcacagatcatacaagtcttcaattttgttatgtttataatcaactgtttttcctttctgtagcttcttacaggtcagaagtttgccccaggcagagaagcagcacagcaaagccttttgttgcccttctttttaaatttctcctgtctaccgttgaaaagtgctaataaacagctaacagccttttctttgccattgtttttaagaaatgaaaagaaagatttgtttccttactagaaattatgtaatttttgtcttagcattacataattggccagagagttacctgtctttgaaattatgaagatttcacagttggaagtcctttttggggttttcccttcacaaagatgaatgacatagatatgattataatttggaagatttatccatcctctcccttcagtgaagtattaaaaggatgaaaaggccattaaaaaagagctactgtttgttatatctaaggaaattattcctagaaatcacttgaattgctctgaaaacgtacagtttttataattagtacacaaaagttcttgagaactgactttgcatttctattctctgagaagagctgtcctggacagtggtgaaagaagtgtctgccgtggcagagggggaggtgctttgtgagaacaggacatcactgataatctgtatctctttcagtttggtgacttcaggaaactgctttcttagcttggtcatttccttctcaggcaactgcgtgcattgaattcgtttttatgcctggaagaacctgtttacagaattatgtaaagccctgtgctttgaaaatacattttacatttgaacttaaacctacatatttctgtgtgagttatatagcagaaaggaaataaattacattgaaagcagtacatatctgtgtgggtggtgattgattttattttatgaatttttagaaggcatatgaggtgtattgttataacattccaggcttagaaaagaatacgtgaaaattcacctgacttaattttctcttccagattatgggacatagaatgtggtgcatgtttacgagtgttagaaggccatgaggaattggtgcgttgtattcgatttgataacaagaggatagtcagtggggcctatgatgggtgagtgtgctaacagagtgtaaaaaagagaaaatctacgtcttaatccttccttatgtttatggtgttaaacataaccattccttgtttctaaaagcttatagattttacacaaaatatctgataccatatttctttaatccgtgtatttacctctccttggtttagtgtcctgaaatattcttcccattcattttattatacttgtttgcacatggttgtcattcatattttggttatttggttatgtatttgactgttttgccctgtaaagcaaagaacaagaaaaacccagtgttaacaggctacccatgtaaaagggtaacctgttaacaaaacagaaacactagagggcagtatttggggacttagtgtggtaagatcttgaattttgatttcttgggttttttatctctttgagtaatttttaagagtacagttctcttgtcatcacttgtcatcctagcatttcatttatgagtttagtcatctttattttcttctaatttctagtggttatggaatccattaattttgtgaatggaccccatgtccaccaatcctaaacacagagtaaattcaaacaaaagtagtctgggcacaatggctcatgcatttaatcccagcactttgggagaccgagacaggtggatcatttgaggtcagtagttcgagaccagcctggccaacatggcaaaacccagtctctactaaaagtacaaaaattagccaggtgtggttgcgggcgcctgtaatcccagctacttaggaggctgaggcaggagaattgcttgaaccagggaggcagaggttgcagtgagccaagattgcgccaccacactccagcctgggcaacagagcgagactccgtctcaaaaaaagaaaaaaaaatagttattcacttaggaagaactcttatcatttctttttgtcaatctgcctgattttggcagctttttaaatatcagaaactaacaacattattttagttcatgagttaactacactgatacattcattagccaatgcaagcagcaggaagtgtagactgctcacttcttctgctttgggacagccatcactgttacaaccttgggaaattgttcagagtgtggtgacatgttccagcttggtcaagacaatattttcttattgtcctggctttgatctgtacccacctgtcttggaatttgtctgctatgtaccttgaggaaacatggcctattaaaagatttttggaagagctacacttatcttatttaaatcaaaagatgagggcttgcttatataaactccattgctcttacatggaccccagtccctcagtacatgtgacctgggccactcttagaagtgcccaggaagaggatgcttcacagttgtagatttctaggtctgtgtaatatcattaaaaggtctaatgtacaagatctcctcttgatcccaaagtatggtataactttactgttaactgtcttcagtttggttaaagctagcctgtttctcatttgtaggttaatcacgtacatttgaactatactcaccatccatatttattgccatgaatttctgctattcttccctgccttctcttacatttgcttttaactaacatttttgtcccctttttgatctttagaaaaattaaagtgtgggatcttgtggctgctttggacccccgtgctcctgcagggacactctgtctacggacccttgtggtaagagccttgctgtttagagagcattggagagcaggtgggggaagaaattaaacgttgatgtgctgtggaatatggatttgaatttaatagttacaacctcacaaaacctacaactaagtggtaaggcaaccagtacatgacaataaaatatgtttatataattcctttcatccaaaaatgctttagagactatatatggagagaaatgtggcagctgtttaacagctgcacagcaactctacacaacagtttagtgcagggagtgaataagaattctgtatccaccagaaacagcagggggtactaagggagagagaatataattattcaaattggaacctgtccaaaatctgaggacctgtacacctgtgccttcaaaaagtgccctgggggccgggtgcggtggctcatgcctattatcccagcactttgggaggtcaaggcagatggatcacctgagatcaggagttcaagaccagcttgaccaacacggtgaaaccccatctctgctaaaaataaaaaaaaaattagccaagcatggtggcaggtgcctgtaatcctagctactcaggaggctgaggcaggagaatcacttgaacctgagaggcggaggttgcagtgaaccaagatcatgcttgcactccagcctgggcaacaagagcgaaactctgtcttaaaaaaaaaaaaaaactgccctgggaatctgcatgaatccccctggtcaaccccttagttctgcagcctattcatgaggtagtgcctccagcaacttgagcccatcttttttgttccccatatacccccttttgacatttggggaaaaaagtgattcaaaaggaggaatgcactaaattatttatcatgttgttagccaagggcccagattgataaatgctgcttccattagaaaattagttggagcaacagggtggacagacaccactcggagaaaagatgagagcaagcatttgaagcccagtgttctaaatcctgactgtcatcatttaggcattcttggctctggagaagagaaagaggttacatttcttgtcttccttgttggatttatgtgtgtatgtataagacagggtcttcctctgtcacccaggctatagtgaagtggcactacatgttgctgatgtatatcaatatttcatttcttttgaaaatttgctgagtagtattctattgtatggttatacccattcactgattgtttctcgtttttggctattaacaaagtttctataaacatttatgtagaagtcttgggatgaatgtatgctttttgcttttatttctctgaggtaaatacctaggagcagatgactaggtcatatggtaagtgtatgtttaaaatttttagaaactgccaaactgtttttcaaagtggtttacccttttacattatagtatatagcagtgtatgagagttccagttactccacattcttgccagtactgagcacagtctgtaatttagtcattctcattgtggtttaattcgtgtatctctaatgattaataatgtcaagcatctattctttgccatctgtatatctcctttggtgaagtgtgttcaaatcttttcccattttttaattgagtggttattgagttttgagattcttttatatattataagttacaaatgcattatcagatgtaattcacaagtattttctccacgttcataaaatttgtttctttgttttcttaaaagtgtctttcaaaaagcggttcttaattttaagtctactgcattgactttttctattatggcctatgttacttgctgttgtatctcagaaaaacctttgactaatccagagtcacaaggatttttccctgtgttttcttctctaagttttataattttcagtttgtattttggtctatgatccattttgagttaatctttgcatatggtacaaggtgtagatcaaagggttgggcttttttacacatgaatatccagttgttccagcaccatttattcaaaagactgtcctttcgaaatgcttttgcagctttgtcaaaaatgaattgaccatatatgtgtgagtcttctttgggaatctgttctgttccattgatttttgtctgtcttgattccagtataattttattttgattactgcagctttttaccaactcttgaagtcaagtaatgtgagtccttcagctttgtctttttcaaagttttttggggcctttgatttttcatgttaattttaaaatcagtttgccaagttcaaccaaaaaagtctgctgggaatgttttttaattttttaataaataaataggtatggggtctcagtgtgttgcccagactggtctcaaactcctggcctcaaatagtactcctacctcagacatccaaagtgcttggattataggcctgagccactccatctgctgggttttttgttggacttgtgttgactgtagatcagtttggagaatattgacttctgaacaatattgagtctttatctctccatttgtttaggtctttttaactttctcagccacgttgtagcttttagtataaaggttttgcacatctttttgtcacagttatccctaaatattttgtatttttaatgctattggaaaaggtatttttaaaccttggtttctgattgttcattgcaaatacatagaaatatacttttacttatttcccaatctatgtatcttttatttctctctccctcttttttttttttcttaattgcactggctaagacctccagtacaatgttaaaaacaattggtaagagtgaatgtcccttttttgttcatgatcttaggcgaaaggcattcagtctttcaccgtttcacatatgtgtatatatagatgtatgtcagctatagggtttttctcttttttttttttgagacggagtctcgctctttcacccaggctggagtgcagtggcgcgatctcagcgcactgcaagctctgcctcctgggttcacgccattctcctgcctcagcttcctgagtagctgggactacaggcacgtgccaccatgcccggctgattttttgtattttttagtagagacggggtttcatcatgttagccaggatggtctcgatctcctgacctcgtgatccagccacctcagcctcccaaagtgctgggattacaggcgtgaaccaccgcgcccggcctagggtttttcatagtgacccattatcaggggattaggcagttcccttctgttcctagattgctgagagttttaatgaggaacacatgttggattttgtgaaatgctttatctacatccattgagataatcatatggtttttcacttttattctgttaattggtatattacattgaattttttttagctttaaatcctttgcattgctggtataaacaccacttgttcatgaggtataattctttttatgtgttgttggattcaccttgctaatatctttttaaggatttttgtgtgtgtgtgtatctgtgtttgtaagggatattggtttgttgctttattttctgtgtctctggttgactgtcatgataatgttggccttataaaattttgaagtgttccctcatctattttctaagagtttgcatatgtgatattatgcttctttaaatgcttgatagaattcactagtgaagcatctagacctggaattttctttgtggaaagttttaattacaacttcagtttctttaataaatacagcactcttcagatttaatatttcttttgaagtccactttaatacttttgtcttccaagcagtttggccgttttatctaaattatgaaatttattgaaataaagttatcatattcccttattatccttttaatgcctgttaggagcatagtcctgtttccttttttggtttcattgattttttttttttatttttctagcttcttaaggtagaaactaagatcattgactttgaacctttttttaaatataatcagttgaagctataaatgttattagaagtaattctaatcactactttagccacatcccaaaaaatgtcaattaagtcaagttggtttataatattcaggtcttctgtatccttagtgatttttctattcgtccttaccaattattgagagaggaatttttatgtctcccactatagttttgaatttgtctatttctccttacagttgtgacagcttttgcttcgtggtttttgtttgagacagggtatcactatgccgcccaggctggaatgcagtggcacacccatgactcactgcagcctcaacctcccaggctctgtcaatccacccacctgagcctcctgagtagctgggaccacaggcgtgcgccaccacgtccagctaatttttttgtatttttttttagagatggggttttgccacattgcccaggctggtctggaactcctgggctcaacctcgacaaagtactgggatcacaggcatgagccatggcacctggcctgcttcatggttttttttgttgttgtcgttgtttttgagacggagtttctctcttgtcacccaggctggagtgcagtggcacgatgtcggctcactgcaacctctgcctcctgggttcaagccattctcctgcctcagcctcccaagtagctggcattacaggcacctgccaccacacctggctaattttttgtattttcagtagagacaggattttgccatgttgggcaggctggtctcgaactcctgacctcaggtgatccacacacctcggcctcccaaagtgttgggattacaggcgtgagccaccgcacccagccacttcttgtatttttaagctctattattgggtacctgcgtgcttaggatttttgtcttagtgattaactgactttttaacattatgaaatgtccttctttgatgtttatagtattctttgttttgggaaattaatactttgatattatatgtaaacattctgcttttttatgattagtgtctgtgtggtgtatcttactatattcttttacttttaatatgcctgtgtctttatatttaaaatgaatttctcatattcagcatatagttgggccatgtttttttttgttttttttttttcttaatccagcctgaccatctctgcctttgtcatgtttagaccatttatgtaatttttgtatgtttggatttaaatctatcatgttgctatttattttccattttttgcttttgtttgttacctcctgttttcatgctcttttttttttcttttttatctcagtttagctcctattatgggttcttagttatatctcactaatttggtgaggagggacctagggtttacaatagttatctctaatttattgcagtctactatcagatgatattgtaccacttcatgtataatgtaggaaacttaaaacactatatgttcatttttcacccccatcctttatgctattgttgctacagattttacttctaaatatgttatcatccccacagcacttgttatttttgctttaaacaatcaaccatcttttaagatttttttgtttgtttgtttgagacggagtcttgctctgtcacccaggctggagtgcactggcgtgatcttggctcactgcaacctccgcctcccaggttcaagcaattctcctgcctcagcctccagagtagctgggactacaggcgcccgccaccacacccagctaattttttgtagttttaatagagatgggatttcaccatgttagccaagatggtctcgatctcctgacctcgtgatccgcccgcctcaggttcccaaagtgctgggattacaggcatgagccaccgcagctggccttttaaagaaattttttaatggaaaaaagagagtttatttttacccacacgtttaccttttctattgcctcccattcctttgtataaattctatttccatctgatacattttccttttgcttaaagaacttactttaacatttcatgtatgcaggtacactggtgacaaatactttcacttgttgtttacttgggaaagttttttttttttttttttaagggatggggtctcattctatatcccaggctggaatgcagtggcatgatcatagctcactgcagccttggacttctagtctcaagcagtcctcctgacagcttcccacatagctgactacaggcttgtgccaccatatctggctaattttctttatttttttagagatagggtctcattgtgttgcccagactggtcttgaactcctggcctcacataatcctcttgcctcacaacctcctgagtagctgagattattacaggtgcaagccactgcgcctggctctgaaaaagttttcgttttgccttcatttttgaaagatatttttgctggctaaataattctatataggccaggcatggtgtctcacacctgtaatcccagcactttgggagtctgaggcggtggattgcttgaactcaggagttcaagaccagcctggcaacatggcaaccccttctcttcaaaaatacaaagattagctgggcatggtggcacgtgcccagtgcaacaacttttgggtggctgaggtgtgaggatcatatgagtccaggagattgaggctgcagtaagccacagatatgccactgcactccagcttgggtgagaatgagaccctgtctcaaaaaaaaaaaaagaaaaaaagctagattgacagtgtctttcagcactttaatgatgtcattccattttcttctggcttggtttctgactagaagttggaagtcactcatctccattctgtatctttttcctctgggtgcttttaagattttctctttatcattagttttcagcaatttgcttatgatgtgtcttggtgtggttttgtttgtatttttcctacttcacattaaaaaaatagaaattgtcagagcaatttgaagaagaaggctaaacttatgttgtctacaagaaagctactttaactataaagacacatacaccttaaaagtaaatggttagcgaaagatataacacatgttataggctgaattgtgttcccctaaaatttatatgatgtcttaaccaccagtacctcagaatgtgactgtatttggagttataggagctttcaagaggtaaataaggttaaatgaagtcattggagtaggccctaatccaatatgactggtgtccttaaaacaagaggagattgggacacacagagaccatgtgaagataaagggagaagatgaccatctacaagtcaaaggaagaagcatcagaatgaaaccaaccctgccaacactttgatcttagaattctagtctccagactgtagggaaattaatttctattttttgagccccctagtgtatgccatactttgttatggcacccctagccctgatggaccattctaacactagtcagaagaaagttggggtagctgtattaattagagagagagcaaacctcagagcaaagaatattatcagggataaagagaagtgttgtataaggataaaggggccagttctccaagaagacctaacaatccttaatgtgtacacacctaacaacagagcatcaaaacatatgaggcaaaaaaccatagaactgcaaggaaaaaatagatgcatccactgttatagttggagacttcagcaccccctatcagtaatggacagatctggcaggcagccaattcagtaagaacatagttgaatttagcagtaccatcaatcaagtggatataattgacaactatagaatgcttcatccaacagcagcagaatacacattcttctcaagctcccaaggaaattacaccaaggcagaccacagtcagggccataaaaggtaccttaaaaaatttacaagagtagaaatcatacagcatatgctctcagattacagtggtattcactaatggaaagatagctgaaaaatcccaaaatatgtggagattaaacaacacacctctaaataacacgtaggtcaagaagaaattgcaagataaattgaaatgtatttttttttaatttttacttttcatttttgtgggtacatagtaggtttatatatttatggggaacatgtgatgttttgaaaagtattttgaagtaaataaaaatgaaaacacagctatcaaaatttgtgggatgcagtgaaagcagtgcttagagggaaatttatagcactgaatgcatatcttagaaaaggtctaaaatcaatagtctaagcttctactagagccaactaagaaaagagcaaattaaattcaaagtaagtagaagaaaagaaataacaaaaactagaccagaaatcagtgaaattgaaaacaggaaatcaatggattacatcaagaccaaaagctagttctttgaaaggatcaataaaatggatgagtctctagccagactatgaaaaacaaagaagacataatgtactaatatcagaaatgaaagagatcccagatcttcacagaatcaatacttaataattatctttccaaacagagaaactaagcctaggcagatccactggtgaattctaccaaacatttgaagaagttatatcaattttctgttatctcttctataagataaaaacagaatgaataacttactaactcatctatgaagcattaccctaaaaccaaaaccagacaaacacaatataggaaaagaaaaatacagactaataatggctaagctatgaagttcaataggttaggcagatcaaatgcattttcagcttaggatagtttcatttacaacaggttcatcaggatgtaacccattgtaatttgaggagcatctgtattttaaactatttgattcatgcttgaacccgggaggcggaggttgcagtgagccaagatcacaccatttctagcctgggtgacaagaacgaaactccatctcaaaataaataagtaaatatatggtttttcttttttttttttttttttttttttttgagacggagtctcactcttgttacccaggctggagtagtgcaatggcgcaatctcggctcactgcaacctccacctcctgggtgcaagctattctcctgtcacagcctcctgagtagctgggattacgggtgcctgccaccacgctcagctgatctttgtatttttagtagagactgggtttctgcttgttggccaggctggtctcaaactccggacctcatgatccacctgcctcaacctcccaaagatctgggattataggcgtgagccactgcacccggccatgtatggtcttattattgcccttatgtttagcaatttcatgatttctaaaatattttaaaatgtaataatgtgccaataaaatgtagtaactctgaaattttttaaaaaatctcgacaaaatattagcaaattaaatccaacaatgtatgaaaagaattatacactgtgaccaagtgagatttatgccaggtatgcaaggctggttcagcattcagaaatcaatcagtgtaatccatcacatcagggggctatagaagacaaatcacatgcttatatcaatggatgcagtaaaagcatttgacaaaatccaacacccattcatgataaaaactctcagcaaacaagggatagagaggcttttcctcaacttcataaagaaaaatgcaaattaaaattatagtaaaatactactacaaacctaccaaaataaatgtaaaagattggtaatatcaatttttggtgaagatgtggagtaacaaactctgataaactgttggtgtgagtataaattggcatgacttttaaaaaattgtttcatagtatcttctaaagccaaacatacacctaccccgtggcccagcaagtctactcctagttgaaatgggtgcatatattcagcaaaagacacgtacataaatgttcctagcagctttgttttataatagccataaactataatcagcccctatgtccaccaacaagagaatagatggattgtagtatattcatacagtggaatatcaaccagtaataaaaaagaatgaactactgttttacatgcagcaacatagaagaatcttataatgttgactaaaagaagccaggcatgagctgggctcagtggctcatgtctgtaatcccagcactttgggaggctgaggccggcagattgcctgagctcagcagttggagaccagcctgggcaacacggtggaatcctgtctttactaaaatacaaaaaattagccaagcatggcggggggcatctgtagtcccagctacttgggaggctgaggcaggagaatcgcttgaacctgggaggcggaagttgcagtgagccgagattgcaccactgcactccagcctgagcgacagagcaagactccatctccaaaaaagaaaaaccaggcatggctgggcacagtagctaaggcctgtaatcccaacactttgggaggccgaggtgggcagatcacgaggtcaggagatcgagaccatcctggccaacatggtgaaaccccgtctctactaaaaatacaaaaattagctgggtgtggtggcatgtgcctgtaatcccaggtactcaggagactgaggcaggagaatcgcttgaacccaggaggcggaggttgcagtgagccaagatcgcgccactgcactccaccctgggcgacagagcgagactctgtctcaaaaaaaaaaaagccagacacaaaagaatacatactatatgattatatttatatgaaattcagtaagagactaaacaaattaataacaataacagcattgggccaggcacagtggcccacacctataatctcagagctttgggaggccaaggcagaaggactgcttggtcttgagttcaagaccagcctgggcaacaaaaagacctaatctctacaaaaaaaaaaaaaaaaagccaggtgtggtggcatgagtctatagtcctcactacttgggaggcttaagcaggaaaatcacttgagcccaggagtttgaggttacagtgagctatgatcacactaccgcattctagcctaggtgacaaaacaagactctgtctctaaaaaaaatgatgatgatgacacctgtaatcccagcactttgggaggccgaggcgggtggatcacgaggtcaggagatcaagaccatcctggctaacacgatgaaaccccgtctctactaaaaatacaaaaaattagccaggtgtggtggcaggcgcctgtagtcccagctactcgggaggctgaggcaggagaacggcgtgaacccgggaggcagagcttgcggtgagctgagatggcaccactgcactccagcaggggcgaaagagcgagactctgtctcaaaaaaaaaaaaaaaaaaaaaaagatgatgatgataaaattggagtggaggtaacattgtttagtaaggggtgtgagattgttttccagtatgctgggaacattctacatcttcatcagggtggtaactgccagtggtgtgctagaacaggctcatactcacttatgagagccaactattagatattcatgaattttgccagctggttgactatgactagcttataattggccatgataggagtttttaatgccgtggaaatctaccgatggttttacaaagtagcaaagtttggttgataaacatttatcagcatactgcttcttattgctcaccaatccttgacctctgattgtagaaggaacttagaagataaaaaccagggaggtagtaaggaatgctctcatccaccctacgccaaaaagggttggccatgagaaactattaatagcatgctatttagcatgtcttggccaaagagtattgctttgtttacagctgcctagtatttgacttttccatgctgcctttagccaaagtaaattttctctatttttttaatttatttatttttattttattttttttttagacagagtctcactctgttgcccaggctggagtgcagtggagtgatctcggctcactgcaacctccacctcccaggttcaagcaattcttctgcctcagcctcccaagtagctgggactataggcacatgccaccagcccggctaactttttgtatttttatagagatggggtttcactgtgttagccaggatggtctcgatctcctgacctcgtgatccgcatgcctcaggctcccaaagtgctgggattacaggtgtgagccactgcgcctggcctctttataacagcaaaccatagcctttccgtagactccttttgacatgttgctgaatttgtgtcctattgattttgagtagttcaagttcctaccctttttgtttctacttctttaggagcattccggaagagtttttcgactacagtttgatgaattccagattgtcagtagttcacatgatgacacaatcctcatctgggacttcctaaatgatccagctgcccaagctgaacccccccgttccccttctcgaacatacacctacatctccagataaataaccatacactgacctcatacttgcccaggtatcgaaatcgattatgtacataacactgtgggtaggagacgggatattagctgtaaggtgttgctagttcatggaactttctcctgccgtttgggtcaccaactcctgtaaagccgaggaagcagacaatgtgagacagggctgaagctgccacagtgtggacagtgcctttcaccaaggtagccagcctcagttctagatgattctagggtcctacttgtgtggtaagcctagtcattcctgccctagttatctagtagtactgttatgaaaataaaatgagatttgaatcagtttgaaaactaagtactgtaatgacccaaaggcctgtgatgtttaagttcccagatcaaacaatacctacaatagagacctttcaagccaagtaaacagtctgatgtctaatgtgtgaatggaaacatctcttggtgaaagttcacactgacatataaataaaagggcagattttaaaaggaatataaaaagtagcttttatatccctatccctattcctcaaccctccaaaaagaggacctgtcttttgacctctgacctccacatgtcctcccactcaagtctccaacctctctctcaggcaggggaagatcctaaaatacccaggtggtccatacatattgtggtatattcagatcatacctgctgttctaaccagttcgaatacactaggttgttaccagtttgagaaggctgccctagctgctgaggagcgttgctgtcaggatttgccacgtgtgcctcagttctcgtggcggaagtacatgttcgctacacgtttctgcatctctctttgcagtgttccgctgaggacagtgattcacgcccagctgggctgtcctcagcttctctttctctcacagaggacacggttcgtcgttcctcagccaggtcgcacaggctgtgtgcccttagacaagtaacttcccagaccctgaatctcttgatgagtaacgtgaggggcagcactcacctcacggaaccctgtgaaggctgtgtggagatactgcatggaaaattcctagtgcttagcacagtggcgaatacataatatgccctcaggaaaaactggtcatgagtattaatattgcaatctccatatacctaccccctcctttgcccaaaattttctcttccttagacttccgtgttactttgccatttttaatattcttcctgactctctgattatttgtgcttctttccccctcactcccaagagtctgtttctggcttttcttattatttttattttattttattttatttcattttattttattttattttatttcttgaaacagggcttcactcctgtcacccaagctggagtgcagtggcacaatgtcagctcattgcaacctccacctcctgggctcaagtgattctcctgcctcagcctcctgagtaccgcgggcacacaacaccatgaccagctaattgtttgtattttttttttttttttggagagatggagtttcaccatgttgcccaggctggtctcgaactcctgagctcaagtgatccacctcccttggcctcccaaagttactgggattacaggtgtgagccaccgcacccggcctgtctctggcttttcttccttatctgagttccttcttaggctgccttctctattcccaaggcttcagatctcatctcattgtagaagactcaaatttctgtctccagtccaagcctctgccttaatctccaggccacatttccagctgccatccacacagctgtccttgaagatagcaagagcacttctagtgctcacatcctcaactgcactgtcccctcctttacactgctggtaccctgcagccacacagccaggccagctttccttgattcccccacttctgttactggcaccgccatgctcatggccactcaaaaggcagggcccacagaccatcccccacccctgccctgccattctacagggcaagtgaaagctatgccaaccgtgggcactctcagcctcaagacatcagagtcactctgcttgaacaccacagccctgagcatgtcagcaagccctgcctttagtataacttcccccatcaggccaggtcacctttgacagaagctcctgcatggcataggcagagagcaggcattaggaaggacccctaagccttttccccattggcagctaagtgaatgttcttttgtcttcaagcaagtaagaaatatcaaaaaaggggctaatgactatttgctctgttttcacacaggacccattaaagttgcggtatttaacgtatctgccaataccaggatgagcaacaacagtaacaatcaaactactgcccagtttccctggactagccgaggagcagggctttgagactcctgttgggacacagttggtctgcagtcggcccaggacggtctactcagcacaactgactgcttcagtgctgctatcagaagatgtcttctatcttttgtgaatgattggaacttttaaacctcccctcctctcctcctttcacctctgcacctagttttttcccattggttccagacaaaggtgacttataaatatatttagtgttttgccagaatctctcttgctttgccattaagcagaagaactagtttccctgtatagcctgctgggagagacccacttctagggtatgggggatgcagcttcaagcccagtgcccagtgtctccctgttaactgcaggaatgccaagcacctggccagagcagcccagccccaatatgcttaggaggagacagagttccctctgtatagcctctgggacaagaaaaagaaaacacaagaatgtatacactggaagatttgggcctcctgcctgccttctctttgtttctgttcctcttcccatctactcccctacgccccttcaaccttttttctctgtctgcttcacctgagaagaaagtgtacgaagagagtgtcctcctctcacatgagccagatcagccagaaaatgcaacacttggaagagttaaatgctgttcagtgaagatttcagccccaggcctttgctgcaagtgaccctgtggcaacagtggattctcagacatgatactctcatcatatttgcaactcttctctctctttcttccccacacccaagaggaggattggtggtagggggcaggcagagggggtggggagaagtttcctgggctccatcaatggctgcatcttttctggactcagcagtctccttgattccatgtagagtgtggaaaggagttgctgattgcatttcctctcattaacaattgggtgtgtaataaaaagcattgtacttcatcttaaatcactggtaaggctcagcctacagaaagatttgaaatggccagagccaatcgcttggtgcattctgcgtaatggtttccatctccgatttcctcatcagggcctgtgaatacccaggtgcctgtatctttgccaagaccgtgatcaaggtagcttaagagagatggtcaggagaaaacactgtttttgttttttttgttgttttgttttgttttggccagttaaatatcatctctcaaatattgatctcaccgtgtcaaccttgcactgcacaaccttccttctgcttctcccacacccagtatttgcagaagggcaaagctgcttaagagagaggatcagggtgaagtttggcacacagggtttattaatggggcaaaaactgccttttcttcctcctcctgaccttattttgctcttcactctccccagccaataaagcgtctgtggcgattggtgaacagcataaacagctggacctcagcaagggtcaggcaaacccagtcactcggaaggcagctgtgtgagctgccaagctagtgggcttcaggtgcaagggtacctgtgccacaccaacctgggagcacacagaatactattaatgtgcacccagctggtctccccaggcaagaaggtatcctcttcccaaggtgtacccactgaatgttgttactacatattgagagtcattttatgcatatgcattctacctttcctgctttatgagtatttttaagcttttagttcaaggttatattcagaaaatatttcccagtataatgatacatcgtagcctaagaaatattttctcaatgtaattcccttcccagctacccaaatgctacagagaaatgttttctacttggccactatcagggttcgtcatctattgtgttgactattaatggctttttgattgggtaaggattttgctatagatgaaggtagagggctgtcagccctgaaaaacacacaggtcagacatttaaaaggcatgggtttcgagctgtctcaaaatattgcccaatagccataattttaccagcctttctgtcatatgctgctattacaaagtggaagctgttgaatgtttattggtgcccagggttttgctctccaatctaggttcagttgaaggaatattgtttctaagactgttttgagacatgtccagtacatcacaaaggagatcggggcgacccctgcagatgtggagccattagcccagttgaggatattctccaagttgtcctctctcctgctgatggaaatgggaatgaagttaagtggtctgaaaaacttgaatcgttcacatttctcagctctgggggtcatttaccagtttgttgtagaagaaataatcaggtaagttaaaagttcatttccagagaaggtaaaccccacttaccatctctgcatgatttcagtgggaattgattatcactaatccccaactgggctagaataaatgtaaagtttgacctttttaaaacgaaaagagagacaaagtctcagcacattccaaggagtggtagaaacagagctgaaggtgtccccattgtagattagtctcttctcactaaaatttactttccaacgtagggcctaaaggaaacctttcttaaagacaggctgaaaccccttcaaaggcagatgaggaggtacagacacgtgaccttttggtgcacactggagctacttggacaagaccagcatgccttgctgcacgtgtgtgtatttcactgctgagaacatcctttaacttggtgtgcaatttgaaaggatgtgaatcatggatggaaggccatttgtacatgtcccttggcaaaattctttctggtgtctcctaacttcagagacagggactctttttggatctctattgacaagtaataaaagtctggccctcataacttgtttccgaactagaaaagtctgtgagacccctacatcattctggtttttttgcttgagtaagaacaatccttttttatttttcttctgtacagtctaaagctacagagaaaaaaaaatgcactcttcccttgccggctcctggtaccattggtctgaacagctgtagttggtctactccttacttagcacttgattgtgtggggaaacaaaggtgggaggggtggggaatactggaaataatcagggcaatttttttctttcccataattggactagataccttggtactgttgaccttctcagcatctcccttttgccttagatggcaacaccctccagtctgtagcagagcagtccaacccagattagtgcagcccggaggcttagggtgcagcctccctggtcttcctccacacagttgttcaccaacagaccagacctcctttaaccacagtgtcaacatagtatcggaaagagagccatttcttaggggaataaaacagtttcgcttctttagctcatctgtggtgtcagaatccttggagctgaagagagaaatcaaaagagcatgatgatggctgcctggtttcaggtggaacttaatgcattgatctttagaagctccttctgttggaagttgagtacctgtgatctaaaatgtcctggaggcagatgacatctaaaatatgtgctttccaaccagcacagctggcgctcttagctcctgattggttgtgtgttttattaaggatcagtgcagttaagtcgtattttaaagtgttacctcccctcctaacccttccccttcttggacactgaaggaaaaggccaactagggtgttagccctctgggcaccaaggaaactaacagctttctcaaagcggtgaccactcaggccagcccagacaaatctgagggatggccagtgcactccaatgatgggacaggcctaacaacacatgtaagcttccccgagagctttcagctggttcacctctttgttctctagactcttaagtactgactgctttgacttttgtgattatgttatggtgatgtgtagtcagtgtaccaatatgttcacaacctaggatcatgataatggagtgtgttttgggttttttttaactgttcagaaaaaaagtaaattacaaatataagattaaagtg

SEQ ID NO: 36675 - DNA, 36652 bp, Homo sapiens
cgcccgcgtcctcgccagccgcgggttcgggcgtcttcggaccagcggggcgccgcaggcccctcgcagcgtccgtcggcaggcgggcagacgggcgggggagtcgccccggcggggcaagtccgtaccgcgacatgggcgcgccgagcacgtccgtaccgcaagatggctgctcggacggggacagagctcgcctctgccgcctcgacaactgctcctgggtcctctaagaggaggaagcgccacccatggcacacagtgtcccgtcggacagcagaaccagccgtcgtcccacgacacgaccccatgccgcccgcagggcgccccggggctcgcgtcggcccggccgtacgccaaaatggcggctcccgcgtatttccgctcgcgcgccgtatcgtcttcgccgcctgcgccggcacacctattggcccccgcggcgtcccgtcgccgcgtcgcgttgctggcccgtcggagcgacgccgctcgggtcagtcggcggccggactgggaagatggacgcaggtgaggagttgccgggggtcggtctttccgcaggaggtgctcgccttatcattggcctcccctgctcgggtcgggctgccgcgactcgcctcggggcacgccggtgcgggccaggctgggccggggcggcgggcgctgcgggagcgcggggcggtgttggtgggtggtgggcggtgggagcgggagggggacggcggcgcactgcgccgcggaacccgccgtcggttgcgctggagcttctgcttttccggtcccgtccggagcgctccggaggttgtggctgcacaggcccttgcgccaggtcggccgtggagggcggcggagcctgccgggcggggagaggcgcggcggcgaacggggcggccgcggtccgggccggggacgcgagcggcgggcgaaagcgtagcctttccgcagctgagcgtgaagggatggaagctctttaacttttatgaagttattggtaggttggaggagagaaacgtgacgtgttcatcacagtatacgtatcttttttgtttttgtcttcaatttagtaaccagtagattctccaagctgcttttccgtgacgagaaagagaaacagtgaatttgtatcatcgggtcttagtttcttggggtcctaagagagagagaaagagaaggagtgtgtgtgtgtgtgtatagggagtgttggtttttttcctatcctttcatgcttccgctccatttttgctagcaagattattttaagtcagcgccaaacccatcgctagcccagtagccctagaaatatttttacacagaagttttagctcattcattctttgtgggaactgatttgccttttaccaagtatcccccatctgtaaagaaagattttcatctggtttaattctgtcattctgaatgggattgtttttactttttatttttctggtagctacaacataaatttattaagatctgagttggaaaactgtaatgtgtattgccaatatctattaaaatgatttgtagcagctcaccacttaaatgtggtaggtggctggaggaaacaggagccctgactccctaaggagcatgttgaccaggtgtatatcttgtgaagtttgtcttttagaataaccgtcattcacggttgaactatttgcagctgtgtactatttgttgtttactattttacaactgttgtattatatctttttaggtgttattgtttgtgatgcaggatttttctcagccactctggcagccagagacctccggctggcgaggcccctgcccaggccttgcttgggtccaggctcgccgcaggagataccccatctacttggtccaccggtgggcacctggtttgcactatggcacggataccatggccaccatgactgtatgctcagcccctggcgggagtgggtgtgtgggtgagtgagtgccgggtcccgccagctgtttcaagcgcaggcaccagagtgggctctgcagagcttacagctagacatgtggcaagcaactcccacggcggactccagcgtccagacaaagggacagtggattctggtgtccagacaaggggaaggtagtggcgcccaagcaggggtgcttacaaccctgaagcccaagagggggtgttgcagagtgtcagcagccctgttactcccattgccctgctccaggctatagctctggggctggctccgtccccgctgcttccctttgctgcctcctgtcacgtggggtgtcacagtgggtggctgccctttgccggcagagggcccagggccacagtgttacagccttctttgtacttgcattcattgggtccctagttcttgtcccacgtccaagaagaatgagactacacttaacactgacaatcgaagggtgaggagggtggagaatagttttattgagtgatgaaacacccctcagcagagaggggactcaagggtggtcttccacccaaagtcgggtggtctcccttggtgtggctgggtccagggcttttataggctcagaatggggagtgtgtgctgatttgtctgtgagtatgcaaaaaaggttaaaacaaagtcactactcaaaggtgggcacaacagtgtaataaaccaattagagaaaagtaggtatatgtaaaataggtgaagggtggggattaattagaggaaagcgcaccaaacaggaagagaggttcgcaatccagtctgtggatttatccgagactcgtcgcttggctttcaggctttaaactgtggcttgaaggttgggtttcactggtgacccacccctctctgcctaggatttgtctgcctcctgcctctatcatttcgataccttgaggctggagtatcatatgagagacttggctaaggtcaaaaacacggttcagtgtcgatcatatgacctaaaatgtgaaaatcatcatgttcaagttgggagaacagttatgttgttacatggcgatactttattttatcttttattttcccttgacaactgtgttgacatggtgatactttaataggacactggatgttgctgcatgtgggatcagagtagaaaaggtgtttgcatttaaaggtctctgtttatgctgataaaaacgtatatgatgtttgtaggatatcatggggaattttccttctgacttgatgctgtatttcctttcagagatgattaatgatctgccctcctttgatctctagagttcttgaagattctgccttccttgaccatgtgtaatacagtttctgttctgatagtcattaattcaatacactgtttgttactgactgtcagatatgtgttaggcattgttctagacactaggactagagaagtaacaacatagatgaaaaccattgccctggggtagctaacgttctagacatgagaccagcattagcagcgaagtgcgtggctcctgggggatggtgatttgggccaaggatgaggaggattggaattgtagccaggatggccaggaagggtctcactctgaaggtttaagttttgacgaagacttaaagcagtgtaggaggaagggcaggtagcaagagcctggtgtggctcaggtgcagcgggtggcggtgggagaagcaggagctgaggatagaaaggtgacttaggctcagtgtagtggggccttgccagctcatagtgaggactcggtgtttattctgaacaggatggcagctcatagtgaggactcagtgtttattctgaacaggatggcagccgtttggaaggtttcattctagaggaggagtcacatgatagactgtgttcaacaggcttgctctggcatctcttttgagaatgtactgcagaggggcaagggcagaggcagcgagaccagctaagagactgttgaacaagccagcaaggagatgccagtggattagctcagggtgggtaagaggttgacttctgcatgtgttttggaggttgagacaatagaatttgtttgtagattggaagttgggagagggatgggtagagagggaggagttaaagatggccccatagtgtatggcctgagctaagcaactcagatggaggggggcgggcgtggtggctcacgcctgtaatcccagcactttgagaggccgaggtgggcggatcacaaggtcaggagatcgagaccatcctggctaacacggtgaaaccccgtcgctactaaaaatacaaaaaattagccgggcatagtggcgggcgcctgtgatcccagctacgcaggaggctgaggcaggagaatggcgtgaacccgggaggcggagcttgcagtgagccaagactgcgccactgcactccagcctgggcgacagagcgagactctgtctcaaaaaaaaaaaaaaaaagaaactcagatggggaagacttggggaggtcctgtctggtgggaagctttctgttgcgagtttggatttatgtgtgttgaatgtgaggtggatgttagacatccttgtagagcagtgtccagtgggcttttgggtctacaggtttggagctaaaagaataagcctgggctggagatagactggaggtcacatcagatgaggtcacccagggtgtgaatgtgggtgggaaagaaaagaggccaaaggcctctgcgggtgtggagaggtccaggaggtggcaggcagaccacagtgtggctgtgttctccaccagtccctagcactgtccctaaaagcatgctccccattcagacgactggcaggtgccagcacttaaatagccacactgcccattccttgaggacagagctggtgtcttgtgcttgcatttctagtgcatcacttgtgtctggcatgtggttggtaataaaaaaaaaacagaacttgaattaataataacctacacattcccctactatcaaagctttcagtttgtagagtttaacataaatccagtatgttagcataacatgtaatgaatgcagaggctgctggggagtggtttttttttttttcttgagatggagtcttgctctgtttcccaggctggagtgcggtgggcgcgatctaggggagtgggttttaatgtgcgcaatctgcccagtgtgtgcactgaaacagtgttttctagctttctgatgtagctaaatttggagttcctttctctctttctctgttttcattcaggactgaactactagcattctcatgtaaactcttggagatttaaaaaaaagtagtaatcatatgcaaactgttatcttaaacctaagagctttctaaaggaaaagaagaacctttgttgaatttataaaatataaatcttttggaaaataacttctaagtgttttaggaaggtttcttcgaaatgaagtggtttacagtaagctcttaaatttactcgtttttttttgtagtcctctctggttgaatgaagtgtaattggtactaaatggagagaagttggttaaattcattgagtacaattccctacatttctgcctgtcagattagtagtactaagtcacatgttttttctgatggaattactatattattaaaatgccatctgccctcttctgcttgtgatcgcagaagtcccagggaagagggcgtggaaaatcaagtgtctgggatccagccgaccaaatgggagaactgcttctaagggggactctttcttaaggtgtacagcacctctccgtccttttttttttttttttttttttttttaagacggagtctcactgtcgcccagactggctggagtgcagtggctctatctcagctcactgcagccttcgcctcctgggttcaagagattctcctgcctcagcctcccgagtagctgggattacaggtgtgcaccaccatgcctggctaacttttttatatttttagtagagatggggtttcaccatgttggccaggctgttctcgaacttctgacctcaagtgatctgcccgcctcggcctcccaaagtgctgggattacaggtgaaccaccacacccaacctacttcttcatcttgttcctcctgcgtgtcatctttttttgaggcagggtctcacttcatcgctcagactggagtatggtgttgcggcctcagctcattgcagccttgacctcctgggctcaagtgatcttcttgcctcacattcctcagtagctaagactacagatgtccacgcctagctattttttttttttttttttttttaagagagacagggtctccctgtattgcccaggctggtctcaaactcctgggctcaagtgatcctcccatcttggcttcttaaagtgctgggattacaggcatgagccacggcacctggccttacatgtcatcttatttcaaattaatatcattacctggaagtctagagatgggtctatatatttatttatgtatatatgtacatatatatataaacatatatatacgtatatatacacataaatatatacacatatatgtataaatatatatatacgtgtgtgtgtgtgtgtgtatgtatatattttcccccccccccgtcgtccaggctggagtgcagtggcgtgatctcggctcactgcaacggggttttgccatgttggccaggctggtcttgaacccttgacctcaggtgatccacccaccttggcctcctaaagtgctgggattacaggtgtgagccactgcacccggcgagtggatattttttccgaagtttgactccttttctatcaggagctacatgaattaccttataaatcacatgatgtggcacgggaagatgatgaaattatgacaggggctatgaaataagacaagggaacctctccatggcgaattgctgaggcagctggtgtcaggcctaagtggatctcatacatctgagagtcagtgaaggaacaagtgtggtggctcacacttgtagtcccagcactttgggaggctgaggtgggtggatcactggagcccaggagtttgagaccagcctgcttaacatagggaaaccccacctctacaaaaaatacaaaaattaggcatgacggtgcatgcctgtagtcccagctactcaggaggctgaggtgggaggatcccttgaggccggaagggggaggttgcagtgagctgagatcacaccactgcactccagcttgggtgacagagccagacccttgggtgacagagccagaaggaacgtttgggaatggaatcatcgtgttggtcgatctgcagatgttagtgattgtgagcgttagttttgcacccattgtgggttctcaccccacttggaaaactggtggctgtgccccatttcatgggtgaggagactgaggctggaagaagtccaggcctgtgtctgtcctgtagctatcgaccaggctctcagactccagaaacaaacctcagtaggaatcagaagtgttggccgggcgcggtctgcctgtagctatcgagcaggctgtcagactccagaaccaaacctcagtagaaatcagaagtgtcggccggttgcggtggctcatgcctgtaatcccagcactttcggaagctgatgtgggcggatcatctgagatgaggagttcgagaccagcctgaccaacatgggagaaacccatctctactaaaaatacaaaattagccaggcgtggtggcacacacctgtaatcccagctactcgggaggctgaggcaggagaatcgcttgaaaccgggaggcggaggttgcagtgagccgagatcgtgccattgcactccagcctgggtgacgagcaaaactccatctcaaaaaaaaaaaaagaaagaaattagaagtgttaattccaaaaaagttatcttcctccattataaagtaagatctggaaggtcagggaggtctttgtaccgttctgatgcctcagtccatggctcctcattgtgtcttcctcttcagctggagctgcgagggtgtccaggaggggtgagttctgctcggagggcctgccgagggcattccttcctgtcctccagcatgagagggacagtgtggggcccctagagtacagggaagacctcctcataactgaagagatgcgagtctgagagtctttattggctcttttgtaggaatcgctgcaggtctctttggtccttggagccagcccgtgaggccgggggcaggctcttgctctctaaatgcagtcactcttggaggaaaggacgttatgttggattcagtgttagtaaagagactcatgtttggttgggtctctgttgaccttgtactctgtgctgcacctctgcttacagaatacctcccatccatgccggttcgtgactgctcacccgtttcagtgatctgagaaggctggccctgaaagagtggttactgctcccgtgcagtttagagcttttcctgcaccttgacttgtccgtttcacagtgaggacaccaagtcacaagaaggtcactagcctgtaaggttgcgtgactgctcagtggtgggctcagacttctgactccacagctggcgctccagctgtcaggaacgtgctccaggtgtgacgtgtggacactccccacttgcagcgtcctccacagtaccgagaggagggtgcagtgtggtgggagaagcaagggatcatgttttcagagtgtccgccactagccctaggggaatgtatgactcgctcccaacagagggcaggattctcggggagggccggagtgcgtttctctggacggaggagcagagcagcttggggcacggtgtgggagccctccttagggacctcatgggtcacgttcgccgtggctgcgccactcctgttcactgccaagcaccgtgattgctccttggatttgctcccctggggtttcctggtctccttgatggtttatacagtgagcaatctgaggccacacacctgtaattttcacagttatagctggaggtgtggtggtgtatttgaacttaatggaacacctcttattcccttcactctgaagttggcttccttgcctataaagtttggtgataaacctaagaaatacacctgctgtgcattttactgcgtccgtgatgaaaatccctcaacttcacagccgctcaggcctcgtgaccctgctttcagagggagcctttttccttttcttccttatctatacttctctcattcctttaccatttatatttttaatatgggaaactagacatcctagaagtttctcagcttccagattctgttactgcagactgttactgattcaacaatatggtccttttcctgatgacatacgccacattcttctgaagtacagatggtctccaaactaccatggtttgacttacaattttttgactttacgatagtgtgaaagcagtatgcattctatggaaaccatacttgacgttttgaattttgatctttttctgggctagcagtatgcctccagatactctcgagatgccagatagctcctcgtcagccacatcatgagaagggggaatgacccctgctctacagggcactgtgttgccagctgagtttgcccaactgtaggctaatgtaagtgttctgagcacatttaaggcaggctaggctaagctatgatgttaggtagattacgtgtattcaatgctttttttttttttttttttgagacagagtttcactctcccacctgggctggaatgcagtggcgcgatctcaggtcactgcagcctccgcctcctgggtttaagcaattctcctgcctcagcctcccgagtagctgggattacaggcacctgccaccatgcccgagtaactttttgtgtttttaatagagatgggatttcaccatgttgaccaggctggtctccaactcctgacctcaggtgatccacccgccttggcctccccaagtgctgggattacaggcatgagcccctgtgcctggcctcagtgcatttttgacctaagtattttcaatttacaatgggtttattggacataatcccatcctaattaaggaacatctgtagtctacaaagagatacttgccagtgttcatttagctctgctgtactttaaataaaagatatgtgtatctttagttcaaagctggtgccttggaacggtgtcaaacatgagaagaatgttccaacagcaagatggaatcattgtcttgcagtgttgaaattagaccggtggtggccaggcgcagtggctcacgcctgtaatcccagcactttgggaggccgaggcgggaggatcatgaggtcaggagattgagaccatcctggctaacacagtgaaaccccgtctctactaaaaaaaatacaaaaaattagccaggcgtggtggcgggcgcttgtagtcccagctactcaggaggctgaggcaggagaatggcatgagccgggaggcagagcttgcagtgagccgagatcgcgctactgcactccagcctggtgggcgacagagtgagactccgtctcaaaaaaaaaaaaaaaaaaaaagaaaagaaattagaccggtggtgttttcatcctttttccttgagaataagttttctggattttagtctatatattgaataaagcctacaggtcaaagaatagtagggacttctgaagattcaggagtggctttagagaggtagcagggacatcatgatgtttttcagctctttaaaaagataggagtgggccggatgctgtggctcacgcctgtaatcccagcactttgggaggccgaggtgggtggatcacttgaggtcaggagatcgagaccagcctggctaacacagtgaaaccctgtctctactaaaaatacaaaaattagccgggcatggtggcagatgtctgtaatcccagctactcgggaggatgaggcaggagaatttcttgaacccggaaggtggaggttgcagggagccaagatcatgccactgcacttcagcctgggcaacagagtgagactccatcacaaaagaataaaaaaaaggcatggaccttaattcatcctaattcagtttttgtaatcatgtgcagaaacaagtaacatatatataaaaaggcaggagagaatgtaaacttggactttatttattcacagtcaccaagcagtttggttgataatgtctctgaaagcatggacaagtgaaatatgtaagagcagagctcttgggggccaggtgcagtggctcatgcctgtaatcccagccttcgggaggctaaggcaggtggattgcttgagcctaggagtttgagaccagcttgacaacatgattagacctcatctctacaaaaaatacaagaattagctgggtgtggtggcacatgcctgtagtctcagctgctcaggaggctgagaccggagaattgattgagcctgggagtttgaggctgcagtaagctgtgattacaccactgtactccagcctgggtgacaaaatgagtcccggtctcaaaaaaaaaaaagaaaaaaaaacaggagcagagctcttggacaaagccctgctgtggaaagcttgcttcatctggctgcagccgctccacaacgcccgtcatcttgctcaggaagccacagcactactctaggaaaggggcagagaggggcctgggtctcccacagctgagaatcctttaaacagtgcctgtagggccctctattgtggatttggtagttctgcctgcaccgagggagatgcttgcaggtgcttctgaaccctgtgtttgggaattagctgcgcatacaattaaggcttttgggtatagtaaaatttgtgtgcctttgaccctgtggttctgagtcctcgatgttaatgacagagcggacattgcagcccttctgtctgccagccagcacctcattggaagtgtttcattgaaacgtcacacccatatgctgaggctgtcctgttgttatcccattttatggatgagggaacattcacacttagaagttaagtgagtggcccaggaaactacagtttaccagtacccaagctgggctttaaattctgactgccccctgcctccccaaggggattgtgcacagcacagaagttcacacacgatgctttttagtatcagcttaggtggagatctgtgtttatgtagaatgctgaggaaaccacaggcatagtatgatttcacgtacgaacctgtgcataaagacttctggaaagagtcattgctgggcaacgaggcttcacgtgatttgtgtatttttgtagtcttcagaattttttatgattagcatatgtcattcttattgaagtgtggggttgttatcaaaaagtaaatttagatgtgggagaaattcatatgtgattgattttcaaaagattgctgtaaagttgctggtgaaggatgagtgatcagacaccatcagagctggagaggcagcagatgggaattgtgtgttcccagttccctgaagagcagctggagagagatgcctctggtgccgccccagaatacgcaatgggcatctcgccacatgggtgtttgggctggtgcattgctgctggctggcgccttcttttcaggaacattgtgggacatgggtatcctcagccacagttctgtggacaggaagaccctgggcctctctagtttctttctttcttttttttctttttcttttctttttcttttttttttttttttgagatggagtttcactcttgtcacccaggctggagtgcagtggcacaatctcagctcactgcaacctccaccttctgggttcaagtgattctcttggctcagtctccctagtagctgggattacaggcgcccgccaccacgcctggctaattgttgtacttttagtagagacggagtttcaccatgttgaccaggctggtctcaaactcctggcctcaggtgatctgcccacctcggcctcccagagtgctgggatcacaggcatgagccactgtgcctggcctagtttcttaattgaagtaaaacagagtaagatggcatgcagggctaatcattagcccagcaggtaagcaccatggctctgcagccagctgcctccttagaaagtggggtgttgccccatggaagtggtggcatgctcttctggtagcattgttgaaatgaaaacaggttcagtccttgatcactaggctttttgtacccgggtacctctggggacttggcagagagtttgatctctcagtgtccaggggttaactttctacctgagagtagcaccccatgcttctccagcacctgctcctaaccaggaaattggggtagaccagaaccccagtcttcccagcagctcagtgtttcttgccccggagcatctgccttcatcacagtgactctgaacacgctgccatggtgacatctggtaaaccttaggatggccatggaaaacgactctttgccctgtttcttcttggcttcccttgcgtacaaggatgaaggaggtggtttaactttatttttgtcctttactttttaagtctaaagtaagtgcttgaatcgggtgggttttcatttttttgctttctcacccctcaggttggcccctaacttggcctctcaccctcgtgtcagctgttagacactgactcagtggctcagaatatgaaaggctcaggaagtagcatgctggccccacctccctgtccccataccttagcagagcagctgcccagcagggcctccttctctttcctaagagtttactccatccatggtgggtgtcttggtaggcccgagatacgagagggagtgctgctgttacaagaatttacagttgttctcttcagcacagaaatgctgtaaatggcctctttcgatactagtttatgaaattataagtgtctgatgattgtgcatctttggtttcaacagctactctgacctacgacactctccggtttgctgagtttgaagattttcctgagacctcagagcccgtttggatactgggtagaaaatacagcattttcacaggtatcggccatgctggagcccaccctggtctgaccgcttggcctgcagaagcattttgtgatcactgttctctgctaactctgccataacttgtgacttgcaaacttaaggcgttgtgtgtgtgtgttttttttcttttaaacaacctctagaaaaggacgagatcttgtctgatgtggcatctagactttggtttacatacaggaaaaactttccagccattggtaagtactctgttttattacaacgcgggacaaaatatgtttttaggaaggaggaaaacttacgcttgtagatttgacttcaatatgccactgacttcatttgaatcttcacagcaatcctgcttaactgaattggccgaggcctcacgtgtagtagtggcaaagctagaatccacggcgcctgactctaggctagtgtgttttcaactgcaaatcccagcttattactggagctggaaatcagtatcatgagttatgaccaacgttgttttaaatgtaggacagaatgtcatagaaagcggtgtgtgtccgccacgggcacgcagcatggcgcttcagggatcttcgttttcgtttgcatgtttgagtgtgtgttctgggtcacagctgtacaatgtgtttcttacttaggtccagaatgtttggaagccattctctgtagccctcatcttttttagtattttccacacttaacctgtggggagatttgaagggccaggtgaatgtgacatgtttttatgtaacactaaggtgcattctgttaaaagccattcatcattgttgtataccctggagctggaaggagatggggactggttctcagccttgcctctcaccggcggagaactgaggccggaggtgagggccgggctggcgtcatgcttcctcagtgccaggtcagggtttggtccctcttctaggggtggtttcattctttatcctgaagtgaggtggaagtcaaatagccacaacggctggacattggagaacactgacgcgtagggacatacgacagtgtctccttaggttgatatttaatgatacaccttgtgagatgtaccctgggaatattgatatgtaatgatatattttaatgacataccttgtcagatgtgccctgggaatagttgctcattccacagtttccgcttgtttcgcagctgcgctgaacctgctctcttggccgccttggatgcaggtttgtccccagcctccatctccttcacagctaccctgccgcgtgctgggaaggagaacaggactggagcgaagcctttctggtttggcagaggccttgtggaggaggtagaggctggggatgagcctgcacatgaagcagccctgtcgcagttctgaagggcagtgtgctgtgtttccttcttagccccacggagataattttttaaaattattactttcatttttttaatagatggggtttcgctatgttgcccaggctggacttgaactcctgggctcaagcagttctccctcctcagcctcctgagtgtctgggactacaggtgcacaccaccacgcctggctctgagatacgtttttatcagcagtagagcgatcagcagtggagcgagggtgaccatgggcactgctgattgggttgttggtgggtgacggccaccactaccccaagacacagggtttattgtccgtgccagtgcatggagaagctgccggaagcccagaggtgggcacagggcgaaccttgtggtctgacccctgaatctctgcttctcaccctggtgtgcagccacctagcagcctcttgtctgctgcacaggtggccctctctgttgtcacagctgtgcagtggccttccactggacccctgctatgggctggcagtgtttcccacgtgcctgtcacatgccgcgcagttccatggtgcatgttgtccatctttctgggccccagggagtggccgtgagggcagggcccaggcacctgtgctggaagggctgagttgctgcccttgcggcccttcctgtgctctcagcagcactggatgtcatcaagcgtttgaatttctgcctttctgataattggaaaatgcgttgttttgtttaactttgcattttctggatgacttacgggggtcagtgtcttcatatgtttgtcagacattccttttgctccgtgactgacttgttcatgtgttttgcccattttgaggaggttgtcgggacatttcactctccagtaaatgtggcccttggcgttactgagtcctaagaggtgtgtgttgccccaggtggagctgatggaggagggagtcggtgcctgtggtgtgggactgaccggctgcctcctgccagtgggcttgtggcctgtggggccatctggccatgagcacttctctctctgtctgccacgacaggggggacaggccccacctcggacacaggctggggctgcatgctgcggtgtggacagatgatctttgcccaagccctggtgtgccggcacctaggccgaggtgagtcacagccctggggagggcgcatggccacggtgttctcaggaagcaaaggggactgtggggtcagggctctttagagcagaccacaggtaaaacagtaagtagaacttgggggtttcttgagtaatgagccacttgtttttcttgatttaaaaaactgactttaaagaatgctaataaatccgcatgggcaacatggcgagaccccgtctcacaaaaaatacaaaaattagccaggcgtggtggctcctgcctgtagtcccagctacttcggagactgatgtggagaattgctagaacccaggagatggaggctgcagtgagctgagatcgcaccactgcgctccagcctctgcaacagagttagaccctatctgaaaaaaaaaaaaaaaaaaaaagaagaagaagaatgctaataaatgttttaaattactgaaactgttttctgtacagatttgttttgataacttggcgtatatgtatttgaaatcctggagaacatgggtttttacttttaaaagattctgggctgggtgtggtggctcacgcctgtaatcccagcactttgggatgccgaggcgggtgggtcacgaggtcaggagatcaagaccatcctggccagcatggtgaaaccccatctctactaaaaacacaaaaattagctaggcttggtgacatgtgcctgtagtcccagctactcgggaggctgaagcaggagaatcgcttgaacccgggaggtggaggttgcagtgagccgagatcacgccattgcactccatcctgggtgagagagcgagactctgtttaaaaaaaaaaaaaaaaaaaaaaagattctgaaaaaggtttggatgccatctgtatctttagtgtgaaagtgaaaacttgtttctcatatttatggtagagctgacctgtaattttttttccaatagattggaggtggacacaaaggaagaggcagccagacagctacttcagcgtcctcaacgcattcatcgacaggaaggacagttactactccattcaccagataggtgggaggctgcagaatgtgccaggccccacccgggctgtctggagagggtggagtggtcggtttcccctcagagcttttctggtgtcgtgggatgtggagcaggaggctgtaaacctgtaaacactgacctctgaccatctgtgcgctgctgtcacatcacccccgtgtcatcccacatcacccccgtcccacccaggcccagaccctgggccttgcccttcctgctgtccatgcggcttgcagtgcctggtgctcggcacagtctggggaaattggcctcgccccatcagtgaatctgaatgctcagattgaagtggagtgagtaaagaagagttggcctttcttgcaagcaaggccggcttttgagcactgtgttttcacttatagaaggaagtggtcccttcatttcccctccttttctaagttcatagtgaaggacagtccctgagaccttgtttgccccctcatgcctcccccgatcttgttggggcatccttccgtctggaggctgggtcgggtgctgtccaggccttcctgtgacgtgtctcctggcaccacgtgccaccagaggtcagggctgggggcgggtgtgtgttgctaatgtgtatctgttccctgcagcgcaaatgggagttggcgaaggcaagtccataggccagtggtacgggcccaacactgtcgcccaggtcctgaagtatgtactgcgcttccactgctgagcatggggcagcagggatgttccctgggggttaaattctccttgagtcttcatggctacaggaaataaggggtctctaattatttacttcatggccctcagaaggtttctcagcgatgactgtgttgaggtcttgtgaataggaatttatgttttctaacaaaatgaacaccgtagtccacatcctggctggcacattggacccttgttctttgctgcatggatccacctgtaatggtggcttctgatggggtgggcagctgaagctagtctgcagccatctgtgcgggtgccgggcccttccacctctgcaggcttgttggaggctgccctccgcgggccttgccacctgcctttctcactctacccggagactccctgtagcctcgctcaccttcccatacacctcagcgtctgaaagtgtgctctgcacctgctccgcaccgcttcctttcgcacctcactcagccccattgcgtgcccgccccccagattcctctgagatgaccttccctgcagttccagaaacttgcctgtggtttcagcttcgtgtccactcttcactcctcttgacccatccagggtcatttggtctgattccatgtgtcctggcatcccagcatttttggggaggctctggccagatcccccaggacttgtcccctcagggtctcctccccactggtctgagggccagcgtctccccagcctgtcttcagccacggcccccttgaagcctctccttctgcatctgcctgttctgtatcccactcaaggccctcaggcatcccacgttccacattcctgaaatggccctgtctcccctcacccacagcctgctcctcagcatggcagtcactgtctccacccagcttttctgtcaggttccctggggtcctgcacaagtccgtctctgccacatcccacgtcacccgcgtcccacgtcacccccgtcccacatccccagcctgctgctccctctgtctccagggcccgccctgtgtttggcgtggcacctgctcagtccctactgcatgcccttcagagtcctctgtccagcagctccccagcccccaccacacccttccactcacacttctcttgctgctgcctggagtggccccaccaagtcagcgctgtttctctggaagcaccaggccactcgccatgctcgctgtttctcctggtcccctgcctgctccccaccagcccccgcccctgttgctggatgatcctccccaacctgcaagtgctgtggcactcaggcacatggacggcttccagggctgatttgtccctggactccaagctcaggtccagctgcttattctgcatttccacctgggtatctgtgtgcatggtgacctgacagccagagcccgtgctggccccagcctgcttctcctacagtggtccttcaggtgctcaaaccaaaatctgggattgttctagacccctctttttgagacggagtctcgctctgtcgccaggctggagtgtagtggcatgatctctgctcagaatcccaagtgattctcctgcctcagcctcccgaagtgctgggattacaggcgtgagccaccgtgcctggccaggactcctctcttttttctttttttttgagacagtctagctcagtagcctgggctggagtgcagtggtgcaatcttgggctcactgcttcctccacctcctgggtcccggttcaagcagttctcctgcctcagcctccccagtacctggaattacaggcacccgccaccatgcccagctaattttttcaatttttagtagagatggggtttcaccatgttggccaggctggtcttgaactcctgacctcgtgatccacctgccttcgcctcccagagtgctgggattacaggcgtgagccaccgcgcctggccaggactcctctctttcttttttttttttttattttttttccgagacagagtctagctctgtagtccaggctggagtgcagtggtgcaatcttgggctcactgctacctccgcctcccgggtcccagttcaagcaattctcctgccttagcctcttcagtagctgggattataggcacatgccaccatgcccaactaatttttgtatttttagtggagacaaggtttcaccatgttagccaggctggtcttgaactcctgacctcgtgatccacctgcctcatcctcccaaagtgctgggattacaggcatgagccaccgctcctggccaattcctctttatttcagtgggcccattcaaaatatcaattcctctttctttcagtgggcccattcaaaatatgtccagactctgaccagtgttcatcctttcactccctgtgctggtcccagccccatcttcttctttcttgttgatcttccttctctctttgtcatcctagagtctctttagcaaataacagcagagccatctgcataaaacatattggccactgctctgccttgaaccgccctggctcttcactgctgactcaggcggggctctacccgacctccctggcatgacacgttgtgctcctgggacacaccagcctcagggcctttgcatgtgtggtgcctggcacttggaccctgttcccccgacacctgcctgggttgcgccccatgtctgcccaggtaccctttggcaccaaggtcttccctgtggctacgttagtagtgccactccccgttcctgcgttactgttctctgcagtgttgaccaccggcccacgtggctgctgcttccttgtttgccctccgccaggtcagctttgccagtgctgctgtgtcccttgtgtgtgggtgcgtcttcggcactgcatctgggctagaggtgggaggaggaaggtggtgtgggagtggggcggggaagcaggctgtcctcccatcttcagcactgcagctgggctggagatgggaggaggaaggtggtggggcaggggggcagtggggggcaggctgtcctcccagtgtcccccctgggcttgtgcattgggaggggctctgtgtggtcaccccagtcccctgctccacccccacccagctcccctccacaggtcttgcattctgtccccgggagcaccaggtctttgctgcctcagggccttttctattgttttaccttttgttgaggtcctctgaccccacctccgccagacctgagatgagatcagagtcgtgttagacttttggctgcagaatctgcccttccctcagaaggggaaatccaaggccatggttcctcctcactggcgtgcacagtcgtgcttcccactaagctgcagatttctctataaggactcagattccttggttgtcagctcagcgtgtttggtggaggggagagcagagcagagcgtgaaggtgctgggaggcctgcctcaaagttggcaaaacccacagcgtctcagagctgcgttcatgttctagttcctgcctctgtgccagtgagaccagaaaaccaggccactcaaaagcctcttgcgtgtgctctctatgaatggaggctggggcaagggcaggacccctgggcctcaggcgagaagaagcagatttaccctcagctttcttcctgtctgtggcattggctgtgccccggattttaggagccttggcccttctcatccgagaagcacctctaacgcgaaccctccttcgcgcagctatagctgcaaagatgaaccgtctttgaattgtacaaaagcttatggtcattctcctactctctgtaggaagcttgctgtcttcgatacgtggagctccttggcggtccacattgcaatggacaacactgttgtgatggaggaaatcagtaagtggctcagagtttccatggacaagaaagttgaaatcacgggcaacatacacacttcctcgcctgagtccccacgggagcctcggcgagtgttgtcagtcgccccatgccgtgcaggtgctccgtggggcctgtgcgccaagccagatgcacggtggcctcgctctcctatcccggcggtcataccaagagaggagagcccaggctgtctggaggccgcgacttggtatctcacgtcgtgttttgtgtcttggttacaaatcgtttatgaaggccctgctgtgcttaggcgccctcgtgtgggaattctggtgaagttattttgcgtgccttgatgtgcgacagagagatgtagcaaccatctctagctgcaccatctcgagcaaaggcacgtcgtgaaggcagagctcttttcagctttctggaagaaaggtctgctgcaaccctgaaggaacctgggcgtggcaacatttacatctaggaggaaaactgtggctcagttttaacaaatgggctcattgagtgagttccaaattcatgtttcaccttccatgatgtagccaagctgagaactcttaaaaatgcctcattgcctttttcactcagggccacctttttcccaaggaacttctcaaaactccctcaattccaattttattgaagttctacatgtaggctattgccttgaatccaattttccataagaaagagctcatttaggccgggcgcggtggctcatgcctgtaatcccagcaccttgggaggccgaggtgggtggatcatgaggtcaggagttcaagaccagcctggccaacatggtgaaaccccgtctctactaaaaatacagaaactagctgggcatggtggcacgcgcctatagtcccagctactcgggaggctgaggcagaagaatcgcttgaacctgggaggcggaggttgcagtgagccttgatcacgccactgcactccagcctggccacagagcgagaatccgtcccccgccccccaaaaaaaagacctcattcagagccacagccgtaactgcgcacagattcacagtgggagtgggtcctgccctgtgactgtgggtgtgccaggtcaccacacaggtgtgtgctgggtcacagacacgccccttccctgcctctccattctgtttcttcatcgtctggccatcctcgggggcattgtgacacagcggagggagtgaggcaggactttataagggagagtgaggctggcttctgcagcattgagagctttgccacagcaggctctccttccaggattctgttcctcagagacttgaacttgggatcataaccaaagggtgtttgtttcttccatctgcctttttcctccattctgtttcttgaaatttttataaaacattggaaacacaggaagagtacaaagaaagagaaaaattattgattttaccactcagaaataactcatatgagcattttgacattcttactctcagtatttctcctgtgcttttcaaaaacttacatagtttcctaagtattttctcctggccatgagtgacagcattgtaattattaactggctacacaatatactattataccttagttccctgttcactgccccatcctccctcccgtgtttggggaaatcacttaccccctcgttccgcacgcgtgctcaggatctcaccaagtcacacctcagtccctggcctcggattagggaggctgttgctgggtgcagtggccaggaaggcgcaagggtcagggcttcctagaacctccgtccctctgggtgcaggtagcactggtgggagtgttgggggcagcttgtctgtgtggactccagctccgtcccttcgggagtctcagggctgcccaaagcagtgctgctgaaacgtggcttgtcagagtgagagtggagtcaggtcctggaagagcttgaatctgcatttcccagcccctggggatggtggctcccgggaggatgtggaggctgcctggtctgactggcttcgtctcactgcgtcagctgcctgaaaggacactgttcctcacaggagcatgtggaaggtgcctgatgcccccatttaggaagaaaggcatccacatccagccagcaaaggcactggcattgatgcacaaggcttgggtttctgggttcctgagtgtggcgtggtgttgtgaggaggacatcggggtcgttctgaatgacccctaccaaaagccccaggagggagtagtggggggagggcaggaagcaggctgcttttttcagtcgtgctgctaagagtgcgcaagggaggacgtctgaggaagaagtccgcaaagccgaagctagagaaacagacgtgtccttggctaagcaaggacttttcttctagtttctcggaactgcttgtggaaggagcagttagataggagaagactgatgccattcagaaattccactaaagcttcttcctgcagcgaaagagctgcctgacggtgttcccactcagattttaggtgaagcctgtggggtaaggggagaccttactgcctacagtgtccccatccaccaacccatcccccccgcaactcatccttctgtccacccccagtcaaaggccagccaggacatccttagcatgctcttcttgtccttaacgttgatgggcttagacctttctaacgacagtagacagaatgtcactgaatgtagggaggaaatacagattggaaaacgtgtcagtctggcagtgaggacaaatgactccaatgaaagaaaagtaaataccagagcaagcacagtcagaaacagagtggggaggagaatcacaatagctggaactcaactctctgagaggcagtgcagccaaatagaggcagctgagagcagagtatgtggattagaacttttcgggagagttggccactgaaggagtaggagaaaattcccctgagttggtgagagttgagtctttagagctaaagacccccaaatttttttatcagaagtacttaaacatacatgttcctgataatatttccaaattgcagaagtaaagggaaacttctctaaacatccaaataatagtatcactactaagctgctttgaagaaaggcagtctcaactggcctgggcatctcatctttgtgccataccaaatgctactggaaaatgtttagaattctgagaaaagacctggcttcatgaggtgagagtaggtatgtgtactgtgtagttgtcattgatagagaaatataaattttaaatgtgttcaaaatataaagagaacacgagaaaatttcaggtggtggcaggaataggcaaaagcccgttgcaccctgttgacagcagggtgtttgtgacgtggtaggtcacacactcagtgctgggctctggaggcacagaagcaaccggcccagctacgcatcagcccttgagccgattcatgtgttcgatcatattcctgagacagtagggtctgtgcaggtaacaaagcaccagtcagcaggaaactcaccaccgggaagcctttctatcaaaacataacttcaaaatcagtaaagtgggccgggcatggtggctcacgcctataatcccaacttcaaaatcaataaagcgggccgggcgcggtggctcacgcctataatcccaacttcaaaaccaataaagtgggccgggcgcggtggctcacgcctataatcccaacttcaaaatcaataaagcgggccgggcatggtggctcacgcctataatcccaacttcaaaaccaataaagcgggccgggcgcggtggctcacgcctataatcccagcacttcgggaggccaaggtgggtagatcacatgaggtcaggagttaaagaccagcctggtcaacatcgtaaaaccccatgtctactaaaaaaaaagttagctgggcatggtggcacgccctcgtaatcccagctgctcgggaagctgaggcacgagaattgcttgaacctgggaggcagaggctacagtgagctgagatcatgccactgcactccagcctgtgtgacacagtaagactgtgtctcaaaaaaccaaaacaacaaaaaataataaaaatatatagaaaacagaataattaacagattagctatggaaagatcaaagctacaggggacccagataacacaacaggcagagtttagtagatacgtgtcaaaccctagattgtgacagcagagtgtgcctgggaatttctatgaaactaatgcggaataaaatgaaaaaaggacaaaaccctgctgcctggaaatgtgaaacctcaaaaaagtcaagtgtagagaccgtaactatgtatctgaacctgatgtgtacagaactcagaagaaaacctgtgtatcttcagtactagtatatgggttctttacaaagtgaaaattaatgaaataagcatacaactcaagaattcggaaaaagcaaaattaactgaagaaaccaaagaataatattaaagacaaatacagaaattaatgatttaaaggaagaaatgtattaggccaggtgtagtggctcatgtttgtaatcccagcactttgtgaggctgaggcaggaggattgcttaaagccaggaattcaagaccagcctgggcaacatagccagacgtctattttttttttttttttggaacagttctgctctgtcgccaggctggagtgcagtggtggcacgatcttggctcactgcaatttccgctgcccaggttcaagtgattcccctgcctcagcctcctgagtagctgagactacaggtgcatgccaccacgcctggctaattttttgtattttagtggagatggggtttcaccatatttcaccatgttggccaggatggtcttgatctcctgacctcatgatctgcccaccttggcctcccagagtgctgggattacaggcgtgagccaccgtgcctggacctcattctataaaatattttaaaaataaattttaaaattaaatttattagaactaacacatactagaactggctctttgaagcaataacatatatgttttaaaaaaatcaaagttaaaatccctcccttggctaagcactgtggctcccgcctgtaatcctagcactttgggaggtggaggcaggcagattgcttgagtccaggagtttgagaccagccgcctaggtaacatggtaaaacctcatctctacaaaaaaacaaaacaaaaaaactagccggacatgggggcatgtacctgtagtcccacctactcgggagtctgaggtgggaggatcccatgagcctgggaggttgaggctgcagtgagacatgattgcaccacttcactccagcctgggtgacacagtaagaccctgtctcaaaaaccaaacagaaacccaaacaactcccttaaggctgggcgtggtagctcctacccataatcgcacctctcagggaggctgagttggaggattgcttgagaccaacctggacaactccctctctataagaaatagaaaaatgaggccaggcacatggctcatgtctgtaatctcagcacttcgggaggctgaggtgagcagatcacttgaggtcaggagttcgagaccagcccggccaatgtggcaaaaccccgtctctactaaaaatacaaaaattagctgggcgtggtgacacacacctgtaatcccagctactggggaggctgaggcaggagaattgcttgagcccagaaggcggaggttgcagtgaaccgagattatgccactgcactccagcctggacaacagagaatcggcttcaaaaaagaaaagtcagggggcacagtggcccacacctgttgttccagctactcgggaggctgaggcgggaggattgcttaagtgcaggtgtttgaggctgcagtgagctgtggttgcaccactgcactgcagcctgggtgacagagtgagaccccgtctctaaaagaaatttaaaaagttctgtctcagaatccttgttttccagctgtctgttttgagaaatttgagtcctacaaaaaagttcagtgagtcatggccacaaaccctccacctagatccaccaattgtgttttgacacgcttggtttttatgagcaagcctcctacgaatgagagtgttcctgagagccacacagcctcatcaccacaaaagaggtgacgccacgactcaccagggtccgtcttggccccttgctgtccagggaacaacccgtgccgctgatttgtgttcctggttgagggtccggtgctgtgtgtatatagttgtgatgtctttctagtctttaattgagaaggttctgcctctttgttgtggttgttgctgctttgtggcatttttgacgagttcaggtcagctgaccatcccacacgctggatttgtctgcttcctcacagttgggcttgggttgagcctgtggctgagagtagcctctgggtggcagtgtcctctgctctcccatccggggcctgcagtgggacactatgtcagatccccggagatggtgtcttttttcctttgtaattaatgaataatccagtggtgacactgagcatgtcctggtgagctgtgtgactcctgcctgataatggtggtttttctagcctgtcctttcctttcacgtttattggttggcgttctgagaagagccgccttttctcccatcacttagtgtgcagtgtgctacctgtcacctgtctgtcacctgtcagtcactgtcacctgtcactgtcactgtcacctgtcactgtccatctttttgatgcttgacggttccacctttggccggtggccacctcagtctggtggtgtcttttgccgtgttctggcgtttttcgtttatgttttgagccctcccttatgttctgggttaagcagatgctgcaggcacctctgaacattccctgcctggccctggaatcagcctggctcctctgagtggggagtggtgttgagaaacctcgatctagacgccgggcatgctccatgctcccggagtgtcttctcccatcaccgcaccctccggttgatgtgtcctccggaccattgactcacgggtgtgtgtaggcagaaggggtggaagcgaggaaaggcgttgctgaggaggcccggagggagcgggttctggctgtgctggcactagccaggctggcaggctgcgtgggtacttctgtgattttcctctcaagtgcacgtggctttttcttgcactgtttcgtgtgtgtgctttatttcacaataaaactcttgaattaagtatgcatagaaactatttcttttttctctgggtggcaagattatgaaaaaattttcttacgcttttctatattttccaagtttgaatttcactgtaagcacctggctttgtaccgccctttttctgttacacagtcatcatttgcttgcttgttgtgggagcacttttgcacaggtctgcttggttagtgaaagcatgtctccctttctaggaaggttgtgcaggaccagcgttccctgtgcaggcgccactgcgtttcctgcagattccgaccggcactgcaacggattccctgccggagctgaggtcaccaacaggccgtcgccatggagacccctggtacttctcattcccctgcgcctggggctcacggacatcaacgaggcctacgtggagacgctgaaggtgggtcctgccgtgcggcgcttgccctgagtccccgtccccttctcccagttcttagtcactttcagcgcatcgtcgtcacgtggccatttgtgcagccggctctcgggggaggggtaaacaaccctggtttacaccgttgcccaaggggtgagtgggcgtgaggcacgtccatcagtaggcacgtgctgctttcgttctgcaagtgtcaaggcgagtgtcgaggatgaaagcatgaggcgcttgcagggggtccttggaaccaggtgccactcctcggcctgacggggagccccgccccctcccgggtctccactgtgccccaggcatgcccaccccactcccccacagccctcttggcctgaggtcccttcggagggtgggttggcctgtgaggaagggacgtgtgggcagggcctggggatgggcagggctgtgtgaggagctccagccacaggctcccccatgtcatgaaagcaaaagggggcggggagcggtggctcatgactgtaatcccagcactttgggagggcaaagcgggcagatcacgaggtcaggagtctgagaccagcctggccaacatggtgaaaccctgtctctactaaaaatataaaaattagccgggcatggtggtgcgcgcctgtagtcccagctacacaggaggctgaggcaggagaatctcttgaacccaggaggcggagcttgcagtgacccgagatcatgccattgcactccatcctgggtgacagagtgagactccatctcaaataaaaaaaaaaaaaaagcaagcagaagggaaaaccatcctttcttcaggtaactcaaattttagaccaaggagtcacatttgtatggaactgaaatgtggcttcctgttaaaattattcagttgtctgaacttggcccctccgtccagccttctgcccatcctgtggggtctcagctgcccccacacataggccccgtctccatcgcttctgccctgtcaggtcaaagcactcagcagggccacctcccgcacccctgctcacatctcctgccaggccccctcactcccggcctccccaaagcccacctctgacatgaagcttccctgagctgagcctgcagattgggtttcttgtgcctgtgggatgtcctgtggtctttcctggacagtaagctctttggtaccatgtcccctcctgtcccctcttgtgtcacccagttgggcctcagcaggcccttgggccccctatggcagtgggtggggggaccgtctgctcccacctgggacctgtgctcagtcccccgcccctccacagcactgcttcatgatgccccagtccctgggcgtcatcggagggaagcccaacagcgcccactacttcatcggctacgttggtgagtccagggttcccaccgtgtccctgtgggcctgggccttttaagggcattccatgagcaggtaccacaccccaggtgaccacttgaggccactggtggaaaagcagcatgccctggggttcattttcagcctggtcgcgggcggcctcctgtgtgcccctttccctgatggtctggtgccctcggctccctccccacctcctgcccactgcttctcagtgtgatgtgggtgcagtgggtctgaaatgcggcctcctctgtccctttcctctgccggctcggccacccacctgcccacctgcctcatcctcccaggtgaggagctcatctacctggacccccacaccacgcagccagccgtggagcccactgatggctgcttcatcccggacgagagcttccactgccagcacccgccgtgccgcatgagcatcgcggagcttgacccgtccatcgctgtggtacgtggcggccacctgagcacacaggcatttggtgctgaatgctgtttgggaatgacgaggaaaactttcggatttttgcgttttttttttcagcatgttgggataagtactgtgttcacgtggttgggaatctgaagggtataagagccggaactgtgtccttgcaccctcacgtccctcccccaggcaccacctcctgtgcagccttcatggccttcgagtggcccagagagcgtgtgtctggatgtgagcgtgtgtgggcgcgtgctgagtgtgcatggatgagtgtgagccatggtgagtgtgtccccctcacacctacatttaaacacacgggcggcccctccacccacccctgcaccaccttcgtcacacccacatttaaacacgggcggcccctccacccacccactcctgcaccaccttttgttttccggaggctctgacttgacctctctgggggatttcctaagaaggagcttccctgtttttccattttgattacctagttgtgatttttggtgtgtgatttatgcagacctgcctgccctcaaatatatttgatggggaaagaggccaaaaaacccccctagaaatcatgaatgacggtgacatgctcagggaagcagttaaccgaatcgggggctctgttgtggatgctccgccccatttaggaggaagaaggcagatctgggcctgaaatgggacggtctctgagctgtggcgcagccccagagtgcacaccacgctccatgcacctcctgggcagggtggcagtagtggggaacatgggctggagctctgtggctcacactttttgtttgtttgtttgtttttgagacggagtctcactctgtcgcccaggctggagtgcagtggcacgatctcggctcactgcaagctccgcctcccaggttcacgccattctcctgcctcagcctctggattagctgggactacaggcacccgccaccacgcctggctaattttctgtatttttaatagagacgggttttcactgtgttagccaggatggtcttgatctcctgacctcatgatccacccacctcggcctcccaaagtgctgggattacaggcgtgagccactgcgcgcagcctggcgcacacttcttaccagaacctagtcacgaattcctcgtcgaactagaattaggtatgtttgttactgtaaacgcagcttggtggcttacagtgattggcactctaacagtcaggtcaggctagagagccagccaccgcagacagaggagtggacgcgtgaacgttgagttgagaccaaaggggccacctggtgggataactgtcctcacccgtgaggaggaggaatgtcccctgtccccgggggagagtgctcctacaccagcgccgaggcggcagaatggtgtcttcaggggaagagagtgcccagtttgagcttctccccccatttcgtttctttttgtgttaacatctgcgcatctggcagcgttgagaattcctagtgactgtcattacaggcggcagctttaaggatgtgattgccggtgacccttggccggtcccctgtctcctggctcctcagcaggaggctccctgtgtcacggtgtccttgggcagttctcggtggcctttgccgccaagcttccagggagctgctgggcgaaggctgagacccagcggccctgcctcacagtcacagagagaagagctccccacttggccctaactcataacctgccccaatcccggaacactcggtgaggtttgagagatgcacaccacgtaacatctcgtgggcgaatcaaggcacagcaacgcagtggagcctgaggggagccgggcactggtgcaggggaccatgcacagggcaccctcggagctccgttcctggccacaggagccaaggcaggctggaatgtccagcacctgcatgctgggggcctctgctgcgccactggcagtgggaatggaagcccccacctcttagccgactgcagatgggggtgtcgtgttctgctcatcgtcatttcgttttaggggtttttctgtaagactgaagatgacttcaatgattggtgccagcaagtcaaaaaggtttgtagccgccccacacccacagccgagctgagccacccagggagacaggcagtggggcgtgcaggggtcgaaggcctgcgtccaggtctcaggcagcctcactgggccgtggggagctttgtcccgcctggcacagctatgtagctgagcagggtggggcgtcctggattgcccatctggcaacacagttaacaaccctggggacggatgttgcgtgttgactttagaatgggatttccagtgtcctcatccgtctcctgttgagatgggggtggtgatggggtgctgagctacgccggccgagtgcgtgtggcccacccccctctgccgtggtggtcagactgtgctgtgtgttgatcaccacactgggttctcgtgtagcctttagtgtggagctgcctctgttttctcatcagtgagatgggatgacaggtttgtccgctggctgtggccggctggcccctttctcttggccgcagcaagcactggggtgaggctgcacctaacggccatgtctcactaacagctgtctctgcttggaggtgccctgcccatgtttgagctggtggagctgcagccttcacatctggcctgccccgacgtcctgaacctgtccctaggtgagagctgccaagtccaggtggggtccctcggaggtacgatctgtgcccttgcttccccagtcctggcccccttggttttgaccattaaggtgtgtgtgagcctgagccgtgagcacttggcagtggttcgcctgtgagaccaggtatggagtggagcgtcccctcctccaagcttgcgcccagcagcccaggacccacctcgtcttccccaccagcgctgcctgcccgggcgctgtggagctgggcgtgctaccatggagtcctcaggggtctggagcagacagaacatgcaggctctgtggtgacgcagtcctgggtgggggactggttcacttgggcaccactggccatgggtggcgtagacccctcggaccatggccagcgtgccgcaggagccggcctgggctcgtgcagtgaagtgagtggccgtgagcgcgtcctcctcatctctgtctccctgtgggaaactctacaaacaaggcaatggcaatggaaccactcctgatgaccacgagggtcagacgcgggacagaggcccctcaggcctgagattgtgccggccgccccctgccctcctcaccctgccctgctcctcttctctgctccctccccccatattcgcaggtctgcacaacccccggacctgttcacacccgcatggggacagctgtctgtgggctgcagagcaggcactgctcagtctgccccacgccaagggcccttgactcacacccaggtggcccacccaagatgcctgatgcgctatgtcctgttccttctagattcttctgatgtagagcgactggaaagattcttcgactcagaagatgaagactttgaaatcctgtccctttgaaaatcctggggtcgggggtggcacctgtgagagcctggggctcctggtgccgctgcgtttcatccatcccgcccgctcgcctgccgagggctgcgccccgtgctgcctccccccagagggccacccgctgtgctcgtggactgaggctgcgctgcccgggaggccttactgcttggtgtcagactgcccagctcagagtgcccgtcagggcctgtgcatccgcacgcggagccgtctgttaggagcttccagagtgttctctcgacactgccagccccgtgttagcacctgggcctcagtcccacttgctcccaggcgccggttctgtggttggtttggaattaaagtcctgtttgaagttgtcagacacagacatgaatttctgggcgctccctgagtcagagtctcagaagacctgtgcaggctggcgtgagaggagcggcagccacactgcggccccacgcccaaggactgggctgctctcgaggggggcgcgcccaccgctgtgtcctctctgcccagcctggcttaccaagggctacctcagtgggagatgaggttggaggaacgaaggcgaggttcctccttgctttggggagaaaagtattcaggaagtgggtgtgtgggaaacctgaagatggcgtgcacaggacacagcgtgggcggcctgggcagaagggcggctggctgtcctggagctgctgctggagcctgccctcagagtgtccctttccagtgctgtggcattctgtggcagcttccccaggtgtggtgacggggggggggcggggcctccacctgtgacagccaggcttgagggtggacggcgtgcctctcccaggagccttccccatgtccttgccttgctgagaattgccctcccatgccgctgaggtgttaggtggtttagggccaaaaggggaaaaccacttgagtcttgtggtgtgtggtgggcagacaccacagggtggcatcacctggtggcatttccagaacctcagccccgattccagcacccaccaccgcctgaccctgtgtaacctgctgtcccgggtcccagagtgcactctgccccgctgctctgctgcctgtcctgggaaagtatctttgccccactaggaaatgtaaacaggagggcttggggagcgtgggcacttttctcatgagcagctactgcggcgttggcaggactcgctgctgctgctgctgcttgtgtaggtcggggagccagagatccccgaggacgcgcgccggacagtcggcactgaccggcccacctggtagcagaggacacccccagccccccaagcattgaagacatagtgtatttcctcgtatcctttctcccttgggtgtagttggggtggggaagcagggaaggctggtgcgatctccattccttgggctccacgtccgagttcatggtgcgccgctgtgctgggagctgcagtggtaatgtgtgggacaccttgaccaaaggggagctttgtctcgtgtgttttgaaaaaggcttaatgaagagaatgttgttcattcttagtagtatagtttgcaattcttaatggcaaataataagtttcagtagaaaac

SEQ ID NO: 36676 - DNA, 36244 bp, Homo sapiens
gcgccggcacacctattggcccccgcggcgtcccgtcgccgcgtcgcgttgctggcccgtcggagcgacgccgctcgggtcagtcggcggccggactgggaagatggacgcaggtgaggagttgccgggggtcggtctttccgcaggaggtgctcgccttatcattggcctcccctgctcgggtcgggctgccgcgactcgcctcggggcacgccggtgcgggccaggctgggccggggcggcgggcgctgcgggagcgcggggcggtgttggtgggtggtgggcggtgggagcgggagggggacggcggcgcactgcgccgcggaacccgccgtcggttgcgctggagcttctgcttttccggtcccgtccggagcgctccggaggttgtggctgcacaggcccttgcgccaggtcggccgtggagggcggcggagcctgccgggcggggagaggcgcggcggcgaacggggcggccgcggtccgggccggggacgcgagcggcgggcgaaagcgtagcctttccgcagctgagcgtgaagggatggaagctctttaacttttatgaagttattggtaggttggaggagagaaacgtgacgtgttcatcacagtatacgtatcttttttgtttttgtcttcaatttagtaaccagtagattctccaagctgcttttccgtgacgagaaagagaaacagtgaatttgtatcatcgggtcttagtttcttggggtcctaagagagagagaaagagaaggagtgtgtgtgtgtgtgtatagggagtgttggtttttttcctatcctttcatgcttccgctccatttttgctagcaagattattttaagtcagcgccaaacccatcgctagcccagtagccctagaaatatttttacacagaagttttagctcattcattctttgtgggaactgatttgccttttaccaagtatcccccatctgtaaagaaagattttcatctggtttaattctgtcattctgaatgggattgtttttactttttatttttctggtagctacaacataaatttattaagatctgagttggaaaactgtaatgtgtattgccaatatctattaaaatgatttgtagcagctcaccacttaaatgtggtaggtggctggaggaaacaggagccctgactccctaaggagcatgttgaccaggtgtatatcttgtgaagtttgtcttttagaataaccgtcattcacggttgaactatttgcagctgtgtactatttgttgtttactattttacaactgttgtattatatctttttaggtgttattgtttgtgatgcaggatttttctcagccactctggcagccagagacctccggctggcgaggcccctgcccaggccttgcttgggtccaggctcgccgcaggagataccccatctacttggtccaccggtgggcacctggtttgcactatggcacggataccatggccaccatgactgtatgctcagcccctggcgggagtgggtgtgtgggtgagtgagtgccgggtcccgccagctgtttcaagcgcaggcaccagagtgggctctgcagagcttacagctagacatgtggcaagcaactcccacggcggactccagcgtccagacaaagggacagtggattctggtgtccagacaaggggaaggtagtggcgcccaagcaggggtgcttacaaccctgaagcccaagagggggtgttgcagagtgtcagcagccctgttactcccattgccctgctccaggctatagctctggggctggctccgtccccgctgcttccctttgctgcctcctgtcacgtggggtgtcacagtgggtggctgccctttgccggcagagggcccagggccacagtgttacagccttctttgtacttgcattcattgggtccctagttcttgtcccacgtccaagaagaatgagactacacttaacactgacaatcgaagggtgaggagggtggagaatagttttattgagtgatgaaacacccctcagcagagaggggactcaagggtggtcttccacccaaagtcgggtggtctcccttggtgtggctgggtccagggcttttataggctcagaatggggagtgtgtgctgatttgtctgtgagtatgcaaaaaaggttaaaacaaagtcactactcaaaggtgggcacaacagtgtaataaaccaattagagaaaagtaggtatatgtaaaataggtgaagggtggggattaattagaggaaagcgcaccaaacaggaagagaggttcgcaatccagtctgtggatttatccgagactcgtcgcttggctttcaggctttaaactgtggcttgaaggttgggtttcactggtgacccacccctctctgcctaggatttgtctgcctcctgcctctatcatttcgataccttgaggctggagtatcatatgagagacttggctaaggtcaaaaacacggttcagtgtcgatcatatgacctaaaatgtgaaaatcatcatgttcaagttgggagaacagttatgttgttacatggcgatactttattttatcttttattttcccttgacaactgtgttgacatggtgatactttaataggacactggatgttgctgcatgtgggatcagagtagaaaaggtgtttgcatttaaaggtctctgtttatgctgataaaaacgtatatgatgtttgtaggatatcatggggaattttccttctgacttgatgctgtatttcctttcagagatgattaatgatctgccctcctttgatctctagagttcttgaagattctgccttccttgaccatgtgtaatacagtttctgttctgatagtcattaattcaatacactgtttgttactgactgtcagatatgtgttaggcattgttctagacactaggactagagaagtaacaacatagatgaaaaccattgccctggggtagctaacgttctagacatgagaccagcattagcagcgaagtgcgtggctcctgggggatggtgatttgggccaaggatgaggaggattggaattgtagccaggatggccaggaagggtctcactctgaaggtttaagttttgacgaagacttaaagcagtgtaggaggaagggcaggtagcaagagcctggtgtggctcaggtgcagcgggtggcggtgggagaagcaggagctgaggatagaaaggtgacttaggctcagtgtagtggggccttgccagctcatagtgaggactcggtgtttattctgaacaggatggcagctcatagtgaggactcagtgtttattctgaacaggatggcagccgtttggaaggtttcattctagaggaggagtcacatgatagactgtgttcaacaggcttgctctggcatctcttttgagaatgtactgcagaggggcaagggcagaggcagcgagaccagctaagagactgttgaacaagccagcaaggagatgccagtggattagctcagggtgggtaagaggttgacttctgcatgtgttttggaggttgagacaatagaatttgtttgtagattggaagttgggagagggatgggtagagagggaggagttaaagatggccccatagtgtatggcctgagctaagcaactcagatggaggggggcgggcgtggtggctcacgcctgtaatcccagcactttgagaggccgaggtgggcggatcacaaggtcaggagatcgagaccatcctggctaacacggtgaaaccccgtcgctactaaaaatacaaaaaattagccgggcatagtggcgggcgcctgtgatcccagctacgcaggaggctgaggcaggagaatggcgtgaacccgggaggcggagcttgcagtgagccaagactgcgccactgcactccagcctgggcgacagagcgagactctgtctcaaaaaaaaaaaaaaaaagaaactcagatggggaagacttggggaggtcctgtctggtgggaagctttctgttgcgagtttggatttatgtgtgttgaatgtgaggtggatgttagacatccttgtagagcagtgtccagtgggcttttgggtctacaggtttggagctaaaagaataagcctgggctggagatagactggaggtcacatcagatgaggtcacccagggtgtgaatgtgggtgggaaagaaaagaggccaaaggcctctgcgggtgtggagaggtccaggaggtggcaggcagaccacagtgtggctgtgttctccaccagtccctagcactgtccctaaaagcatgctccccattcagacgactggcaggtgccagcacttaaatagccacactgcccattccttgaggacagagctggtgtcttgtgcttgcatttctagtgcatcacttgtgtctggcatgtggttggtaataaaaaaaaaacagaacttgaattaataataacctacacattcccctactatcaaagctttcagtttgtagagtttaacataaatccagtatgttagcataacatgtaatgaatgcagaggctgctggggagtggtttttttttttttcttgagatggagtcttgctctgtttcccaggctggagtgcggtgggcgcgatctaggggagtgggttttaatgtgcgcaatctgcccagtgtgtgcactgaaacagtgttttctagctttctgatgtagctaaatttggagttcctttctctctttctctgttttcattcaggactgaactactagcattctcatgtaaactcttggagatttaaaaaaaagtagtaatcatatgcaaactgttatcttaaacctaagagctttctaaaggaaaagaagaacctttgttgaatttataaaatataaatcttttggaaaataacttctaagtgttttaggaaggtttcttcgaaatgaagtggtttacagtaagctcttaaatttactcgttttttttttgtagtcctctctggttgaatgaagtgtaattggtactaaatggagagaagttggttaaattcattgagtacaattccctacatttctgcctgtcagattagtagtactaagtcacatgttttttctgatggaattactatattattaaaatgccatctgccctcttctgcttgtgatcgcagaagtcccagggaagagggcgtggaaaatcaagtgtctgggatccagccgaccaaatgggagaactgcttctaagggggactctttcttaaggtgtacagcacctctccgtccttttttttttttttttttttttttttaagacggagtctcactgtcgcccagactggctggagtgcagtggctctatctcagctcactgcagccttcgcctcctgggttcaagagattctcctgcctcagcctcccgagtagctgggattacaggtgtgcaccaccatgcctggctaacttttttatatttttagtagagatggggtttcaccatgttggccaggctgttctcgaacttctgacctcaagtgatctgcccgcctcggcctcccaaagtgctgggattacaggtgaaccaccacacccaacctacttcttcatcttgttcctcctgcgtgtcatctttttttgaggcagggtctcacttcatcgctcagactggagtatggtgttgcggcctcagctcattgcagccttgacctcctgggctcaagtgatcttcttgcctcacattcctcagtagctaagactacagatgtccacgcctagctattttttttttttttttttttttaagagagacagggtctccctgtattgcccaggctggtctcaaactcctgggctcaagtgatcctcccatcttggcttcttaaagtgctgggattacaggcatgagccacggcacctggccttacatgtcatcttatttcaaattaatatcattacctggaagtctagagatgggtctatatatttatttatgtatatatgtacatatatatataaacatatatatacgtatatatacacataaatatatacacatatatgtataaatatatatatacgtgtgtgtgtgtgtgtgtatgtatatattttcccccccccccgtcgtccaggctggagtgcagtggcgtgatctcggctcactgcaacggggttttgccatgttggccaggctggtcttgaacccttgacctcaggtgatccacccaccttggcctcctaaagtgctgggattacaggtgtgagccactgcacccggcgagtggatattttttccgaagtttgactccttttctatcaggagctacatgaattaccttataaatcacatgatgtggcacgggaagatgatgaaattatgacaggggctatgaaataagacaagggaacctctccatggcgaattgctgaggcagctggtgtcaggcctaagtggatctcatacatctgagagtcagtgaaggaacaagtgtggtggctcacacttgtagtcccagcactttgggaggctgaggtgggtggatcactggagcccaggagtttgagaccagcctgcttaacatagggaaaccccacctctacaaaaaatacaaaaattaggcatgacggtgcatgcctgtagtcccagctactcaggaggctgaggtgggaggatcccttgaggccggaagggggaggttgcagtgagctgagatcacaccactgcactccagcttgggtgacagagccagacccttgggtgacagagccagaaggaacgtttgggaatggaatcatcgtgttggtcgatctgcagatgttagtgattgtgagcgttagttttgcacccattgtgggttctcaccccacttggaaaactggtggctgtgccccatttcatgggtgaggagactgaggctggaagaagtccaggcctgtgtctgtcctgtagctatcgaccaggctctcagactccagaaacaaacctcagtaggaatcagaagtgttggccgggcgcggtctgcctgtagctatcgagcaggctgtcagactccagaaccaaacctcagtagaaatcagaagtgtcggccggttgcggtggctcatgcctgtaatcccagcactttcggaagctgatgtgggcggatcatctgagatgaggagttcgagaccagcctgaccaacatgggagaaacccatctctactaaaaatacaaaattagccaggcgtggtggcacacacctgtaatcccagctactcgggaggctgaggcaggagaatcgcttgaaaccgggaggcggaggttgcagtgagccgagatcgtgccattgcactccagcctgggtgacgagcaaaactccatctcaaaaaaaaaaaaagaaagaaattagaagtgttaattccaaaaaagttatcttcctccattataaagtaagatctggaaggtcagggaggtctttgtaccgttctgatgcctcagtccatggctcctcattgtgtcttcctcttcagctggagctgcgagggtgtccaggaggggtgagttctgctcggagggcctgccgagggcattccttcctgtcctccagcatgagagggacagtgtggggcccctagagtacagggaagacctcctcataactgaagagatgcgagtctgagagtctttattggctcttttgtaggaatcgctgcaggtctctttggtccttggagccagcccgtgaggccgggggcaggctcttgctctctaaatgcagtcactcttggaggaaaggacgttatgttggattcagtgttagtaaagagactcatgtttggttgggtctctgttgaccttgtactctgtgctgcacctctgcttacagaatacctcccatccatgccggttcgtgactgctcacccgtttcagtgatctgagaaggctggccctgaaagagtggttactgctcccgtgcagtttagagcttttcctgcaccttgacttgtccgtttcacagtgaggacaccaagtcacaagaaggtcactagcctgtaaggttgcgtgactgctcagtggtgggctcagacttctgactccacagctggcgctccagctgtcaggaacgtgctccaggtgtgacgtgtggacactccccacttgcagcgtcctccacagtaccgagaggagggtgcagtgtggtgggagaagcaagggatcatgttttcagagtgtccgccactagccctaggggaatgtatgactcgctcccaacagagggcaggattctcggggagggccggagtgcgtttctctggacggaggagcagagcagcttggggcacggtgtgggagccctccttagggacctcatgggtcacgttcgccgtggctgcgccactcctgttcactgccaagcaccgtgattgctccttggatttgctcccctggggtttcctggtctccttgatggtttatacagtgagcaatctgaggccacacacctgtaattttcacagttatagctggaggtgtggtggtgtatttgaacttaatggaacacctcttattcccttcactctgaagttggcttccttgcctataaagtttggtgataaacctaagaaatacacctgctgtgcattttactgcgtccgtgatgaaaatccctcaacttcacagccgctcaggcctcgtgaccctgctttcagagggagcctttttccttttcttccttatctatacttctctcattcctttaccatttatatttttaatatgggaaactagacatcctagaagtttctcagcttccagattctgttactgcagactgttactgattcaacaatatggtccttttcctgatgacatacgccacattcttctgaagtacagatggtctccaaactaccatggtttgacttacaattttttgactttacgatagtgtgaaagcagtatgcattctatggaaaccatacttgacgttttgaattttgatctttttctgggctagcagtatgcctccagatactctcgagatgccagatagctcctcgtcagccacatcatgagaagggggaatgacccctgctctacagggcactgtgttgccagctgagtttgcccaactgtaggctaatgtaagtgttctgagcacatttaaggcaggctaggctaagctatgatgttaggtagattacgtgtattcaatgctttttttttttttttttttgagacagagtttcactctcccacctgggctggaatgcagtggcgcgatctcaggtcactgcagcctccgcctcctgggtttaagcaattctcctgcctcagcctcccgagtagctgggattacaggcacctgccaccatgcccgagtaactttttgtgtttttaatagagatgggatttcaccatgttgaccaggctggtctccaactcctgacctcaggtgatccacccgccttggcctccccaagtgctgggattacaggcatgagcccctgtgcctggcctcagtgcatttttgacctaagtattttcaatttacaatgggtttattggacataatcccatcctaattaaggaacatctgtagtctacaaagagatacttgccagtgttcatttagctctgctgtactttaaataaaagatatgtgtatctttagttcaaagctggtgccttggaacggtgtcaaacatgagaagaatgttccaacagcaagatggaatcattgtcttgcagtgttgaaattagaccggtggtggccaggcgcagtggctcacgcctgtaatcccagcactttgggaggccgaggcgggaggatcatgaggtcaggagattgagaccatcctggctaacacagtgaaaccccgtctctactaaaaaaaatacaaaaaattagccaggcgtggtggcgggcgcttgtagtcccagctactcaggaggctgaggcaggagaatggcatgagccgggaggcagagcttgcagtgagccgagatcgcgctactgcactccagcctggtgggcgacagagtgagactccgtctcaaaaaaaaaaaaaaaaaaaaagaaaagaaattagaccggtggtgttttcatcctttttccttgagaataagttttctggattttagtctatatattgaataaagcctacaggtcaaagaatagtagggacttctgaagattcaggagtggctttagagaggtagcagggacatcatgatgtttttcagctctttaaaaagataggagtgggccggatgctgtggctcacgcctgtaatcccagcactttgggaggccgaggtgggtggatcacttgaggtcaggagatcgagaccagcctggctaacacagtgaaaccctgtctctactaaaaatacaaaaattagccgggcatggtggcagatgtctgtaatcccagctactcgggaggatgaggcaggagaatttcttgaacccggaaggtggaggttgcagggagccaagatcatgccactgcacttcagcctgggcaacagagtgagactccatcacaaaagaataaaaaaaaggcatggaccttaattcatcctaattcagtttttgtaatcatgtgcagaaacaagtaacatatatataaaaaggcaggagagaatgtaaacttggactttatttattcacagtcaccaagcagtttggttgataatgtctctgaaagcatggacaagtgaaatatgtaagagcagagctcttgggggccaggtgcagtggctcatgcctgtaatcccagccttcgggaggctaaggcaggtggattgcttgagcctaggagtttgagaccagcttgacaacatgattagacctcatctctacaaaaaatacaagaattagctgggtgtggtggcacatgcctgtagtctcagctgctcaggaggctgagaccggagaattgattgagcctgggagtttgaggctgcagtaagctgtgattacaccactgtactccagcctgggtgacaaaatgagtcccggtctcaaaaaaaaaaaagaaaaaaaaacaggagcagagctcttggacaaagccctgctgtggaaagcttgcttcatctggctgcagccgctccacaacgcccgtcatcttgctcaggaagccacagcactactctaggaaaggggcagagaggggcctgggtctcccacagctgagaatcctttaaacagtgcctgtagggccctctattgtggatttggtagttctgcctgcaccgagggagatgcttgcaggtgcttctgaaccctgtgtttgggaattagctgcgcatacaattaaggcttttgggtatagtaaaatttgtgtgcctttgaccctgtggttctgagtcctcgatgttaatgacagagcggacattgcagcccttctgtctgccagccagcacctcattggaagtgtttcattgaaacgtcacacccatatgctgaggctgtcctgttgttatcccattttatggatgagggaacattcacacttagaagttaagtgagtggcccaggaaactacagtttaccagtacccaagctgggctttaaattctgactgccccctgcctccccaaggggattgtgcacagcacagaagttcacacacgatgctttttagtatcagcttaggtggagatctgtgtttatgtagaatgctgaggaaaccacaggcatagtatgatttcacgtacgaacctgtgcataaagacttctggaaagagtcattgctgggcaacgaggcttcacgtgatttgtgtatttttgtagtcttcagaattttttatgattagcatatgtcattcttattgaagtgtggggttgttatcaaaaagtaaatttagatgtgggagaaattcatatgtgattgattttcaaaagattgctgtaaagttgctggtgaaggatgagtgatcagacaccatcagagctggagaggcagcagatgggaattgtgtgttcccagttccctgaagagcagctggagagagatgcctctggtgccgccccagaatacgcaatgggcatctcgccacatgggtgtttgggctggtgcattgctgctggctggcgccttcttttcaggaacattgtgggacatgggtatcctcagccacagttctgtggacaggaagaccctgggcctctctagtttctttctttcttttttttctttttcttttctttttcttttttttttttttttgagatggagtttcactcttgtcacccaggctggagtgcagtggcacaatctcagctcactgcaacctccaccttctgggttcaagtgattctcttggctcagtctccctagtagctgggattacaggcgcccgccaccacgcctggctaattgttgtacttttagtagagacggagtttcaccatgttgaccaggctggtctcaaactcctggcctcaggtgatctgcccacctcggcctcccagagtgctgggatcacaggcatgagccactgtgcctggcctagtttcttaattgaagtaaaacagagtaagatggcatgcagggctaatcattagcccagcaggtaagcaccatggctctgcagccagctgcctccttagaaagtggggtgttgccccatggaagtggtggcatgctcttctggtagcattgttgaaatgaaaacaggttcagtccttgatcactaggctttttgtacccgggtacctctggggacttggcagagagtttgatctctcagtgtccaggggttaactttctacctgagagtagcaccccatgcttctccagcacctgctcctaaccaggaaattggggtagaccagaaccccagtcttcccagcagctcagtgtttcttgccccggagcatctgccttcatcacagtgactctgaacacgctgccatggtgacatctggtaaaccttaggatggccatggaaaacgactctttgccctgtttcttcttggcttcccttgcgtacaaggatgaaggaggtggtttaactttatttttgtcctttactttttaagtctaaagtaagtgcttgaatcgggtgggttttcatttttttgctttctcacccctcaggttggcccctaacttggcctctcaccctcgtgtcagctgttagacactgactcagtggctcagaatatgaaaggctcaggaagtagcatgctggccccacctccctgtccccataccttagcagagcagctgcccagcagggcctccttctctttcctaagagtttactccatccatggtgggtgtcttggtaggcccgagatacgagagggagtgctgctgttacaagaatttacagttgttctcttcagcacagaaatgctgtaaatggcctctttcgatactagtttatgaaattataagtgtctgatgattgtgcatctttggtttcaacagctactctgacctacgacactctccggtttgctgagtttgaagattttcctgagacctcagagcccgtttggatactgggtagaaaatacagcattttcacaggtatcggccatgctggagcccaccctggtctgaccgcttggcctgcagaagcattttgtgatcactgttctctgctaactctgccataacttgtgacttgcaaacttaaggcgttgtgtgtgtgtgttttttttcttttaaacaacctctagaaaaggacgagatcttgtctgatgtggcatctagactttggtttacatacaggaaaaactttccagccattggtaagtactctgttttattacaacgcgggacaaaatatgtttttaggaaggaggaaaacttacgcttgtagatttgacttcaatatgccactgacttcatttgaatcttcacagcaatcctgcttaactgaattggccgaggcctcacgtgtagtagtggcaaagctagaatccacggcgcctgactctaggctagtgtgttttcaactgcaaatcccagcttattactggagctggaaatcagtatcatgagttatgaccaacgttgttttaaatgtaggacagaatgtcatagaaagcggtgtgtgtccgccacgggcacgcagcatggcgcttcagggatcttcgttttcgtttgcatgtttgagtgtgtgttctgggtcacagctgtacaatgtgtttcttacttaggtccagaatgtttggaagccattctctgtagccctcatcttttttagtattttccacacttaacctgtggggagatttgaagggccaggtgaatgtgacatgtttttatgtaacactaaggtgcattctgttaaaagccattcatcattgttgtataccctggagctggaaggagatggggactggttctcagccttgcctctcaccggcggagaactgaggccggaggtgagggccgggctggcgtcatgcttcctcagtgccaggtcagggtttggtccctcttctaggggtggtttcattctttatcctgaagtgaggtggaagtcaaatagccacaacggctggacattggagaacactgacgcgtagggacatacgacagtgtctccttaggttgatatttaatgatacaccttgtgagatgtaccctgggaatattgatatgtaatgatatattttaatgacataccttgtcagatgtgccctgggaatagttgctcattccacagtttccgcttgtttcgcagctgcgctgaacctgctctcttggccgccttggatgcaggtttgtccccagcctccatctccttcacagctaccctgccgcgtgctgggaaggagaacaggactggagcgaagcctttctggtttggcagaggccttgtggaggaggtagaggctggggatgagcctgcacatgaagcagccctgtcgcagttctgaagggcagtgtgctgtgtttccttcttagccccacggagataattttttaaaattattactttcatttttttaatagatggggtttcgctatgttgcccaggctggacttgaactcctgggctcaagcagttctccctcctcagcctcctgagtgtctgggactacaggtgcacaccaccacgcctggctctgagatacgtttttatcagcagtagagcgatcagcagtggagcgagggtgaccatgggcactgctgattgggttgttggtgggtgacggccaccactaccccaagacacagggtttattgtccgtgccagtgcatggagaagctgccggaagcccagaggtgggcacagggcgaaccttgtggtctgacccctgaatctctgcttctcaccctggtgtgcagccacctagcagcctcttgtctgctgcacaggtggccctctctgttgtcacagctgtgcagtggccttccactggacccctgctatgggctggcagtgtttcccacgtgcctgtcacatgccgcgcagttccatggtgcatgttgtccatctttctgggccccagggagtggccgtgagggcagggcccaggcacctgtgctggaagggctgagttgctgcccttgcggcccttcctgtgctctcagcagcactggatgtcatcaagcgtttgaatttctgcctttctgataattggaaaatgcgttgttttgtttaactttgcattttctggatgacttacgggggtcagtgtcttcatatgtttgtcagacattccttttgctccgtgactgacttgttcatgtgttttgcccattttgaggaggttgtcgggacatttcactctccagtaaatgtggcccttggcgttactgagtcctaagaggtgtgtgttgccccaggtggagctgatggaggagggagtcggtgcctgtggtgtgggactgaccggctgcctcctgccagtgggcttgtggcctgtggggccatctggccatgagcacttctctctctgtctgccacgacaggggggacaggccccacctcggacacaggctggggctgcatgctgcggtgtggacagatgatctttgcccaagccctggtgtgccggcacctaggccgaggtgagtcacagccctggggagggcgcatggccacggtgttctcaggaagcaaaggggactgtggggtcagggctctttagagcagaccacaggtaaaacagtaagtagaacttgggggtttcttgagtaatgagccacttgtttttcttgatttaaaaaactgactttaaagaatgctaataaatccgcatgggcaacatggcgagaccccgtctcacaaaaaatacaaaaattagccaggcgtggtggctcctgcctgtagtcccagctacttcggagactgatgtggagaattgctagaacccaggagatggaggctgcagtgagctgagatcgcaccactgcgctccagcctctgcaacagagttagaccctatctgaaaaaaaaaaaaaaaaaaaaagaagaagaagaatgctaataaatgttttaaattactgaaactgttttctgtacagatttgttttgataacttggcgtatatgtatttgaaatcctggagaacatgggtttttacttttaaaagattctgggctgggtgtggtggctcacgcctgtaatcccagcactttgggatgccgaggcgggtgggtcacgaggtcaggagatcaagaccatcctggccagcatggtgaaaccccatctctactaaaaacacaaaaattagctaggcttggtgacatgtgcctgtagtcccagctactcgggaggctgaagcaggagaatcgcttgaacccgggaggtggaggttgcagtgagccgagatcacgccattgcactccatcctgggtgagagagcgagactctgtttaaaaaaaaaaaaaaaaaaaaaaagattctgaaaaaggtttggatgccatctgtatctttagtgtgaaagtgaaaacttgtttctcatatttatggtagagctgacctgtaattttttttccaatagattggaggtggacacaaaggaagaggcagccagacagctacttcagcgtcctcaacgcattcatcgacaggaaggacagttactactccattcaccagataggtgggaggctgcagaatgtgccaggccccacccgggctgtctggagagggtggagtggtcggtttcccctcagagcttttctggtgtcgtgggatgtggagcaggaggctgtaaacctgtaaacactgacctctgaccatctgtgcgctgctgtcacatcacccccgtgtcatcccacatcacccccgtcccacccaggcccagaccctgggccttgcccttcctgctgtccatgcggcttgcagtgcctggtgctcggcacagtctggggaaattggcctcgccccatcagtgaatctgaatgctcagattgaagtggagtgagtaaagaagagttggcctttcttgcaagcaaggccggcttttgagcactgtgttttcacttatagaaggaagtggtcccttcatttcccctccttttctaagttcatagtgaaggacagtccctgagaccttgtttgccccctcatgcctcccccgatcttgttggggcatccttccgtctggaggctgggtcgggtgctgtccaggccttcctgtgacgtgtctcctggcaccacgtgccaccagaggtcagggctgggggcgggtgtgtgttgctaatgtgtatctgttccctgcagcgcaaatgggagttggcgaaggcaagtccataggccagtggtacgggcccaacactgtcgcccaggtcctgaagtatgtactgcgcttccactgctgagcatggggcagcagggatgttccctgggggttaaattctccttgagtcttcatggctacaggaaataaggggtctctaattatttacttcatggccctcagaaggtttctcagcgatgactgtgttgaggtcttgtgaataggaatttatgttttctaacaaaatgaacaccgtagtccacatcctggctggcacattggacccttgttctttgctgcatggatccacctgtaatggtggcttctgatggggtgggcagctgaagctagtctgcagccatctgtgcgggtgccgggcccttccacctctgcaggcttgttggaggctgccctccgcgggccttgccacctgcctttctcactctacccggagactccctgtagcctcgctcaccttcccatacacctcagcgtctgaaagtgtgctctgcacctgctccgcaccgcttcctttcgcacctcactcagccccattgcgtgcccgccccccagattcctctgagatgaccttccctgcagttccagaaacttgcctgtggtttcagcttcgtgtccactcttcactcctcttgacccatccagggtcatttggtctgattccatgtgtcctggcatcccagcatttttggggaggctctggccagatcccccaggacttgtcccctcagggtctcctccccactggtctgagggccagcgtctccccagcctgtcttcagccacggcccccttgaagcctctccttctgcatctgcctgttctgtatcccactcaaggccctcaggcatcccacgttccacattcctgaaatggccctgtctcccctcacccacagcctgctcctcagcatggcagtcactgtctccacccagcttttctgtcaggttccctggggtcctgcacaagtccgtctctgccacatcccacgtcacccgcgtcccacgtcacccccgtcccacatccccagcctgctgctccctctgtctccagggcccgccctgtgtttggcgtggcacctgctcagtccctactgcatgcccttcagagtcctctgtccagcagctccccagcccccaccacacccttccactcacacttctcttgctgctgcctggagtggccccaccaagtcagcgctgtttctctggaagcaccaggccactcgccatgctcgctgtttctcctggtcccctgcctgctccccaccagcccccgcccctgttgctggatgatcctccccaacctgcaagtgctgtggcactcaggcacatggacggcttccagggctgatttgtccctggactccaagctcaggtccagctgcttattctgcatttccacctgggtatctgtgtgcatggtgacctgacagccagagcccgtgctggccccagcctgcttctcctacagtggtccttcaggtgctcaaaccaaaatctgggattgttctagacccctctttttgagacggagtctcgctctgtcgccaggctggagtgtagtggcatgatctctgctcagaatcccaagtgattctcctgcctcagcctcccgaagtgctgggattacaggcgtgagccaccgtgcctggccaggactcctctcttttttctttttttttgagacagtctagctcagtagcctgggctggagtgcagtggtgcaatcttgggctcactgcttcctccacctcctgggtcccggttcaagcagttctcctgcctcagcctccccagtacctggaattacaggcacccgccaccatgcccagctaattttttcaatttttagtagagatggggtttcaccatgttggccaggctggtcttgaactcctgacctcgtgatccacctgccttcgcctcccagagtgctgggattacaggcgtgagccaccgcgcctggccaggactcctctctttcttttttttttttttattttttttccgagacagagtctagctctgtagtccaggctggagtgcagtggtgcaatcttgggctcactgctacctccgcctcccgggtcccagttcaagcaattctcctgccttagcctcttcagtagctgggattataggcacatgccaccatgcccaactaatttttgtatttttagtggagacaaggtttcaccatgttagccaggctggtcttgaactcctgacctcgtgatccacctgcctcatcctcccaaagtgctgggattacaggcatgagccaccgctcctggccaattcctctttatttcagtgggcccattcaaaatatcaattcctctttctttcagtgggcccattcaaaatatgtccagactctgaccagtgttcatcctttcactccctgtgctggtcccagccccatcttcttctttcttgttgatcttccttctctctttgtcatcctagagtctctttagcaaataacagcagagccatctgcataaaacatattggccactgctctgccttgaaccgccctggctcttcactgctgactcaggcggggctctacccgacctccctggcatgacacgttgtgctcctgggacacaccagcctcagggcctttgcatgtgtggtgcctggcacttggaccctgttcccccgacacctgcctgggttgcgccccatgtctgcccaggtaccctttggcaccaaggtcttccctgtggctacgttagtagtgccactccccgttcctgcgttactgttctctgcagtgttgaccaccggcccacgtggctgctgcttccttgtttgccctccgccaggtcagctttgccagtgctgctgtgtcccttgtgtgtgggtgcgtcttcggcactgcatctgggctagaggtgggaggaggaaggtggtgtgggagtggggcggggaagcaggctgtcctcccatcttcagcactgcagctgggctggagatgggaggaggaaggtggtggggcaggggggcagtggggggcaggctgtcctcccagtgtcccccctgggcttgtgcattgggaggggctctgtgtggtcaccccagtcccctgctccacccccacccagctcccctccacaggtcttgcattctgtccccgggagcaccaggtctttgctgcctcagggccttttctattgttttaccttttgttgaggtcctctgaccccacctccgccagacctgagatgagatcagagtcgtgttagacttttggctgcagaatctgcccttccctcagaaggggaaatccaaggccatggttcctcctcactggcgtgcacagtcgtgcttcccactaagctgcagatttctctataaggactcagattccttggttgtcagctcagcgtgtttggtggaggggagagcagagcagagcgtgaaggtgctgggaggcctgcctcaaagttggcaaaacccacagcgtctcagagctgcgttcatgttctagttcctgcctctgtgccagtgagaccagaaaaccaggccactcaaaagcctcttgcgtgtgctctctatgaatggaggctggggcaagggcaggacccctgggcctcaggcgagaagaagcagatttaccctcagctttcttcctgtctgtggcattggctgtgccccggattttaggagccttggcccttctcatccgagaagcacctctaacgcgaaccctccttcgcgcagctatagctgcaaagatgaaccgtctttgaattgtacaaaagcttatggtcattctcctactctctgtaggaagcttgctgtcttcgatacgtggagctccttggcggtccacattgcaatggacaacactgttgtgatggaggaaatcagtaagtggctcagagtttccatggacaagaaagttgaaatcacgggcaacatacacacttcctcgcctgagtccccacgggagcctcggcgagtgttgtcagtcgccccatgccgtgcaggtgctccgtggggcctgtgcgccaagccagatgcacggtggcctcgctctcctatcccggcggtcataccaagagaggagagcccaggctgtctggaggccgcgacttggtatctcacgtcgtgttttgtgtcttggttacaaatcgtttatgaaggccctgctgtgcttaggcgccctcgtgtgggaattctggtgaagttattttgcgtgccttgatgtgcgacagagagatgtagcaaccatctctagctgcaccatctcgagcaaaggcacgtcgtgaaggcagagctcttttcagctttctggaagaaaggtctgctgcaaccctgaaggaacctgggcgtggcaacatttacatctaggaggaaaactgtggctcagttttaacaaatgggctcattgagtgagttccaaattcatgtttcaccttccatgatgtagccaagctgagaactcttaaaaatgcctcattgcctttttcactcagggccacctttttcccaaggaacttctcaaaactccctcaattccaattttattgaagttctacatgtaggctattgccttgaatccaattttccataagaaagagctcatttaggccgggcgcggtggctcatgcctgtaatcccagcaccttgggaggccgaggtgggtggatcatgaggtcaggagttcaagaccagcctggccaacatggtgaaaccccgtctctactaaaaatacagaaactagctgggcatggtggcacgcgcctatagtcccagctactcgggaggctgaggcagaagaatcgcttgaacctgggaggcggaggttgcagtgagccttgatcacgccactgcactccagcctggccacagagcgagaatccgtcccccgccccccaaaaaaaagacctcattcagagccacagccgtaactgcgcacagattcacagtgggagtgggtcctgccctgtgactgtgggtgtgccaggtcaccacacaggtgtgtgctgggtcacagacacgccccttccctgcctctccattctgtttcttcatcgtctggccatcctcgggggcattgtgacacagcggagggagtgaggcaggactttataagggagagtgaggctggcttctgcagcattgagagctttgccacagcaggctctccttccaggattctgttcctcagagacttgaacttgggatcataaccaaagggtgtttgtttcttccatctgcctttttcctccattctgtttcttgaaatttttataaaacattggaaacacaggaagagtacaaagaaagagaaaaattattgattttaccactcagaaataactcatatgagcattttgacattcttactctcagtatttctcctgtgcttttcaaaaacttacatagtttcctaagtattttctcctggccatgagtgacagcattgtaattattaactggctacacaatatactattataccttagttccctgttcactgccccatcctccctcccgtgtttggggaaatcacttaccccctcgttccgcacgcgtgctcaggatctcaccaagtcacacctcagtccctggcctcggattagggaggctgttgctgggtgcagtggccaggaaggcgcaagggtcagggcttcctagaacctccgtccctctgggtgcaggtagcactggtgggagtgttgggggcagcttgtctgtgtggactccagctccgtcccttcgggagtctcagggctgcccaaagcagtgctgctgaaacgtggcttgtcagagtgagagtggagtcaggtcctggaagagcttgaatctgcatttcccagcccctggggatggtggctcccgggaggatgtggaggctgcctggtctgactggcttcgtctcactgcgtcagctgcctgaaaggacactgttcctcacaggagcatgtggaaggtgcctgatgcccccatttaggaagaaaggcatccacatccagccagcaaaggcactggcattgatgcacaaggcttgggtttctgggttcctgagtgtggcgtggtgttgtgaggaggacatcggggtcgttctgaatgacccctaccaaaagccccaggagggagtagtggggggagggcaggaagcaggctgcttttttcagtcgtgctgctaagagtgcgcaagggaggacgtctgaggaagaagtccgcaaagccgaagctagagaaacagacgtgtccttggctaagcaaggacttttcttctagtttctcggaactgcttgtggaaggagcagttagataggagaagactgatgccattcagaaattccactaaagcttcttcctgcagcgaaagagctgcctgacggtgttcccactcagattttaggtgaagcctgtggggtaaggggagaccttactgcctacagtgtccccatccaccaacccatcccccccgcaactcatccttctgtccacccccagtcaaaggccagccaggacatccttagcatgctcttcttgtccttaacgttgatgggcttagacctttctaacgacagtagacagaatgtcactgaatgtagggaggaaatacagattggaaaacgtgtcagtctggcagtgaggacaaatgactccaatgaaagaaaagtaaataccagagcaagcacagtcagaaacagagtggggaggagaatcacaatagctggaactcaactctctgagaggcagtgcagccaaatagaggcagctgagagcagagtatgtggattagaacttttcgggagagttggccactgaaggagtaggagaaaattcccctgagttggtgagagttgagtctttagagctaaagacccccaaatttttttatcagaagtacttaaacatacatgttcctgataatatttccaaattgcagaagtaaagggaaacttctctaaacatccaaataatagtatcactactaagctgctttgaagaaaggcagtctcaactggcctgggcatctcatctttgtgccataccaaatgctactggaaaatgtttagaattctgagaaaagacctggcttcatgaggtgagagtaggtatgtgtactgtgtagttgtcattgatagagaaatataaattttaaatgtgttcaaaatataaagagaacacgagaaaatttcaggtggtggcaggaataggcaaaagcccgttgcaccctgttgacagcagggtgtttgtgacgtggtaggtcacacactcagtgctgggctctggaggcacagaagcaaccggcccagctacgcatcagcccttgagccgattcatgtgttcgatcatattcctgagacagtagggtctgtgcaggtaacaaagcaccagtcagcaggaaactcaccaccgggaagcctttctatcaaaacataacttcaaaatcagtaaagtgggccgggcatggtggctcacgcctataatcccaacttcaaaatcaataaagcgggccgggcgcggtggctcacgcctataatcccaacttcaaaaccaataaagtgggccgggcgcggtggctcacgcctataatcccaacttcaaaatcaataaagcgggccgggcatggtggctcacgcctataatcccaacttcaaaaccaataaagcgggccgggcgcggtggctcacgcctataatcccagcacttcgggaggccaaggtgggtagatcacatgaggtcaggagttaaagaccagcctggtcaacatcgtaaaaccccatgtctactaaaaaaaaagttagctgggcatggtggcacgccctcgtaatcccagctgctcgggaagctgaggcacgagaattgcttgaacctgggaggcagaggctacagtgagctgagatcatgccactgcactccagcctgtgtgacacagtaagactgtgtctcaaaaaaccaaaacaacaaaaaataataaaaatatatagaaaacagaataattaacagattagctatggaaagatcaaagctacaggggacccagataacacaacaggcagagtttagtagatacgtgtcaaaccctagattgtgacagcagagtgtgcctgggaatttctatgaaactaatgcggaataaaatgaaaaaaggacaaaaccctgctgcctggaaatgtgaaacctcaaaaaagtcaagtgtagagaccgtaactatgtatctgaacctgatgtgtacagaactcagaagaaaacctgtgtatcttcagtactagtatatgggttctttacaaagtgaaaattaatgaaataagcatacaactcaagaattcggaaaaagcaaaattaactgaagaaaccaaagaataatattaaagacaaatacagaaattaatgatttaaaggaagaaatgtattaggccaggtgtagtggctcatgtttgtaatcccagcactttgtgaggctgaggcaggaggattgcttaaagccaggaattcaagaccagcctgggcaacatagccagacgtctattttttttttttttttggaacagttctgctctgtcgccaggctggagtgcagtggtggcacgatcttggctcactgcaatttccgctgcccaggttcaagtgattcccctgcctcagcctcctgagtagctgagactacaggtgcatgccaccacgcctggctaattttttgtattttagtggagatggggtttcaccatatttcaccatgttggccaggatggtcttgatctcctgacctcatgatctgcccaccttggcctcccagagtgctgggattacaggcgtgagccaccgtgcctggacctcattctataaaatattttaaaaataaattttaaaattaaatttattagaactaacacatactagaactggctctttgaagcaataacatatatgttttaaaaaaatcaaagttaaaatccctcccttggctaagcactgtggctcccgcctgtaatcctagcactttgggaggtggaggcaggcagattgcttgagtccaggagtttgagaccagccgcctaggtaacatggtaaaacctcatctctacaaaaaaacaaaacaaaaaaactagccggacatgggggcatgtacctgtagtcccacctactcaggagtctgaggtgggaggatcccatgagcctgggaggttgaggctgcagtgagacatgattgcaccacttcactccagcctgggtgacacagtaagaccctgtctcaaaaaccaaacagaaacccaaacaactcccttaaggctgggcgtggtagctcctacccataatcgcacctctcagggaggctgagttggaggattgcttgagaccaacctggacaactccctctctataagaaatagaaaaatgaggccaggcacatggctcatgtctgtaatctcagcacttcgggaggctgaggtgagcagatcacttgaggtcaggagttcgagaccagcccggccaatgtggcaaaaccccgtctctactaaaaatacaaaaattagctgggcgtggtgacacacacctgtaatcccagctactggggaggctgaggcaggagaattgcttgagcccagaaggcggaggttgcagtgaaccgagattatgccactgcactccagcctggacaacagagaatcggcttcaaaaaagaaaagtcagggggcacagtggcccacacctgttgttccagctactcgggaggctgaggcgggaggattgcttaagtgcaggtgtttgaggctgcagtgagctgtggttgcaccactgcactgcagcctgggtgacagagtgagaccccgtctctaaaagaaatttaaaaagttctgtctcagaatccttgttttccagctgtctgttttgagaaatttgagtcctacaaaaaagttcagtgagtcatggccacaaaccctccacctagatccaccaattgtgttttgacacgcttggtttttatgagcaagcctcctacgaatgagagtgttcctgagagccacacagcctcatcaccacaaaagaggtgacgccacgactcaccagggtccgtcttggccccttgctgtccagggaacaacccgtgccgctgatttgtgttcctggttgagggtccggtgctgtgtgtatatagttgtgatgtctttctagtctttaattgagaaggttctgcctctttgttgtggttgttgctgctttgtggcatttttgacgagttcaggtcagctgaccatcccacacgctggatttgtctgcttcctcacagttgggcttgggttgagcctgtggctgagagtagcctctgggtggcagtgtcctctgctctcccatccggggcctgcagtgggacactatgtcagatccccggagatggtgtcttttttcctttgtaattaatgaataatccagtggtgacactgagcatgtcctggtgagctgtgtgactcctgcctgataatggtggtttttctagcctgtcctttcctttcacgtttattggttggcgttctgagaagagccgccttttctcccatcacttagtgtgcagtgtgctacctgtcacctgtctgtcacctgtcagtcactgtcacctgtcactgtcactgtcacctgtcactgtccatctttttgatgcttgacggttccacctttggccggtggccacctcagtctggtggtgtcttttgccgtgttctggcgtttttcgtttatgttttgagccctcccttatgttctgggttaagcagatgctgcaggcacctctgaacattccctgcctggccctggaatcagcctggctcctctgagtggggagtggtgttgagaaacctcgatctagacgccgggcatgctccatgctcccggagtgtcttctcccatcaccgcaccctccggttgatgtgtcctccggaccattgactcacgggtgtgtgtaggcagaaggggtggaagcgaggaaaggcgttgctgaggaggcccggagggagcgggttctggctgtgctggcactagccaggctggcaggctgcgtgggtacttctgtgattttcctctcaagtgcacgtggctttttcttgcactgtttcgtgtgtgtgctttatttcacaataaaactcttgaattaagtatgcatagaaactatttcttttttctctgggtggcaagattatgaaaaaattttcttacgcttttctatattttccaagtttgaatttcactgtaagcacctggctttgtaccgccctttttctgttacacagtcatcatttgcttgcttgttgtgggagcacttttgcacaggtctgcttggttagtgaaagcatgtctccctttctaggaaggttgtgcaggaccagcgttccctgtgcaggcgccactgcgtttcctgcagattccgaccggcactgcaacggattccctgccggagctgaggtcaccaacaggccgtcgccatggagacccctggtacttctcattcccctgcgcctggggctcacggacatcaacgaggcctacgtggagacgctgaaggtgggtcctgccgtgcggcgcttgccctgagtccccgtccccttctcccagttcttagtcactttcagcgcatcgtcgtcacgtggccatttgtgcagccggctctcgggggaggggtaaacaaccctggtttacaccgttgcccaaggggtgagtgggcgtgaggcacgtccatcagtaggcacgtgctgctttcgttctgcaagtgtcaaggcgagtgtcgaggatgaaagcatgaggcgcttgcagggggtccttggaaccaggtgccactcctcggcctgacggggagccccgccccctcccgggtctccactgtgccccaggcatgcccaccccactcccccacagccctcttggcctgaggtcccttcggagggtgggttggcctgtgaggaagggacgtgtgggcagggcctggggatgggcagggctgtgtgaggagctccagccacaggctcccccatgtcatgaaagcaaaagggggcggggagcggtggctcatgactgtaatcccagcactttgggagggcaaagcgggcagatcacgaggtcaggagtctgagaccagcctggccaacatggtgaaaccctgtctctactaaaaatataaaaattagccgggcatggtggtgcgcgcctgtagtcccagctacacaggaggctgaggcaggagaatctcttgaacccaggaggcggagcttgcagtgacccgagatcatgccattgcactccatcctgggtgacagagtgagactccatctcaaataaaaaaaaaaaaaaagcaagcagaagggaaaaccatcctttcttcaggtaactcaaattttagaccaaggagtcacatttgtatggaactgaaatgtggcttcctgttaaaattattcagttgtctgaacttggcccctccgtccagccttctgcccatcctgtggggtctcagctgcccccacacataggccccgtctccatcgcttctgccctgtcaggtcaaagcactcagcagggccacctcccgcacccctgctcacatctcctgccaggccccctcactcccggcctccccaaagcccacctctgacatgaagcttccctgagctgagcctgcagattgggtttcttgtgcctgtgggatgtcctgtggtctttcctggacagtaagctctttggtaccatgtcccctcctgtcccctcttgtgtcacccagttgggcctcagcaggcccttgggccccctatggcagtgggtggggggaccgtctgctcccacctgggacctgtgctcagtcccccgcccctccacagcactgcttcatgatgccccagtccctgggcgtcatcggagggaagcccaacagcgcccactacttcatcggctacgttggtgagtccagggttcccaccgtgtccctgtgggcctgggccttttaagggcattccatgagcaggtaccacaccccaggtgaccacttgaggccactggtggaaaagcagcatgccctggggttcattttcagcctggtcgcgggcggcctcctgtgtgcccctttccctgatggtctggtgccctcggctccctccccacctcctgcccactgcttctcagtgtgatgtgggtgcagtgggtctgaaatgcggcctcctctgtccctttcctctgccggctcggccacccacctgcccacctgcctcatcctcccaggtgaggagctcatctacctggacccccacaccacgcagccagccgtggagcccactgatggctgcttcatcccggacgagagcttccactgccagcacccgccgtgccgcatgagcatcgcggagcttgacccgtccatcgctgtggtacgtggcggccacctgagcacacaggcatttggtgctgaatgctgtttgggaatgacgaggaaaactttcggatttttgcgttttttttttcagcatgttgggataagtactgtgttcacgtggttgggaatctgaagggtataagagccggaactgtgtccttgcaccctcacgtccctcccccaggcaccacctcctgtgcagccttcatggccttcgagtggcccagagagcgtgtgtctggatgtgagcgtgtgtgggcgcgtgctgagtgtgcatggatgagtgtgagccatggtgagtgtgtccccctcacacctacatttaaacacacgggcggcccctccacccacccctgcaccaccttcgtcacacccacatttaaacacgggcggcccctccacccacccactcctgcaccaccttttgttttccggaggctctgacttgacctctctgggggatttcctaagaaggagcttccctgtttttccattttgattacctagttgtgatttttggtgtgtgatttatgcagacctgcctgccctcaaatatatttgatggggaaagaggccaaaaaacccccctagaaatcatgaatgacggtgacatgctcagggaagcagttaaccgaatcgggggctctgttgtggatgctccgccccatttaggaggaagaaggcagatctgggcctgaaatgggacggtctctgagctgtggcgcagccccagagtgcacaccacgctccatgcacctcctgggcagggtggcagtagtggggaacatgggctggagctctgtggctcacactttttgtttgtttgtttgtttttgagacggagtctcactctgtcgcccaggctggagtgcagtggcacgatctcggctcactgcaagctccgcctcccaggttcacgccattctcctgcctcagcctctggattagctgggactacaggcacccgccaccacgcctggctaattttctgtatttttaatagagacgggttttcactgtgttagccaggatggtcttgatctcctgacctcatgatccacccacctcggcctcccaaagtgctgggattacaggcgtgagccactgcgcgcagcctggcgcacacttcttaccagaacctagtcacgaattcctcgtcgaactagaattaggtatgtttgttactgtaaacgcagcttggtggcttacagtgattggcactctaacagtcaggtcaggctagagagccagccaccgcagacagaggagtggacgcgtgaacgttgagttgagaccaaaggggccacctggtgggataactgtcctcacccgtgaggaggaggaatgtcccctgtccccgggggagagtgctcctacaccagcgccgaggcggcagaatggtgtcttcaggggaagagagtgcccagtttgagcttctccccccatttcgtttctttttgtgttaacatctgcgcatctggcagcgttgagaattcctagtgactgtcattacaggcggcagctttaaggatgtgattgccggtgacccttggccggtcccctgtctcctggctcctcagcaggaggctccctgtgtcacggtgtccttgggcagttctcggtggcctttgccgccaagcttccagggagctgctgggcgaaggctgagacccagcggccctgcctcacagtcacagagagaagagctccccacttggccctaactcataacctgccccaatcccggaacactcggtgaggtttgagagatgcacaccacgtaacatctcgtgggcgaatcaaggcacagcaacgcagtggagcctgaggggagccgggcactggtgcaggggaccatgcacagggcaccctcggagctccgttcctggccacaggagccaaggcaggctggaatgtccagcacctgcatgctgggggcctctgctgcgccactggcagtgggaatggaagcccccacctcttagccgactgcagatgggggtgtcgtgttctgctcatcgtcatttcgttttaggggtttttctgtaagactgaagatgacttcaatgattggtgccagcaagtcaaaaaggtttgtagccgccccacacccacagccgagctgagccacccagggagacaggcagtggggcgtgcaggggtcgaaggcctgcgtccaggtctcaggcagcctcactgggccgtggggagctttgtcccgcctggcacagctatgtagctgagcagggtggggcgtcctggattgcccatctggcaacacagttaacaaccctggggacggatgttgcgtgttgactttagaatgggatttccagtgtcctcatccgtctcctgttgagatgggggtggtgatggggtgctgagctacgccggccgagtgcgtgtggcccacccccctctgccgtggtggtcagactgtgctgtgtgttgatcaccacactgggttctcgtgtagcctttagtgtggagctgcctctgttttctcatcagtgagatgggatgacaggtttgtccgctggctgtggccggctggcccctttctcttggccgcagcaagcactggggtgaggctgcacctaacggccatgtctcactaacagctgtctctgcttggaggtgccctgcccatgtttgagctggtggagctgcagccttcacatctggcctgccccgacgtcctgaacctgtccctaggtgagagctgccaagtccaggtggggtccctcggaggtacgatctgtgcccttgcttccccagtcctggcccccttggttttgaccattaaggtgtgtgtgagcctgagccgtgagcacttggcagtggttcgcctgtgagaccaggtatggagtggagcgtcccctcctccaagcttgcgcccagcagcccaggacccacctcgtcttccccaccagcgctgcctgcccgggcgctgtggagctgggcgtgctaccatggagtcctcaggggtctggagcagacagaacatgcaggctctgtggtgacgcagtcctgggtgggggactggttcacttgggcaccactggccatgggtggcgtagacccctcggaccatggccagcgtgccgcaggagccggcctgggctcgtgcagtgaagtgagtggccgtgagcgcgtcctcctcatctctgtctccctgtgggaaactctacaaacaaggcaatggcaatggaaccactcctgatgaccacgagggtcagacgcgggacagaggcccctcaggcctgagattgtgccggccgccccctgccctcctcaccctgccctgctcctcttctctgctccctccccccatattcgcaggtctgcacaacccccggacctgttcacacccgcatggggacagctgtctgtgggctgcagagcaggcactgctcagtctgccccacgccaagggcccttgactcacacccaggtggcccacccaagatgcctgatgcgctatgtcctgttccttctagattcttctgatgtagagcgactggaaagattcttcgactcagaagatgaagactttgaaatcctgtccctttgaaaatcctggggtcgggggtggcacctgtgagagcctggggctcctggtgccgctgcgtttcatccatcccgcccgctcgcctgccgagggctgcgccccgtgctgcctccccccagagggccacccgctgtgctcgtggactgaggctgcgctgcccgggaggccttactgcttggtgtcagactgcccagctcagagtgcccgtcagggcctgtgcatccgcacgcggagccgtctgttaggagcttccagagtgttctctcgacactgccagccccgtgttagcacctgggcctcagtcccacttgctcccaggcgccggttctgtggttggtttggaattaaagtcctgtttgaagttgtcagacacagacatgaatttctgggcgctccctgagtcagagtctcagaagacctgtgcaggctggcgtgagaggagcggcagccacactgcggccccacgcccaaggactgggctgctctcgaggggggcgcgcccaccgctgtgtcctctctgcccagcctggcttaccaagggctacctcagtgggagatgaggttggaggaacgaaggcgaggttcctccttgctttggggagaaaagtattcaggaagtgggtgtgtgggaaacctgaagatggcgtgcacaggacacagcgtgggcggcctgggcagaagggcggctggctgtcctggagctgctgctggagcctgccctcagagtgtccctttccagtgctgtggcattctgtggcagcttccccaggtgtggtgacggggggggggcggggcctccacctgtgacagccaggcttgagggtggacggcgtgcctctcccaggagccttccccatgtccttgccttgctgagaattgccctcccatgccgctgaggtgttaggtggtttagggccaaaaggggaaaaccacttgagtcttgtggtgtgtggtgggcagacaccacagggtggcatcacctggtggcatttccagaacctcagccccgattccagcacccaccaccgcctgaccctgtgtaacctgctgtcccgggtcccagagtgcactctgccccgctgctctgctgcctgtcctgggaaagtatctttgccccactaggaaatgtaaacaggagggcttggggagcgtgggcacttttctcatgagcagctactgcggcgttggcaggactcgctgctgctgctgctgcttgtgtaggtcggggagccagagatccccgaggacgcgcgccggacagtcggcactgaccggcccacctggtagcagaggacacccccagccccccaagcattgaagacatagtgtatttcctcgtatcctttctcccttgggtgtagttggggtggggaagcagggaaggctggtgcgatctccattccttgggctccacgtccgagttcatggtgcgccgctgtgctgggagctgcagtggtaatgtgtgggacaccttgaccaaaggggagctttgtctcgtgtgttttgaaaaaggcttaatgaagagaatgttgttcattcttagtagtatagtttgcaattcttaatggcaaataataagtttcagtagaaaac

SEQ ID NO: 36677 - DNA, 98593 bp, Homo sapiens
ggaagggatgggctcgcgctgccgggcgtgggcgtggactcgggcgtgggcactggcggagttccaagcccgggctgaggagggggcggcggcggcggcggcggcggcgggcgggtacccttcgactgggcgttgccgctgttccctgcgcggcatggaggggacggccgtggccgtgttcgaggtgatgctgggaagggagagaaagcggaggacactttctgaggagacgggctttgtgaggagaccgcgaagtttgggcagaggggtcgggcgtcgcctaaggtgaaggaggaaggttcgggaatcgaggcccgtctcccacggggaagcgaggaagtaggagcagatgagggctctcgctcgcggggtactctgtgggggaacgacgccctctctccagcctacggctcagaaagctgcggcgtttgccgagcaccggcggacacccaggggcagagcctgacgcagcctcggaggtgcctgccggagcccagcgccttccatgcaccgggtgctgggagggggcgcggaaagaaggaaaggaatggggcaagccctggcgttgcggggcggggtggggggagtcggggcgccaggacagaggcaaggagggacccagtgcagactgggagcgagggagagtttttttaggccccggtgcaggtgcaggtttctgggttcgaagcagctggacgtggaagggcgaggttcagaggccacacctgtgctcggggagctgctctggaagacggcactgagcgcctggcgccggccacgccccgtgtgctcatttcattacccactttcacggccggtgcccaatgggacgttgagctgctgtttgtgaggggtactgggcaggtgacagaagcacaggctctgagggcacctgagagagtacccccgggcgtcctgcctgtttgttgtcatcaaagaaggcggcgggattccattttacaaataaccgaacctaggctagaacccagggcgctgactcataggccagtgttcttttcccaactgcgctgtcataccgacatgagaatatctttagggtttgtttgtttgtttgtttgtttgtttgttttttgagacggagtctcgctctttcgcccaggctggagtgcagtggcgtgatcccggctcaccgcagtctccgcctctcgggttcaagggattctcctgtctcagcctcccgagtagctgggattacaggcgcacgccgctacacctggctcatttttgtatttgtagtagagacaggttttcaccatgttggccaggctggtcttgaacttctgacctcaagtgatctgcccgcctccgcctcccaaagtgctgggaccggcgtgagccaccgtgcccggcccgatatgggaatatcgtaacagaggacgtgtgaaggaatagttagactctacacgtacctggaaaccattcttgttaactggtacaaatgaggatcttagttcccagatctccctgcctttaaaaagggggtaataattttccttgtgttgcctccctgtaaaagtgagaatctgtttgcatgaataataatgggagttggccgggcgcggtgggtagcctgtattctcagcactttgggagaccgaggcgggcagatcacttgagatcaggagttcaagaccagcctggctaacatgaggaaactccgtctctgaaaaaaatacaaaaattagcggtggctcacgcctgtaatcccagcactttgggaggccgaggcaggcggatcacctgaggtcgggagttcaagaccagcctgatcaaaatggagaaactccgtcactactaaaaatacaaaattagccaggtgtggtggcacatgcctgtaatcctagctacttgtggggctgaggcaggagaatcgcttgaacccagggggcggaggttgcagtgagctgaggtcgcaccattgcactccagcctgggctacaagagcaaaactccatctcaaaaaaaaaaaattagcagggtgtggtggcaggcggctgcacttccagctacctgggaggctgaggtgggaggatcacctgagcccgggaggttgaggctgcagtgaaccatgatgatgccatcactgcactccagcctgggagtcagagtgagactctgtcccctctctccccccaaaaataaatgaaatatattttattttcaatttgtctcgaataaatgtgtttttttttttctttttgaaacggagtgttgctgttgcccaggctggagcgcagtgacccaatcttggctcactgtggcctccacctcccgagttcaagcaattctcctgcctcagcctcctaagtagctggggctacaggcacacaccaccacacccggctaatttttgtatttttagtagagatggggtttcaccatattggccaggctgatcttgaactcctgacctcaggtgatccaccgcctcaacctcccgaagtgctgggattacaggtgtgagctaccacacccggtcgattaaatgttttacccagacatcttggagtcctgttcaacttaaaatattgtgtgtagtctttactgcattagaacttagaaataatagctaatatctgttaagcatttgctatttgccaagtactgtgttaagcattttgcacatatttttatttaatttttttttttttttagtagagatggggcctcactatgtttccagggctcaagcgattctcccaccttggcctcccaaagtgctgggattacaggcatgagccactgcgctcagcgttgcacgtaccttatttgtttactttcagcagcagccctatgtggtagttttatccccattttaatagatgaggagtctgtggtttggagagattaagtaatttgcccaaggtcacatgctagaatttggcacatcagggattcaaatccaggtgtggagtgcagtggcctgatcagggctcacttcagcctcaatcttatgggctcaagagatcatcctgcctcagcctccccagtggctgagactacaggcacacgccaccacgctgggctaatttttgttgttgttagtagagataaggtctgcgtatgttgtccaggctgatctcaaactgttgagctcaagtgatcctctcacctcggcctcccaaagtgctgggattgcaggcataagctaccgcgcagggcagcattagcactcttaaatagtattctgaccctcaaaagtgttgatttaatgaaagatcaagatgattcataaccagatgccactcttattcatagtcttcatgttggcttttatttggggcaggaaaaaagaaacaagaaaaacaaactcccacttaatttttccctaattattatttccagatgaatttatcttctgaataaaggaatttattgtctcaatttcctgtcttactgggcattatgttgaatttcactgactcttttcttatgtcactctcctagctatttattttgtttagacacaatactctgaacaaacctaaatctgacattttagaagcaagaatacaatttttggggggaaattagagttactaatttaactgggtcatagagatgtattattactgtgatttctaaagaagattatgttttctttgaattgtgctcttttcagattttgagatttttaataattcactggaagtgtgacatagatgtatcaaagggagcattgctagaagggcagctagtgatttccatagaaggattaaattctaagcaccaggcaaatgctcttcattgtgtaacaactagtaagtagagaaagaaaaaatattttctatctcttttgtcatggtttatgtcgtagcttatttaaaaatttcaattagaatcttttatcatgttattccaggattgttccataattataaaatgaaatgattatgtaataagtgtctggtggtagatttacaaatgtatcatacaggaaaggtgagtagttgaatgactcttaccatagattatttattttactggtttaagttaaaattgctcagaaacaatcttatttttctcttgattttaatctactttgtcacagctaaattatattacattgagctttacctactttttttttcccaagtctaaattttggcagtagcaaaaaaaaaaaaaaaaaaggaaaaatgatgaatggtgcatactgtgattagtttgaaaatatctcttccatttggctttcatgcttttatcatttttgcctgttgtctttgagggaaacctgatgcagtgagtggctctgaagcatgaattttcttaaacttgaagtgttagctttttgtgtgtgtgtgtgtggtgtgtgtgtgtgtaggtttattgaagggtactttggattgaagttgccccttcaggcttagagaagtcacttgggcaccaagttgagattggatagtgaactaggctttacaagacatttgcttacctgaacaggaatgacctgtcttgtctttgtgtattaatattaaacatcttcaagagcagtatgacaggttggtttgctcttactctgcatgaactgcactctgactggcagggttcccaccactcttgagagaaatgcttggctacgtgtctagggtgatggttggtctgtgtgtggttgtaatagtctaatccaataaactctggccagggtagcaaggttgatttaattcaaagcaaaggactttagccacagtagtttttggcaagaaactcgattctgcattttgagcctgatgaacttctttagcccacctagaatagggggcatttctcttctctttattgtctctgagctttaagtaattatggttataattatttatttatttatttagagatggagtctcactctgtcgcccaggctggagtggcgcaatctgggctcactgcaacctctgcctcctgggttcaagcaattctgcctcagcctcctgagtagctgagattacaggcagctgccaccatgcctggctaattttgtgtgtgtgtgtatttttaatagagatggaggtttcaccatattggccaggctggtctcaaactcctgacctcaagtgatagtgatccacctgcctctgcctcccaaagggctgggattacaaacgtgagctaccgcacccagcctatgtttatatattttttttgggtaggaaacgtggtgatacatgcttgataaaaaacattacagaaacatatattgtggagagtgagactttctacacatctcacgcctttgagatgattattaacattgagtatatattctagattttcctttttccccctacttgccaaggataatctgtcttctagatttttctatgcctacgttcttagttatcaatatccattttttagaactagaactatactatacatatgactgtgctatgtaccagtactttgtgggcagcatttcatgttagcataagggatctatttcattttttttgtaaaaaaatgtacacttatttagttttagtttttgtcagttacacacacatatggttttggctgggtgtagtggctcatgcctgtaacaccagcactttgggagtctgaggtgggcagatcacatgaggtcaggggttcgagatcagctgtccaaaatggagaaaccctgtctctactaaaaatataaaaattagcgggttgtggtggcacacacctgtaatcccagctactcgggaggctgaggcatgagaatcacttgaacctgggaggacagaggttgcagtgagccaagatcgcaccactgcactccagcctgggtgacagagtgagactccatctcaaaacaaacaaacaaaaaacccgacagtaccctgcgtgcttcccccatctctcccttcccatctttctccctcctagaggctaatacttttaactctgttaattgattatttaatatttatctttgatctaagtaacatgtttgtgttgttgtatcttttttttttcccccaaatatggtctcactctgtcacccaggctggagtgcagtggcacaatcatagctcactgtaaccttaaatgcctgggctcaaatgatcctcctaactcagcctcctgagtagctaggactacaggcatgtgctaccatgcctggttgttttatttttgtatttttctagagacagggtctcttgctatgttgcccaggctggtctgaaacccctgggctcaagcagtcctctcactttggcctcccaaagtgctgggattgcaggtgttagccaccacgcctggccaagatgttatttatttatttattaatttagagacagggtcttactctgtcacccaggctggactgcagtggtgcaatcactgctcactgcagccttgaccccctgagctcaggtgatcctcccacctcagcctcctgagtagctgggactacaggcatgtgctaccatgcctgactaatttttgttttgttttgtttttgttttttgaggcagagtctcactctgtcaccaggttggagtgcagtggcgccaggatctcggctggctgcaacctctgcctcccagattcaagcgattctcctttctcagcctcccaagtagctaggaccacaggtgtgcaccaccacgcccagctaatttttgtatttttagtagagaccaggtttcactacgttggccaggatggtctcgatctcttgacctcgtgatccacccacctcagcctcccaaagtgttgggattataggcgtgagccaccgtgcctggctgactaatttttttttttttttttttatagagatgaggtctccctatgttgcccaggctggtcttgaagtcctggactcaagcgatccacctgcctcagcctcccaaactgctcgaattataagcatgagccattgtgctcagccctaaattgttatatcttaattttcctttttataggcatttattgattttccaccatagaggatgatggctctctttaatatcttcacctctaccatgtgtctttcttttaatatagttataattttccaaccacgtagatcaatatttactcatcatgaccataaaatgcagtttagccatatagaaaactatgattacttttctttataatttcccttcagttaatacttattttattttctgtttttatcatctagtcaactcgcaaacttccagcatttgtctaaatctactcaatatattccagtacatcagataatatatcagtttcatcctcctgaaaaactcttttccagtgtatcctgacctgctctaattttgacttgatgctttctgtatctggtgcacagctgttaccttggaatcttcccttcatcattattcagagtgtttctgtagtttttctcttgcattggattttgtgcttcctgaatccctctctctctttttttttttttttttacttggcttactccttgctttgatggatctcaggctccagtagcttccttggaaagagtgtttggaaggtaaatttcttgagaccttacatctctgaaaacatctccacgtatacctaattgatagtttggccatataggattctaagccagaattcatttttccttcagaattttgatgacattgcagcattattttctaacttaaggtgttgctattgaaaaatctaaaaatctttctgattactctgtatgtgacctgttttttcttttttcttcccctctgtgtaagctttcatttttatttttttgagatggagtttcactctgtcacccagggtggagtgtagtggcatgatctcgacttactgcaacctccgcctcccgggttcaagtgattctcctgcctcagcctcctgagtagctgggattacaggcgttacaccaccatgcctggctaatttttgtatttttcatagagatagggtttcatcatgttggctcggctggtctcgaactcctgacctcaagcgatccacccacctcagcctcccaaagtgctgcgattacaagcatgagccaccgttcccggcctctctgtaagcttttagaatcttctctttatccttgtattaattacagtaaataagggtaggtgctataacaaaccctaaaatctcagtggcttggccaggcgcggtggctcacgcctataatgctagcactttgggagggtgaggccagcggattgcctgagctcaggagtttgagaccagcctgggcgacacggtgaaaccccatctctactaaaatacaaaaaattagccaggtgtggcagtatgcggctgtagtcctagctactccagaggctgaggcaggagaattgcttgaacctgggaggcggaggttgcagtgagccaagatcacaccactgcattccagcctgggtgacagagtgagactccgtctccaaaaaaaaatatatatatatcagtggcttaacacataaaatgtttagttttcttgtatttcacagtcagatgaatgtgtgtgtatgcaggcaagcaggcaagtattttgttttatgctatctctgtcttgcgggtgtatccttctctaagtcctctaagttctctccagctaaggatggggaaagagagcagagcttataaatggaagacttttatggggtaggctcgggaattggtatgttactgctgctcacgttctattggccaggacttagtcttttttttttttttttttgagacagagtctcactctgtcacccaggctggagtgcagtggcatgatctctgctcactgcaagctccaccccctgggttcacgccattctcctgcctcagcctcccgagtagctgggactataggtgcctgccaccacgcccggctaattttttgtatttttagtagagacgggttttcaccgtgttagccaggatggtctctatctcctgacctcgtgatccacctgccttggcctcccaaagtgctggcattacaggcgtgagccaccgcgcccggccatgtttttatgttttttaagacagagtctcattctgttgcccaggctggaatgcagtggcatgatctcggctcactgcaacctccacctcccaggttcaagtgattctcctgcctcagcctcctcagtagctgggattacaggtgtctgccaccacacccagctaatttttatatttttagtagagacagagtttcaccatgttggctaggctggtctcgaactcctgacatcaggtgatacgcccagctcagcctcccaaagtgctgggattacaggcatgagccaccacgcctggccaaccaggacttagtcttattgccacagccctgcagttgcaaggaagactgaaaaacgtagtcagattatgtgttcaggaagaaggagaatggggtatttgtttgcgagcaccagcagtctctgctgtggtctccattgtcacaatgatgcacctgggtgtgggtgtgttttcaaacattgtgctcagcactcagcaagacttttaaacctggaaacccttgttctttggttctgggagattttcccttgcattctctcttttctttcccccctttctgcaacttctattatttagatattagacttcctagactggttctttttcctttttaaaatcgtttctctcataatttttatctcttctactttctaggcattatctttttgagtatataaagatttttttaaagttttcttttctccacctcgttcttgtttcccttgtattgcttttcttagtctggtgtctgttttcatgttagaagctttcttcaaatatcttaaaattactggttgctcatttttaagagttagagactataaagctgatttgaaattttagcatcactaaaaggtgatctaattgggcttttaactggggaactttctcttctcttcaatatcaatatctttaggtctttgctcttggaatgaccagatctttcagtctcttaccaagtgggtaaaagccagacttgattctgggaatgagagagaaaagggggtattgggtatctcagcattcaggggttctgttcactaactccacttgtttttagtacaattttgattctcgtcccaaagattgacaccttgaccattttcaagtatcttctccccaatccacaccaaagttagggaggagccagtcccttgaatgctgagtggaggagggaatctaaagatttatttaaattcatttttcaacagactctccttaatttatcttctacctcacccatacattcagaggttcctgatactgccatgcctgagtgttttgcaattttattatataaatcaggttgtttcttggccttccctgtccccttatacttagattactcaggtctcctaaatcctttcctactagtcgttctgctttgtagtttctagattttttttttttttttgatatagagtctcactctgttgcccaggctggaggtgcagtggtgtgatatcagctcacttcaacctccgcctcctgggttcaagaggttctcctgcctcagcctcctgagtagctgggcctacaggtgtgtgccaccatgcctggctaatttttgtatttttagtagaaacggggtttcactatgttggccaggctggtgtcgaactcctaacctcaggtgatccacctgccttggtctcccaaagtgctgggattacaggcatgagccactgtgcctagcctgtagtgtctagatttttattacaatcatgtttgtctcttgttttccatccttgtgggtttgtgcccttataaatctcttttctattattttattgaggtttcaggagggaatgaaaataaacgtgtgtgttcaatcggctgtctttacctggaagtgtgcagtggtatcttttaaatttggtttgaaatctctgctctctagggctgctgtaacaaagtaccacaaactggatggcttgaaacaaaatatatttattttctcacagttctggaggctagaagtccaaaatcaaggtcttggtatggttggtttgctctggagactcagaaatctgttccatgcctctctcctagcttctggtgattgctgacaatccttggtatttcttagattgtaggtgtatcactccctgccttcacatggcattctcctctgtatttctctctttcttcacatggccttcttataagtacaccagtcaatggactcaggaacaccctaatccagtatgaccttgtcttaacttgctggcatctatttccaaataaggtcatatacactggggctagtacttaaaactatcttttgggggacatagttcaacccacaacagactagcaaatttgatatctgagatgattcatctatcagaagccaagagataattagttttttccatcagtaattattgaaggctttaacaaatatgattttcatgatgtttcccaaaatgtatgccacagaatatttatatgagttataagaaaggagttatgtagtcatttaaatttgggaaatgttagttaaaataagtttttaaactataggtctgttcaggacctctcatgtgccagtgtggactatgaaacatactgtttgggaaatgctacatacagttaacccccttttccccccttttttttttctcaggatggagtctcactctgttacccaggccggagtgcagtggcgcagtctcggctcactgcaacctccacctcccaggttcaagtgattctcatgcctcagtcccccgagtagctgggattacagatgcccaccaccatgcctggctaattatgggtgaggagtgcttccacctgctccacatcctatccagccctcaattttcagttatatttccaatgcttttatataaaaacgataaaattctatcctccagatgcaaagatgacagtagagacttatctgtaaaatacatattttaaagcaagcattcccccaaatcccctctatagaacagaagattatctttttaaaacaatgtaaacaaaatttttttctgagatggggtcttgctctgtgttgccaagggtggagtgcagtggtgccatcacggctcactacaacctctgtttcctgggctcagctgatcttcccacctcagcctcctgaatagctggactacaggtgtgtgccatcatgacctgctaatttttgtattttttgtggagatggggttttgtgatattacccaggctggtcttgaattcctgagctcaaaatatctacccacctcagcctcccaaagtgctgggattacaggtgtgaaccaccatgcctggccataagatggtctttataaagggcggaggcggcggtggggggtgggggcgggtgcaggcactgtggctcatacctgtaatcccagcactttgggaggctgaggcgggtggattgcttgaggtcaggagttcgagaccagcccgcccaacatagtgaaacttcgtctctactaaaaatacaaaaattagtcgggcgcggtggcgtatgtctataatcccagctacccaggaggctgaggcaggagaattgcatgaacctgggatgtggaggttgcagtgagctgagattgtgccacttcactccagcctgggcgacagactctgtctcagtgaaaaataaaataaaataataatgaaaaagactatctgttgttaaatgttctgtgctgcttgggcttaggcctttggaagtgtgtatcatttatccagaatcacttaaaatctggaaatctagagtattactatccaataaaacttctttgtgatgatggaaatgttctctgtctcctgtttagcagactagtcattcgccacatgtgactatggagtgcttgaaatgtggctaatgtgactgaggaactaaaattttttttttgagacagagtttcgctcttgttgcccaggctagagtgcaatggtgcaatctcggcttactgcaacctctgcctcctgggttcaggtgattctcctgcctcagtctcccaagtagctgggattacaggcgcctgccaccacgctcagctaatttttgttatttttagtagagatgggatttcaccatgttggccaggctggtctcgaactcctgacctcaggtgatccacccacctcagcttctcaaagtgctgggattacaggcgtgagccaccatacccggctggaactaaatttctaatttaatttagctaaatgtaaatagccacatgtagtttctggctgctgtactgaacagcagtttacagaatgatgttgcctctcactctagttccgtgattctcaaccttatttccctgtctgaaagatgcacattttctgagggatagatatatttctattggttcctatggcaatgattcttagattctgaactatgaggtcatgtttctctggggaagggcatattcaatttgaaaataaaaagcctctaggtagttctgatctttttgtcccctcgttggtgcctgcttccttattcactgtctaccctgaataattattgctctaaaatttctaatatttatagttagaactctaggtaagagaattcttacctgatactggtattttctttttctttttttttttttttttttttttttttgagacggagtctcgctctgtcgcccaggctggagtgcagtggcgcaatctcagctcactgcaagctccgcctcctgggttcacgccattcccctgcctcagcctcctgagtagctgggactgcaggcacccgccaccacgcctggataattttttgtattttttttagtagagacggggtttcaccgtgttagccaggatggtctcgagctcctgaccttgtgatccgcccacctcggcttcccaaagtgctgggattgcaggcgtgagccaccgcacccggccggtattttctatttaagggtaaaattggttagaagaagagccaaagtttgaattgactcgtatattaggatatgagttattgacacgatatattctgattactagctgcaatttgcagtcttcacataatctttttctgtcaagtagagtatcatccaaagaggcagtcctggtgttgattgtgggtggatgttgaatataggtgaaaatacttgctattcggttatctctaagaagttatttttcctcaaaacagtcattgtaccattatagtatttctttgatgtttccatttttaccaaactcattagtagtggtcactttttaaatgttctgtgtctgtaagcagttttttagactctcatttgattctttcaatagaatgcatttacttatttgtgatatttctttgtattctgtttcttacagttgcttctgcaggaagcctttttggtggcatggtcctcaagaagttcctaaaaggtaaagaattacctaacttccatgagactgaatatcttcccgacaattaatttgatattttctgaaacaaatttataatgaaagaaagagctgacagatttataaataaaaatacaggatgcccacttaaatttgaatttcagataaataataatttttttaacataagtatgtctcatgcagtactttatcctacattttatctggcttctgattaaaagatgatctattaatataaaactgtatagaattgacaagatacctagatcactgtagcttttctgtatactctgtatacaactttaggcaaaattttcccagatgtaaaataaaaattttagtaggtatttgtttctatctacttcaaagaaataatgtgtggagaatgcttttactgtaaatgattggctagcagtaataatgttttccacattatatgccagagttggtacggtttaggagtttttgctgaccttagttttaagaatttatttatttatttattgagacggagtctcactctgtcacccaggctggagtgcagtggtgcgatcttggctcactgcaacctctgcctcctgggttcaagcaattctcctgcctcagccttccgagtagctgggactacagttgcatgctgccacacccagctaattttttgtatcttagtagagatggggtttcaccgtgttgccatgctggtctcgaacttctgagctcaggcaatctgcctgcctcggcctcccaaaatgctggattacaggtgtgagccaccatgcctggcagaatttctttttatttttttggacttaagaatactctacaagccaaaggccataacatttattttaaggaagccaaaatgaccttagaactcttacgctttcatttttatttcttatggttgtttgctacataagtattatccattggcctattttttcctaatgaattgttaatttacaaattttacaaaataacttttaaaaataaactttcccagactaaatctggaatattaatagatttttaaaagcttatatctgtccttgctttaagaaaatatactgtagccaggcccagtggctcatgcctgtaatcccagcactttgggaggccaaggcaggcagattacctaggtcaggagttcaagactggtcaacatggtgaatccccatctctactaaaaatacaaaaattagccaggcatggtggtgcatacctatctatagtcctagctacttggtggggctgaggcaggagaatcccttgaacccaggaggcagaggctgcagtgagccaagatcataccattgcactccagcctgggtgacagagtgagagactctgtctcaaaaaaaaaaaaagaaaacatactgtgtattaaaatggcaacaactggccaggcacagtggctcatgcctgtaatcccagcactttaggaggccaaggcaggcggattgcttgatccagtagaactttttggagttcaagaccagcctagcaccatcacgagaccccatctttacaaaaaaaaaaaaaaaaaaaaaaaaaaaaattagccagggaaggtggtgcacacctgtactcccagctacttaggagactgaggtgggaagattgcttgagcctgggaggtaaaggctgtagtaagccgtgatcacacaccactgcactccagcctgggtgacagcaagacttggtcacaaacaaacaaacaaaaaaagggaacaaccaaaaagctacattggaaaggtataatgttataaaataaatgtttatgaaatgtattaccattttttaatgacaaattttcttcgtgctttgtaaaatgcaaatcaattaaaatttgaatttatacccaaatttatagcaactcaattattacttaaagcacctttttttttttttttggaggagataaacccattttattgtctatcatgttatacaaaaatctagaaataatagatttgtatagaaaacaacgataggccgggcgcggtggctcacgcctgtaatcccagcactttgggaggctgaagtgggcggatcacgaggtcaggagatcgagaccatcctggctaacacggtgaaaccccgtctctactaaaaatactaaaaattagccgggcgtggtggcgggcgcctgtagtcccagctactccagaggctgaggcaggagaatggggtgaacccgggaggcggagcttgcagtgagccgagattgcgccactgcacaacagcctgggcgacagagcgagagactccgtctcaaaaaaaaagaaaaaaagataaaaaggaaaaaagaaaaaaatgataataaatgagggtgcaaaacatagaatttaaatttggtattttttccccatgatattaggatgataatcatttcaaagcacatgtctagcttcatagtaggatttgttcactggccaaagcctgccataaaactatggctttcagtgtctgtctgctctactggctcttgacaaaacttttgaggtcttcaagaaaagtaatgtacgcctggtgctccggggctgtgcgaagctccaccaactcatctgcaaaaatgttgtccaccccttggtccgcaaggaaatccattaggtggtcatataaggcccagtccagggaatctgtgttgagtgtatagttagtatccttccattcaaactcgctggtggaccaaaagctaacttccctgatagagaagatgtcactcagcctcctcttcttgtccagcttcatcctctggataatgacagtccagcacaagggccttcttgccatcattctttatagcttcaaccacgaaatggggagttgatatcaattcagggtcttcaaccttctgcccttgcgagggttcctcctcaccatcaaatgttggtgggatgctgttgttaatattgaaagtgacagtgattttttccccccagcaactttccgcactaatttagcttctgtcccattcagttccagctcccaaactccagacatcttaggaagggttttatgcttctggattttcctttcctcctgaatttcatcactcaggaaatcaatcaaagctttgtctccttcgcacgccacacccacagccggaggtgcagggcccgcgaggccgcagggggcccggccgcagaacacgcgcgcaaactgagcagcctgaagggcgggcgcacagccggggcgccggccaggagctgccggaaaggcggggcgggccccgggggtgtggaagccggcgacgcagaagcccagcatatggggcactcagcgcagcagtggcagcatggcggagaggactgcgaacatgtgcggatgcaaaggacaacccaggcctaggtacccagagtacccttttttgtttgtttgtttctttgagacggagtctcgctctgtcgcccaggctagagagcaggggcgagatcttggttcactgcaaccttccgcctcctgggttcaagcgattctccggcctcaacctcctgagtagctggtattacaggtgcgcaccaccacgcccagctattttttgcatttttagtagagacggggtttcaccatgttggtcaggctggcctcgaactcctgatctcgtgatccgcctgcctcggcctgccaaagtgctgggattacaggcgtgagccaccgcgcccggccaatacctttctttatcttggtcatatcaaagaaaacaaactatttttacaactcagttacaagatgaatactctaaagacacaaatatataggaaacaattctaccttttgaaacttcttttctgaagtaatttttagttgaagaatggagacaggccagctgaagtgtctcacacctataataccagcacttcgggaggacaagatggaagaatcgcttgagcccagtagttagagactagcctgggcaatatattgagacccccatctctacaaataaagaaaattagccaggcatggtggggcatacctgtagtcccagctactcaggaggctgaggcagaattgcctgtgcccaggcatttgaggctgcagtgagctatgatcatgccactgtgctccagcctgggtgacagagtaagactgtttttaaaataaaaaagaatgaggacttaaaaatgcttgttgctaaatgaagtgatcagatgtattccccttttcctttgtaaattgtcttggccctctgaatctaccttccaactgtctgtatccttggatattttacagacttcggcttttgctctgtgaccctaattttgtttaggttctacttggtgtgagcacattaatgttttttgttttattttgagcacatttaaaaactaattgtggaggaaaagtaataaaaaatgagattttaaacattattattattattattattagagatgaggtctcactatgttgcccaggctggtcctgaactcctgggctcaagcagtcctcccacctcggcctcccaaaatgctgggattacaggcatgagtcactgcacctgtcctattattatttttgagacagggccttgctctgtcacccagactggggtgcaatggtgtgatcatggctcactgcagccccaagctcctggacttgagccatcctccagcctcagcctcttgagtagctagggtcacatgtgcacacctccatgcccagttactttttaaattttttctaaagatgggatctcactttgttgccctggctggtctcaaacttctggttggtctcaagctctcatgcaacagcctcccaaaacgtagggattacaagtgtgagccaccctgcccagccaagatttttattttagctccagaacattctgtgagcatttggtaagaatgttctccctttagtattaatcacaatgataatttattgagcatttactatgcattaggccttgtgctccacttaaaggtagttatagtagtgaacaagacagatttggtttctccctttatacccctagtgaagataccttaattattctattgcctctttaagcctatgcctagaaaaaagggaatatcagctattgtcctgaagagtttgctctgattctgagacttttgggagatctgaatccaagttcaagaatcatgggctgactgcttcaaaaacatctaattatttataagtttttccttgttcatttttgaattattgtctttgggttgatgcagagaagggaaagatcattcctagtggccctgctcctgttaatgtctgtgaaattgctttgaaagaagtgaaaatcggccgggcgcggtggctcacacctgtaatcccagcactttgggaggcctaggcgggcggatcacaaggtcaggagtttaaaccagcctggtcaacatagtgaaaccctgtctctactaaaaatacaaaaaaaaaaaaaaaaaaattagctgggggtggtagtgggcacctgtaaccccagctacttgggaggctgaggcaggagaatcgcttgaacctgggaggcggaggttgcagtaagctgagatcatgccactgcactccagctcgggcgacaatgcgagactccatctccaaaaaaaaaaaaaataaagaagtgaaaatctggccaagcatggtggctctgactaaaatcccagcactgtgggagactgaggtaggcagattgctcgagccttgggcagcatgatgaaaccccatctctacaaaaaatacaaaaatcagccaggcatgtgaaaatcagctaggtgtgcctggggtcccagctactagggggctgaggcaggagatccatttgagcccaggaggtcaagtctgcagtgagctgtgattgcgccactgcactacagccttggtgacagagtgagatcttgtctccaaaaaaaaaaagctatataaatggagtatattattagcactagggaggagataggagcattccttgcaaaataaacccacacttaatgtgcttgtacaaggagtggtcagatcatatataaggctacttgtttgactaatatttgtgaaagtgctttgaaaaaagtgaaaagccgtgtaactacaagagaatagttttattatcattgttactcttagggagtatcatttatgggttatcatttatggaataaccacatactcatgccaatacaaactctagacaatttttgtcatggtgacttagttttaatttaactgttactttaaaaactcaaagcaatttcatttaatccttattgtgataaagtgtgagtggctaactcttcgtacaaagaggaagtactgcacatcaagtacataattaaaattgaatcatttgctcatgctcaatcacatttagtagccaactgtagcctaagtcttctctccagttgttagggctcttaatattaacctccactcaataatgctagttattctttttgtttgtttgtttgtttttgagatggagtctcactcttgtcacccaggctggagtgcagtggcgtgatcttggctcactgcaacctctgcctcctaggttcaagaaattctcctgcctcagcctcccaagtagctgggattacaagcgcctgccaccacggccagctaatttttatatttttagtagagatgggatttcaccatgttggccaggcctgtctcgaactcctaacctcaggtgatccacccgcctcggcctcccaaagtgctgggattacaggcgtaagccactgtgcctggcctagttattcttactaattagtaacaaaaattactcagtgaacctcacaaaggaaattggtgaagaataagacaggaatcccttagctccctggtttatgcaccattaattatgccttttttactattattatttagaatttctgacactattaagctaatagcaaactgctttaaattggtccatttactgatctttacactgtttagttagcttcatcagggagtctctggcagctggattcattactcatcagttttctagatgctaaaaaattgtgtatctatacaaagttaatatgtctgtaaattcagtttaactctgttgttttcttcattatttggctgatttctctcagtgtctaaaacaagtggtctgacccttctttaggggagctgaactgttgaagaactatcagctttagtttcctttactcttcaatctgttctaccagggttgtatcaaggtacttttttctctggatctggaatactttagatcaattcctgtaccaaataggctcatatttctgtgtattttatttatgctggattaataagcaatgaccattgtaatctccctactcacctacttctctactggtttattttctcttttttcccctttcttctctggtccctaactatttatacttttattcagtaaacttttattgtaacatctaccttgccacaaagaagtcacaggaagtagaggcagctctgcaaataaaatgcagtgtgattagtactgtaatggaggtgtaagttgaaagagcttctctcataacccagaggatattccccaaagttcagtcaccaatgtgcttttcttcccttcattattctgcatcattattctacattcaattcagacagcttttctactttcaagactttaactaacattaactatgctgatgagacttatttttccccctcttgatcactgacatgtctcctaaactccaatggaatagctttgaatgtcaattagactattccatttgagagttcctctgaaatatcctgtgtaacatgtctaacatggggttcagtttcttgaaatgaacttattgtgtaatgtctgcattcctttcagtgatattgacatactcataattctccagcgttaaaaatcttggtttttatggtggggtttctccttttttgtttcctcattatgtaattgatttttcgttaattctgcctttataatataaaattcttattaatttaaacatagcttacattcttcccttaatgattccttatttattattatattaggtctaagtacttcagaccagagttaaggccttctctcaagaggataatcccctctactttgcagaataatgcccattaagatagataagttcttatgtgtttaaaaaattgtcactacatgttaaatgtgtgctactgtctgcattgaatacttatctacttaggtataattccatttatatattcatttatgtgtatacttatccatttatatagaactatttctatcataaatgtcttttagtgaaacatgattgtttcagtttgtcctatttgctcagctctgcttcctattatgtccttattcaagtgaggaaaggaaagtggatggaggaatatgaaaaaaatccatgtttatagatctttattttgctgctttttcctctttcttctattcatattatttttatttttgtctttttaaaatagcttctcatttccatgtttattgacataacttagctctttatacagtatggccagttattttaaaaagatgtgcaagtgtttttcccaaataaaatttacagccttcttttttcttcataagactagataagaataccagtccttgtaaacagggaggactgctttgctgttgatatatggttacatggctatgatagttcagtttttgcctcttccctatatgctacccttttggtgtcagggagacttttttgttgttcattgttttgttttttggaggcagggtcttgctctgtttcccaggctgaagtgcagtggcatgaccacagctcattgcagccttgacctcttgggctcaagggatcctcccatttatagccttctgagtaactgggaccacaggtgtgtaccaccatgcccagctagttattttattttttgtagagatgagatctcaccatgttgcccaagctggttttaaactcctgggctcaagcgatcctcccaccttggcctctcaaagtgtaaggattacaagtgtgagccttcatgcccagcctgtttattttcaagtttacttttgtcctctttgttaatttgttgggaaagaaagtgaggagtggtgcttttcatgggttagagagattgacaggtccagacttgctcaacattgagtaagaaactcacaatggtgaactcttgaatgtctgacgtaatcaagttttttttttttaagtctgagattcttgtattcaagaataaaaatctattataattttatatcttacaaaatcaacaactctaaggctcagaatttatctaacgctttttcccccgggagctcattttgtagacatgatctcattcattcttgaggagcagtcagacataagtgttatcatcatctctgtttcagagatgagaaaactgagacttagcctcatatactaagaagggaaacatttgtagactcataggttgctggttatccattaaactgtgagagactacacttaattttaagcttttgatacattctaaacaggctgttgttgccaaatttacctaacgcttggtaagattttataaaggttggctgaagatcaagacacgctaaaacagatttttgttttttgtttttttttttttttgcttccttaatatttctttactcttttccttgttacatttatctaattgcacttcactattgagaacatgttcaagatttgatgtgacagaaggggatggaaaggacagaagtggtttttaccaaccctgacatattccttttccttttgaacttggatagataaaacaggaggaaaaggatagctcttattattagagatcctgggagctggctcattctctggctgagtggtacataactgcttttattcagcagcccatgagagctaacctgccttgtacctggctggcttaaaatgcttgaactgttacaattcctcattgagtaatcagctgggcacttactgttccaactctgtccttctgggttaccacacatctttcatcttctcagctgggaacacaaggagagttgtctccctatagtggtatagtggaatttggctggaatgggaagaggggatactgtattttttcttgagtagactttatggctagccatttaatacattctgaaaaatggtcagatgacatcacatagaaaaattacctcaaaatggatcaaagaactaaagctataaaactcttagaaaagaaagaaaggtttaaatcttcatgaccttggattaggcaatgttttcttggatatgacatttaaagcacaagcaacgaaaggaaaagtagagaaattggatttaatcaatattaaaaactcttatgcttcaaaagatgatactaagaaagtgaaaagatcaattatacctaaaaaaaaaaaagctggaaaatgaaggtctctagttccaaaactcagaaaaaaaaggtgaataaataatccacagataagaaaagtctagtatccagtgtacatatagaacttatacaacaacaattaaaggacaaatagcaaaattcatatggtaaagccccaacccccagtgtgatagtatttggagatggggcctttgggaggtaagtggggttagattagatcatgagggttgggccttcatgagattagcagttttatttatttatttatttatttatttacttattttttaatttttattttttgagacagagtctcactctgtcgcccaggctggagtgcagtggtgcaatcttggctcactgcaagctccacctcccgggttcatgccattctcctgcctcagcctcccgagtagctgggactacaggcgcccaccaccacgcccggctaatttttttttttgtatttttagtagaaatggggtttcactgtgttagccaggatggtctcaaactcctgaccttgtgatccgcctgcctcggcctcccaaagtgctgggattacaggcgtgagccaccacggctggcctgagattagcagttttataagaagaggaagggagagagagattattctctttttccctctccctcccttgtatccaccaaggaaaggccatgtgagggcacaatgagaaggcagctatctgaaagccaggaagagagccctcatcaggaaccaaatcaactggcaccttgatcttggccttcccagccttcagaattgtgagaaataaatttctcttgtttaagctacctagtttatggtctcttgttatggcggcttgagtggactaagacaacatttatcctaaaaagatacacacatggccagtaaacccatgaaaagatagatgctcagcatcattagtcattagggaaaaatgcaagtcaaaaacataatgaggccaggcacggtggctcatgcctgtaataccagcgctttgggaggctgaggtgggaggatcacctgaggtcaggagttggagacaagcctggccaacatagtgaaccctcatctctactaaaaatacaaaaattagctaggcgtggtggccggtgcctgtaatcccagctacttgggaggctgacccaggagaatggcttgaactcagaaggtggaggttacagtgagctgagatcacaccactgcactccagcctgggtgacagagccagactctatctcaaaacaaatgctccacacaccagtggtaatatgaaattgaagttttttaaactccatcttcccctttacttccctcttctctttcctgacaccccttctggcctccttacccatcgttggccacttagcatagtataatcccctgctgccttgactttctactttttctttcttatcagtctccaggcttgggtaatcaccattattattattttttcattcttatttccaagctgccaagtgttacttgtgtaaatcataaaactgaatgttgggtacgctataaatttaaggagaatttctaacttcttggggttgttcagtactcttatcttgtttattcttttatataattctcatagtgtatatttcaaattacctgacactcaataaatgtctttaccttctatttttctgaaaaggttgaggttatccaaatggcacttcttctggatttctttttttctttttttttttttagagatgaggtcttgctatgttgcccaagctggtcttgaactcttaggctcaagcaatcctcccacctcggcctcccaaagtgctgggattacaggcatgagccaccatcctcagccattccaatttctttttaagaaatttaaatttgaggctgggcgtggtggctcacgcctgtaatcccagcactttggaaggccaaggtgggcggatcatgaggtcaggagattgagaccatcctggctaacatggtgaaaccccgtctctactgcaatagaatgtggctgccatgctggctttgcaacttcaagagatcctctgcacccttacacttctcagccaatttgtggaagaagtggccagtgccttccagtgccacatcattgtggtcaaaatagaagcccagaatgagagagatgtaggaggcctacagatacaaattgaccaggcgattgacagctgcctccaactcgatgaaataattctgatgagtctagttggcaagaaggagctaaccacaaaaacagtgttggctggtctcagaagcaggagatggccgagaagatggtcctggaggttgcaagtggagaggacagtggagggcagttggaggctggaagagagggagtccctgggtttgttccatccaaatactattgaagcaagagacagatgggtgggactgtcaaatgcactgccagaacatccatgaacagctcatggttcaagaagtaatttcaacttttaaggcttattatttaggaaatacattttataagactatagctgccatagatagtgagtagagtcaattaaaaaccttctggaaaggagtcaccattctagatgccattaagagcattcgtcattcataggaggaggtcaaaacatcaacgttaacaggagtttggaagaaattgattccaacccttatggatgactttgaggggttcagtacttaagtggaagagttaactgtaaatgtggcccggccagtaagtggtatttttttaagaatttcattttccaactgtttcttgctagtatttgaaatacaattgatgtttatatatttttcaagcttgctaaactagcctgggaaacatagcaaggccccatatctacaaaacatttctaaaagttaattgggcatggtgctgcatgcctatagtcctagctactcaggaggctgaagcagaaggagtgattgaaaccaggagttgtagggtgcagtgagctataattttgccactgcactccagcctcggagacagagcaagaccctatctcaaaaaataaaaatcttggccgggcaccgtggctcatgcctgtaatctcagcactttgggaggctgaggcgggcagatcatctgaagtcaggaattcgagaccagcctcgccaacatggcgaaaccccgtctctactaaaaaatacaaaaattagctgggtgtggtggtgcgtgcctttcttcccagctactccaaaggctaaggcagcagaatcagctgaacctggaaggtggaggttgcagtgagctgagatcatgccactgcactccagcctgtattgttagatttgatttgccataattttattaagaatttttgcatctatgttcacaaaggatatgtgtaattttcttttcttgtaatgtctttgtctttttttggtacaagtaatactggcctcatagaatgactttggacatattctctgttcttcaattgcctagaagagtttgtagaagatattatttcttccttaaatatttggtacaatttcttccttaaatatttggtgcaaatcatcaaggaagccatctgggcctgattttttccttcctaggaaatattttaactacaaattcaatttctttaataattatacagtctctctctctctctctctttgagacatggtctctgtcgcccaggctggagtatggtggggcgatctcagctcattgcagctttgacctccctggctcaagcgatcctcttgcctcagattcaggactataggcctgcaccaccacacctggtttgtattttttgtagagacagggtctcactgtgttgcccaggctggtctggaactcctgggctcaagcgatcctcttgcctcagcctcctaaagtgctgggattataggcacgtaccactgcacctggccttttttttttttcctgagtgagcatgggtaatttgtgtcaaggaatttgtccattttatctaagttattgggttattgacataaaattgttcataattttccttattatctttctaatgtttgtagaatctctagcaatatcctctttcttactccctggtgttggttatttatatcttctcttttattttccttgatcagtctggctagaaccaggttcttcctgttgttctatttcattcatttacactctgatcttttattctttcttttgctcgtttggggtcttacttgctcttctgtttctagttttataaagtgaaagctgcaatcattgattagagacagttctacgctaaagtcataatgacattttatgtaatttcttttttcttttttttgagacagagtctcgctctgttgctcaggctggagtgcagtggagtgatctcagctcactgcaacctctgcctcccaggttcaagcgattctcctgcctcagcctcccgagtagctgggattacaggcccccaccaccaagcccagctaatttttgtatttttagtagagacaccatgttggccaggctggtctcaaactcctgacctcaggtgatccaccagccttggcctcctaaagtgctgggattctaggtgtgagccaccatgcccagcctatataatttctttaatagtgctaaagttttaaatttatatttattattacatctagtgaatctggagtttatttttgttttgctttgctaaccagctgactttaatggagtttatttttattttatttatgatgtaagttaggaatctaatttaaatccttttccaaacagattgctacttgtcccaactcagtttattattgaatagtactttacccagtaatttatattattattctgtcatatactaagattctatatatgcttgggtctgtttctgggtaatctagtctttatctctgtgcctgggccagtattgtagagttttatttcctaaagctttagaataaatcttgctatatgatagggcaaatctctcctccttgtttttctttttcagaatcgtctttggtgtttctttgttttgttttgttttgtgcttttgacaaagtctcgctgtgtcacccaggctggagtgcagtggcacaatctcggctcactgcaagctccgcctcctgggttcacgccattctcctatctcagcctcccgagtaactgggactacaggcgcccgccaccacgcctggctaatttttttgtttttttgtttcttttgtatttttagtagagacagggtttcactgtgttagccaggatggtctcgatctcctgacctcgtgatccgcccgcctttgcctcccaaagtgctgggattacaggcgtgagtcaccgcgcctgaccttgtctttggtttttaaaacctttactcttggctatgagttttataattagttaagttccaggctggacatggtggctcacgcctgtaatcccagcactttgggaggccaaggctggcagattaccggaggtgggagttagtgaccagcctggccaacatggtgaaaccctgtctctactcaaaatgcaaaaattagccaggcatggtggcgggcgcctgtagtcccagctactccggaagctgaagtgagagacccacttgaacccaggaggcagaggttgcagtgagctgagatcgcaccactgcactcctgcctgggtgacagagtgagactctgtctcaaaaaaaaaaaaaaaaaaaaaaagctccacaaaaaaatcttgttgtgattttcattgctattaaatggaattatagattaagttggtggcaatgaacatttttagcattgtttttgtgagatgatatatcttgtcatttatttagatttttcttttaaaaatgttatttaattttagttgtcacacttttaagagataggcactataagggagaataaggggctcgaccaagagcaaatggctataagccaaagtctgcctgactttagagaccattttgccaggtgttattatttgttcaaaatattgcctgctcttctcctgggagatttatattttttgccctatgagtataaggctgggtcatgtaacttgccagggccaatgaaatgtgagtggaagtgacatgtgtcgccttccaggagaagctttaagagtctatgtgtattttgctggtagcttcttttcctttgccatgaggctaggatgtctcagatgagggggtactcctttagcccaggtcttgcttagatgtggctcttgttggctttgagttcacttatggttctgcaacctcttaactggcttctggagttctcacaaaagataatttgatattgctgttgagttggtttttctgtgggggaaacgaggacctggggcttcctatcccgccatcttgctgatggcattcctatttagatcttttatgttaacactttaaaattcttttcataatggtcttagatatcttttgctatatttatttctatagtcttatagtttttgttgctattatgaatgatattcatttttttcaaccctactgaattcatcccttattaatttggataatttatctgtggattcttttggatcctctatatgggcactcaaagcatctctaaattatgacaactccatcttttccttttcaatccttatatggcttctttttttttttgagacagagtctcactctgtcacccaggctggagtgcagtggcgtgatctcggctcactgcaacctccacctcccgggttcaagtgattctcttacctcagcctcctgagtagctgagactacaggcatgcaccaccatgcctgggtaacttgtgtatttttagtagagatgggattctaccatgttggccagcctggtcttgaactcctgacctcaagtgatctgcctgcctcggcctcccaaagtgctggaactacaggcatgagccatcacgcctggcatatggcttacttcttttccttgtcatattgtattgaatagaatagtactagtattaaatagaatagcaggggtaatattaggcatctgtcttgctttccttaaacaaggaaattaaacaaggaaggattatttaaaagtctaccactggccgggagcagtggctcatgcctgtaatcccagcactttgggaggtcaagattggaggatcatttgaggccaagagttcgagaccagcctggtcaacatagcaagtccccatctcttagaagaaaaaaaagtccattattaagtatatttgcaatagtttttatacctgctcctgttaagtttaggaaattattttctattcctaatttgccagcgtgtttgttatgaatgagtgctgtatttcctgaaatgctttttctaggccaggcacagtggcttatgctagtaatcccagcactttgggaggccaagacgggaggaccacttgactctggtagtagaagaccagcctgggcagcatggcaagacccagtctctacaaaaaaatacaaaaattagctgggcatggtggtgtgcagctgtagtgtcccagcttcttgggagcctgggacagaaggatagtttggccccaagaggtggaggctacactaagccagaatcatgcccatcatgtttttttaatactgttgtaatcactatatctatatatctatatctatatatctatatctatatatatctatatatctatatctatatatctatatctatatctataatgttgtcctatgtctttttttacttaacataagcatttttcatgttatgacatagtcttctagtcattattttaatggctaaattatccatcaagatgtatcataaattagccatttttctattaatagacatttaggtttattcttttttttcccccattattatgaatagcaggatagtttagtgtctaggagattatactgtgtgttcttgaacaagtttttgatcttttgaaagcacctacctcataaaattgttttgaggattaagtgaagtaatacgtataatgcatgtagcacagtggttattctgaatacacagttctcaataagtgctaattaatatcactggaatgaatatcttaatgcatatagctctttactatattgaaaattttaggattaattttatgagatagaattaacttgatcaaagtctgtgtacatttttatggctctgaaattgctttgtaaaaagtgttggccaggcgtggtggctcatacctgtgatcccagcactttgggaggctgacatgggtggatcacttgaggtcaggagttcaagaccagcctgctaacatggtgaaaccccgtctctactaaaaatacaaaaaaatagcctgtagtcccagctactcgggaggctgaggcaagggaatcacttgaatccgggaggtggaggttgcagtgagccaagatcacaccactgcactccaacctgggcatcaaagcaagactccatccccccaaaaaaagttgtgtcttgtaatgctaacatttgtagcaaagttaccaacttcaccgtactttgccagcattgggaatttcaattacttaaaatatttaagctaatttacaagttaatgagatggttaaaagttttaattatatttctctgaaccttttaataagtgtttaccacctctattttctgttttctgaactttgtgtctttttcttttctttctttttttttttttttaagagacagtctcaaactcctgggctcaagtgattctcctgcctcagcctcccaaattgctgggattacagacttgagccactgcacccagccttctccatgtctttagggacaaacttctaggatgaaatttaggatgaattaagtcattagcttgacaccatgatgtacaaatccctgaatttcagtttcattgttaaaatgccattgtttcaagatgctcagttggctatggaaagataggtcatctatcccagctactcagggggatcttttgagcccaagaggtcaaggctacagtgagctgcgatcacagcactgcactctagcccgggcaacaaagtgagactgtctccaaaaataaaatataaaatttatatggaaagaaaaacccagaatagccaacgccatattgaagagtaaagtcaggggactggcactacctgacttcaagacttataaagctacagtagttagcccaaggtaattaatagattcaatgccatccccatcaagctaccaatgactttcttcacagaattggaaaaaactactttaaagttcatatggaaccaaaaaagaacccgcattgccaagtcaatcttaagccaaaagaacaaagctggaggcatcacgctacctgacttcaaactattctacaaggctacagtaaccaaaacagcatgatactggtaccaaaacagagatatagaccaatggaacagaaaagagcccttagaaataatgacgcatatctacaactatctgatctttgacagacctgacaaaaacaagcaatggggaaaggattccctatttaataaatggtgctgggaaaactagctagccatttgtagaaagctgaaactggatcccttccttacaccttatacaaaaattaattcaagatggattaaagatttacatgttagacctaaaaccataaaaactctagaagaaaacctaggcaataccattcaggacataggcatgggcaaggacttcatgtctaaaacaccaaaagcaatggcgacaaaagccaaaattgacaaatgggatctaattaaactaaagagcttctgcacagcaaaagaaacaaccatcagagtgaacaggcaacctacagaatgggagaaaatttttgcaacctactcatctgacaaagggctaatacccagaatctacagtgaactccaacaaatttacaagaaaaaaacaaccccatcaaaaagtgggtgaaggatatgaacagacacttctcaaaagaagacatttatgcagccaaaaaaaacacgtgaaaaaatgctcatcatcactggccatcagagaaatgcaaatcaaaaccacaatgagataccatctcacaccagttagaatggcgatcattaaaaagtcaagaaacaacaggtgctggagaggatgtggagaaataggaacacttttacactgttggtgggactgtaaactagttcaaccattgtggaagtcagtgtggtgattcctcggagatctagaactagaaataccatttgaccccgccatcccattactgggtatatacccaaaggattataaatcatgctgctataaagacacacgcacatgtatgtttactgcggcactattcacaatagcaaagacttggaaccaacccaaatgtccaacaatgatagactggattaagaaaatgtggcacatataccatggaatactatgcagccataaaaaatgatgagttcatgtcgtttgtagggacatggatgaagctggaaaccatcattctcagcatacttttacaaggacaaaaaaccaaacaccgcatgttctcactcataggtgggaattgaacaatgagaacacatggacacaggaaggggaacatcacacaccagggcctgttgtggggtggggggagggggagggatagcattaggagatatacctaatgttaaatggcgagttactgggtgcaacacaccaacatggcacatgtatacatatgtaacaaacctgcacgttgtgcacatgtaccctaaaactttcataaaaaaaaaagaaactgtggtattggcaaaagaataggtaaatagtgtttttttgctcaattttgagtatttttaaatactcaaatacttataattccctgccttatgagattatttttgctctgaaaagctagctgtcaagaaaaattcaaggaaaaaaatagtcttttatattcacttatttatgatttctggtgctcttcatttcttcctttatagctgggtttccatcttcagcctgaagaaaatcctttagcaaatcttctagcagcagattatttcatcttctatcttaaaatgcctttaccttaacctcatttttaaaggatattgcactggaatatctggcttgatagttttctccttttcaacattttgaaagatgttgtcaattgtcttctgcgctttattgtttttatttatttattttattttatttttttggagacagagtctcactctctcacccaggccggagtgcagtggcgtgatcttggctcactgcaacctctgcctcctgggttcaagtgattcttgtgcttcagcctcctgagtagcactgggattacagacatgtgccaccacacctggctaattttttgatttttagtagagacagggtttttccatgttgaccaggctggtcatgaactcctggcctcaagcgatccacctactttggcctcccaaagtgctgggattataggcatgagccaccgcgcgtggacctggcctttattgtttatggtaagaagtcagctgtgattcattttatacctcctgtgtatatgatgtgtgcttttcctctggcttctttcaatattttatctttatctttggtttttatcattttgactattatatacctaggtgtgattttctttgcatttatcctccttggggtttgctgagcttttcacaccttaatatttttcatgaaattttagggaattttgttcatggttttttgatgtttttcttgtcctattctcattttattctcctatcctccttctgggactcccattgcacatattttagactggttgatattttcctacaggtttctaagactattcatttttcttcagtcttttttttctttattctccagattggatagtttttgttatttgtcttcagtgattttactgactcttctgtcacctctaatctgctattaaacctatcaagtgaattcttcatttcaattatttaacttttcagttatagaatttctttttggttctttttgtatagtgttatctgctgacatttcctatcagttcactcattaaggccgccttttaagcctttgaacatatttataatagattctttaaagtctttcctaaatgtaatatctgtaccatatcaggttctgtttcttttcttttttcagagacagggtctcactctgtcaccaggctgaaaagtgcagtggcacagtcatagctcctgcagcctccaactcctgggctcaagtgatcctcccacctcagcctcttgagtagctaggacccacaggcatgtaccaccacgcccggctaatttttaaatttttttgtagagatgagtctttccatgttgcctaggctagtctcaaactcctggcctcaagcgatctccctgccttggcccctcaaagtgctgggattataggcatgagcctggccctcaggttctgtttctattagttgctttttttcccccttgactgtgggttatcatttcctatttctttgcatatttagtacatttttgttttatactgggcaatatgatcatattctatattgtgttatctatctctggagagtattaatttttgctctagtaggctatgcaccttgaccttgtacaggcttgtttttatgcattttaaagggtaggtctgtagaaagccaatgcatttttcaaactcttctaatttgataccatttagcctccaaactctatctcctctgtgggttttgtcaaggaatggctttagacttttttggggtgggtctagagcacaccttcatcgacagtatggtttttattactaaagcattatctgtggggcatctcagctagacaccagcagttttaacaaggtctccccatttctagctaggcctgaaggccaacatttttcagcactggaaaatcttgctagtgtcttgttacattctcaactccatagcacctgctctgtgggaaatcatatgtagtctcactctctgcatggatagtccagaccttggccaaggactcatggggagctcctacacagactttagtaccctgctctttgtatctccctcttctccagtgccctgccctgcagattccaggtactttcacaactccaaaatctattctctgcctcctcagcttagtgggaccactgtcctctgcttgggttccatgtccctgttctgtagatgggaaaatttccccaggcagacacccagggaaataacaggactaacctggtgagtttcccttctctcaagggattgtaaccttgtgctatctattgtccagtgcctgaaaacaactgtctcatatattttatccagttttacagtagtttttggtttgagggctcatttggttatttcattaatgctgggaggagaagccccagtacatagttttgctatgtgttcgtaatgtcatctgattgaaaattttctatctacttcatctttaacagttgaagacctatgtgaagaggtaacttgatactgataatgatctctttcttcctccttatccccacatgatctcagcaaaaatgtaaactcatgtttaaatggacatggtggtttgtttagtggttatttgaggacttgtagatggtaaacattttaagtctctcattttgtaatggtagtttggctctcttaaaagttcagatttggctgggtgaggtggctcatgcctgtaatcccagcactctgggaggttgaggcaggaagatctctcgagaccagcctgggcaacatagtgagaccctgtatctacaaaaaattacaacaatttccctaaacagtttaatataaagaaaaaagattagctgggcatcgtgtacacctgtagttctagtgagttgggaggctgaggtaggaggatcctttgatcccagaagttgaaggctgcagtgagctatgatcaccccactgcacatagcctgggccacagaacatgatcctgtctcagacagacagacagacagatagatagatgataggtagatagataagtaagtaaaagagtccagattcaaaattacttcagatctttgaagatagtactggatcatcttctgacatttagcattgctaactcatgggttttttttgctaatttaatttttttggtagctcgtagggttttctgcttatccttgttattttgggtttcactgtgatgtgttaactatgtggcttttttaatttttgcttttgccttgttttttcgaaatttagcctgcttgacgtttggtaaaactgttcagatagcacttacatctgtctttgttttatatttctcagtcattatttcttctggatctatttttaatgtctcttgccttttcttttaattgatataaaattcatatatcataaacacaaccattttaaagtatacaatttggtggtttttagtatattttcgggattgtataactaatattttttggcagggtctcactctgtcacccaggcaggagtgcagtggcgtgatcatggttcactgcagcctctacctcctggcctgaggtaatcctcccacttcagccctctgaatagttgggactagagctgtgcaccaccacacctagttaatttttttgtttttgttttttttggtttttgttttgttttgttttgtttttgtttctgagatggagtcttgctctgttgcccaggctggagtgtagtggcgcgatctcggctcactgcaagctccacctcctgggttcatgccattctcctgcctcagcctcccgagtagctgggactacaggcgcctgccaccaagcctggctaatttttttttgtatttttagtagagacagagtttcactgtgttagccaggatggtctcgatctcctgacctcgtgattcgcccaccttggcctcccaaagtgctgggattacaggcgtgagccactgcaccctgccatttttttgtattttttatagagatggggttttgccaaggggtggtctcaaacttctgggctcaagtggtcctcccgccttggcctcccaaagtgctgggactataggcatgagccactgcttcctgcctgtataactgttatcactatccaattccagtacattttcatccagaaaaagaaaccgtgtactcattagcagtcactctgcttactttcattctctatgccttggcaaacactaatctactttctgtctctgtcgatttgcttattttggacatctcatataaatggaatcatacaatatgtagcatttagtgtgtgggttctttaagcattatattttcaaggcctatccatgttgtttcatgtaacagtacttcatttctttttatggctgaatactccccatttggttaagccattcatcatttgatggacatttgggttgtttccacttttagctgttctgagtaatcctgctatgagcattcatgtactaagttttcttttacatttgctcttttactgtgtccaatctaaccatccatagagttttaatttcaaacactgtatctttaatttcttttcttttttttgtatctttaatttctaagatttctttttttttttttttttttttgagagtctcgctctatcgcccaggctggagtgcaatggcgtgatctcagctcactgcaacctccacctccctggttctagcagtcctcctgcctcagcctcccaagtagctgggattacaggcattcaccaccatgcccggctaattttttaaatatttttagtagagacggggtttcaccatgttgtccaggctggtcttgaactcctgacctcaggtgatccacccgtcttaacctcccaaagtgctgggattacaggcatgagccaccgtgccgagccagtttccaagatttctaataccccattactttctgtttaatttacgacagtgtttccttgtttcatggcttctttttctttttaaaggtataaaatatagatacttatttaaaaatctctcccagattgttctattaactttatttccttaggtataagtgcattggttgatgtgtattatcgttttcatggtattaatcttctttgcctggtaatttttaattaagagctaattgttcatgatatgtttaatctgaacacattttgtgttgacaactgtcccgtaggaggctctctgagttgctgagccttagccttgtatgatgtatacctaggattaatctttgtatgggtggtaagatgcaaagctcttgcatcttaatagattatatagttctgagtcctttcaccacttacatgaaatggctctatggccctcatctcatatcagtgaggctgctgccagaatccccttggctgtaaccaacattcaggtagacaggcagtgcacctctagtccttgttcatgtgttgctcccttgcttagacctcctgtgtgtggctcttgctcttaaacctatgagtgttacagtattagctctatgttttttcctagtctaggcccaaatactatgcatctttttagttcttgtctactattgtggaatctctcttttgttccctttttgttgttcttttcaaaggaggagaaagaagaacacctttccatttctggtctataaagatttctctcttctggccagatatggtggcttacacctgtaatcccagcactttgggaggccaaggcgggcagatcacttgaggccaagagttcaagaccagcctggccaacatggcaaaacctgtctctactaaaaatacaaaaattagccaggcatggtggcacaaccctgtgatcctacttactcaggaggctgaggcaggagaccctgttgaacctgggaggcagaggttgcagtgagccaagatcatgctactgcactgcagcctgggtgacagagcaaaactctgtcttaaaaaaaaaaaaaaatttctgttttctttttttctcaccatgactatgtatttattaagatttaaaaatatttgtattattttatatgtttgaacaggaagatgagatttcagcatatgcttaattcatcttgaaatcaaaggcttttacttagtttttgtttcacctttttacatttaactgtagtcaacctatctggatttgtatgtttgtgtgtgtggagtgagactactgaaattgatttccccccaaatatctacacaatttattttaaattagtaagatttctgaagaattcagttatttacaaaccttttctcatatatccacatttaccccatttctgtactgtcttactaatcaaactgaaataggattcaggtacaattttttcttatttcacagaatggtaattgaatcacagaaaaggggggttgccttaggtcagaaagttgatcagtggtgaaactgaagattgacgtaagacatcctggtttagtgctaagttcattaaacttcagtgtagcatacccttgctgtcctattatcaagggctttgtaactgaattaggtttgaaaaacaaactaatggcaagaacaatattacccattaagattgatagctacaatttttgttttgtttttttttttttgagatggagttttgctcttgttgcccaggctggagtgcaatggcacgatcttggctcactgcaacctccacctcccaggttcaagcaagtctcctgcctcagcctcctgagtagctgggactacaggagcatgccaccacacctggctaatttttgtattattagtagagacggggtttcaccatgttgatcaggctggtctcgaactcctgacctcaggtgatccacccaccttggcctcccaaagtgctggaattacagacgtgagccaccgtgcccagccgatagctaggatttgatcttgggaatgtgcacacttttttgaggtggttaaaacattatgagatatgtagcatgaatgccttaggagaaacttgtgctgttattttagggcatatttttttaatcatcgttaggtttttaaagtttaatttttgtgtaatatcaacattgtcaacctcaataacaaagcaggccaggcgcggtggctcatgtctgtaatcccagcactttgggaggctgaggcaggcggatcacctaagatcgggagttcgagaccagcctggccaacgtgatgaaaccccatctctattaaaaatacaaaaaaaaaaaaaaaaagcctagcggggcatggtggtgcatgcctctaatcccagctacttgggtggctgaggcataagcatcacttgaacccaggaggcggatgttgcagcgagccgagatagcgccattgcactccagcctgggtgacagagtaagactccgactcaaaaaaaaaaaaaaaggtacatgcctgagagtcattcttgaatttttcagccttcagctctaaattagttcatgtactagacttgtgtttattacataatgagttgatttattaaaaaatacaagaatatcagaactatcagttctgaagctatctggcattaaacatgaccttgtggaaattaacagaaaataaaaattgatttagcaaatgtaaaaaattgaaaagatgaggttaaatgtcctaatcccataaagtaattctaaatgttcaagcaatttgctgatgcatagccatttccagtcatattttaaatcttgtagataatcttttcatcagggaaaagccttcttggctcaccagtttaataaacaaatccagaaatcctggttcttatccaaactgcttgtttgactttgttgccatttcttctcacacagaaatacagtccatactgcccggaatctctgcaaagctgacttggacttcagaggaaggcagctattctcaggatatgacaggggtaacacccttccagatgatttttgaggcaggttttgttgtggtcttataaattactaatgattttattcttatttttctgcaatctaataacaagaaagaaaagcctaggtccatcaaagttccaagctggaatgaaataaggcaatggttcccaaacttgcctgtgcagacattagatcacctaggagctcccaaaatactgtcgtctgtgtcccactctgagtgattgtgatttaattggtctgggtgttgtaattattagtcttcttgggctgccataacaaaataccacagactagatggcttaagcaatagagatttattttctcacagttctggaggctagacgtccaagatcaaggtgctgtcagggctggctttggtgaggcctctcttcctggcttgtagactactgccttgtcactgtgtccttacatggctttttttctgcatgtggatgaaaagaaagagatctctaatgtctctttatttttattgaaaatttttttggtagagatgtggtcttgctatgtcgcacagtctggagtgcagtggctattcacaggtgcagtcatagcacactacagacttgaactcctgagcttaagtgatcttcctgcctcagcctgccgagtagctggtagctgggactacaggtgggaactactggcacctggctctggtgtatctttttataaggacaccagtcctattaagacctggggtcagtgccctacccttgtgacctcatttaatcttaataacctcctgagggccctgcctccaaacacagtcactttggggcttagaacttcagcatatggattttgagggacacactcagtccgtaataggtatggcataggctttggaacattttttagatcccaggtgattcctaatatgcagatgaatttgagaaccactgaaacaagcccttatttgaatttggatctcctaataaagaaaattaaaagtgactcccagtgcagatcctacctggatacatttttattagtttggtttagagatctctttatcgacttatttgtagtccagatttatgagggtgataattcattctccattccctttaacaggtctctcatctcctattttccttccttagagttggtggagacataacgaattagagtgctttaaacattctcccaggaagcccttgggcagcctttctccatgtttgaataattatatgctcattctgaaaggaatgggtatggtatcaggacaacagatatccctggctgtgccttatcttctttaggagaatggagggtaaacaatctggagcaattaatggttagtcagctctgaaactattcatgtcaagtagcaataaaaaggtgattccagtgaaccaagaagggcaattctaggaaatgaggttctgtgtttcagtcagcctgaacaagcagtaagttgtatacataacatttatatatattatgtaagcatcctgacaagtctatgaagtgggtaggatgaggattatcaccccattttacagaccagaaagttgagattcagagaacttgactgactctcccagtgtcatacaacagttaaatggcagaattagaacttgaaccaaagtctgactcatatagatcagggctatttcaatatttacttattcatccagacgtgtgtttgttcaagtcagtgtcagtgagctagatactatctgtaggtacagtgtcttaagatatgttacttgatcctggctgggcgccgtggctcacacctgtaatcccagcactttgggaggctgaggcgggtggatcatgaggtccggagattgagaccatcctggctaacacggtgaaatcccgtctctacaaaaaatacaaaaaattagccgggtgtggtggcagcctgtagtcccagctactctggaggctgaggcaggagaatggtgtgaacccgggaggcggagcttgaagtgagccgagatggcgccattgcactccagcatgggtgatagagtgagactctgcctcaaaaaaaaaaaagatatgttacttgatcccaaggaacctggaatataaatagaaagatcaagaagtaaacacgtaattacaatacggtgtgattcccaggatggatgatagaagtgagccctgaatgctatgttagcatggaggaagggcatctaatccatgggaagaggttgaagtctggaggtcttgatgagactgaaaaacagatttgctgggtgtaggagattctgacacttgaaagaataggaagttgttatcagagtgataaagtttctcttatttctttattgcaaaagtagtgtttccctcagaaaaatcaaagtatgatcaaaacaaacatttagaatacacataatttggcctttcaaggcagccgttattaacaccttggtgtacatcttttcacaatagagtgggacatttcaatttaagattttcagaatggaacagttccaagccgtggccatggaaataggtggctgggaatgagtggaggtcaaggtcattattgttgaagaggtcagggaactgtgagactaagttattgcttaggctagttatctgcttggatatggatgtcagtcaagatgatgacagcatttggcatacagaggaaaactgtgagcttagtgaccagcagtcagctggtgatggagatgagaagtaaaataatagtatagtcaaacggcattagcctcaagggaacaaggatttcctcatgcatttcttccattatatctcattgtttttggtactgtgcagctatgtagacaatatttgaatgaagagaatgagaagagataaaagggagattgtaaaagatttcatcatggatgcctcaattgaggagaaaggttaagtagcaaggttcacagcaaaggctaatagagactccatggaaaagctataataaatgatccattaatttgggcctgcgaggaaagtcaattgcaaggaagactgaggaaagtttcatttaggagagatattgggttttgtgtttatgcccacagctagtcttacatcttggtgttcattaggctgggtaacatgtcccttcaaaagcaatctgattttataagatcttcttgacagctttatccagtttaatatttatttttgtaataatactaagtgatcaagtgaatggagttatacatatatacatacaaacatatatatgcacaaacatatctatatatttatacatctgtacttctgtgtgtatgtatctaaggtgagggggcaagagagagagacagactttcttctagaaagtgatataagggctcatgactgtataagttcatatttgaaaacatacttctatattctgtcatataattagacatatttaaaggtgaaggctaaaaccatatgattcaatagtagtttctgctgtgcacggctggcagcatctatttttttcataacagtaaataagtaaattcactgcttctgtaggtatgtcaggctggggtactgggtctctaacacccaacacccaactgtaaaaggctttgtcatctctctcttcctctttctaataatttttttttttttttttgggagggagtcttgctctgtggcccaggctggagtgtagtggcgcgatctcagctcactgcaagctccgcctcccaggttcatgccattctcctgcctcagcctcctgagtagctgggactacaggcactcgccaccatgcctggctaattttttatatttttagtagagatgggctgtgttagccagatggtctcgatcttctgacctcatgatccgcctgcctcggcttcctaaagtgctgggattacaggcgtgagccgccgcacccagcttcctctctctaataattctatgagtagatcttaaaagggtcctctaaccccttttaaggggttagttgtgttgtattaattatcctctctgacctgacattagtcactttatcctaactctgggataggtgtcggtccttctgctgtattcctttagcacctcatttatctaaatttcacattgtcatataaattagtctgtctcatctactgaactgtgaactcttctaattctgagattgtcttatttatttttataagcccaggtacataataagccacattaatattttatgagtgagtaaatgcatatattgagtagccatacataagcattgcttgtcaggctccataaaaaataatgatggattatatattaccccattcagatagctacctgtatacacagaaaatgaacatttttggagaggcagcattggatagtagaatgtggactttggagttagtcagctctaggtttgaatcccagtgctgccacttaactagctgtgtatgaccttggacaaattaattagcttattgagtctcattatcctcttctataaaatggagttatttcttacttgcatagaaactgcttgacatgtagcaagtagtcagtaaatatcatcattattcattgtagtctctctccagtagttgctcaaggaactttcacttcggttgtcttactgttagatataattagccctctctatgatacgccctataatcaccaaggttacaaagctttgaaagtgttccaagaagttgttttggaagtggtaagcacagaaaatgctttaaagactattgctttttggtttaaacattttatactaaaattttaaaaatgaaggatgtgactatgatatgtataccaattgcagttattatttaattaccactgttaacatgcatgaataatcctagacatatttacagaattttctaataatcccccatccattttggtaataatgtttttttttttttgagatggagtctcactctgtcacccaggctggagtgcagtggcacgatctcagctcactgcaacctccattccaggttcaagtgattctggtgtcttagcctcccaagtagctgggattacaggtgcacgccatctgtaatcggctaatttttttttgtattttttcagtagagatggggtttcaccatgttggccaggctggtcttgaactcctgacctcaagtgatctgcccgcctcagcatccgaaagtgctgggattacaggcatgagccactgtgcccagcccatttttgttaattttttcaaatactttttcaaataattttttctttttttgttttttttttttttttttttagacagagtctttctctgtcacctagcctggagtacagtggtgtgatcttggctcactgcaacctccgccttccaggttcaagcagttctctgcctcagcctcccgagtagctgggatcacaggtgcccgtcaccactccaggctaatttttgtatttttagtagagacggggtttcatcatcttggccagccctggtcttgaactcctgacctcaggtgatccacccgccttggcctcccaaagtgctgggattacaggtgtgagccactgcacctggcccaattttttctatctttaatcccaacctattgccacagtttttgacttctttttcagtgtacttataaaaaacattaaaaggccaggtgcagtggcttatgtgtaattctagtgctttgggaggccaaggtgggaggactgcttgaggccaagagtttgagaccagcctgggcaacataatgagaccctgtctctacagaaaattaaaaaataaaaattatccaggtgtggtgatacacacttgtagtcctggctatttgggaagctgaggtgggagggttgctggagcccagaagttcgaggttacagttagctatgatcatgccactgcattccagcctgagtgacaaagcgagaccctgtttctaaaaaaaaaaaaaaaaaaaagtaataaaataaaaatattgtaatagtttatccttctatatttgcatgtttcttctttttgtattatcatattttgacatctgggaccattttttttgttttttgtttttaacatatacctagtacatggctgtgtattctctgagccaacaataaaaacctactgatttctgattgtatttcttctttcatttttttggagttctgcattttctaggagactgtttctaactttggttttaggaacactataatagtgagtcagtataggtaagtggttaatgctaaagatttatagccaagttgacctggctaaccttggacaagctgtttaacctttttgagactcttttgtaaaatatttatttttattttccttcatttttaaaaatccagatcctgcacaatcttttatttataaaatttgggtacctaatagagtttttgtgaaggttaaatgagataatataaataagataccttagcaccatccctgctgtaaaatcatcacctagtggtaaatcttatatttgtagggaagtgtttgtagtatattggcaagaacatgggcaattagtattagaaagacttaaggtcactcacaaaacaaaaaagaaagacttacagtcaagttctggctatactactgaacagctaagtgaccttaggcatgttgcttaacttctctgagcctttttaaaaaaatctacaaagaaggggccaggcgcagtggctcacttctgtaatcccagcactttgggaggccgaggtgggcagatcacctgaggtgaggagttcgagaccagcctggccaacatggcgaaaccccgtctctacagaaaatacaaaaaatcagccaggcatgatggcacgcacctgtagtcccagctactcaggaggctgaggcaggagaatcgcttgaacccgggaggcagaggttgcagtgagccgagatcacaccactgtactccagcctgggcaacaagagcaaaactccatctcaaaaaaaaatatatatatatatacaaagaagagattgtaatacctaccttacaggattattgtgaggtagtatatatatagcaactgcacaacacttgtcacatagtaggtattcaatgagtgatatctattattgttaccatgtataatatacactttctttccttcttttttttttttttttcgagacagagtctagctctgtcacccaggctggagtgcaggggcaccatcttggttcactgcaacctccacctcccaggttcaagtgattctcctgccttagcctcctgagtagctgggattgcaggcgcatgccaccacacctggctaatttttgtgtttttagtagagatggggtttcaccattttggccaggttggtctcgaactcctgacctcaggtaattagcccacctcggcctcccaaagtgccgggattacaggcataagctaacacgcccagcctacaatttcaaatatatggatccttaaaacagttctgtgaggtcaaagcggtaggttttatccctattttgcagattaggaaatgaggtccagagcagtgattttttttttttcaagagtatttaagtaattttttttttttacagaaccagtactagaacacaggtcttctgacttttgagctttttgctcttcagcttttccttataaataaatgtttggattaatggattgatgtcaaaaataggttccttttagtgtttgctccttccgactccactcagattctttttttaaaatttctttctaaaaaagcataactcagattcttaatacagattgttccaaagcacattaggatggtggagttattcttaccaacttcagtctgaattacttttaaatttgtccccaaaggtggttttgacattatgggttttactctgatctttattctcgtgtcttctgaagttccgtgtaatagatactctaacccaagaagtgatggctatttagattttcttttgcatacaattctcattcccaaagatgtctccctttggttgtccaaaaagctttctgaggtatagttacttttagaagaggaaataccgttttaattcatttgtgctcttgagattgtgtatgtgtggtaggtgtttttgttgtattattacaggttgatgaaaagcccagaaccttgatgacagattgtctggttataaagcattttttacgtaaaatcatcatggtgcaccctaaggtaagctgttcctttgtacaataatgattctcttatttaagtcattgttttccagagacctttactgtgtaggacatggacagatgtgattggttctttttctttcaatgaagatgattaaaacgtttaatatttgaggtcatggtggctcatacctgtaatcccaacattttgggaggccgaggcgggaggatcgcttgagtccaggagtttaagaccagccaaggcaacatggtgagactctgtctctacaaaaaaaattttaaaaattagccaggtgtggtagtgagctcctgtaatcccagttcctcaggagggtgaggtgagaggattgcttgagcccaggaggttgaggctgcagtgagccatgattgtgccactgccctccagcctaggtgacagagcgagaccctgtctttggaaaaaaaaaaaaaaaaagacaactttcaactttcaatattgaattgatttggtttctatgtccttaagacagttgtttttttttttttagagagacaaggtctcactatattgcctaggctagtctctaactcccaggctttaacaatccttctgctttggcctcccagtgtgctgggattacaggtgtgaggcactgcacctggcccaaggcaatctttttttttttttttgagacagagtcttactctgttgcttaggctggagtgcagtggcatgatctcggctcactgcaacctctgcctcccagattcaagccattctcctgcctccgccttcctagtagctgggattacaggtgtgcaccaccatgcccggctaatttttgtattttcagtagagacagggtttcactgtgttggccaggctggtctcaaactcctgacctcaggtgatccacacacctcagcctcccaaagtgctgggattacaggcctgagtcaccacacccagccaaggcaatcttaatgttggttatgtgttatagcgagaaacctctggatagagagagctttgttttgggttattttcacttttttttattgctttattgtatcactttagatacctcttccctcctctgtgctttgttttttgttaaagctagataataaaccttgctgtttatctccttttctaaagtgactataagaacaaataaggacttttttttttcctgagacagggttttgctctgtcacccacgctggagtgcagtgacttgatctcggctcactgcagcctctacctccaaggttcaagtcattctcctgcctcagctccctgagtagctgggattacaggtgtgcaccaccacacctcgctaatttttgtatttttagtagagatgggatttcgccatgttggccaagctgatcttgaactcctagcctcaagtgatccacctgtctcagactctcaaaatgctgggattacaggcgtgagccatcatcatgcctggccaagaaattttgatagaatattttgaatattagagagctaaattttttattatctgtagttagatatgtttataaagataaacacttaagcatatctatgacatcccccttctgccatcttcctactttttgcctattgtttcagtcactattctaagtgctctttgtgcactcgctcacttaactcttacaacaccccttgtgaagtaagttttatcatcatcatccgcattttgtagctgagaaaactatggtacagagagtaaataacttgaagagtcaggatttgaactcaggcagtctggttctagagtcacttcttaccttatgttacacagaaagaaaaatataggtgaatggagagaataattagaacagtgaggtacactggagaggatataaaagtcagatggagaagaggaagaaaaagcaaagaaaaaagcatggaatgttccacatatgaaaataatagaaataaaaatggatagttcctttaaaaaggaggtgaaggggctgggtgtggtggctcacacctgtaatcccagcactttgggaggccgacttgggcggattgcttgagctcaggagttccagaccagcctgggcaagatggtgaaactctgtctctactaaaaatacaaaaattagtcgggtgtggttccatgcacctgtggtcccatctacttgaggggctgaggcaggagaatcgcttgaacccaggaggttgaggctgcagtgaaccgtgtttacaccattgcactccagcttaggtgacaaagtgactctgtctcaaaaaaaaaaaaaaaaaaaaaaaagttaagggataggggttgagagaatggcaaagaggcagggatgatttctgataatttgtgacaacctggagctgtgatatagggctcaatatatttaagatttagaatttaaacacaggcaagcattaagtatgtttagggaaaatacaagtgataaagaatgtattttttggccgggcgtggtggctcacgcttgtatcctagcactttgggaggccgaggtgggtggatcacaaggtcaggagattgagaccatcctggccaacatagtgaaaccttgtctctactaaaaatacaaatattggctgggcacagtggctcacgcctgtaatcccggcactttgggaggccgaggtgggcagatcacctgaggtcaggagttcgagaccagcctggccaacatggcgaaaccccgtctctactaaaaatacaaaaattagccgggcatggtggcgcacgcctgtaatcccagctactcaggaggctgaggcaggagaatcacctgaacctgggaagtggaggttgcagtgagccgagattgtgtcattgcactccagcatgggtgacagagcaagactctgtctccaaaaaaaaaaaaaaaaaaaaatacaaatattagctgggcatggtggcgcgtgcctgtagtcccagctactcaggaggctgaggcaggagaactgattgaacctgggaggtggaggttgcggtgagctgagattttgccactgcactccaggctgggagacagagtgagactccatttcaaaaaaaaaaaaaagaatgtctttttcctggctgagcacggtggctcatgcctgtaatcccagcagaagtaaaactttgggaagccgaggtgggtggatcactcacttgggtggtcaggagttcaagaccagcctggccaacatggcgaaaccccatctctactaaaaatacaaatattagctgggcacagtggcgcgtgcctgtagtcccagctactcgggaggctgaggcaggagaattgcttgaacccaggaggcggaggttgcagtgagccgagattgcgccattgcactctgcactccagcctgggcgacagactgaaactccgtctcaaaaaaaaaaaaagtcttgtttctctaggttcatccgtgtcacaaatgacaggatttccttctttttaaaggctgactaggctgggtatgatggctcattcctataatcctagcactttgggaggctgaggcaggaggatcacttgaccttgggagttcaagaccagcctgggcaatatggtgaaaccctgtctctacaaaaaaatgcaaaaagtagctgggtgtagtggcacatgcctgtggtcccaactactcaggaggctggggtgggaggatcacttgagcctgggagaccaagatcacaccactgcactccaggctgggcaacagagcaagaccctgtctcaaaaaaaaaaaaaaaccacaaaaaactaactgtattccattgtgtatataccacattttcttaatcaacagaaagacaaatactgtatgatttcacttatatgtggaatctgaaaaagtcaaactcatagtagagaatagaatggtggttaccagaggctgggagtgggttaaggaaggaaatagggagttgttagttaaagtgtacaaagtttcagttagacaggaggaataagtctttagaatcttatttcacaggggggtgactatagtcaataataatgtattatatatttcaaaatagctgagagtaaatttcaaatgtcttaccacaaaaaatgctagtaagttatgtgatagatgttaatctacttgatttaatcattccacattatatacatatatcaaaacaccacattgtaccctatgaatgtatacagttatagtttatcaattaaaagtaatgttaatttaaaattttttaagcttattcttttcctttagggattagatatggaagtttttaatctgtatcttggctcatgttaaatctcacacttaacttattgttttgcaggtcagatttcatttcagtgtaaaggtaaatggaatcctctccacagagatctttgggtaagttcttaggtctatggcttaagatgatgctatggctctgcaatttttctcagctattattgtcctatttccaaaaggttcacagtttgatatcttgacccaaagtcaccttgaaactaattttctgacacccccacattttattattttagtagattcatccctgtctctagagggggtaaacttaaagattgccattttccccttggttaattagttactgaattctagtaatcgctggggtggtagtagtcatgggccaaaatttatgtcaaacagagattgattttagaatctttgagagatggcttagctttgctttgctttgcagggtggagaatgaacccactttgaaccttgggaatggaattgctcttttggtcgactcccagcattatgtgaggtgaaggcgtaaagccttgttgtccctctgcatgttttactctcctctcgagtacgaatgtgggtagaaattggaaattgtctcacttgtcatttgtaagtgccaggtgtcagcttctctataagaaaagcagaagtaaaacttttttttatgttgaaaactgctattttaagttatttatgtatttgaatctattctaaatgacctgaagacatgtgccttcttctcttcaggccttattttacacagaccctgctagttccaatcccatttaggcatgagaagagaagactatgaatttaaaactttacttgaattcttggctagagagatagtatgaatacaaaggaattcagtgtacattattttctgtgcatcagcattttgcataggtttggaaatcatctctctgcccatctccatcttcttcagactccaagaaagtaaatctggccaggcgcagtggctcatgcctataatcccagcactttgggaggctgaagttgatggatcacttgaggttaagagtttgagaccagcctggccaacatggcaaaaccctgtctctgctaaaaatacaaaaattagctgggcatggtagcacatgcctgtaatcccagctacttgggaggccaaagcatgagaatcacttgaacccaggaggtggaggttgcagtgagccgagatcacgccactgcactccagcgacagagcaagactctgtctcaaaaaaaataaataaataaaaaatgtaaaaaatccatggaggaggtggtaaacaatatggaacacacagagcccttctgtcttgccttcctgtgccatttaactaccacagaatccaaagtgaaaatgaattatgtcaagaaaagacctaacatatgcttaagtccaattaatttattttttctttttttgagacagggtctcagtctgttcaacccagatgccatcatagctcactgcagccttggtctcctgggctcaagtcattttcccacctcagcctctcgagtagctagtagctaggaccacagaaatatgctaccatacgctgctaattttttttttttttgagacggagtctcgctctttcgcccaggctggagtgcagatctcacctcactgcaacctccacctccctggttcaagcgattctcctgcctcaatctcctgagtagctgggactataggtgcatgccaccacgcccagctaatttttttgtatttttagtagaaatggggtttcaccatgttggccaggatggtctcaatctcctgacctcgtgatcctcctgcctcggtctcccaaagtgctgagattacaggcatgagccactgcgcccagcccatatactgctaatttaaaaaaaatttttttttgtagagatgaggttgttgcctaggctggtgtcaaactcctggactcaagcaatcctcctgcctcggcctttcaaagagctgggattacagatgtgagccaatgtgtccagccctaatttagtctttattcattagtttctgcctctatttatgtgcccagaggcaacactagtagtcaaagtctcttaaggcttaaagagactgcctgtggttcttagtctgttttcttattctcacccaaaattacacctcagatgagaatatttttgtcatttaatatgcaggtaataatttccccaccccatatctttctttagtgatcctctaataataaacaatccttacaggtagcagctcatcatcatagttgtactgacacaagtttaagcctttgagccaatttttgtagatgtgtttccttggatgacctgattagagacaaagggaaaggttcattaatatttcctctctattaattaattcattcattcttaatcagctttctcaggttgactgttttctctctgtttagaaaagagctattggaaagtaacaaaattttactagattctttctaggagagaaagatggcctggttttttctcattgttactatcaaacagcaacctcagacctcttcagcggaaggtgtagcatgcgtgagagcagacttataagtatcatggggccagttttaggccatttgtgattcatgggccccctcacacaatgctgacctttgaatgaatttggaaatttgctcagaaccaaagattaattttagtggaggaagtatacttgagaataagaaacaggctggtcatgatatctcacacctgtagtcccagcactttgggaggccaaggcagaaagattgcttgaggccaggagtttgagaccagcctaataaacatagtgagaccccatctctaataaaataaaataatagtaattatttttcgagacaaagtctcgctctgttgctcaggctggagtgcagtggcgcaatatcagctcactgcaacctccgcttcccaggttcaagcgattctcctgcctcagcctcctgaatagctgggattacaggtgtgcaccatcatgcacagctattgtatctttagtagagatggagtttcaccatgttggccaggttggtcttgaactcctgacctcaagtgatccacccacctcagcctcccaaagtgctgggattacaggcatgagccacaatgcctggtctaaaatgtttttttaaaaagagaaactaagaagcatccgttagtggcagcaaaagcaggagcaatgatatctctgaaatgccagtttttctactacttccattgctgtgattccctgagtgagacataagttatttattccaacaaaactgatatggcaggttgtgtggttgtacatatgctagaggttacaaaaataattttgaatgctcttttaaataatttcttaagaggaaaaaatgttaaatttgacttgtctgttttctgacagtagaccaaattttggtacaattgaatcacactgcagcagaattcaccctgtgctaggacatccagtaatgcttttcatccctgaagacgtggctggcatggacttgttgggagaactgatactgactccagcagctgcactgtgccccagcccaaaggtttcttccaaccagcttaacaggatttcttcagtttccatatccttttgatgaaaagttccatccaattatctttgaaatgggtttttatatcccagttttaggaaagcctttagtatgtgaattctgcatctacaaatatatatgatttgtataaaaacatataatctaatgtgaaagccaagcttgaaaattttgccagggaactgaaaactgtaaaatgtgacacatgccatgcgtttttcatacaatccaatatgactgaagcatgaaatgaatggtgcacgaggaagagatgggactagaaaagtagtctggagttgaatatggtagatcttgagtgccatactaaggattgtgaattttattctctgtatagtaagaaaccattgaatgttttgggagaagtctttagcagcattatagagtacggatgggagacagaagttagtaatactaagtaaataagtaagtgaactggattaaaaataatgagtgcttgacggctgggtgcagtggcttacacctgtaatcccagcactttggcaggccgaggtgggcggatcacttgaggtcaggggtttgagaccagcctggccaatatggtgaaaccctgtctactaaaaatacaaaaattaggccgggcgtggtggctcacacctgtaatcccagcactttgggaggctgaggcggatggatcacaaggtcaggacttggagaccagcctggccaacatggtgaaaccccatcttagtaaatacaaaaattagctgggcatggtggcaggcgcctgtaatcccagctactcaggaggctgaggcaggataatcacttgaacctgggaggcaaaggttgcagtgagccgagatcgcagccactgcactccagcgtgggcaacagagtgagattccgtctcaaaaaaataaattaattaaagccaggcgtggtggtgtacgcctatagtcccatctacttgggaggctgaggcaggagaatcacttgaacctgggaggtggaggctgcagtgagccaagaacacgacactgcactctagcctcggtgacagagcaagactctgcctcagaaaaaataaaaataaaataacaataataatgagtgcttgaatctaaagtgtggtaggcacggaaaggccagacttatcacctgaattaatcaacaaaatgtggtaaccagttcattattaaggtagggagagattaggggcagggaatgtctaaggttgatgtcagatttctattctatgtctgtctagaataggcaaatacagagagaaagttgatggaggggcttttttgtttttttttttggagacaaggtctggctctgttgcacaggccagagtgcggtgacacaatctcagctcactgcaacctctgcttcccggactcaaaccatcctcccacctcagcctcctagagaccacaggtgcatgccaccatgcccagttaatttttgcatttttggtagagacagagtttcaccatgttgcccaggctggtctcaaactcctggactcaagcgatccaccaggctcggcctcccaaagttttgggattacaggcataagccactgtgctcggcctggaggggcttcttttcagagtaatgaaagtgttctaaaattgatggtggtagtgactgcacaactctttgaatattctaaaatccattttattacacatttaaaatgagtgaattgtatggtatgtgaattgtatctcaataaagctatttaaaaatatttccatgaataactgacagaataatgatactttcagcaagataaaaaaacattaatagcagatttaggagataaagaagatgagtttgacattaaacatgttgagtttatggtgtctcaagacatcctttgaacatagtaaggagctatataggaatttggtctggaacttggaaatggtcagatttagagatacagaattttagagtctcagtttcctccataggtaagagtcgtgtagtgctgtgtttagagcatggcacaggagtgtaaatgttggattcactactaattagctgtgtgactgtaggcaactcacttaaccagcctaagcctttacttcctctgctttaaaatgaggatgatacttatctcataggtttagtttcccttgcaaaaattggttttctgttcttttggggtttgtttgctcgttttagaattaagtataataatccatgtgaagctcctagcatataatgagtactcaataatattaataattgttattgtcatatgattgaagctataggagtaaatgaagttatagaaaattataaacaatgagaacaggccggacacggtggctcatgcctgtaatcccagcactttgggaggccgaagctggcggagcacttgaggtcaggagtttgagaccagcatggccaacatggcaaaaccctgtctctattaaaaatacaaaaattagctggacatggtggcacatgactgtagtcccagctactcgggagactgagacaggagaattacttgaacccaggaggcagaggttgcagtgagcactgcattccagcctgggcgacagagcaagactctgtctcaaaataaaaaaaaagagagaacagaagaggcgtggtatgatagatgtcagctatctgatgttgcatatcagatatcaaaagataccatagtatcttttagggaggtggagggagcaggatagtgatgaagactatgcttggacattttctattttaaaacatgctttttctttatatctagatagtacagaacagtatagaataaataagtttcttcttcttcctcattccatcatctagaagggataagacagacaaattttttgtcctcttggggaaaatttaacagatagatattaggtagtgataagtgcagtggagataaatagaacaaagtagtagagaatgatggagatgttattttaaatatgggcagtgaagcctctaaggaggtgatgttttaaaaaagagagagagctagctatgaaaattctgttgagattttactttctgaaagtggcaaacttgataatttagaccaaccttctcaatgaaggcaaaggctagatgaaatattaaaacatcataaaagcaggccgggtgtggtggctcacgcctgtaatcccagcactttgggaggccaaggtggatggatcacctgaggtcaggagttcgagaccagcctgaccaacatggagaaaccctgtctctattaaaaatacaaaattaaccaggcatggttgtgcatgcctgtaatcccagctactcaggaggctgaggcaggagaatctcttgaacctgggaggcggtggttgcggtgagccgagatcgcgccattgcactccagcctgggcaacaagagtgagactccatctcaaaaaacaaacaaacaaacaaaaaaatcataaaagcatcaaagagctagtgaagaggaagagtttctgtgccatgatttaggagaggtttgaattacagagagctgagcctagcattgggggatgcttttgccctggagcagtttgccaattagagcaagcagttgagaggctaagatgtattaatacttccaaatcagtgcaggacaagaaggccaaagaatccaggacctgctgagcttgggagtgctgctaaaaacacctcttgccttgggcaagggataactagaaggctatattttaaggagtaaggtgaacctgaaataaattactcttcacatggactgtatatgctttttggtcatctaggcaggccagaaaatcttgaactttgaaattggattaggatgattttagatttgttagttctagatgttttatagaagcaaacaaaaatttctagaggaaaataactgcatcctgtgctcccaattatttaacactttttcaaatacagtgtcccatggtgcatatgcacacacacatgcacagtcacaaataaccaggtgtaagaaaggacaagataatatgaacaagagctagcaaaaacaaaatcacagaaacacccactgggactccagatactggtgatatcagatattgactttaaaaagttatgcttagctgggtgtggtggttcacacctataatctcagcactttgggaggctgaggcaggaggattgcttgagcctgcaagttcgagatcagcctgggaaacacagtgagacccccatctctatacaagttacctgtgcatgtgtggtgcatgcctgtggtgccacctactcaggaggctgaagtgggaagattgcttgagcacaggaggtcaggactgcagtgagccatgatcgtgccattgcccttcagcctgggtgacgtgagaccagtttcaaaaaaaaaaaaatgaaaaattatgcttactatgttgatgaaaatgaaagcaaagtttgaaaattttactagaaaactgaaactgtaaaatatgaaataccttttaacaagaacaaaacagaaattgtagaatcaagaaatataataaccaatgttgaataaaattcagtacactggtttaacagcagattaagtacaacttaagtgaatttgtaaactaaaagctaaagatagcaagaacttagcaaaaataaaacaaagagacaagttatggaaaatacagaagagaggggttaacagagtaaagagtaaaactgtctaatgtatatttaattgatgtccaaaaagagaagagagaagagaaaatagggcagaaacaatatttaaagagttaatggctgaaacaactgagacagatttgtgtgtgtgtgtgcgtgtgtgtgacggagtctcgctccgtcgcccaggctggagtgcagtggctcgatctggctcactgcaagctccgcctcccgggttcatgccattctcctgcctcagcctcccaagtagctgggactacaggcacccgccaccacgccaggctaattttttgtatttttagtagagacggggtttcaccgtgttagccaggatggctgagacagatttaagaacagaataatcaagcagtataaataaaaaagatttctacacctaaagagatgaaaaacagagaagaatcttaaaatcagtcaggaggacaaatcatctttaaaagataaattaacagttgacttccccataccaacagaaggtgttagactaatagtgttaatgtcttgaaataaaatcattaccaacctagaatttcatatccaatccaaatattcctcaacataaaaggtaataaacttacctgtatattatgttaaaattataatccacgtaacaagaagaattaattcaacagactttagaacatggtgttttgactatacgttcttagcaggatatactctaaggatgaaatggaagtccaaagacctcttaaaatttattcagtggcatgattgttagtaataatattggtattttatattggaattattgtatgcatacttatgataaataattatgttaacaatgttaggaaccaaagtttttagcatcagatagaagatatgtgagtgtaaattcagagaaataactattttttttaaagggatctcactctgttgcccaggctaaagtgcagttgtgcgatcatagctcactgcaacctcgaacttctggggttaagcagtcctcctacctcagcctctcctgagtagctgggactacaagcatgcaccatcatgcctggctaatttttttatttttattttttgtagagacagggtctcacccccgagtttccaaatttaatgaaaactataaacctgcagattcatgatcaatgaaccctaagtgtaagaaatatgaagaaaattataccaagtcacatcataatcaaagtatttgaagccagtaataaaaaaatcttaaaagcagctggagataagacacattatgtatagaggaacaaaataattatggcagatttctcactggaaacagtgttagctagaagaaagtggggtaacatctttataaagtactgagagaaaaaaggcaaaatgaagaatttttcagacatagaaaaggtgaaagaatttatcaccagaagacctgtattataagaaatgttaacagaaatcttttaggtagaagaaaaatgttgccagacggaattctgaatctacccaaaaaaggaagagcactggaagtggtggctatgcgggtagatacaaaatacttttgtccttttaaaaacacaaaatatccttcttgagtatataaaccaaaaagcatccaagacaggtttcaatcagtttagaagtttattttgccaaggttaaggatgttcctgggagacaggtctgtgcctttctctaaagatggttttgaggtcttcagtatttaaaggggaaacgcaggctggagaggaaagatggaggggatgatcacattattgaatccatatgttacaagagaaaaggagcaagtaggggaacagtcaattatgtatttgtcttgtgctcagtaaagtggccctttatataatagaaggtgaacattacagtagctacctgtagaggtatttaaccctttatctgtagctatctgcttaggaacaaaaggagagacagcttcttgcatgactcagctttcagctaaattatttccttttggcatagtgatttggggtcttgagttttaattttcctttcacaagtaccttaccagaaaaaaaaaaatctttaaaaaacaagtcttgaagtctctcccttcaggctccaattacacattcctgaattaggccacctaaagttatcctgcagttcactgaggctttattcatttatgtagagacagggtcttgctgtttcccaggctggagtgcagtggcttgatcttagctcactgcagccttgaactcctaagctcgtgtgaccttcccacttcagcctcctgagtggctaggactacaggtgtacaccaccatacctggctaattttgcatgtgtgtgtgtgacatatcttgctatcattttctatgttcttcatatttcttttttttgagatggagtctcactctgttgcccaggctggagtgcagtggtgtgatctcagcttactgcaacctctgcctcctgagttcaatcaatcaggcccctgaaatgatttctatctctgccatttcagcctcccgagtagctgggactacatgtgcccaccaccatggccagctaattttcgtatttttaatagagacagggtttcgccatgttggccaggctggtctcgaactcctgacctcaagtgatccgcctgccttggcctcccaaagtgctgggactacaggcatgagctactgtgcccagcctatactcttcatatttcttatgcttagggttcattgatcatggatctgcaaaaatataatgtataaggtttataacatctatggaaataaaacctgtgacaatagcacaaaggccaagaggagagaagtggaagtatattgttggattcttaaactttatatgaattgttataatatcatttgaaggtagactgtgataagttaaagttgtatactaataaagcctggcaatccctggtttaatgcaacagttataactaataacttaaaaaggagataaaatggagttataaaaaattcctggcaggcatggtggctctcacctgtagtcccaactaccttggaggctgatgcagagagaggctcgcttgagcacaggaatttgaggctgcagtgagctatgatcacatcattgcactccagtctgagcaacagaatgagaccttgtgtcttataaaagggtggggagagagagaaaacactttttaaaatgtaaaaaacaatttctaatccaaaaatagaaaagaggaaaaaggaaacaaagaatacaagcaagaaatggaaaaaagatgatggatttaaactccactatagctatcttcatattacaagtaaatgatttaaacaacccaattataagacaactgcacatcttggctcctcaaacactcccctcttattctgagtttgcatctttttttttgagacggagtctggctctgtcgcccaggctggagtgcagtggcgcaatctcggctcactgtaagctctgcctcccgggttcacgccattcttctggctcagcctccctagtagctgggactacaggcgcccgccactacgcccggctaattttttgtatttttagtagagacggggtttcaccgtgttagccaggatggtctcaatctcctgacctcatgatccgcccacctcagcctcccaaagtgctgggattataggtgtgagccaccgcgcctggccctgagtttgcatcttaaaaatccccttgccctaaacagtgagtcagccttagttcatgtgttaatgccttctgagatttgtgagggagacttcatttatgggtataaagcctttccataatgcctcagtgcccactgggtaggaattttaatcttcacaataccttgtgtttaccccataagaaagaggatgaaaacgaatgaaagataaaggaaagcacacattctggtctctggccttggttcaggggacaagaaaggttaagcagtggttcttaatggggtaattttgtccttaaaggacatttgacaatgtctggagacgttttttattgtcatggagggggtaacgtaagaagggtgctactggcatttggtggctagaggccagggattctgctaaacatcctatagtgcacaggactgcccaccgcagtgaagaattatctggcccaaagtgtcactagtgcagaggttaagaaaccctgggttacaggtagggtgagagtgggaatgggaagttcagagatagaaaccatttcaggggcatgccttcctttgttttagataataggtttggagacaatccgaggaagtttccttctcaatctaagtatactcaaatacttcctagaagatattctcttgtatatacttctagcatgtatcacattgtattacagcttaccggcttttatgtctgtctcccatgttgtaaatatgataaacttgaggacaggtattatctggatatttgtctttgtaccccaagaacttagaacttaaaacaatgttaacctgtggtgcctttcaaatctatgaccatgtgaaccggatgaataaataaactgtcttaatattatatctgtagctcacacttattaaacccagaataaatttctggggatcctagtggatctatctctggtgcctcacatctgtcttcagtgtggaaaaggcttaatatgtaactgcataggctgggcatgatggctcacgcctgtaatcccagcactttgggaggccgaggtgggcagatcacgaggtcaagagatcgagaccatcctggccaacatggtgaaaccccgtctctactaaaaatacaaaaattagtcaggcatagtggcatgcacctgtaatcccagctacttgggaggctgaggcaagagaatcacttgaacctgggaggtggaggttgcagtgagctgagatggcgccattgcactccagcctgggcgacagagcgagactccatctcaaaaaaaaaaaaaaagtaactgcatagcacacttatgggagtgtaaaccaggtcagtgttgtttgtttgttatacaagtgaatacatagtcataagatactaaaatttggcagttttctttagcaactacacatatttctatatggacctttgggtctgcctctgatattgtcaacttgggagcagccgatgactactttcttcaaagatacctcttctttagttgactggaaaaaataccatttgtgtatgatacccaatttggatctcaatttggatagaggtatatcctccctctttctgcacaggaattaagacatttgaagaatattagataaatgaaaggaaatatgaatagaacgtgtgtataaaaatatgaccagagatctgatggcccaggttggggtttgggggtcagggtctggccaaatgtgagagaccacttgaagtgaggcaaacaggtgtcaaacaggcaagctctttcagagcttgttttggcattgcatgtttttttttgttgcttgtttttgtttttgttttgtttgagacagagtcttgctctgttgcccaggctggagtgcagtggtatgatcttggctggctgcaacctccgcctcccgggttcaagtgatcctcctgcctcacccttccgagtagctgggattacaggtgcctaccaccatgcctggctaatagttttttgtatttttggtagagacagagtttccccatgttggccaggctggtcttgaactcctgacctcaagtggcccacctgtctcagcctctcaaagtgctggtattacaggtgtgagccaccgcacccggcctggcattgcatgttgatactggttctcctcttacttcctctgctgcctcctctattcctggtccttctgttagatacttgttcagaggatttctaatgtacctaatctgtcaactctgggcctttacaaaggtgagtaagggagcaatgatacctctgaactactgtggaagagaaatgcttcataatgaactgagaaaatccacataaaattccttagaaaaagttaaaacgcatacaaatgcaagatgtaatagtattaggcctaggaagctggctgtaatattcccataagctctaaccacaccagctttgggtgaatcatgctaaaagctggaggttaataactgagctaataaaactgggaaattggagtatgcgaccatgggctgatatctaggaggggttgcagttttgagattgactgttctaactagaatcctttgaaatttagaaggtagtctggtcgtctggctcctgaagaagacgaccagtagggaagaggtattctgcggctatgactggtatgagaacattgaagcctactgggatggggcagtatcttagagggaatgatagactccaccgatttcgaatagagatatgactggtgaatttctagggatcgccatacctccttttctctttcatttttgtttttgggctttgctggtttagttttttgccaattcatggtcctgaactttctcagttaactttggaaatgaataacgtaggaaatgtcctctcatctccctcccttattactctaaaggacagaaccaggatccacatggaggtacttctctacatggatctgaaatatgggactatcctgattgtattctaaaggatcaaggtgctagaaagtgaccactgggcaatggattacatttggggatacaaatatatagtattggggctaagagaacaggttttttagtcagtctagcaaagtctagaactcagttccaccacctactggctcccgttggacgaggtatttaacctatctgtgcctcttttcttatctgtaaaagggcataagaataggttctatccgatactgttgttgtgaagtctaaatgttgaaatagtacataagcatttgatgcagtacctggcacataacacaaattagctgttgtcattacactcaggtgaatctaacctcttaccagccatacctgccttagaaagttgtacaaggaatcaatgaatttattgtgtagagcttctcagtaatgtaaaggagtgctgtttggcttgcattttacacacatagttactattttaatgttcttcctgtgagtcattatgatttgcttccatcatgtggatagagaaacaggttcaggagggtaaatgggtgttcagatttagatctcctattctcagatccttctttgttcagaatacaggttctgtagtcactttgtatttcaagagctttacttatcttagaaattcgtgtaatatcttgtcctctagatttggtgcttccagatgtgagttatcaggtggaatccagtgaggaggatcagtctcagactatggatcctcaaggacaaactctgctgctttttctctttgtggatttccacagtgcatttccagtccagcaaatggaaatctggggtaagtataagagaatggggttgccagctggggtgtgccaaatgctaagagagagggaaactttgtgtaatgcacacatctaaattagatatatttctgtagaataaataagttcagtgaaaaaccttgcttaataaaatgaacatatcctatagaaaagattcatatattgatgcatcgcttaaatgatgacatttctagtctggttggccagaaatcagcagatacttcatatattgctccctagggatcagcggttttcaacgttagccgcacaatatattacctggagagcatctaaaatgcttactccccagagattctgatttccagatggactgaggtggggcttagggttcagtatgtttttaaattttttttatttttagagatgctctgtcgtccaggctggagtacagttgcgcgagcatagctcaatgcaacatcaaactcctgggctcatgtggtcctcccgcttcagcctcccaagtagctgggcctacagatgcatgccagtgcacctggataactttttcaattatattttgtattattattttttgtatggaggtcttgctttgttgcccaggctgttctcgaactcctggcttcaagtaatcttccttcctcggcatccccaagtgcttgtcagtatgtttttaaagtttctcaggctgggtgcggtggctcatgcctgtaatctcagcactttgggaggttgaagtgggtggatcacttgcagccaggagttcaaggccagcctagctaacacggcgaaaccccatctctactaaaaatacaaaaattagctggcatggtggcagcttcttgtaatcccagctattcaggaggctgaggcaggagaatctcttgaacccaggaggcagaggttgcagtgagccaagattgtaccactgcacttcagcctggacaagagattgagactctgtctcaagaaataaaataaaataaaataaaataaaatcacttctcaggtgattctgatgtacagcaaggcttgggaacttttcatcatcatgctgcctttccaggtggatttaaaaaatgcacacctgttcttattcaggtatgcaacagggaacctttggtgtttatctattagatgggtgacaatttgttatcaatcagaaaggttatctatgatagagataaaacagtggtttcattttctggtccatgaaacacatgcatcagaatcactggatgatgatgatgatgatgatgatgatgatttttgagacagagtctccctctgtcgcccaggctggagtgcaatagcgtgatcttgactcactgcagcctccacctcccgggttcaagcaattttcctgcctcagcctcctgagtagctggaattacaggcacacgccaccacacctggctaatttttgtatttttagtagagatggggtttcaccatgttggtcaggctggtctcgaactcctgacctcgtgatccacccgcctcagccccccaaagtactgggattacaggtgtgagccaccacaccaggccattattattattattgtagaggcaaggtctgaactcctgggctcaagtgatcctcccacctcggcctcccaaagtgctgggattacaggcatgagcaatcgcactggcctcaagtgattcttaaatagagtaaaatttgaaaaccactgagcatgagcaggagttgacttctgcattttaatccaataaaccctgggacataaatttaagtgtttctcaatgccctcctaatctttgaggaaagttacaaggagaagtggagcttatacaaatttggggaaaggttcgtaagcctcccttttggtgcttctgatatgtctctgttctcctttctctatgggccaatgtgttttcgtgggactctattctccaggcactctagtgctatttggtgtggccctgctcctactgagtcataagaaaaaagagactgcttacaccagatcaaaagagctcatgttgactggtgtcaattatttattgaacaaaccattgttggctgtggtattcttccttctaccttccttctgagcctctcagaagtaagataaggcaaacttttccctgccttttcccaacacatgctgtacacactaggagagaagcactgtttcctggggctctggcttgtagctctttatttgaggagctaatggtctttggtgtaccgccgttctgatgattaacaccaggggaatggaaaatagaagatacctaaactaatgtgaggattcctggggctgttccctgtggcttatgctcacatagacagaggttggtaagagcagcagctgattattgtggaaaagacatcagggtggaatcaagagacctgggtttaattttagcactgataccaacttcctcaatgatttttgggaagtatgtcacgtaaatctgagcctcccttttcatatctttaacatgagattgttaggctaggccccatcaaaggcccttccaggtctaaaaccctcttaagacttaagatctgctaccttctggcaggctttttttaaggtctgtcagaaggtaatccttggataatgcaagcctgataacatgttctgagccctaaagaacattccttaagaactcagattcctcagaaacacagtattatcattcctgaactactgtgataatttgtacacttctgtttagcttgaccctgaaggcctgcagtatctcagttgttgtactcagtattggatttaaaagaaattcatcaatgtattagtaaacacagtaaggctctcccatcttacacatctggtaatttaagactagcctctgaagaagatgcacagtgagggaaggtagatatagacatagtgataattttaccttctcttcccccttttctttctcatatccttaaaagctttctctagagcctcttttttaggaaacagatggtgcaaagttagtctgtttccatgtgtctttaagaaaattacttaattggccttatgcccacctaccttgtcatggtaacttttctgtgattaactcattttttttttcttgtgactaactcattattttccccaatgtcaaaagcatttggtggtcaaaagttttaggaatgaactttgacttttaaattaaatgtctgctttcaaaagagatctgatttcttgaagctgttcttaaaaccaaactatggaaaataccaatctagatgatacattaacatagcaatagcaatattttgaaactgtacagtgtacatttcaaaacacttcatgggctaggcactgtggcttggctcctgtaatcccaatactttgaggggccaaagcaggaggaccgcttgagcccaagagttcaagaccagctcgggcaacacagcgagacctcgtctctacatatacaaatttgcccgggcatggtccctcacacctgtaatcccagcactttgggaggccgaggcgggcggatcacactgaggtcaggagtttgagaccagtctggccaacatggcgaaaccccgtctctactaaaaatacaaaaattagctgggtgtggtggcaggcgcctgtaatcccagctactcgggaggctgaggcaagataatcacttgaatccaggaggcggaggttgcagtgagccgagatcacgccattgcactccagctcgggcaacaagagcaaaactcttgtcttaaaaaaaaaaaaaaaaaaaaaattggccaggcatggtggtggtgtacacctgtggtcccagctattcgggaggctgaggtgggaggatcacttgagccccggtggtcgaggctgcagtgagccaagatcgtgtcactgcactccaggctgggcaacaaaacccacaaaacactttgtgtacattatcgcagtttatctacacaacatacctgtgagagcaggtggtataaagccattttctatactgaagaaaagatttcatcaccactagttgatggcagaattggccctagaatctatgttctccctgactccagctccagaatccttttgagcttaccatatattacgttccctaccaggaaaggatcatggtgccttgtggtagaaaatgttcttctggtttgcatttttaatacagtcctggaaaaagccagccagttttaggctgcttcccatagaattctgaacactgaaaacaaagaataatcaagaaggattttctccaggtgacctgtaaatttggcttcctgtgcctgctgcatcgggatcattaaatggtggcctattgtttgatggcatagtttttttgcctgttgctctcacatattagcttttctgaatgagactgagcagtggtgcctgtggttactttaacagagataatctcccatttaaaaggacctcataccaacagttctgtgtcatctctgtgaattttaaccttttctttaccacagtacgtctgaaagcactgccacaacagtgatgttcacatagacgtagagtagggttagacacactctataggacctttgcttctccctttctcctctcctttgggagtcactgggattgttgtttatagtacatggtatatatttctgctatgaattaaacaggatcccttatttgtttctttaaaaaataatgtcattctccaccttaattttcctgagctttcttagatttatgagtgggaattaggtaggtgtgtaagttgctgggagattttgtctaaaaaaaggtaattatttgtggatatgtaggggtctcttcttccaagaggcatctttcccactcccagtcctgactcaaagcacatgaacagcaatcttgaagtagttatcctcgctcatggttaatccttggataatgcaagcctgataccatgttctgagccctactgaacatttctaaagaactcggattcctcagaaaccagtgttatcattcctgaactactgtgataatttgtacacctctgtttagcttgattctgagggcctgcagtatctcagtcgttgtactcagtattggatttaaaagaaattcatcagtgtattagtaaacaagtgtcttaaatcttacacatctggtaatttttttttttttttttttgagacggagtctcactctgtcacccaggctggagcgcagtggcacaatcttggctcactgcaagctccgcctcccgggttcacgccattctcctgcctcagcctcccgagtagctgggactacaggtgcccgccaccgtgcttggctaattttttgtatttttagtggagacggggtttcaccgtggtctcgatctcctgacctcgtgatccgcccgcctcggcctcccaaagtgctgggattacaggccacatctggtaatttaagactagcttttgcagatgcacagtgaggggaggtagatatagtgataattttaccttctccctccccttaggagtctatactttgctcacaactcatctcaatgccatccttgtggagagccacagtgtagtgcaaggttccatccaattcactgtggacaaggtcttggagcaacatcaccaggctgccaaggtaataaggaattcacagcctcttttctcctattctctaagaaaaagatagcaagcatatatggcaggcagggcccaggagcccttcctcccttaatgccccttcctctcctcttctgtcacctgggtgatcttgtaacactgcatctagcctacaactcaaactttagcttagatggatcactgtaaccagcttgcttagtcttacctcctagtaggtgtgtttgggtaaatagggaaatagttaatagggaaaaatggctgataacacacctcttccttatgcatataattccccttcccacacagacttctggagctgctgtttcgctgtgtcttacattcttcccccattttcctaattctttacaccaccactttctctccttacctgattttctacatccatccatcctgtgtacttttggtaacacatttcttacctcatatggcccccttttcagggaaaaaacaaccacactaagagagcagaactaaaagctttttttttttttcccaaatagtgtgtctgttttcttgatcattgtcctattgcttgtcttctctgatgtgtctgtgtcagtaagtcacctctgtgaaatgcaagaacattttaaaattttattttaattccctaagtgttatgatgtaaaaatatgtgaggatctcagtaacttttgttgatggataggaagaattgttgaaatcctgctctgatggaaatgtgtgggccctctgggattctctaaaccacatcttgggattcatgcagtctcccccttacttgttatgttccccaggctcagcagaaactacaggcctcactctcagtggctgtgaactccatcatgagtattctgactggaagcactaggagcagcttccgaaagatgtgtctccagacccttcaagttagtaggagattgggattggggatgcttaaaagtgccagggttttggctgggtacggtggctcatgcctataatcgcagcactttgggaggccaaggtaggaggattgcttgagcccaggaatttgacaccagcctgggcaacacagggagaccctgtctctacaagtaattaaaaaatcacccaggtggagtggtgcacacctgtggttccagctcctcaggaggctgaggtaggaggatcaactgagcccgggatgttgaggctgagccgtgatcatgccactgtactccagcctgggcaacagactgagacctgtcttaaaaaaaaaaaaaaatgcccagggcagtggctcatgcctgtaatcccagcactttgggaggccaaggcgggtggatgacctgaggtcgggagtttgagaccagcctgaccaacatggtgaaatcctgtctctactaaaaatacaaaattagccagtcgtggtggcagttgcatgtaatctcagctactcagaaggctgaggcaggagaattgctggaacccaggttggggaggttgcagtgagccgagatcgccccattgtactccagcccaggtgacaacagcgagactccacctcaaaaaaaaaaaaaaaaaaaaagccaggattttaatgacattctactgcttatctttgtaaaatgtacagtatttttagaaacattactttatttgctccactgtgatgctacatagtaccaggcttaagttttaagaaatatttgttggaatagtagtatgtataccattttacaaatgagaaaacaaattatttaagatttctgctttctttaggtcacacagctagttaagaacagagctagggctgggtgtggtggctcatgcctgtaatcccagcactttgggaggctgaggcggtggattgcttgaggtcaggagttcatgaccagcctgaccaacatggtgaaaccccgtctctactaaaaatacaaaaatcagccaggcgtggtggtgcacgcctgtagtcccagctactcaggaggctgaggcagaattgctgaaacccgggaggtggaggttgcagtgagccaagatcaccccactgcactccagcctgggtgacaaagtgagattccgtctcaaaaaagaataagaaaaaaagaacagagctaggactagatcagtgattcctaatctaattccttgttgaaaaatgctatctcatggtgacagaatacactggaaataactgagcaaccttacctattacgtgtatgtggcagtacggaatcagaggctcaggttcaaatcctgactcatttacttattagttatgtttaggcctatagttctgagacttgtctacaaattggaaaaagtaatagtacctcacagagttattatgaaggtgagagctaaatgtgtgctatggtctgaatgtttatatatccccaaaattcatatgttgaaatcctaacccccgaactgataatattaggaggtatgaggcctttgagaggtgatttaggtcattaggccttcatgaatgggattagtgcctttatttttattttattattattttttgagtcggagtttcgctcttgttgcccaggctggagtgcaatggcatgatcttggctcaccgcaacctccgcctcctgggttcaagcaattctcctgcctcagcctcccaagtagctgggattacaggcatgcaccaccatgcctggctaattttgtatttattattattattattattattattattattattattattatactttaagttttagggtacatgtacacaacatgcaggttagttacatatgtatacatgtgccatgttggtgtgctgcacccagtaactcgtcatttaacattaggtatacctcctaatgctatccttcccccctccccccaccccacaacaggccctggtgtgtgatgttccccttcctgtgtccatgtgttctcattgttcaattcgcacttatgagtgagaacatgtggtgtttggttttttgtccttgcgatagtttgctaagaatgatggtttccagtttcatgcatgtccctacaaaggacatgaactcatcattttttatggctgcatagtattccatggtgtatatgtgccacattttcttaatccagtctatcattgttggatatttgggttggttccaagtctttgctattgtgaatagtgccgcaataaacatatgtgtgcatgtgtctttatagcagcatgatttataatcctttgggtatatacccagtaacgggattgctgggtcaaatggtatttgtagttctagatccctgaggaatcgccacactgacttaatttcgtattttcagtagagacggggtttctccatgttggtcaggctggtctcaaactcccgacctcaggtgatccacccgccttggcctcccaaagtgctgggattacaggcccgagctactgtgcccagccggattagtgcctttataaaaaaggccccaggccgggcgtggtggctcatgcctgtaagtaatgtcaacactttgggaggccaaggtgggtggatcacctgaggtcaggagttccagatcagcctgaccaacatggtgaaactctgtcactactaaaaaaaaaaaaaatacaaaaaaaattagccaggcgtggtggcaggcgcctgtaatcccagctacttgagaggctgaggcaggagaatcacttgaacctgggaggtgaaggttgtagtgagctgagttcgcaccattaccctctagcctgggtgacaagtgcgaaactctgtcccaaccaaaaaaaaaaaggccccagagagacccttgccccttctgccatgtgaggacacagggaggaagtgggcagcctacagcccagaggagggccctcaccagaacctgaccatgctggcactttaatttcagattccctgcctccagcactgtgagaaatcagtttctattgtttataagccacccagtctataggaatttggtatagcagcccgaatggactaagacagtgtcaaagtgcatagcatacggtagattctcaataaatgttagtgtttcccttcctttaggaatgtgtgctgaccaactggtattatcaatgggcaacttatcattccatatttgttgcttttttttttttttctctgagacagtgtctcgctctgtcgcccaggctggagtgcagtggcgcgatctcagctcactgcaagctccgcctctcaggttcacgccattctcctgcctcagcctcccaagtagctgggactacaggcgcccgccaccacgcccagctaattttttttgtatttttagtagagacggggtttcatcgtgttagctaggatggtctcaatctcctgacctcgggatccgcccgccttggcctcccaaagtactgggattacaggcatgagccaccacgccctggcctgcttcatttttttggtatagttttcttgaaaagctagtataacacaaaaaaattttaaaataataactaataaaatttatcactataatttttactcattatctcatatatatttgtaaccaaagcattctattttcatatataatttgccattttccccatttcaacagtcttagaatttttagttaatatcccactgtattgtttaaatctaatttaataaaccattcctctgttagacatttgtttacattcttgcttatatagtggttcagttaatacctttatgtaatatcttgcttcttttgaattattttctagaacaaatttctataaatggagttatgagtcaaagtgtataacacatttataagctagtgcattttatcatagcttcaactttctgggtcatgtggatagcacagggtagtgaaaagaacactatattgggaattctaaggtatccattaaagccctaacttttgtactaactagctgtgagatcttgggtgggtcacttcttttttttttattttttatttatttattttttttgagacagagtttcgctcttgttgcccaggctggagtgcagtggtgcaatctcggctcactgcaacctccgcctcccaggttcaagcaattctcctgcctcagcctccccagtagctgggattacaggcatgtgccaccacccctggctaattttgtattttttagtagagacagggtttctccatgttggtcaggctggtctcaaactcccgacctcaggtgatccgcctgcctcggcctcccaaagtgctgggattacaggcatgagccaccacacctggctttttttttttttttttgagacggagtttcgctcttgttgcccaggctggagtgcaatggcgcgatctcggctcaccacaacctctgcctcccaggttcaagcgattctcctgcctcagcctcccgagtatctaggattacaggcatgtgccaccacgcctgactaatttttgactctcctgcctcaccctcccaagtagctgggattacaggcatgcgccaccacgcccagctaattttgtattttcagtagagacagggtttctccatgttggtcaggctggtgtcaaactcccgacctcaggtgatccacctgccttggcctcccaaagtgctgggattacaggcgtgagccaccgcgcccagcccacttctcctttttgaatttcaattttctcatccataaaattagtgtgatgtattaggttattaccctggtcccctttaattctaacatcctataattatatatttaaaagtagaaagctgttacctatttcctgtgggtgcaaactgtattattttgttcctctcctccctaaaagactcgtcagaaaaaaaaaaagtctcatatcagcctcagttatgcagtagaacctgtgctgtcttggaaactcttcttatagaagagcagtttatataaccccttcatgaacagatggatcttctggatatttatctcctacagagatgggagaacaggccaggcgcagtggcttacacctgtaatcctagcactttgggaggctgaggcgggtggatcacctgaggtcaggagttcgaaaccagccttgccaacatagtgaaaccctgtctctacgaaaaatacaaaaatgagccgggtgtggtggtgcatgcctgtagtcccagctactcgggaggctgaagcaggagaatcacttgaatctagggggcggagggtgcagtgagccaagattgtgccactgcactccagcctgggtgacagagcaagactctgtctcagaaaaaaaaaaaaaaaaaaaaaaaaaaagagagatgggaaaacaaagaccttctttgaaggatcttgcttagatgacagaagtgggaagacatataggagccacaactgcctgtcttacaccaagtatctcaggccttctttttttctctactgccttcatgaaaactaagaaaactcttaactttaatggcttgcctactgtctgcctcctcatctccctgtataaactttctgtgagaactttcccccttggtttccagtactggaactcagcatgttctatttctggcccattttaggcagctgacacacaagagttcaggaccaaactgcacaaagtatttcgtgagatcacccaacaccaatttcttcaccactgctcatgtgaggtgaagcaggtaagtgtaaataatcagtactttggtgggaatcttccattttgatatatgggaatcctgaattgagggtgggtaggtacaagtgtttcagactgcataatctgaggtcagcctttcagcaaggaagtctgtgaaacaaaatcatctgttttctatctctcaggaatgactatcccactggttgcctggtgtccaatgtcttgaaaaccgttgtttcatgtgttgtatccaggatttttgttatttcaggcaggagggtagattcagtccccgttactccatcttgtccagaagacactgtaggataatttcatctttaatttctcttatttattcatcctacatttttagttccagataagtcaatcgtactgactggagccaagaaagccagaaaagtgggcttcagttagacaactactaccagctacacctggaatctggagaaacagaatttcctgctaggatctccgttcactcattagaggagaccatcacaaaaccagttaaaagctatttgacctccttgagggtaaagaccccaactaaggaaattctagatctccagcatccaaaaaggtgaaaagataaaagtgtgtgtgtgttttttgttttttttttttttgagatggagtctcgctctgttgcccaggctggagtgcagtggcatgacctcggctcactgcaacctctgcctctgtctcaaaaaaaaaaaaaaaaaaaaaaaaaaattagctgaggccgggcatagtggctcacacctgcaatcctagcactttgggaggccaaagcaggtggatcacttgaagccaggagtatgagaccagcctggccaacatggtgaaattctgtctctactaaaaatacaaaaattagctgcatgtggtggcacatgcctgttgtcccagctactggggaggttgagatacaggccgcgtgtggtggctacgcctgtaatcccagcactttgggaggccaaggtaggtggaccgcctgaggtcaggagttcgagaccagcctggccaacatggtgaaaccctgtctctactaaaaatacaaacattagccggtgtggcgacatgcacctgtaatcccagctacttaggaggctgaggcaggagaattgcttgaacccaggagacagaggttgcagtgaaccaagatcacaccactgtactccagcctgggcgacagtgagactctgtcccagaaaaaaaaaaaacaaaaccatgatacagaggggctgggaacgatggctcatgcctgtaatcccaacactttgggaggccgaggcaggtggattacttgaccccaggagttcaagaccagcctgggtaacatggcaaaaccccatctctacaaaaaaatagaaaaattagccaggcatggtggcacatgcctgtagtcccagctactcgggaggctgaggtggaagaactgcatgagcccaggaggcagaggttgccgtgagctaaaatcatatcactacactccaatctaggtggcagtgggaccctgcctcaaaaataaataaataaataaataataaataaacaaacataaaactaatagaactataaggagaaatagacaaatccaaaattatattttgagatttcaacataattctctcaataattaatagttatgataagcagagacagtcagaacaatgctttcaatcactttgacctaactggcatttataaaaacactctgttcaaccacagaagaatatgcattcttttcaagtgcacaaggcacttttagcaagatagaacatattctaaggcattaaatatgtctcaatacattttaaaagatctaagtcataaaagtatgtttctgactataatagaattattacagcaaaatcaataaaagaaagctatctagaaaatccccaaatatttggaaactaaatgacacatttataaataacctatgagttaaacacagaaatcaaagggatattagaaatattttaatttaattaaatggaaaagcaaattatcaaaatttgtgagatgtagctgatgtagtatttagaggggaaaatgcctgtgttagaaaagaaaaaaggctcaaatccatgagatcactttccaactgaaactagaataagaagagcaaattaaacacaaattaaacagaagaaatgaaataataaagatcagaatggaaatcagtaacatagaaaccagaaaaacaatggagaaaaatcaatgaaactaaaaggtggctcatttagaagattaataaaattgataaacatttagccagactaatcagaataaaaagaatgaacacaaattatcactatcagaaatcagaaaggtagcatcagatattaaaaggattatcagaatattttgaacaagtttacagtatattttacaacttagatgaaatggacaaattccttgaaagatacgaagcccactcaagaagaagtacccctatatacctgatagcactgtatctgtttttaaaattgaatgtttaaaaaccttaccataatatcctcaatatataaagaactcttaaaactcattaataagaacacaactcggtttttttaaatggacaaaatatttgaacacacttcacgaaagaagctacagatacacaaatggcagataaagacataagatgcccaacatcatcagtcacaacaaaggttcaaaaaagaaccacaatgagataatcatttcataccactggaataaaaggactgactataccacatgttaacaagcatgtggaagaaagaactcacatacactgtttgtggaaatggaaaatggtacaagcacttcggagaacagttagcagtttcttaaaaagttaaatatatacctatcatatgacctagctctttcactcctaggtatttacccaagagaaatgagaacatatctccacacaaagaatcatacacaaatcttcatggcacttttgttatagccccaaaaatgagaaacaacccagtatcaacaggtaaatggataaaaaaattgtagtagattcatataaaggaacactatgtggcaataaaaggaaagaactattgatacacacagtgacatggatgaatctctgaatagcatggcaagtgaaaaaatcaaaaactaaaggagtacatactgtttgattgcacttacatataattctataaaatgccaactaatctacacaggtcagtggttactagaggatgggaggtgggagagttggaatgattataaagggcagcaggatgcttgcagggagatgaatatgttcattatgttgattgtgtgatggtttcacaggtatgcacatgtgtacttaaaaattgtacattttcggccgggtgcggtggctcacgcctgtaatcccagcactttgggaggctgaggcgagtggatcacgaggtcaagagttcaaggccagcctggctaagatggtgaaaccccatctctactaaaaatataaaaaaaattagctgggcatggtggcaggcaactataatcccaactacttgggtggctgaggcaggagaattgcttgaacccgggcggcagaagttgcagcgagctgagatcatgccactgtactccagcctgggcaacagagtgagactctgtctcaaaaaaaaaaaaaaaaaaaacaaaaaattgtacattttctatgtatgcagtttactctgtcagtttatatctcaacagttataacaagtatggacactttcttttttttttctttttttgagacggagtctcactctgtcgcccaggctggagtgcagtggcgtgatctcggctcactgcaagctccaccccccgggttcacaccattctcctgcctcagcctcctgagtagctgggactacaggcacctgccaccatgcccgactaattgttttttctatttttagtaaagacggagtttcactgtgttggccaggatggtcttgatctcctgacctcgtgatcctccggcctcggcctcccaaagtgctgggattacaggcatgagccaccgcgctatggacactgtttctgagaaaatgagtaacagggcctttggtacctcctctgcatctgctctgccccttgtacttctgctttcctgattgggtggggaagtttaggtgcccaggcacccaaggatcaaagcatcttatggactttaccatcctcctcttcagtgtgattagagaggcacagagcagcagtaaagccgttagtgctcccttcaccaccccttccatggctggctgtgccttctacgatgcacttcccaggaacgtgtccactgttcctttcagctgcttcaccgcaaatactcttgccagtttccctcggacttggaaagccgctgtccacgccttgcgcaaataaagctaaaatccattgtatcagtttcctgggatgctgtcagaaattaacatcaacttgaaggtttaagaacaatccaaatttattgtgtcacagttctggaggccagaagtccaaaatcaaggtgttggcagggccacactccttccaaagtttctagaggagagtgcttccttgtcttgcctcttctagcttctgataaaaactgtaccttggtttcttgtagtttgcataactccaaactgtaactccatcttcacattgctttctccctgtctctcaaatctttctgcctttttttttttttttttttttttttgacaccgagtcttgctctgtcgcccagactggagtgcagtggcaacgatcttggctcactgcaacctccgcctcctgggttcaagtgattctcctgcctcagcctcccgagtagctgggattacaggcgcctaccaccatgcccaactaatttttgtatttttagtagagacggggttttgccatgttggccaggctggtctcgaactcctagccttaggtgatctggctgctttggcctcccaaagtgctgggattacaggcaggtaattagggatttagggcccaccctaaatccaggctaatcctgtcttgcgatctggaattacatgtgcaaagacttttctcaaataagctcacattcacaaattctgggggttaggatttggacatatttggggtgggggagaatgcagttcactacagccatccacatcttcagctttctagggacaggttcagggtaaggcatgtgctgttatcataggacccaggatataagcgcagagggactcctcaggatctaggagtgcttcagcctctgaagtacttttacttgggcctctgtggtatcccagtaagacctaaaaaagataatctgggccaggtgcggtggctcactcctgtaatctcagcactttgggagggcaaggcaggtggatcacttgaggtcaggagtttgaaacctgcctggcaaacatggcaaaattccgtctctactaaaaataaaaaaattagccaggcctgttggcacacccttgtagtcccagctactcaggagggtgagacatgagaatcgcttgaatctagggggcggaggttgcagtgagccaagatcatgccactgcactccagcctgggtgacacagcaagactctgtctcaaaaaaaaaaaaagatctgacctcttttaccctgttcttttgctatagtcatggctcatagcctcagggccattcatagcccaattaatttggcatatggctagtgaactcaaggtcttaccagtagtcataggtcttggaaagaaggaacacttactgaatccctaatctgtgccgagattttcactttaatctctgcaaagatgttataaattaggtcatagttttcccattttacagatgaggaaactgattacagaactttcataatttgcccagaatcacagtcagtaaatagcaaggctagaatttgtaccgagagctcccggctctgaaacctggtaatattgttaacacagaggactaggttgcaagcccagggcagatgagtgatccaggtcattgagtagaacccatgattctccactcaacatcctctggtaatggccatttagtgataaataacttgttagtggtacaagagtggcacccagtggcttcagctagaactacaagactaaggatgataggtcaaattctttgacctctgggccattctgtttccatttctaaacaggaaaggtagaatagctgacctcttgagtaacagggaagaaaaccatctattatatgctttattgagaaactgaaaaaatgagggagtgtgtattcagagtgaacatattcagggaaaggtcatgcaggaatggagaaggtattatttttgtttttatttttttagaaacaggttcccgctatgttgcccgggctggagtgcagtgactattcataggtgtgatcatggtgcactacagcctcgaactcctgggcttaagtgatcctcctgtgtcagcctcctgagtaactggaactacaggcgtgcatcactgcacctggcgaggagtggatattttaagcctgaatgtttgaacagagacagtgggccaggaaggagtgaacaagatagtactccagggtttagtgtcatagatatatgtagggactgagaacttaaacccagaatgagcaggagtagtatcaaggaggcaattttctaaggaaaggcattgtttccggcgggtcgggggagggggtagactagaaataaatgtcccatagaatgttaaatccaaggtgtattctgaggtcagggctgtcttatctgggggaccaggtgatgaatgaagggtgtgcaaggctaccagagaggcccagagcttcatatctcaatgcgggtagttccttgataagacccatttcaagataggagaaagatttatctatgacacgagattttccaagctaaagccaaaaaaaaaaccaagttctgtctcaagataaaaatatttagaaaatatcctgtttctttctttatgtctttagaattatttttgcccctcctatgttccttggaatataattacttgggaactaaaacttgttttagtaaacaatatatgatagatctctcatggagataattcatataccataaaatttaccactttaaagaataaaactcattgattttaagtatattcactgtgctgtgcagccatcgccactaaaattacagaacatctccatcatgccattagcagtacctattcgcagtgagtcccagttcccctctcccttcaacccctggcaaccactagtatgcttcccatctctgtggatttgcctattctggacacttcatatagatgggaccatacaacatgggcctttatgtgccttctttcatttagcatgtttctaaggctcatctatgttgtaccatataacaatttcatccattctttatggctgaataataatccattgtattgatataccacattttatccattaattagttgatgaacacaagttttttccacttttcggctattatgaatatgctgttacgaacagcatatttgtgtggacatgcttgtaactgtcttgggtatatatctaggagtagaattgctgagtcatatgataacactatgttctaactttttaaagaactttcgagctgatttccacagtctgcatcattttacattcctgccagcactgtgtgatggttccaatttctctataccctcattaactgttgtcattgtttttcttactgccattctagtgcatgtgaagtaatttcgtggttttgatttgcatttctctagtgaatactgatgctgagtatcttttccatgtgcttattggccatttgtatatcttctttgaagaaaggtctattcaaatcttttgcccatttgctgttgttgttgttgttgagacggagtctcactctgttgcccaggctggagtgcagtggcgctatctcggctcactgcaagctccacctcccggattcacaccattctcctgcctcaagtagctgggacttacaggcgcccactaccacgcccggctaattttttgtatttttagtggagacggggtttcacaatgttagccaggatggtctcaatctcctgattttgtgatccgcccacctcggcctcccaaagtgtagggattacagacgtgagccaccgtgcctggccctcttttgcccatttttaaattggtttgttaaattattgagttatgagagttctttaccttgggccaggcaaggtggctcacacttgtaatcccagcactttgggaggcggaggtgggaggatcgcttgagcccaggagtttgagaccagcctgggcaacatagtgagacctcgtcactacagaaaatatgattttttttttttttttttgagatggagtcttgccctgccacccaggctggagtgaagtggagcattctcagctcactgcaacctctacctcccgggttcaagtgattctcctgcctcagcctcctgagtagctgggattacaggtgtgcgccaccacgcctggctaatttttgtattttcagtagagacggggtttcaccatgtcggtcaggctggtctcaaactcctgacctcattatctgcctggctcagtctcccaaagtgctgggattataggcgtgagctaccgtgcgtggcctataaataaattttaaaaagagttctttaatttgggtaacagtaccttagcaggtatgatttgtaaatgtcttctcccattcttgtggattgacttttcacttttgttcataggaagcacaaattttattttatttttattttcttgagacagagtctcactctgtcgcccaggctggagtgcagtggtgtgatcttggctcactgcaagctctgccttctgggttcacgccattcttctgcctcagcctaccgcatagctgggactacaggcgcctgccaccacgcctggctaatttttttgtatttgtaatagagacggggtttcactgtgttagccaggatggtttcaatctcctgacgtcatgatccgcctgcctcggcctcccaaagtgctgggattacaggcttgagccactgcacctggccgagaagcacaaatttttaattttttttttttttttttgagatggagtctcactcatcacccagactggagtgcaatggcgtgatctcagctcactgcaacatccacctcccaggttcaagcaattttcctgcctcagcctcctgagtagctgggattacaggagcccaccaccacagccagctaatttttgtatttttagtacaggcggagtttcaccatgttggccaggctagtctcgaactccttacctcaggtgatctgcctgcctcggcctcccaaagtgctgggattacaggcatgagccaccgcgcctggctatgaatttttaattttgaggaagaagatacctatttttatacatctgtattcttgaaaaggagctgggaggattgggttctggtctcagtaagaacctctttttctctgtccaaattattgaactaaccagtgtggcagggctctaggaggctaccgatgactacagaatataccctgtggcttcccaggtttgactttctcagtcaaacttacctggtgtaaggcactctgctagctgtaaagtgataaaggcatgatggcccttgcctttgaagggatttagggtgtagaaaatggacatttgcacattacttgatgaatgggcacacaggatacttgcagagtatgcagagcccgaggaatgggcaggcagtagccaagagactggagctcagagaagaaaggatgtgccgtgaatggccagagtggagaaggatccacagagggaaaccttgaagactggagggtgggtagggggattcatgagccaggaggaagagggagttccaggtgagggcagataaccttgtgaggtcagtgaagccaccaggcacactcctgtttcactagggctcgttcatgtttctacaaaactcacttaggacttctaatttttttaagcagctaaccctagaaaaaaaggactcagcccagggcactgaggacgcacctgataacagcagcctggagctcctagcaggtaaggttttagcttttcaagtgagccctggactgcagcagaggaagtaaaaaacgtgagttcaaactttcaaactattccactgtaccttctactacagcggcgtccttctgcaatttagtgggctgttgctgccactgtgggtcttcaaggcagcagcaggtcttccctccccaagatgttaggacaggactagaaatttgtattaaagtctgtgcagttacagatagctgcacatgatggggtgggggtaggtaatacgcagattcagggccctgaattttattttatttttatttttttgagacagagtctcacctctgtcgcccaggctggagtgcagtggcgccatctcggctcactgcaagctccgcctcccgggttcacaccattctcctgcctcagcctcccgagtagctgggaccacaggcgcccgccatcacgcccggctaaatttttgtatttttagtagagacggggtttcaccgtgttagccaggatggtctcgatctcctgaccttgtgatccgcctgccttggcctcccaaagtgctgggattacaggcgtgagccaccgcgcccggcctggcaccatgtcactcttaatgtgtgttatgggaaagtgtcagtgcgtgggttgtgattgcaattatactgaagtcttttctccatacatgtctcctgcagtgcttaaacagccttcccagcccacagcagcaggggtacagcagctctcacattcagtcactagcagagatgccaggtactattctgagcttttaaaatgtactaatgctcttagttctcaaaactatcctaggagctataggtactgttattaactctcattttgcatatgaggaaattgaggcccacagatatcaataaacttacccaaggctacacagccagtaaatgacagagcaagaattcaaacccaggcagcctagctctgctgtctctggaagagccgaattagcagggatgccctcctacagatcctgagtccttcagataaaacagtatctgggtcaagggaagctggggatcgtgacgtcagcacctatgcttggttggtaaatccctctttctagggtcacaaccacaacacatacgcgtttatgcttaggcctaagatgtgtccctgaaatcactgtcaactgaaccatgttttaaatgttgtgggggctgttgctactgaaaagaaccctgctgtgaacgcttgtacaaagcaaagaatctatttttataaatttagatctggagattttaaaaaatgcaaatatgatacatacaattcagtatttatgcagtcagaagagacaaaggaataagtatcttcccatacaaggaaaaaaattaacatttaattcagtaccttctgtggaccctggggagatgctggggtcttccacagccttatctcatttagtctttacagtgcccttctgggggcagggggaggcatggatcctaacaaactagaggacccaggctcaggtgaggcagaacgcttagcaggaggtaatgactttcagtttgccgcctccaaagcccatgttttctccagtgtgcaacatgagctttaaaatctaggtgtttataatctggtggaacccctggaggatggcttgggctgttctgtcctacagacctgtggctctcagcatccattctacgcctcacatgggcagccctgctgaagaaaatcaccaaactgtgtgttgatgccaccatccattggtggtccactcactcaggagcctttggtttgtcagtccttccccctgcctttctggcctttgtccctcagtggctactccattctttaaaaaatctacccagtctctgcctcctgcttcatacttacggatctcttttctcagtaaactcacccaacttgcaccctcccactgcagaacctcatcagtgtggggacccatttcctccaggctcacagtgggatcgtcccttctgctttcttgggacctgcttgcatcagttatcactgctgcaccttcagccttcccctgagttcctttccctcagcaggtcaagctctcatttcatcagaagaaaatctcccgtgaccttgaacttcctccacttatcctcaacctctctccctcacatctcagccaaggatctcaaaaccacaagctgcatgcaccctgtctccctttcttcctctcattctctccctcacttagggtacttgctttttctgtggcctctgaaacttctctcctcagggaaggcctcttaattaccaaattttgcatttaccttcattgtatctgaactatgtgcaaaatttggcactgtaaggctatgactcgcctggtttttccctccctgggcttttctcttcatctactttcctctggtcatgcctaaatagtgctcatcctgctctcccacccagctatcttccatcccaactgttgaccactgcctctgggctcaagactctcaaattggtatgaccagccaaggcctctgctgagtgccagctgggagattcatttgctcactaggcagctcctcgtggaggtcccattggtacctcagtttcctctctcctgactaaagagacttttagtctgtttcatgattaatccaatttatcacatctgaaatcttggattcattcaagaggcctctcattttttttttttttttttttttttgagacagagtctccctctgttgcccagactggagtgcagtggcgtgatctcggctcactgcaacctccctgcctcccaagttcaagtgattctcttgcctcagcctctgagtagttgggattacaggcgcccaccaccatgcccagctaatttttgtatttttagtagagacggggtttcaccatgttggccaagctggtctcaatctcctgacctcgtgatctgcccgcctcggccccccaaagtgctgggattacaggcatgagccaccgcgcccggccaagaggcctctcccacatccaggcgctcacaaaggcctatcacttaggcctgatgaacacttctgattcctggtgacgcctctatctccactgtctttacttgttattgggctcttaaggtcttcctgtctctagtttgatctaagccacacctttgaaagaacgatctttctgaagtacaaaattaccaatatatttcaccagtgcttaaaactctttattggcttcctgtcttctacagatgaaaatctgtttctagccaggcaaggtggtgtgtgcctttagtcccagttactcgagaggatgaggccgggagttcaaagctgcagtgagctacaatcacgccactgcactccagcctaggtgacaggcgagacctcatctttaaaaagtaaaaatttacataggaagttgttttatgcctttgcataaggtttgtgttaactttcagcaagaaattccctttctctcccttgtctggcatatcactcttcatccttcaaaacccagctctggggcaggagtggtgacttatgcctgtaataccgtcactttggggagctggggcgggaggacagcttgagactagcctgggcaacacggtgagacccctgtctctacaagtaaaaaaaattagccggtgtggtggcatgcgcctgtggttcctggtactctggaagctgaagctgaggcagtaggatcgcttgagcccaggaggtcgaggctgcagtgagccaggactgagccactgcactccagcctgggcaacagagcaagaccttgtctcaaaaaaacaaaaggtcagctcaggtatctcctcatggaaacccttcttcacatccagaggtggtcggcttccttctctattctaaccctgggctttgtacacaggtctgcatcccctcctagcatctgtgagcttctctcagggaaaagctcattgatctgcatccccaagacctgctggggaagaatctatccatctaaactcgctttaatttgacaaatgaatcagttaagagtaggaaagctgcctatgggcactgctcaatgcaacgtgagcaacaaagggagacagaactgaggccagaaaggtgaggggggacagaggctggcagggaggggagcttgtcagtgcagactccaggaagaatctatacagaaagttactgagcggcctgagtcccccaagtgagggctcgggacaatctcccgcctgggtgagagaatagggagaccctgaaacgtctctgcagcctcgggctgctccagaagcgcccacagctgcagggttttggtgtggatgggacctgctgacagggatgcggtgggaagagcccctcggcgcccgttctcccaggcttccccttggccaagggtgctcctagcacagggccatgaaagtaagatgaagaggcttgtttttctcctagataccagcgggcaagcagaaaacaagaggctcaagaggggcagcccccgcatagaggagatgcgagctctgcgctctgccagggccccgagcccgtcagaggccgccccgcgccgcccggaagccaccgcggcccccctcactcctagaggaagggagcaccgcgaggctcacggcagggccctggcgccgggcagggcgagcctcggaagccgcctggaggtaactgggcgagggccgcgcagggaagggctcagcaggaggtgcaggccacgggccgctgctgagaggtcctcaccccgggcccccttgttcccgcaggacgtgctgtggctgcaggaggtctccaacctgtcagagtggctgagtcccagccctgggccctgagccgggtccccttccgcaagcgcccaccgatccggaggctgcgggcagccgttatcccgtggtttaataaagctgccgcgcgctcaccaagtcc

SEQ ID NO: 36678 - DNA, 2569 bp, Homo sapiens
ggggagggggcagtgtcctccgagccaggtgaggcgagtaggaaatgctggatctggttaatgattcgccttgttccgggagtgcgagcgtggcaagaggaagctggtgaagtgggggaggatgcgtgctccggagggccgccaccccaggaatgtgtggctggcgggtggggctggcacaggagggtggggcccgtgcggaggggcggcagcccagccgtttctagggcaggccaagaggatgaggagaggaggaccagcctgcgataggagtaggcaggtcctgacccggtgcctgcgccctccccacaggacaggcatgttgttgggactggcggccatggagctgaaggtgtgggtggatggcatccagcgtgtggtctgtggggtctcagagcagaccacctgccaggaagtggtcatcgcactagcccaagcaataggtgagtcctctcggggtcaggcaggccgggcaggtagagctgaagtgggacctggtggtccagctccatggtctcccccaaggagagtggggctggttgctgatcctttttgttcttcccaactcttcaagccaggtggacagagagtcggggggacataggctgaccttctcctcttcttcccaggccagactggccgctttgtgcttgtgcagcggcttcgggagaaggagcggcagttgctgccacaagagtgtccagtgggcgcccaggccacctgcggacagtttgccagcgatgtccagtttgtcctgaggcgcacagggcccagcctagctgggaggccctcctcagacagctgtccacccccggaacgctgcctaattcgtgccagcctccctgtaaagccacgggctgcgctgggctgtgagccccgcaaaacactgacccccgagccagcccccagcctctcacgccctgggcctgcggcccctgtgacacccacaccaggctgctgcacagacctgcggggcctggagctcagggtgcagaggaatgctgaggagctgggccatgaggccttctgggagcaagagctgcgccgggagcaggcccgggagcgagagggacaggcacgcctgcaggcactaagtgcggccactgctgagcatgccgcccggctgcaggccctggacgctcaggcccgtgccctggaggctgagctgcagctggcagcggaggcccctgggcccccctcacctatggcatctgccactgagcgcctgcaccaggacctggctgttcaggagcggcagagtgcggaggtgcagggcagcctggctctggtgagccgggccctggaggcagcagagcgagccttgcaggtgagcccggggacctgatcccctgtcactcccccacccctgatatgggcagatacggggatcacagggtcccactcgggaggcaggtgagcccggggacctgatcccctgtcactcccccacccctgacgtgggcagatatgggggtcacagggtctgactcgggaggcaggtgagcccgcggacctgatcccctgtcactcccccacccctgacgtgggcagatacgggggtcacagggtcccactcgggaggcaggtgagcccggggacctgatcccctgtcactccccaacccctgacgtgggcagatatgggggtcacagggcccgaccagggaaagtgctccctccggagcacaagggctgtggagcccagtggctgtgcctcctaaggatctcatgtgtccccaggctcaggctcaggagctggaggagctgaaccgagagctccgtcagtgcaacctgcagcagttcatccagcagaccggggctgcgctgccaccgcccccacggcctgacaggggccctcctggcactcaggtcggagtggttctggggggaggctgggaggtgaggacctggcccagccccactccaagctgacttcccaacccacagggccctctgcctccagccagagaggagtccctcctgggcgctccctctgagtcccatgctggtgcccagcctaggccccgagggtatgtctgtgccccacctccccctggggcaccgggccctcctgtggctgcagccacctcagcctgtgtcctcccgcagtggcccccatgacgcagaactcctggaggtagcagcagctcctgccccagagtggtgtcctctggcagcccagccccaggctctgtgacagcctagtgagggctgcaagaccatcctgcccggaccacagaaggagagttggcggtcacagagggctcctctgccaggcagtgggaagccctgggtttggcctcaggagctgggggtgcagtgggggactgccctagtccttgccaggtcgccagcaccctggagaagcatggggcgtagccagctcggaacttgccaggccccaaaggccacgactgcctgttggggacaggagatgcatggacagtgtgctcaagctgtgggcatgtgcttgcctgcgggagaggtccttcactgtgtgtacacagcaagagcatgtgtgtgccacttcccctaccccaacgtgaaaacctcaataaactgcccgaagc

SEQ ID NO: 36679 - DNA, 3348 bp, Homo sapiens
gagctcgcgggcgactgcctgccaggcagacgctgcagctaagctgcgcggtggctgtggcaggtgagagcctccggaagggaggcggcctctggccccgaccctgctccgcgatcgcccactcgggcgcccggccgggcctggcagggaagggccgccgccgccgccgcgcgtttgcgaggcctggcggggccgcggggcccaggaatggcgtaaggggcccccccagactccgagacggcccgagcgggtcgccggctgtgggacggcggcgtgcccttcctttcctccctcccaggttcgcgcccgagctctgctagccacccgtccgacaacttccggactcccaggtagggaggagcccctgttagcactgccagttaccccgaacacttggccgttttggaagggccgggactccctcccctgccttgtgggtgcatctgctcaaactctgtcggcccctcaagcagaaatggtgtgggatctgggccaaacccctcttggagtgactcagagccgccagccctactggagggatggggcatggggtggatggcccctagcctttcccttctgagctggtttgtatcaccccggtggcttcagtcctggtgccttcatcttagctcctgtactttgcctctcccaccccactggttttcctgcctccctcttcagaggtaagacacatggctggaccaaggcctccagggtaagtgacccgaacttcaagccagcagaggccatgtcatcctaagctagggataggggaggctcgccgggatgagcctttggcttaacctaacctctgctccctacttctgcctcaccccagtctcagatgacgggaggccaatgccaaagacggataggatctatagaggcagtcctcttctaggactgggacacaacagtgcatgaggcaactgacaggggtgatgtaaagctgttgtgtctccatcctggttgccccagttctagcaggtgatgtgacactacggtggtcgctgcccagattgagaagtggaagggggtgttgctggccgctagaaacactcataattccactgagtttgaggctctggtaggggcgcatgtgggcatgggaaggagccctgcactctgagcacagcctctcagatgtaacgcagtggctctgggagctcaaagtctcagcccagtgggagctctgacaaaaggaggagaaacccccccagtagacatgtggctctgtctgatccactcctgccgccccttctggcaacttccctggggagggaggacctgcttcccagcaggaccttcatcgagtcactgtaggggcaggtagagtgggccagggagccacagctgaatggcactcaagggccatcactaggcattgcctctccattcctgagtgtggggcaagggtccctgctgagttttactcttagcagtgggcttccagatccccatgctcctgggttcttgactgcctccctcttcagaggtaagacacatggctggaccaaggcctccagggtaagtgaccctcaccagctgcctctctgtgtcccttacctcctcagggacagccctgccatcaaggaagacagcacaggactgggacccacccatgaacccttctcaggacaacccaacagcaccagtggggatgttctcctaagccgcagagggcctgggcacgccatccgtcctccaggaagagccatggtgttaatgcaggacaagggcagctctcagcagtggcctggtctggggggcgagggtggtggcacaggtcccttaagcatgctcagagctgccctgctgctcatcagcctgccatggggggcccaagggacagccagcaccagcctcagcactgctgggggtcacaccgtgccaccgactgggggccgctacttgagcattggagatggctctgtgatggagtttgagtttcctgaggacagtgagggcatcatcgtgatctccagccagtacccaggccaggccaacaggacggcgcctggccccatgctcagggtcacctccctggacacagaggtgctgaccatcaagaacgtgagtgctataacctggggaggcgggggtggctttgtggtgagcatccactcaggcctggctgggctggccccactccacatccagctcgtggacgcccatgaggccccgcccacactgattgaggagcggagagacttctgcatcaaggtctcacctgctgaagacacgcctgccaccctcagcgccgacctggcccacttctcggaaaacccaatcctctacctgctcctgcctcttatctttgtcaacaagtgttcgtttgggtgcaaagtggaactcgaggttctgaaggggctcatgcagagcccccagcccatgctgctgggcctcctgggccagtttctggtcatgcccttgtacgctttcctcatggccaaggtcttcatgctgcccaaggccctggctctgggcctcatcatcacctgctcgtcgcctggcggcggggggagctacctcttcagcctccttcttggaggggacgtcaccctggccatctccatgactttcctctctacggtggctgccactggcttcttgcctctgtcttcggccatctacagccgcctgctcagcatccatgagacgctccacgtgcccatctccaagatcctggggaccctgctgttcattgccatccccatagccgtgggcgtgctgatcaagtccaagctccccaagttctcccagctgctgctgcaggtcgtcaagcccttcagctttgtgctcctcctgggcggcctcttcctggcctatcgcatgggggtcttcatcctggcaggcatccggctacccatcgtactggtgggtatcacggtgcccctggttggcctgttggtgggctactgcctagccacgtgtctgaagctgccagtggcccagcggcggacggtcagcattgaggtaggggtgcagaacagcctgctggccttggccatgctgcagctatccctccgccgccttcaagctgactatgcctcccaggcccccttcattgtggcgctgagcggcacctccgagatgctggccttggtcattggccacttcatctacagcagcctgttcccagttccctgaggcctctgggtcaagctttcatcagccccagcccccacactccaccaaagttctcatgcactatgcactcagaaaaatccaggcttattttttttactgattttttattctccagctttcagtgccaaagaggccatgctgagttaggtaggtgggcgctgcccagaaaatatatttcaataaaagagagaagcaagc

SEQ ID NO: 36680 - DNA, 8981 bp, Homo sapiens
gctcttcctccggggccgctggcactgcggccgctccgcaggcagagaagccgggagcgggcgaggcggcggcggcagcagcgatggtgagggcccaggcggggccggccagccctgcgacgggcagagggcgagtggcgagggtgggagagaggagtccaaagtccgcgggctggggcctcccctggggcccacgagggccagacctgaggcggtgaccactgctggagcaggacggggcggaccctccactccctgcgcgccgcatgggagagaaatgcgtgagccccgtcctggctgcaccgcgcagagcgagcgggactcgggctccccattctcctgaagcaaagcggttaagagcaccgactttggagtcggactccgggctgggatcccagctctgtgacccgggacaagtcacttaacctccctgagcctccttttccgcgtctgtgaagtggggtcagtaatacctgccttgttgggtccttgcgaggttaaaggagccacagtggcagagacccgcctggcactcagaacccactgctaagaagtggtaggaaatgtaacgacctcgtcagccctttccgcagctgtgaggagccaagcctggctcaggagttggaaacttgagcagatggggtggcagaggccattccagccccatggcagggtgttggagggcgaactcctcccctagagaaagagaaagggagatgtttactctgaaagttccactgaagttatcagtgtatggcacaggcctgactccctgctaacctctacctagtgacacattcctgagttgagtcatccccactcctgctgcagatcctggcctttgtcctcacttgccatctccaaggcaaagatgtcaggaacagctggtgccagtttctccctttccctagggctcctgggaaaatggactgggcaggaagtaggcttggtgctttaagattttgccttggagaaactgacagaggtgtgatggatgtggcctggctaggggtcaatgcctggatggccttatctccagggaacttggaggcaggaagaggaagtggggcaggaaggtagcactgagctctgaggccaggccaggaagctgaggaaggctctgagaatagggcagagcccagagcccacttaagggtgtgcagggcaaggggtcaggcaggggtaggggtgggcttcagccggcccttagctctttgggagaagctcctgaagtgaaggctgaaggcaggatattttattgggggaggaggatactgggaaacctggggattctcacgggtacatttgaggcagtctgtggaggagaggctggggaggtcgctcctccacccatccatctcctagcctcttcctgtttcttctttcactcttgcccctttagcgctttccttccttccacccatcccctttccctccctggtccttcttcctttcacttttcttttcttctctatgactcattcaaccaacaaggatttcttggaaatgtccttcatgccagcatggtgacaagtataggggacagagcaggaacaaagcagtgatgggaaagatggaaatggaatgaataattacttgaattcattaatcttgtagatgatcctctctccaaagaatgtgtgtgttgagccacaggcctccctcatatgcacacaaattaggttggtagcatcaaccagattctttagccaatcagctaaagtgtctgacctccttgtacctgcatctaatttagcacacgggttacaaatgtggtgcctggagtctgtgttggttcaactcccagatcttctactcactggctctgtgatcttggacaggtgatttaacacctctgagccaaagtttcctataaaactgggaaaaggccaggcgcagtggctcacacctgtaatcccagcactttgggaggccgaggcgggcagatcacgagttcaacagttcaagaccagcctggcaaacatggtgaaatcccgtctctactaaaaatataaaaaaatagccgggtgtggtggcacacgcctgtagtcccaactatgcgggaggttgaggcaggagaatcgcttgaacctgggaggcggaggttgcagtgagctgagatcgcgccattgcactccagcctgggtgacagagtaaggctgtctcagaacaaaaacaaacaaacaaacaaacaaaataactgggttaataatatggccttcaatgggttgttgggtgaggattaaatgagacagagcaaatgaacagcaagcagcatagtgcctacctcagagtatgtgcccattggatggtggctgttattcttgctcaagatgtaaaacctcaacagcctgccgtgccagatgaaaataaactagatgcagccgggcgcggtggctcacgcctgtaatcccagcactttgagagagaggccaagccaggtggatcacgaggtcaggagttcgagaccaccctggctaacacggtgaaaccctgtctctactaaaaatacaaaaaattagctgggcgtggtggcaggcgcctgtagtcccagctaccctggaggctgaggcaggagaatggcgtgaacccaggaggcagagcttgcagtgagtggagatcacgccactgcactccagcctgggcgacagagtgagacaccatctcaaaaaaaaaaagaaagaaaataaactagatgctagttaccaagttaccaaaagcccatttaaagttctgagccacaggttagaaacaattatgtgtactatgtgtacaagtttgccatagggaagagcttgcttggctgtgcattttataaaacgaagaggttttactgaccacctgtattacacaattttttttttttttgagacagaatctcgctctgtcgcccaggctggagtgcagtggcccttagttcactgcaacctctgcctctcaggtttaagtgatcctcctgcctcagcctcccgagtagctgggattacaggtgcccgccaccacgcctggctaatttttgtatttttagtagagacagggcttcaccatattggccagactggtctcagactcctgaccttgtgatccacctgcctcggcctcccaaagtgctgggattacaggcgtgagccaccacacctggccatattgtacaattcttgagatctgactgctaaaaaaaaaaaaaggagctagggaaatgtgggccacatcaatataatagctcttatttattgagcatttagtatgtgtcaggcgttgtgctaagcttttgatttacaataagtcacataatccttagctaacattattatcagcactttacagaagaggaagtggaggtcagaaaggtcatatcctcagtctcagtcactcagctggtgagtggcagaagcaggatttcaacagacgggtgcaaagcagagccctgctcctagtctctgagctgagtgccgacttagggaggcaatgttataccggtacttgcgcccattcatctgacgacagttagaacagtttcttggatactagacaggagatggggagacaaggagagttaggatagggaggtttttttgtttttgtttctttgttttttcttgagacagggtctcactcctttgcccaggctggagtgcagtgcgcaatcttggctcactgcagcctctgcctcctaggttcaagcaattctcctgcctcagcctcccgagtagctgggactatgggcaggcaccactttgcctggctaatttatgtatttcttggtagaggcatgatctgcccaccttggcctcccaaagtccagggattacaggcatgagccaccgtgcctggcccagatggtgtggttttgagaactgcgttttcataggaggaatcaaagagattgagcccagaaaaacctgagaggtttgagtgtcatagaggggatattctgtacagggggcaacagtctgtcaagaacatttcctgtgtaactgccactctctggcaattacacaactgctcccctctcgccctggctcaaaattccaagccctgcaggcttctggcctcaggtctcagaaatgcctgtctcacccttcttcctttctccacgctctgcttgtcacccctctcccgcctggtggccatctcctggcagtcttgctgatggtacttctccacccctctggctggcctctctgccattttcttacttctatctgtgcctgtctaccaccaatagagaaattatcctgaagcacttcttcactgtcacccgtggctcaaaaaccacactagctcttaagttttatcagtcgcttggagccagtcttctctacctgaccttttctgccttctgtcctgccccatccctcccatcctctgcctggtcctcactgtcagggtgtatccctatctctcagtgcaagaatgtccctgctccatgtcatccttcaaggggtcacccgcccccaccatggcaccctctctgtggcagctctgatacttactatctgtatcgcacagtgtaactctttactcttctctaattgtattacatgtgtcttttccccagggcaaagtggtctctttaagaataggcacaattaggccaggcatgatggctcatgcctataatcccagcactttgggaagctgaggtgggaggactgcttgagcccaggagttcaagaccatcctgggcaacatagcaagaccccatctttaaaaatataggcaccatttattcaggaactgtttatcacatctctgctgtctgcagacattatgctgagtgacagtgtggcgtaaggcagtatggcccttgtcctcttgcttacctccttccagggtccctggagctttatttctcacagtgccagcagagacctgtgtatatagtcagtgtcctttttcctctggttgagtgggggccaaggagggcccgagacttgagtctaaggcctctgtgttccctggagcgaatgtgttcttttaggcctgggtccatcttggctccaggcaggcctggcttcgcattgggggagactggtccagattacagctggaagcacagccagctctttggagaatgtgacccaaatatcaccccttgttgaaaaataaggtaacaacagctgtagcatttagaatagaaaataaaaagataatatccagcattttcccagtctctagcagtgactcttattttcgagtatttatccattctcaagtttttgctttggactatttaattttgttttttgttttgttttgtttgctgagatggagtcttgctctgttgcccaggctggagtgcagtggtgtgatctcggctcactgcaacctccgccacccaggttcaagcgattctcccatctcagcctcccaagtagctgggattacaggcatgcaccaccatgcctggctaatttttgtatttttagtagagacagggtttcaccatgttggccaggctggtctcgaactcctggcctcaagtgatctgcctgcctggggctcccaaagtgctgggattacaggtgtgagccactgcgcccagcctgccttggagtatttgaatgtggggaagttcaaaggattgaatgatggagccttgttgaatgctatagtagtaataatagtgatgacggttgactcaggaaaaggtgagagtgcagtttccctgctctcttcgttgttcctctgtgtttcctgcttactgcttcctccagcctgtgagcgcagcctcccctacagtggtttgcctgacctctcttgaagcaggttgcttttctagctcatgggtaaatattgacctatttgggtttcaaatgcctgcccctcgaaactcatgcagggctagaaaaacatgctgggagaacatctcttgagaataagaattgcttttggttaggctgtatcgtaattggcccactcactgattccttgcttgcaatggtcagcactgtgctggcctcccggtgggatggtggtggacaaaggcagggcactgctccctgccctccctctgggagtttgtggtccagctggggagataggactcatacagtgggaattcttggaggctgtataccaagcagctgcaaggatcctgaaggaggattcttggctgagtgggaggtagccctctgtgaccaccagatctcttctaacacttaagttttctggttttaagtggaattcagtcaagtgccaaaatgtctgttgtagacaatgggtgacgtgggctggcaggaaaagaagcttgcccttcttgtaaggaggggaagggaacagggatgggctgtggggaagtaggctaagaggaaggagtttctgtggtttgctaatccactggtattcatctccctgaaatgtccctgctcctaggcttctggcttataccagggcctcctgcctggtgtctctctctgttacgtgcacccaaagcccagtgcctttcttgcacatgacccagactttctctctcccctgtcatttcaaccttccccagcttggatccaagacctcccttcccagtcctctgaaatgagctggtgttttctgttaggcaaagctgccccccaggctgggaaatccaagagttagtctcatctctgtaagttggaccccagtgaggaccccagctgagtggaaggctggaggccaaaaaccggtaccactgaggttcccagacggagagggaagttggagcagtgatatagggagcaggatcaggccaggaggcagaactggcctgaccagtcagaggcccaaagaggaagatctgagcttctcagtttggggatagaggggttaggcagagactatgatgtgtgctgcttcaaaattacctttctagcctgtagggtaggtctcctccctgtgtgttccagccaggtagcttggttacccattctttgctgccttcttaggccagtgggaaaccttagggcagctgtgcattgattgggtagacgccattctggagcaggtgagaaaagaatcagctttgtgggagggtggggtcctgggaagatcccaccttgggacagcttagaggaagctgaggtgctggaagccgggacttacctaggtcctaggccctgccttgacgtgcaaggggaggagcctgtgagacttaaggtgtgccgcactcaccccgaaggccagaccttcactccgcacacatcatacccttacacgaaggatgctgttactctcatgctgtacccacctacagggggagaaggaggcttctagatctcaggggcagatgagggccaggtgggggcctcatgcagccctgacctcgggcttggtgtccaggcaggaatagagttggagcggtgccagcagcaggcgaacgaggtgacggaaattatgcgtaacaacttcggcaaggtcctggagcgtggtgtgaagctggccgaactgcagcagcgttcagaccaactcctggatatggtgtgaggcctgggggagcatggaggggaggggagaggattgggaaagtctctcttgggctgtattcaggatctccagttccttggtggggttgaggccttcttgagggccagtgtggggcctctgggtttcctcaggcacccatagcctagacatgcaacagatagaccccacaagataagaaggccttggtttgaagctgtggaccttcttaaaggtagaaaactggtatcgttttttgtttcttttttactttgagacagagtctcactctgtcgcccaggctagtacagtggcacaatcatatttgctgcagcctctacctcccaggcttaagtgatcctcctgcctcagcctcctgaagagctaggactacaagcctgcaccaccatgcctgtctaatttttgattttttgtagagatgaggtctcaccatgttgcccaggctggtcttgaactcctggatccaagagatcctcccaccttggctttccaatgtgctgggattacaggcatgagccactgtgtccagcctgagtactggcattgttaactgagggtgagacactagggctgaaagtcaagggccacaccggtgtttgagatgagtcaggctgggagggttccacggcaggtggtatagaaagagagcagacaaggccgggcgcggtgtctcacgcctgtaatcccaacactttgggaggccgaggtgggcagatcacaaggtcaggagttcaagactatcctagccagtatggtgaaaccccatctcaactaaaaatacaaaaattagccgggcgcagtggtgtgcacctgtagtcccagctactagggaggctgagacaggagaattgcttgaacccgggaggcagaggttgcagtgagctgagattgtgccactgtactccagcctgggtgacagggagagactccttctcaaaaaaaaaaaaaaaagaaagaaagtagacaagatggggaggatgcaggaggagactaagccttactgagatggggttgggaggagctggctcccaggccaagagggtgccagctaactcccactttgtgtctgggggtatccgcagagctcaaccttcaacaagactacacagaacctggcccagaagaagtgctgggagaacatccgttaccggatctgcgtggggctggtggtggttggtgtcctgctcatcatcctgattgtgctgctggtcgtctttctccctcagagcagtgacagcagtagtgccccacggacccaggatgcaggcattgcctcagggcctgggaactgacccagctggtcctgaaggagaagccaaatggctgcactggccgattctggtctccagaggaccttggtgtttgctctcccttgacccaccccagtgagtgccaaagggcagccccaacatgtgcacccctgcatttcctgtcatgccacagactggcccttgagggcagcctgctgtactggccatgctgggccagccccacctggagctcagtaaaaactgctgtttgat

SEQ ID NO: 36681 - DNA, 6399 bp, Homo sapiens
cacgactctgggagtggggaaacagagagccggttcctctgctgcagaagtcctcggggttccttctcacaactctgcgaaggggaaagggttgtgagacccaaccagaccccaactccagctcccagcaggaggtggctgcgccacactcgggaggcctcttggtttcagggtctctctgtctctctctcaccctcttcctcgctttctctgtctctctgtctctctctctctctctccctcgtccactcccccaaacatgtccaccggctccctcagcgatgtggaggaccttcaagaggtggagatgttggaatgtgacgggttgaaaatggattcgaacaaggaatttgtgacttccaacgagagcaccgaggagagctccaactgcgagaatgggtctccccagaagggccgcggcggcctgggcaagaggaggaaggcgcccaccaagaagagccccctgagcggggtcagccaggaggggaagcaggtccagcgcaacgccgccaacgcgcgagagcgggcccgcatgcgagtgctgagcaaggccttctccagactcaagaccaccctgccctgggtgccccccgacaccaagctctccaagctggacacgctcaggctggcgtccagctacatcgcccacttgaggcagatcctggctaacgacaaatacgagaacgggtacattcacccggtcaacctggtgagtgctcccggggctgcagctgcagtccaggcgcgcccgcactcccgcctgcggtgggcgcgagtgcgcgcggggctgggagtgggggtgtgggcgcggcggtgacttacacatctcgaccaccgcgggcctagagcctccagggaccggaggcgggcggtctagacacggccctcgctctctgccctaccagcccccggagcgggagtgatttatgcgagggtttgacgtggcagcccaattaaaagtttgcaagtgtgttgagctggcacagaggagggatcccccgctcccgctccatcgccatcctccctggggtgcagtggctgctgcggaactgagaacactgacaagacgctgcgagcggacaggcattttgttaatccttttttcttcttttagcagagagtggaacttgattttcctttccttgtaaataaaaacacccaactccgtttctttcacaagcatatttaggaccattggataaggacacatctatgccccccaaattgtccacgtaagcccttaaccgcttaaatattctgtgcttctcctataagtggattaatatttttaaatcccagaagttctagtaatgatcagcaaaatcagtaaatcctcactagtatgagtgtaataaatactaaaataggtcactctcacccaagatttaagaaatgttaccttttatcttaaaaagtaatgcccattgagcctaattttttaacacaaaaaactgataatcattgagtctacttttttctcaaatgtattttactgtttaagaaatatatcttaatttttttcatttgattttattttaaaacttctaagatctaaagaaaaacaataacaacaacttactaggatctctgtttgtatatgataagaatgagagatttttccttttaaaaggcaagtcttatcagctagcactagagcagtagtgagaggggtctgaattgtcttctcaccgaattggtttctggaattgctggagaagaagatgcaaacccacattttaccatgaaaaatgttttctctccaattgaaagtttggggtttttcccccccaatgagtaaatagctttttaaaatctccacctaaaatgaaagtgttgcctcgaatatttacaactgctactctcttcatctttgaataagaaacttaaatgagctttattataaaacagcccggagaaaggaagagaaagcatactttctcagtccagcatgaagacgatcttaaattaaaagtcaatgtagtatagcatttttttttccttaagaggtggtgattaatctagaagctgtagtcaaagccggtgtttgcgatggaagaaacgaaagtcggactagggaaatagatggtgatgaaaggcgatgaaagcgacagggccctgaaacccgaccaccgcctcagaaggaggccaggagggcgcttcgccccgaactcggtgcccagtaggcacaaggtcgttctgggcttcccggctcagactgccaaagcgtctgcctccaggcagtgccacagcaccacccactctcccactctcggcttgcccggggcttcctgcattgagtctcacaaggaacccagtataagcccttttggctctcattctaaaagaccaccaccagcaccaccaccacctcgagctgtgacttggcgccaaagcagctatttgctttatgcagccgcagggtgcgctaggaccgggagtaaattgcagagataaccggtctctccagagcaccgcctgcccccaccgccccccttcctttcatctcaggccccgagtccaccccaccccctccgccacggccacttacctcctccaccctcttctttcccgcagacgtggccctttatggtggccgggaaacccgagagtgacctgaaagaagtggtgaccgcgagccgcttatgtggaaccaccgcgtcctgaccttggaggtgcgagtctgggaaaggcgcgctcccggggggagcgggccccgggaaggcgacccctgccctcagtgctctctgtctctgcttccccctcgcaatgctcctctctctgtcccaccccgcgagaacactttacaacgacgaggagattcgtttccaaaccagaggagatcaattgtacttacaaagattcccatctatttaactttattaacttctaccgtgaatgactctgcaagccttgctggtccaagtgcaatatgtaattataaatatataaatagataagagcctatcaatgtatcttttgtacaatatgttgtaaaatgtagatcataggatagctgactttgacagtcacatttataaagtaattcacttaaagatatatatttttttcaaacaagttttgctacttttgaaaataaatctttctttatattgctaaaagctctgatatttggagtgatttttaaaaatatttggaataagaaagtgggaaactatggggaagcttgataatgaaaatggttcttttaaacctcaatctaaacttctagagatagaagaaaattgcatatgagtttcataatgaagatgcagattatgttttatactgaaaccttaaaaaagaaatatatcggttacttttaaggctaatagaaattatataactgaaaacaaagaatgggcagtattaaagttatccacagttatacagttcaagagtaaaacgcaccagaaaaaggaaatccaattttcatggattccaccgtatgactgctgacacgggcgagaaagtaaactccaccttttgtcaccttccaggtgtgagcatagctgcaaactagtgaagaaataatagaagctatgaaagatgtaaattccataacccttagggtgtgtttcaggattttcaaagctctgcagcatacattatctacatttcttattaatagtccattaattaattctaacaataaacccgcatgcctgccttttggttgctgttagcgggtgcgtttagctcccgccacgacttccggcggactgggtttaatttaaacattttccaggctacggaacagctcctaagggaagattaagttgagataaacagagaagcaaggccgaggagcctgcgacccgggtccctcactgccccagcgcagcccgcggcggccgatgcgccagatgccaccggggctgtttaatgttcggggttatgaccgcagtgtttacaagacgtcttcggttatttatactgttattcctcgcagagagccttgaaacttccgcttcatttgctctttcttttcgattttttacccttttttctcggcttagtttggtacctggagcgagagcttctccgcccttccaccaaccccacaggccgcttcgcgggtggagccctctgcctggccatggaggaaggatcccgctaggctggtcccgactggagaagctgctctgccaggtgtgctctctgtcagcaatagtgacctcattaccaaggggtggcgaccacattaccaagcgcaattccccattctccaagggctgagaacttcggtgacttcatccacctgtctatttgcacatggaggacttttcaagatgtcaggatacccttccatcaccccaccaccgccaccccaacttgactttcaagaacacatttcaagctctggccagagtcccgttcctcaaattcatgtgttctctcctttctaccagagggatagagcccatgcctcaacctatccagagttcaaatcaaagagtccccagtgtgattcaattgattgcctttcacgtttcgcaaattttccaatctcccactcacgtttttacaaaacgaatgctctaaattctgaggattccaggcaggccatccatagagaaataactttttcttgctcattcccttacaaccccaatctatacatggatttttagaaagtcttcatggctatctatagttccctaccaataatttgaagcctttgctttaggcaggaggcatgtggctatgaatagggaacacgtagatttgaccctggttctgcatccaactagctgtttcttgaaagagcctggatcctcagttttcccatctctgcaagcagggataacggtaatgagaatgataataatcattatatgcagaccttcctctttcatcttacagaggcttagtgaggctcagatgagattatatctgtaaaatcccttggtaaaggaaaagctccgtgaaaatgtcagttacttttactaagtggcgggtagtgaattatctgtgcctagacccaaactgaaagtgtctcaggcaggaagttccaagggatgtatgtttatagcatccaggcaatgatctttttttttccacgaactaaaatacctctttttggtatctattgactctttctctctctctttctgtctctctttcaccttgcacctctccctaatgctctctaaatttgtccagagctttctttttcctagaaatccagagagcaaagtcagagcctggcacctgcagataggataacactggtgtctgatggtgaggctgcccagtcccatcaggagcctcagccaaggaggggcctgggcacactcaggtccccatggttgtccattgaatggagtgaggatcaaggtgggaatgactgggtggtggctgccactagcccaggaacatgacaacgtgaccacaccacacatgcctccaacacacacccacagtctaaacatctctccttctcagtgagcccttctcccattccagatcatcagcacacccacacccaccataggtctctctcctccggtcttcccagaagggtaaaactcccagcctaccctgctccagcttcagcccaggtagttggtgtgtctcaatatgaatagggggtgagtagcttcatagaaagaatggggaactcccttggcctcaagccagtatagtttggaagttgggggtcggggatgttaagggtggggagtatcctgcctgtgacctctaggttatgaaaactatcttagaaggtgcttttagaaagaaccaggagaacaaccaaagcagcttacagacgcctgaacggagaatgaagtgtttcaagtaagcgagtctgcaagttctcagaagcagacagatatccaatctggactgcagccagggaagtcctctctctcgctctctctctctctctctctctctctcattgcttgtatgacttcacaagcaactcaggatcattctagcaggctttcccactgtcaaacagagacttcattctaaaaagagaagtgataaacagagctccagctctgctagctctatatatttactgattagtggaaagcactgaccaaggagacttttaagccagtggttcttcagaatcacctagatgcctccaccctccagagatcctgagtccaggagtctgaagtggggccccaggtgatgtcattgctgctggtcccaggaccacattttaacaatcaatgttttcaggtgtctcatgaggaacactacttaatgcagtgggaaagaaaatatttcagaggagaattttttcttaaagaagctgcatattctggactctaatttagtttaattcactccaggatggcacgcaggattcctaattcttaaatgccattcagtctggacttcaaatcacttgtcttcagaaaataaaagatttgttccacc

SEQ ID NO: 36682 - DNA, 26066 bp, Homo sapiens
tcgagcccgctttccagggaccctacctgagggcccacaggtgaagccacttagtgcctgatctgtgtcggggttgggggagccatgggctcaggggtgagggagagtggaacggagccaggaagggagggggtgccgtggagggaagagaatcgaggctgatgctggggtgcaggggtggcatggggtgtgtggtgtgcccagcagtgtgagtctctggagaggtgggcgctggggagaaggagagggaaggagagacgggtatggatggaaaggcagaggaagccaggctaaaccagcgtgtcccaatgaggggccctgggctgagtggaggaaatgggtgcggtggaggtgggtttggctgggcacagcgggcacgtgtgggtaagcgggtggggccggttgtgcgggtggcctatctggggcaagcagccgaggccgactgtgtccggcgtgtggttgagcacgggcaggtgtctggcggtgaccctgcacgtctggtgtttacctggccctgggtctgacgtgggccgcgcctggctgctggcgggacagtgtgttatctgcctgcggacgcttccggccacttggcctgggcctctgcccttagcgctgtgttttcccggccaagccccccatcccccctatctagtgctaggactttctggctccagaggtcaccgcggccgggcggaggctgccaaagcaaaccagccccgtgacttgtaggaagccagcgggggaggggccggggcaggatgagcagggcaggcgggagaggctggggctggggttggggcccaggaattgggcagggaattaggcagaggtgcagcaagtggcgggcacagccaggacctggggctggaggacgcagaaagggcggggggaagggttcgctgggtgagggtggagtgggcttagggcagctggggccctccatctgatctcttctggtcagacccccacccttcagcctgcactttctccctaaacccccagcctccggccaggcctgtccctgttcccacatccccgcagacaggcacacctgggtccccctggaggtccaaggcaagccccgtagctgggcccgcctggtccagcccccacaagcccggccccatcagccaggtggcctccagtgctgccaatcgaatggtccggcccctccccgccccttcacccgcccctcgcccagccccctcctcctcaggtgaggcagcctggcctagcaggccccacgccaccgcctctgcctccaggccgcccgctgctgcggggccaccatgctcctgcccaggcctggagactgacccgaccccggcactacctcgaggctccgcccccacctgctggaccccagggtaaggacaagggcccccagactcacagttccagccctgaggacaggggttccctcatccccccacccagcctaatgcccacctcctaatagaggggttcctggggacctgaagagggggcactatgacgtccccccaagcacctaggtgttctgtcctgctcttccttcagactcagccgttggaccccagtcctttcctccccagacccaggagttccagccctcaggcccctcctccctcatactagggagtcctggcccccaaattcctcctttcccaagacttatgatttcaggtcctcagctgtctcctccctcaaaccgggatcctcagtcccctgctccaccaggctcaggcatgggggtccccatccctgcaaatccaggcgtccccccgctgctggtcagacactgaccccatccttgaacccagcccaatctgcgtccgtgatcacggcgtgctctggccaaggcccagtccctacagcctgcctggatggacgcctgggactgggggcgccaggactgggctgggctgggctcccccaggccctgcctccccgtccatctcctcacaggtcccaccctggcccaggaggtcagccagggaatcattaacaagaggcagtgacatggcgcagaaggagggtgagtccccttccctgagccccagctttggctctgcctggcgccccgccctctgtgctcttttctctaccctctactcttcggagccccctctctctgggcacccctcccagatgcatccccacccctgttagtcctcctccacctgattaactattaaccacattttctgtgcagctgtgccaccaccagcctcccttctaccctatgtgaccttcctggcgtgctgcctcagtttcccctcatcccccagtgatttctcagctaactctggacttgtcctctgctggggctgaggcggggaagctgtagctgtcatggttaaggacacagatttggagtgaaacacacaggcttgcatttgaatttgctcttgccatcttttttgctgtgtgatctggtgcaagtgacattattcttagggctttggtctccctctgggtcaagcatggataccagtcctccctctgtgaggttgctgagtgcatgacacacaccaggcactggtctggggctctgcatataagacgcatgccatcaagcagagctgtcatgacagaggttggcaaactcggagtcccagagacccaggacccccaccgatcccagacattcctccacctcctggctctgtgggcaaaagagcagagggaggactttggactgggcctggatggatggagaggggagagacggcagagaaaccaccataaggatgagagagagagactgcgtcatggagttgctggcccttgggagtctctgggcagcccccagctagcctggcttcctttctacctctcacacatgggacccagctggaggggcgcatggaggggcgtcctgttctttctgccttcccctagctggggctgactccctctcttcttccgcaaccaggatagccgggctcagtcctgggcagtagcactttctagctgtgtggccctgggcagacggcgtgttctccctgggcctccattctctcatctgtgaaatggagagggtgacagtgcatgtccaacagcgtggggcgaggcctgaaatgccaggatgggcaggaagcactgagcgtgttggctgaaatgattagttcagatctctggcctcctcgggtctcggcacagctggcaattcagaccccaaaccaatcagctgcagtccagagggaacccaggctcccagttactcaggagaaggcattgcaccctagccgagcaggtggatgacagaatccagctccttggggacaatctctttcctggagctgccggaaggacagccccagggcttgggcccatgggtgaatgagccagggaagaaaagcagaaaatgcccgaatggacagagatggcctgggtacaaagagaaacagacacaaagtgggctctggtgcctccctggcagctccgggctggtcttggaggggagtcctgctgtcagggctaggggtgtggaggtcgaacctggacacagatgctgaagggttccgattctgcacttacttgccgggtgacccgggtttggtggctgccggactttgggcctccttttctcatctgtaaactgggggtgatggcaatggcgccttcctcgtgaacagctgcaaggatttaagtaaggatgctgtgcaggactggacggggttagggtagggcggtgcgtccgtgtgtgattcagagagccgttgtggctgcagcggctgctgttgttggtgtcactgttattgctgctggcttcttggtgctgcctggaaacttggaattggaggaggtgatactggagttgcaattccaaggatgccaggcagagggaagagcaaggctcttgctcttctctgggaagctgggaggtgacacagcactggtgtgcacgtagccaattgtggtatttctggaggtgaagctggaagttgagctgggtgggagaagaggtgtgcaagctggaccaggcaggggtgggactgttttggggaagagctggccaattccttgcagtaccaggtctctccacaaggtggcgccagtggttagtccctgcttctcttgtctaacttgtattttacaagttctactgtttgggttgctttttggaagctctctctggtacctgatagtgacccacatggttgtctgagaattgggggaaacatactcccaaatctctgaaagccatgcttataccctagtggggctggaaatgccaggctgagggacttaagctgtctggggggtactagggagtcacagagggttctataggtaaagaggggacaggttggatttggtgtctcagtaggttccccaagcctccgtgtggagggtgcgctagaagggagactgagcccagcggttggatggggccggagcaaggtgcagatggagagaaagaaggaaacgggggaaggagagtcactcaggaggattggcaggctgtcgggggaggggaatgttatgcagatggggatggtcctaggagtgagggcctctgagacaggaccgggaggaagaatatacttggggagacattggggagacattctgggacctggtaggggcaaagggactaggaggtcccagggaaaggtatttaaaaggtatttaaaggactgcaggagccctgacctgggacctggaagagggtctagggctggggacagaggggaaactgagtccacagaggtgggtgagacagacttaggggcaaggaggagcagggggaggctgcggccagccctacaaactctggattttacggagtaggtagagggtgggtgaagacagcagcctcagaggcgggaaggaaaatcaggtgcgcctggtgtcccagaagtccaaagaggagagcatttatacaggaagctgcagtcatgtaagatgaggcccgagacacggagccaccagttgagtggattttcagagccagagagccaaaggtgttacgcgtgggggtctttgcagccaaatggtggaggcggaagaactgacctatgagaagacccaaggcatccagaggggcctggagaagcaggggcagagagtctcagggagatgtaggggtgggggaggtctggcttaccaagggaaatagccctgctgctgggatcaaagaattgatgttgacgtgccgcctgtcccagtagagacacgcagggaggatgaggatgcgtcccacaccctgggccagatgaggatgctgcctgtcccagtagagacacgcagggaggatgaggatgcgtcccacaccgtgggccagatgaggatgctgcctgtcccagtagagacatgcagggaggatgcctctcatactgggggaaccccaggatgcagatgcttcctgtcccactggaggcgctgaagtcctctgaaccacacagcatggaaggaggttcttcctctcaccctaggagacacatacatagtggcattgcttcctgtcccaccagatgtgccaaggcctctaggctgcattctgcatggcctagagccctggcaggcacagctgaaaacaaagcaagcaagaccagcccagtggctgtcgggagccaagacctcctgctggaacctggagagtggtcctgggcagagttggggggcaggcctgagaacccctcgcaggacaggcaggggtcagccggcagtagttgggctggtctggcccactggggcctcttttggggaagagagtgtttcctcatgccttgatgggagccactgagctttcaatttttttttttttttaatacagagtctcgctctgttgcccaggctagagtacagtggcgcaatcttgattcactgcaacctccacctcccgggttcaagcgattctcctgcctcagcttcccgagtagctgggactataggcgcccgccaccacacccagctaatttttgtatttttagtagaggcggggtttcaccatgttggccaggctggtcttgagctcctgacctcaagtgatccacctgcctcagcctcccaaaggaccgggattacaggcatgagccaccatgcccagcctgagctctcaaattcttaagacacccagataatggccacaccaggaaggtcctagaccactccctgctctgttccaggtgctggcctggtgccgggttcaccagccacatcaccatgggtgcagatgggcgagctgggagctcctgccaccttggggtgctttgcggctgccaagggcagttgaacccaagccaggcccagctgaaggctttcagcagcctttactctttggccttcttataatccctagtgaaggggttggcttttatttatttatgtatttatttatttatttattttttgagacagagtctcgctctgtcgcccaagctgaagtgcagtggcgcgatctcggctcactgcaagctctgcctcccgggttcaagccattctcctgcctcagcctcccgagtagctgggattacaggtgcctgccactgcgcccggctaattttttgtattcttagtagagacggggtttcaccgtgttagccaggatggtctcgatctcctgacctcgtgatctgcccacctcggcctcccaaagtgctgggattacaggcgtgagccaccgagcccggctaggagttggcttttaatctccaggacctctttgccctgggaataaaatcccttttcctgtgccaccaggcctccccagctggccccagccttggttcccactaccttccccaagctctggccatctggccatctcgatggcctctccagcctctgacataagagagcctgcttattcttgcctcaaggcctttgcctgtgctgttccctctgcccacagtgcccttccttgtggtctgtgtgtggctggcacctcacctttcagagcttagctcagaagtctcctctaggggaggccctgtgatccctgatcccctgcagaagcccacctgctgccccagcctgcacggttttcttcacagcctctgccacaatctggaaattattgggttcatttacttgtttccttgttaatgtctcccactccccacctacacgcatgagaacgtgaacccctgagagtcgtaaccttatctgtcttctttgggttatgttcccggaacctagaaaggtgccaggcacacagcggatgttcagtaggatggtaaacaaataaagcttctttaggctgatgaaaaaactgagggtcaggcgcggtggctcacgcctgcaattccaacactttgtttgggaggctgagacaagcagataacttgagtctgggagttcacgaccagcctggtcaacatggcaaaccccgtcaatacaaaaaatacaaaaattagccatgtgtggtggtgtgcgcctataatcccagctactcgggaggctcagaattacctgagcctgagcgcttgagactgcagtgtgccatgatcgcgccgctgcactccagcctgggcagcacagtgaaaccctgtctcaaaaaaaaaaaaaagaaaaagaaagagagagagagagaaaaagaaagaaagaaagaaagaaagaaagaaagaaagaaagaaagaaagaaagaaaaggaaggaaggaaggaaaagaaaaaaactgaggctgaggctcagagaggggaggggagttgctcaggcccacacatctctgatgatttataaagcatttatagagaacttgctatgtgccaggcacttccgcacagtgagagccaggatggcttcgtggctgtacacaggggacctggcatcaaacctgcccagggttctggacgctgctctgcctcttccaggctgtcactgtgggcacgtgaccccacttctctgagctatctcaaaaacaggaatcatagttgtgggattgaaataaggactaaatgagctgatgtatttagaacggtgcttagcacctggaggcatcaatacaatttgagctattcttcttcttcttgaaaataactttaaattattatttttagaagtaggtgctcagtggatgcccatttaatagataagaaagttgaggctcaaagatatgatggcacctgccttaggttccagctaggaaggggtagggtcaatatttttaaatgaggctggccagacgcagtggctcactcctgtaatctcagcattttgggaggctgaggaaggaagatcgcttcagcccaggagtttgagaccagcctgggcaacatagcaagaccacgtcgctaaaaaaattaatacataaaataaaatgaggctggcagattttcaagtggaggggcaaatttgatcttgcaactgggtaccatgagagaggtctgatttagggggtatctaggggcaaagcatctagaacagcagaaacgactgaggcagcgaggaaatgccagcggcagggaagagagctaccaagagggcaaaggttgggggtcacagtcccaagaagagatggcccaaagcaaagacagaaatacaaaagcacagtgtcactggggaggagacattccctaagtgccaggaaagtgcagggcggaggtggagaccgtggcaggtggcccggccatgcccccctcccagctggaaccctgggggagctgggcacctggttgttcacacggcaggggaggaacagccctgtcaactgctggccccgggaaactgggcctggggaggacatgcttgggcataataagttagccctgggggcagggcagagctggcctcgggcccagaccctgccgcaatgaggacaggcctggctgtggccccagcatggtgtctgttgcaggtggccggactgtgccatgctgctccagacccaaggtggcagctctcactgcggggaccctgctacttctgacagccatcggggcggcatcctgggccattggtgagagcggttcctgtgcctctgacctcccctggcccctgcagcctccagcctgcctgccctcacccctcccttctctgcagtggctgttctcctcaggagtgaccaggagccgctgtacccaggtgagtggagcaggctgggaccctctgggggagccctggaggacacgtgtatctggcgggagctcaacaagcgtatttgttgaataaatgcacaaatgcatgcagaaatgctaatcataatagtgcatttgtattgagtgcctgctatgtaccaggcactattctaagcaccccacatgtctaacccagactttttcagacaccagtgtattactcatgagtgcctcataaaattaaattagtgagttggaaaaccatgttttttttttaagtatgaaatagattcgattacagactatcacagtacatctctcagtaagtaaaggttatgctaatttttgtttgtttttttttttttttgcatccatatacatgtaatcccactgcatccccacactctgagggtgggactgttattctccctgttttacagatggggaaactgaggctttgagcaatgcagcagtttgccccagactacagagctatgggctacatcaggatgtaaaaatgtgtttcttactgcgtggcatggtgaaaacatgttggggaggcatgatataaattcagtggacccttctaactctcctaggaggtagtttttttgtttgtttgttttaaaaaagaaaaaagtcttgctctgtcacccaggctagagtgcaatggtgcagtctcagctcaccgcaacctctgcctcccaggttcaagcgattctcctgcttcagcctcccaagtacctgggaatacaggcgtgtgccaccatgcccagttaattttttgtatttttagtagagatgagatttcaccatgttggccaggacggtctctatctcctgaccttgtgatccacccgcctcggcctcccaaagtgctgggattacaggcatgagccactgcgcctgtccctggtaattagctccattttacagatgtgcaaaatgaggaccagagaggacatgcagctggggaacgaggggccaggaacagctcttagacttatccactgtaagtgtgtctgcaggcatgtggaatgaatggccacacaaataaatagataaagaaactaactgtgggatgaatgaatgaatcttcccaaatgccaacttcaagctgccattccctgatgcaggacagcaggaaaaaaggggaagttgggtggtgggatgtatttttcatgtctgtgagcctcatctaattccataaaggattcagttcacactaaaatcagaaatgaaaatccagacaagaaaagccaacatcaacattaatcatcattaccagcacttagcatttgtatgcaccagccaaggccttgggaccttatgatatcaactcattaagtcttcccaacaacctgttgtttttcttttcttttttttttctttctttctttctttcttttttttttttttttttttgagatggggtcttgctctgtcgcccaggctggagtgcagtgacacgatcttagctcattgtaacctacatctcctgggctcaagcaatcctcccatctcagccttctgagtagctgggactataggctaatgccaccatgcctacacaaaattattttgtcaataacaaattattgttatttttatctttttgagccagagtctcgctgtgtcgcccaggcaggagtgctgtggcgcgatcttggctcactgcaatctccatctcccaggttcaagtgattctcctgcctcagcctcctgagtagctaggactacaggcacgtgccaccacacccagctaatttttgtatttttagtagaggcggggtttcaccatgttggccaggatggtctcaaactcctgacctcaggtgatccacccgtctcggcctcccaaagtgctgggactacaggcatgagccaccacacccaacctcattttttaaatttttagtagagatgggatcttgctacattgcccagtctgatcttgaactcctgagctcaaagcagtcctctcagatcagcctcccaaagtgcagggattacaggtgtgcaccaccacaacccattttcctatggggatgctgaggcacagaaaggctgagtgacttgccccaggtcatggagctagtcagtgtcagggctgggatttgaacccaggcagcctgcgtagtaactgtatatagtgtctacacttgattgcttgttaaaaaaaaaaaaaaagaacagctgaattcattgccatagtaaagactgacatatgccaggccctggcggcagcctttacccagcaggcctatgaagttagggctgttacatcccaacattttgcatttgggggaaattgagtcccagtgaagcaaactgacttgcccgaggctgaccacacatcagagacagagcgaagggatcacgcccctgtcaaaagcccctccgtgacaacacgtggcattgagataaaatcccaacccatcacaggctccaagcctcctagtgtggaggcccctctccacccccacctcacactggcttctagcaccctcagggcccagtcccttgctcaaatgacctgctcacacagaagtctctactcacccacttctttctagctcacacccagaggcagatttcagttctgcacagttccttctgagctgtggggcctcccaccagtccctactctctccaagactcaatttcctcatctgtgagatgggggtaagaagaatcagtgggaataagaggagataaaaatctgtgtagtacttgggcggggtgcggtggctcacccctgtaatcccagcactttgggaggccgaggcaggcagatcacctgaggtcaggagttcgagaccagcctggccaacgtggtgaaacctcatctgtactaaaaacacaaaaattggccaggcgtggtggcgggcgcctgtaatcccagctactcaggaggctgaggcaggagaactgtttgaacctgggaggcgcgggttgcaggttgcagtgaactgagatcacgccactgcactccagcctgggtgacagagcaagagtctgtctcaaaaaaaaaaaaaaaaaaaaaggctgtgcagtacttgcctcttagccagcacagtggacattggcttttgtatctcactcctgaaattctttcttgaaatttcttgagcaagatcttcctggacttccagactctatggcctctcaccctatggtgtgtccctgccaccccggtaaaaccctcctcactcattgtgaattatttactcctggcgaactccaggaaggcagggaccttttgtggtcagacggtgcctggcacatagtaggttctcaggaaatccttgagttatgagtgcacccaaagccaaaacactgggatgaactagagagtcatgggcctccagctggaaaggagcgaggccaccactcacacccggctctggccagcaccacgccgccaccctgcagaggtatttgggtttttcaacaactcagggaaatgatgaaacaaacaaacaaacaaaaacaaccccaagcttgtatccccacctcgctttttttttcctgggattttcacacttctaaatatatccaacaacttggcaggcacaccaggtgacccagaacatcctttttgtgttgcctgaaatgataggaacaagaataaagaatttaaaagtgagaaacagcagcagagagtgtgactttaaaaatagccagaggggacatttgatgttctctccccactcccatctcccccaacacacatctataaagtgattttcccccctaaaacctcacactttctggaaatcacatttccagagcagttaacagtcattttaaaataagaatccacccctcttcctgccccagctggtgtttcaaactccaagccttggctttcatggggtgatgaggaccccccagctagaggtgccaggcattccctgccccaaccccagagcaggagaccgtaattaaggcaggccaggccggtgcggtggctcacgcctgtaatcccagcactttgggaggcccaaatgggcagatcacttgaggtcaggagaccagcctggccaacatggcaaaaccccatctctactaaaaatacaaaaattagccgggcgtggtggctggtgcctgtaatcccagctatttgggaggctgaggcatgagaatcgcttgaactcaggaggcagaggttgcagtgagctgagatcgtgccactgcactctagcctgggagacagagcaagactccatctcaaaacaaacttaaaatagaataaaataaaataagaatccgcccccctccccgccccagttggtgtttcaaaccctgagacttggccttggaattcatggggtgatgaggaccccacagccagaggtgccaggcgttccctgccccaaccccagagcaggaggccatcattaaggcaggccagccaggtggcttttcagtgccagccgtagctgaatatattaggcagggagacaggcaagggtttgtatgagacccacagaaggaacagggaatatgctggtctgggttcaagtcccggttttgctggttagccgtgtgcctctgggcaagtttattcctctgaggcttagttttcccatctgtaagatgggcatagaagtggtcactactggctgggcacagtggctcacgcctgtaatcccagcacttggggaggccaaggcaggtggatcacctgaggccagaagtttgagaccagcctggccaacatggtgaaacgctgtttctactaagaacacaaaagttagccaggtgtagtagcatgtgcctgtaatcccagctactcgggaggctgaggcaggaggatcgcttgaacctgggaggcagaggttgcagtgagccgagatcatgccactgcactccagcctgagcaacagagcaagattatgtctcaaaaaaaaaaaaaaaaaccgaagtggtcactatctccgaggatggttgtgggattcagagagccacttggataggatgcatagcatggggccagcccactgacaccccccagtaaacgtagccagtgctattattactgtgctgttgtttaaccctccagaggggaagtctcttgagaggctgtccagggcaatgttaaaagcttggggtttgaagtcactcagacctgatttcgaatcctctctccctgcttctcgtgcatttggtgacgttggggaagccaccccacctctctgagcctcagcttccccgtctggaatttggggatgatcttcgtggctcctggggtgtgcgacgaggccttggttgatggtggggcagaggtagcctagccccaggaacacagtaggtcctcagctggggagagttctacttggaagtcttgcttctccttgtcccaacctgcggggctgtgggaagacccctcagctggtgtgtggcctcaccaggttccttctaagaggatgcaaaagcaagttttcatttgactcggtttcccagaatgtgctctcagagcccaggccaggcaggaggctcttgagaaaaggacaaaaagacatggtggctcacacctgccatcccagcactttgggaggccaaggtgggaggattgcttgaggccaggagtttgagatcagcctggacaatatagcaataccctgtctctacagaaaaaaataaatttaaaaggcgtttttagctcaggctttgctgggttctaacctggctattgtcactcagctttatcctaacataaaaaaataaacaaattagcagggtgtggtggtatgcccctgtggtcctagctacttgggaggttgaggcgggaggatcgtttgagcccaggaggttgaggctgcaatgagctatgatcgtgccactgcactccagcctgggtggtggagcgagaccctgtctcaaaaaagaaaaaaaaaagtggcagggagaaggaaaggaaaggacaaagaggttcacagctgatctctccctgaacctgctccttccgtccccatctctgtcagccccatcttttcaggctcaggccaaacccctcggttaccctcccagttcctccagtcacccatgaatcagatcttgcaggaaaccctgtcagctgcacctacagaacctctccaaaatctgaactcttctccccgtccactgcccccaccctgctccagcccccttcccctcccctctggacatcccagagcctcctccctggcctccctgctcccatccctgccccccaatcatatcccacaaaggggatatgactcactcacttaaccggcaattctggagggtcttaaaacctggctgcctcaagaggctttaaaatgttatcagatgggggccaggtacagtggctcatgctggttccccacttgcagccagagggagctggtgaccacctgagtcaggtcagggccctcccctggctgcacctcacaccaggtgccagcaaagccctgatgttgctctatttctagctcccacctgatctgcccctccctggctcactctgctctggcctcccactgttcctggagcactccccccagtcccccacaccagccttgggatctttgcatctgcaagtccctctgtctccgtgctgatctcacacacctcctgacactttctcacctcctgcaggtctttgttcttgcaccaccttcccagggacgctctccttgcagcgactgaaaagtgcaacctcaccccaccctccatgccggcactcccctccctcggtggcattttatttttctctgtggccccttcctatcttgtgacacataatatatcctacttatttgtccctttcttgatttgtctcacctactgagctttgagttccacaggggtcggggtttttgtctgatttgttcattgcagtggtgatttgttcactgcctaaaatagagcctggcaggtacaaagtgtttggtaaatagaaatcaataccccagggtctgtgacctgacttaggtgttaacaggttcctctgaggtgtgtggggaacagactgaggggtttcaggggacatctgttctcaccacaaattgccccccaaccagccccagacatgaacagtctcccgggagctccctctagccttctcgtatatcccagccctgcctcatgtcacaatttgtaatgatgtgtttggctgggtgacattttatggccatctgtctccctatcccctataatgtggtttgccgaaagcaaagcccaggactgtctcggccatctgtgtctccaggatcacccctcactgggcatggagtatgtgtccagttaacgcttgctgagtgaatgaatgaatactccatcctctgcctggagaattacgcactttagcatatccaaggctctgacaagtcctgcataaaagagcattattgttttctttctttctttccttctttccctcttcttttctttctgactataggatattgattatcaatctggcaatagtcaagattggcagtctggtgtattagtcaaaggttttcagcctacaaaagacaaaaagaaaaaataaactggctaaaaacaaaaggggatatgatttactaactcacttaaccgacagtcacagaggttcttcaaacctggctgtatcaaggggctttaaaatgttatcagatgggggccaggtgcagtagctcacgcctgtcatccagcactttgggaggccaagacaggcagatcacttgaggtcaggagttcgagaccagcctggccaacatggtgaaaccccgtgtctactaaaaatacaaaaaattagccaagtgtggtggcatgtgtctgtagctccagctactcgggaggctgaggcaggacaatggcttgaatccgggaggcggaggttacagtgacccaaggttgcaccagtgcattccagcctgggtgacagagcgagactctgtctcaaaaaaaaaaaaaaagttatcagatgggaaatgaattccgatattaaaaattgatatgtatttatactatattattaaagttatttttcataaaacatagaagggtaagtttaagaaatgagaagtatttataccaaaatgattaaatattatttaatttaaagatataaatgtcttgttggacaaataattcaaaatttccattagacaggaaaaataagttcaagagatatattgaacaacatggtgattatagttaataacaatatattatatacttgaacattgctaaaagatattttaagtgttctcaccacacacaaagggtagtgcatgtgttaattagcttgatttagccgttccacaacgtatacatatttcacatcatcttgtacaccatcaatgtatataattttgtcaattaaaataaatacatattttaaggccgggtgcagtggctcacacctataatcgcagcactttgggaggccgaggcaggcagatcacctgaggtcaggagtttgagactagcctggccaacatggtgaaaccccatctctacttaaaatacaaaaaaattagctgggcatggtggtgcatgtctgtaatcccagccactcgggaggctgaggcagaagaatcgcttgaacccgggaggcagaggttgcagtgagctgagattgcaccactgcacaccagcctggacaacagagtgagactccgtctcaaaaaaataaataaataaaaataaaataaatacatatatatttttgagatggagtctcactctgtcgcccaaactggagtgcagtggcacgatcttggctcactgcaacctctgctgcccaggttcaagcaattctcctgcctcagcctcccgagtagctgggattacaggcacctgccatcatgcctggctaatttttgtagttttcatagagacgaggtttcatcatcttggccaggctggtcttgaactcctgaccttgtgatccacccatctcggcctcccaaataaatacatattttaaaagatagaaatcactctggaaggagagttaatctgtttgatataataataataatatattaatattatattataacaatatattagtattatattctaataatatattaatattatattataataatatattattatattataacaatatattaatattatattataacaatatattaatattatattatgtaataataatactactccatatagctatggaaaagttcatatgaagaaaccaggctatgatctacaaactggcaacaaatttgttcttctattttccatatgctgtctgtgtacgtataaagtgagaggtctttttatatgagttaagggtgtgaccaaagacaaatggaaaaagacaaatgacaaacatactaataaagagcttcggtttctccacaaaaaatacaataataaaataaaatgttatcagaaatctcttgactctcctccacgttagctcactttttccctcaagagggtgaacatgacccttaacagatccagcctcaagtgctggattctcttgggaacttggttaaatggttttttttcttcccgaatgtccaagtcaccttccagacctgcagctcctgagcagccaacttaggacttctaatggagagtgaagttcccctggttcgcggaggggccggccacagcctcaaggctgctgttgattggtccgacctgagtccttgagtctggcagagtgccatggtgctctgtaatcccacctgtaatcccagcattttaggaggcagaggcaggaagattgcttgagcctaggagttcaagaccagcctgggcaacatagcaagacccgtctctacaaaacaaaacaaaacaaaacaaacaaacaaaaaaattagtcaggtgtggtggtgcacgcctgtggtcctagctactcaggaggttgaggtaggaggatttcttgagtctgggaggtcaaggctacagtgagccaagatcacaccactacactccagcctgggcaacagagcgagaccctgtctttaaaaaaaaaaagtccttgagtcatgattccagatgcaatcgcagatgtgggggctgcaaccctccgatgggctggggttcacgtctacaccacatggctggagcacaggccaggaggggctccggctggggaagcatgtggggagcctggctgtgggacccaggcggccccgggccctgtcgccctgcagtgcaggtcagctctgcggacgctcggctcatggtctttgacaagacggaagggacgtggcggctgctgtgctcctcgcgctccaacgccagggtagccggactcagctgcgaggagatgggcttcctcaggtactgggggccctcggaggggtgggagccgggaggggctggggagcaggcctaacccctgccccgcccagggcactgacccactccgagctggacgtgcgaacggcgggcgccaatggcacgtcgggcttcttctgtgtggacgaggggaggctgccccacacccagaggctgctggaggtcatctccgtgtggtgaggagggcagcgggcaggtggggcaacacctcagacccccaaggcactccctctccccgttttccttccacctgtcttaactggtctctatttcctttctttctgtgtctccaatcccatctctcccagtgattgccccagaggccgtttcttggccgccatctgccaaggtgagatcctaaaactcagaaccctctcctttaggcccttggggaggccacgtcccctcaagctccccaggatggggccatgtactttcagaccccctagggcagggccaagcctgggctctggggacctgggctccagtcccctgtcgccgccccctgctgacccttgtcccacagactgtggccgcaggaagctgcccgtggaccgcatcgtgggaggccgggacaccagcttgggccggtggccgtggcaagtcagccttcgctatgatggagcacacctctgtgggggatccctgctctccggggactgggtgctgacagccgcccactgcttcccggagtgagtgccccccaatggcgctgatgatggggaggcagaggagcggagagacagtggggaggagggcggattgtgcccaggcaggtggccaccctccacccctttccctggtaggcggaaccgggtcctgtcccgatggcgagtgtttgccggtgccgtggcccaggcctctccccacggtctgcagctgggggtgcaggctgtggtctaccacgggggctatcttccctttcgggaccccaacagcgaggagaacagcaacgatattgccctggtccacctctccagtcccctgcccctcacaggtaagtctaagggctgagccatggggcttgaggacccgaggccaggaggacagaggaggggaccaggggcacaaggcaatcaacttatggctcaggcatccttggcaataaggggaatgatctcgagggagcacaaagtgggccttaactatcaatgatcagtgcagccaatttggaaaatttgccagcatttccccaagaagtatacataaagttaccattggacccaacacttccactcccaggacaggaggtatatacctaagacaaatggaaactgtgtctgcaccaaaactcgtacatcagtgttcatagcagcattattcataatagcccaaagatggaaacagcccaagactgtttcatcggacaaatgcataaagaaaatgtggtatattgaccgggcgcggtggctcatgcctgtaatcccagcactttgggaggccgaggtgggtggatcacgaggtcaggagtttgaaaccagcctggccaacatggtgaaactccatctctactaaaaatacaaaaattagcctggccaacatggtgaaactccatctctactaaaaatacaaaaattagcctggccaacatggtgaaactccatctctactaaaaatacaaaaattagcctggcgtggtggcacacgcctgtaatcccagctactcgggaggatgaggcaggagaatctcttgaacccgggaggtggagattgcagtgagccgagatcacaccactgcactccagcctggctgacagagcaaggctctgtcatcttgaaaataaataaataaataacaaaaaaaatgtggtatatccacacaacgggagaatattggaccatagaaatgaatgaggtactgattcatgctaccacaaggatgaaacttgagaacagtgctgaatgagacaagccagccgcaaaggccacatactgtaggatgccacttgtatgaaatgtacaaggctgggcacggtggctcacgcctgtaatcctggcactctgggcagctgagatgggaggattgtttgtgctcaggagtttaagaccagcctgggcaacatagcaagaccccatcacttaaaaaaatgagctaggtgtggtgacggatacctgtagttccagttactcaggaggctaaggcaggaggatcacttgagcccaggagtttgaggctgcagtgggctaggattgtgccactgtactccagcctgggtaacagagcaaaaccttgtctgttaaaaaaagaagaaagaaagaaagagaaagaaaagaaaggaaggaaggaagaaaagaagaaaagaaaaggaaagaaagaaaagaaatgtctagaataggcacatcggtagagatagaaagttgattgatggtggcagggtgggaggtggggatgggagattgggaggtgactggtgaaggacacaaggtttcttgtctgggtgatgaaagattctaagtcgatcatgatcatggttgcacttgtctgtgactacacaaaaagccagtgacttgtgcctttaaaaggaattgtctaatatgtgaatagtagttcaatcaagctgttaccaaaaaactaataaaatgaaaagaaaatgtgttaaaaatgaatgaatcagacttagaaagtaagttaggagtcattccctctgcaattccctggagtattcccttggtcttactgagactcacttaggtgccaacatgtccttaacacctctccaacacatacatcttccttttggattaaaagcaggccctgggcttcagatttcagcaggctgcagtgtaataataataataaaaataggctgggcatgtaatcccaggccaaggtgggggtatcgcttgagctcaggagttcaagactcgcctgggcaacatggcaaaaccccatctctacaaacaaaaaaaattagctggctgtggtggtgcgcgcctgtggtcccagctacttgggaggcggaggcaggagaatcacctgatcacccaggagatcaaggctgcagtgagccatgatcacaccactgcattccagcctggttgatagagcgagaccctgtctcagaacataataataataacggtgataatgatgatcatgaagtagtaatagcgagtagtattcgagttcatgattgagtattcgagtatagcgagttcatgatcatgaagtagtaaaagggaataagggagtacatgatgagtgtacacaacacagtaaaataatctggtaaacatagcagtgtgccaggcaccattccaaatatgtcctgtgtatggactcacttagttctcacagcaaccccagcacaccctggtaaggagggttctcttaagatcctgttttccacccaggaaaaggtcccaacccaaagaaggcaaacaatgccccaaattcgtacagctggtgaacggcaaagatttgtgcccaggtggactggcactggaatctgtgcttgtggcccccacgctgtggtgacggagaatccagggccatgttggggttggcattatgtttatttttatgtttattttatttttcatgatctgtggtactggtttcccattgaagggagtgatacatgcttttctttaaaaccaaaccctgtcctgacatggtggctcacgcctgtaatcccagcactttgagaggctgaagcgggcagatcacttgaggtcgggagtttgagaccagcctggccaacgtggtgaaaccccatctctactaaaaacacaaaaattagccaggtgtagtggcaggcacctgtagtctcagctactctggaggcagaggcaggagaatcacttgaacccaggaggtggaggttgcagtgagccaagatcgttgccacacccttctccttagtgaaaagagtgagagagttaatattgaagtaaggacgcatctttgaggacaggtggacaggtggaagcggctgggatttcagacacagggctgagggggtcacagcatgggctttggggtcagattcagatatttgccaactgtgtgatcttggacacatggcttcacctcaccgtgcctcagtttcccttatctgtaaaatgacttcctagggttattgagacaattaaaagggttaatatgagtaaagagcttagagaactgccagcacatagtgaacactggtaaatgttagcaattgctactattgttgtttaatacttttactagttatatgaacacttgctgtttgcctggcatgcaactcaatgactcaccaatttctcactacaacttctggggataagtgattattatttccattctacatctgagagctctaagactcaggcaggtgatgtcatcagcaggcagcaggcagcaggcaacaggcagggctgccaggaacccttgcataggttgtgcactgcacaaggacaccacatctcagggttaccactctctctgtagacctgtgtatttattattatgattttctgctaggtggaagtcaaatgtctcaagataggagtgtctctctctctctctctctctttcttctctctctctctttctttttttgagacagagtcttgctctgtcacccaggctggagtgcaatggcgcaatctcggctccctgcaaactctgcctcctaggttcaagcgattctcctgcctcagcctcctgagtagctgggattacaggcacctgccatctgtaatcccagtgctttgggaggctgaggcaggaggattgcttgagcccaggaggtcgaggctgcagtgagccatgttcctgccactgcactctggcctgggtgacactgcaggcttagaaatgaaaacaagctgtgttaaaacatacatgttatgaaactttggacacgtgacttggcctcattttccccctctctaaaatgggataatatagaccctacctctctgggctgatgaaacattaaagaaaatggtgcaggaaggcgcctagtatgcgatgagctcttggtacgtggcgacttccgttgtggcttttttgtttgtttgtttgtttttgagacagagtcttgctctgtcgcccaggctggagtgcaatgacatgatctcggctcactgcaacctccacctcctgggttcaagtgattcttctgcctcagtctcccgagtagctgggattacaggtgcgtgccaccatgcccggctaatttttgtatttttagtagagatgaggtttcgccacgttggccaggctggtctcaaactcctgacatcaagtgatcctcctgcctcggcctcccaaagtgctgggattacaggcatgagccactgtgcccagcctattgtggttttttttttaaagaacagagagggcagggtgtgttaggggccatggtagcagctggacagaggtttgtaccaggtggggcaggccagcgggggctggaccagcattgtctctctcacagaatacatccagcctgtgtgcctcccagctgccggccaggccctggtggatggcaagatctgtaccgtgacgggctggggcaacacgcagtactatggtgagtcctgtcctctgcctctgatgccaccgtttgggagactctgaactaggctggggatgggcagtctggctggttggatgagtcttgaccatgaggagtagggacgctgaggggaatggggtgggcaccaggagggaaggggggtgtgtacaccccccagctctggccagccttgcctgcacacccccaggccaacaggccggggtactccaggaggctcgagtccccataatcagcaatgatgtctgcaatggcgctgacttctatggaaaccagatcaagcccaagatgttctgtgctggctaccccgagggtggcattgatgcctgccaggtgagggactctgtaggggcagccccctggtcgctgccaccccagggatggagatgcaggggagtgggtggtcaggctccccatctaaaagcctgagggctctggggccacagcccatgtcatcccggggtgggcctcctgtccaaccactttggccttcagccagacctccctctcccctcccagggcgacagcggtggtccctttgtgtgtgaggacagcatctctcggacgccacgttggcggctgtgtggcattgtgagttggggcactggctgtgccctggcccagaagccaggcgtctacaccaaagtcagtgacttccgggagtggatcttccaggccataaaggtgaaagttgggtccagatgggagccagggtggggacgtttgggtgtctaatgggggaagggaggcagagatttgttttaggaaacctacgctcaggcctagaagagggccccccttgggaacagatggactttgaagggttcctggggaagggaagccagtggtgggacgtggaagcctctcagacctcgggagcccccagctgtctttccccagactcactccgaagccagcggcatggtgacccagctctgaccggtggcttctcgctgcgcagcctccagggcccgaggtgatcccggtggtgggatccacgctgggcctaggatgggacgtttttcttcttgggcccggtccacaggtccaaggacaccctccctccagggtcctctcttccacagtggcgggcccactcagccccgagaccacccaacctcaccctcctgacccccatgtaaatattgttctgctgtctgggactcctgtctaggtgcccctgatgacgggatgctctttaaataataaagatggttttgatt

SEQ ID NO: 36683 - DNA, 12115 bp, Homo sapiens
cagagtcagaaaactccccagctaaacacccgtaagacttcatacaacacaatactctatactgtgatgatcacagctgccaaggtaagaaacagatttcgctgactttggtaattcttactttctataattcttaattcctataatttctataatctgaacttttaaaatgagttaattttatgaatatcagttcaatcttaggcaataaaatgacatgacaaagtgcttaaatttataaatgcttatccatttagtgacaggaaaaatgagacaactttgaaatgaaaaaggtcatattcatctttgatcctggttactggtttgtcatttaaatttatctttcacttttattttgcttttcaaatgtgaatttctgccaattaaaaaatcttccaattatgttaccatatttggtagtagtggttaatttctccatgcaaaaacaatgacttaattttgttatttattgctctgctgagaaacagtgcagaactgagctatttacatctgaactaatatgaatagtcatttgactacaacatgcacattatcagcatgcctattccaatattatcataatttcatacagtgaataatgaaatggagtttcagaatatataatacaagctacttttaaagtgcccttgaggatgtttcccctctaaagtccagtcaacttttaacaaacatttctaaaaaaattccatgctattaataaattgagttactgatattaaattcaatattgtatcataaagaagtttagaaattttaaaacaatgttcacaaacacaaaaaatctgacgttagagaataatttgatactttaaaaagttattttgacacacgaatattcttaactatcttattttcacacaaatttgattaaatggatttctgcctattaatgcctatagttttgtcaagttattatcctccagtggtactccatttcctctctcggatttagaaagaaaggaaaaaataaaataaatgccaggaatggagatgccacaatcaattttatgacttctgtttgaattctaccctattctttatgttacaatcctcaatttagtaaatgaaacgtttcctcattcttagatctctgtcagggcatacagaaaattacatatattttatttattttgattttcatatttcatatatatgttaaaataaaatttatctctaaaattctcaattcctatgacaaatgttaattctattgctcactacaaataagaactttgtaactctgtaagcagctttccttaagacataaaaaaacataatttttgtctaccactgaggtatcctaattgtgtctccatatctctatactcatatttttcctttgatagtacataaaagtcattcagtgtaggtgtcttatgttatttgtgcatttttattcaaatatctatcaaattacattctcacacttcaaattgggtgttcacgagttattttattgtatcagaattttgctatatcacatattactctaaaaagtacacatacttctggatagagcagaaattatattaaacttacccttagctcactagtatgtctcagttaacagaaattacagttacagagactgctaaaatttcaaatataatgtggtagtaccatacattgtgtcccaactagttcatctataccttaaggtgcaagttaagtattatctttgtttatgaagacatgtggtttcaaagtaagtgctaaaaaaagtgttagatgaaatcaaatggaaaaaatatgaaagatgtttaaattaagaagcattaagttttaaaaacgcatgaaagagccagagtacttgctttactaaaaggcgtgacagcactatcatttcctaaaactcaaatatcaaatccattttatttgtattttagtaggcataaaggaaaatgatcacatttgggtatataatcatatctttaattagtgagattaagaaataataaaatattgcataaatacaatagtttcagaaaattttaatgtattttaatgttttaatgtactcattacacatgtacactaaattatgtaatatattaaatttttaattaaaaaacctaaagtctagttacctctccaaattagacaatatattaccaatcccagaaatgaggagggccaatgaacacttcttttttattcttaaagagcaatttcctaatatactcgtgtacacaaatatttcatttggtcctcttaattatatatttgatactgcatccctattctacaatttaggaaagatgcaaaaaggtgaactgctcaagatcacagaactaagaaaacagggaaaccttggcagaagtttaggttttgtcactaagccacatgcacatcctctatatactgatcagcatggcttaaagtaaaccatgacactgacaaacaaaatttgaaagcccccaaatactgtaaatgatattctaaaaggcaaaaggcaaattcagagaatacaaacttctattttaattaaaagccattccactccatttaaattcaatttatgcatagcattacattcttaatagtctaaattatattctactgatcattttcaaaaccagaaatatacgaaaattacagatgcccttagttattaagcaatacctcctggaaggcaaaattcaaactaactgcacagactttaaaaaaaataacacaccccaatcaatcaaagtttccttttatttgtttcattgctaaaatactcatgccttcaattcatctgatacctaaaatccaagttaacatctcctcaaaactttcacaaaaatcacatttcgatactttattctaggttccctagaatcaagtagtctctttgtacaatttcaaagttcttacccagagtaattctgaagcatgtgttaccaaataaacacatgaaaatgaagcctggatgtacagcatactcatagtcaactgaggacctctagtgcctttgaaaaggtactccatctttagttttcaacccccaacccccgcacaaaaaaaaaggttgactaactcactcacattaatagggggtatatttattaagtggcattcattttaaatccttaagactttctcaatactacctccccatattctcttcccccagaaaagattctgaatttccaactcctacagggttaagaagaatattttacttgtaaatacacttgtaaagcattgtttcaatatttaaaaaacaataatgaaggcaaacctacagacaatatagcaacagcaataagctaaattgtcagttttagagagaaaaatatctctgtgctgttgtttaatgaattctcctcaagacagagctttaacatgagaagcacttcattatgggtcaatttaggaatgagaatatattgatttttatgcatatacaattattttcataaccagacagaagcagcttgaagattctttcaaacagccagtctggaccaacaaagctctggaatgttgctaccacaaagtaacttcaaatagaatgtccaagtttagtattaggcaatctcaaaaggaaaatgactccactggagtgaacttttgtaagccaacagattcatcgtaaatctaatgatgaactgtcctaatttattaccacaagtccaaaaaagggtatatgcacattcacttatggcttatcagtggaaatgtcagaaagtagtagaaaaataaaattccaaacaatccaaatatagacaagtcctgtttattcaatctatagaaaattctaatcttctaaaccaattagatggaaaaaacatcctagagtatatcagactgtagccttagatattacttgaattcaatttaataaagtatttcttcagtactcccatgtttactaaaagaataaacaaaattaaaaggagaaaagcaaaattctaaattctacaaacataaagaatcccaggaatttattatttcagcaaaaggaataccaccaaaaatactgaagtttgagaagttctgcaagaagtgaacatacttaaagtatagatggagattaatgctcagcatatacaacatcattaaagtatcaattgtctagcaagtcataaagcaggccaccaaaagttttcagaagactattgaggttccttccgcacaagaatgcatctgatattacattgctaaaacaggactcactgcagacaaagtaaggactcctgaaggagttgatatatagtagcttccaccaaacatgttgcctaacatggtatatgacattagtcaaaagattagagttgcctaatggcttttctatttccttcttccacctcaaaaaaaaaaccagaataccatcttgaacttgattttttttttaatttccagcgttacttttcttgaggaaaggacgacaaccaaaggatttataaatcccacaaagaatagtaaagaattctttatttttattcttctcattcccctaaaaagtagagtaatcatggatccacagacataagatactctgtggatactttcctgcctctgacatgtaactcaagagacaggagtctggcatttctacacccaaactcctaacaagcacctttcatgttttcaatactcttgattctagggcctagaagacaatttgattttaaaattcatctataaatgaataccactcttgtgtcaaaacaaccaatttatatatattgtcattcttttaataaaagggtggagagcagcttcagtttccatggttgtttaggccatatacaagttcagaaaatcccaaaactatttatgattagactaacagaatgctctaaaaagatcagataacatgaaaataaaactaaactatttttgtatgctttccatcgaaaaagtactctattaaacagcttagctgttaagaaattaaaaaaaaaaaaaaaaaggaaactcatacagtggttgtcagtgcagagaagagaatgataaacatctgacaaccatgccataaattataatgtagtaaaggtcacagacaactccaaaaataggattctgctgttcccacaacaaaggttttcaattctcaatgtatgacaggaagccccatcttctatggataaaatctggcctaattatcatcatacaaatgttggtattcagtagaactaggattccacacatttcagatgataactgtaaaaaattgagcccaataaattaaatgtatatcattaacattttagcgtgtaaagcagatttaagtttaggcataaaatcataaagtagttacaaataactttaggattatggcatatttctaaatctgacaagaaacaggatactatttttggtcatctcctttacacccaatttgtttccagaaacaaactcttctttttcaataacagttagctgttgtaggattataagatcatctttaaagtatgttaactatgctttaaacagtaaagagctcatctctttagggcatatctctgtatttcacaaatactaaaaacccatttatacaaagcctagttcaggttaatactgtgttaatcaggtaaccattaatttaggtgaatcctctaagcctcatttttctcacctgtgatagaaagagacttgaggaaaatattagagcttacatgtccaactaacaaattgttattagaactagttaatctgtcaatcacagcattatttttaaaattgtttaacttattattaaaaatgagggccaggcatggtcattcacacttgtaatcccaggaattacctgagctcaggagtttgagaccagcctgtgcagcacagtgaaaccctgtccctaccaaaaatacaaaaattagccaggcatggtggcgcacacctgtggtctcagctactcaggaggctgaggcagggagatcgctagagcctgggaagttgaggtgcagtgagccacgattgcacaactgcactccagcctgggtgacagagcaagaccctgtcagtcattcattcatccattcataaaaacaattaattaattaaaaatgagatggggtctcattatgttgcccaagctggtctcgaactcctgggctcaaacattcgtcccgcctaggccttccaaagtgttggaattatagatgtgagccaccatgccctgcccacagcattatttttaattaacaattttctaatagttttagtcataaaaatcccttatttaactttagtgatttattgaagcataccaattatgcactaagtactaggatactaaataaacacacagtttctttacttcagaaactatcagtctagctggggatacaaacatgtaaattgaaattgtgctataatctgacagatatcctcatatagataacactaaagccctattaaaaaccagtagaggtgacaaccaattccaccttaataactaatgaaaggtttcactaggaagtgatatttaaactgaaccttaagaatcaactgaagcttgcatggcagacaatcaaaaggtggagaacacattccaggcagagatagaacaacatgtgcaaagaacaaaatcacaaaagggaatggagtatttatggaaaggtgacatgtttcatgtgactgaagtacaacttaccagtgtcaacgtaggggatgactcctgtatatgcttcatgataaactcctggccaactccctcctttcccatgttttgtctcaaaataatttttaaaatttctgaccttttaagaccacttaagcccaaaaacctcacaaaaccatatgttcaaataggaattaccaagtctaattattattcctttcttaactgtattctgctacacatcttcataaaaggtgactactcggccaggtgcagtggctcacgcctgcaatcccagcactttgggaggccgaggcgggtggatcacgaggtcgggagatcgagaccatcctggctaacatggtgaaaccccgtctctactaaaaacacaaaaaaattaggcatggtggcgggcacctgtagtcccagctactcgggaggctaaggcaggagaatggcgtgaacccgggaggtggagcttgcagtgagccgagatcgtgccactgcactccagcctgggcaacacagcaagactgtctcaaaaaaaaaaaaaaaaagtgactactcaaatataaataaaatcttcccataattttccaatccactagatctacaataagcaaatatcaacataagcaaatatcaacataagcaacttaaaggatgaatctcaataaagaacaaaagaaaatctatttatattttacctgaagaattcaaacaaaagtcattaaatatatgtcaagtttaagctgctatgtcccttatttttaacttttgttttaagtttgggggtatgtgtgaaggtttgttacacaggtaaacacatgtcatggggagcttgttgtatgtattacttcatcatcccgttattaagcccagtacccaacagttttctgctcctctgcctcctcccatcctccccgctcaagtagaccccagcgtctgttgtttccttctttgtgttcataagttcttatcatcttgctcccacctgtaagtgagaacctgtggtatttggttttcttttcctatgttagtttgctagggataatgacctccagctccatccatgttcccgcaaaagacatgatatcattcttttttatggctgcatagtattgcatggtgtatatgtaccacattttctttatccagtctgtcactgatgagcacttaggccggttcatgtctttgctattgtgaatagtgctgcaatgaatattcatgggtgtatgtctttacggcagaaagatttacactcctctggatatatacccagtaatgggattgttgggtcgaatggtagttctgcttttataagctgctattttctaagtagaagtgttatagacaacctaaataacagcctttagccacctgtttagacaatgaagaatatatgctagaaaaatacaggtagttaataactctttaaggaaagaaaatttgatagaagttgagtgtttggaactccttgctacagaccaatattatgaagggggacagagtctcaagccaaaaatgcccagtctactatataattcagaatataatagacccaagttgaacactacagaatctaaacaccataaaccatatggtttctttgccaaagtaaatgccgggttctaactagtcatgcctgatacttaccttcccctttgccattctttcagcacttccttctgctcccttcagcactttcctctctcaggaatgggctaacaggttgagatgggcttttatgggatgtataaaaggacttaggagaaaataaaatctgacacctggggtaaggtagtaatatgttgattaacaataatatatcaacaaatgttaacagtcactatgtctggcagttaattactgactttttttctccgtttttcatttttcttatttcaaaattgacacataagtatactgattgaaaacaaaatgtccccaagtgttaataacgattatctctggacagttaatacagttaattttcagtctatatataatttttctgtaatgacatgtaaattcttattttattaatcatcaaagtataggccccacaggcagcaatagcttgtgggatctctgaaagaaggcatgatggaaactactactattaagtagaagtctgtaaataggatatgtctgtggtagtgagataataataattactatgtgttccaagcttgacagtcttcagtacttaacatcaaatcttattaaaatgttacttaagataacattctataaaactataaaatcataaaaaggaataacaatttgaatctatatttttggtaaaacacttcccatttaacactattttattttagattaaaattaagatccagggaacaatttgttgtatgcatttcctttttatgagattggctctggagctattaatacagtgactgatcaaaccaattacatctacagagtaacagatttaaagaaactatatgttagaacttttacccaaaagaataacccaaaacaagctgtaccttaaaccaaatacagcaggtcctcaaataacatcatttctatgtcattttgttataacatttaagtatgtgtggggcttgcatattctccccacatctgtgggactctggtttcctcccatatcccaaaacagtgcacattaggttcactggcatgtttaagttgtcctgggttgagtgtgagtgtgtacatgagtgtatcctgtgatggagtggcctcctatccaaggtgggttcctccctccttgagctgctgggattggctccagccaccagcaccccaaaccagaataagagggttgaaaaatgaatgaatggatgaatacaaattattatcgaataaaaattggtaaagtctacggtgatcatacaaatgcatgacaataaacgctatggcacaaaagcactcagagatcccaccgtatttgaattgtttttgatctgcatggagctggatgtgctcctgacaattttcatttctcaaacatgattccatgtttttaatagaccaccacaaccactgttactcactgattcaccaaatactgggtaattatctttgttggcttttttttttttttcctgggacagagttttgctctgtcacccaggctggagtacagtggcatgatctgggctcaatgcaacccctgcctcctgggctccagcgatcctcccaagtagctaggattacaggcacatgccaccagcctagctaatttttatatttttagtagagacagggtttcaccatgttggccaggctggtctcaaactcctgacctcaggggaactgcccgccttggcctcccaaagtgctgggattacaggcatgagccactgcacctggcctatctggtttttattaatctttcttaaatgtatacatagttcatatttctctcaacgtttaatattagaagtgtttggggtctttattgagaagtttggtgatgtttttgtgaccagaaatatgctataggaacttaactcttgtttacatcaatcagcctagggtaaaaatggttttgttatatgttgttttgcgtaaagtcatggtttccaggaacttatggaagacactgaggattactccaatacttgtagtaaatttgggagaaaaaggcaaggactaaagttactactcctaacacaaatgagacggtcatggtgtgccccatcaaaaaaggagagaaagagagacagacacatagaaacacgtgcacatacacacacacacacacacacacacacacacacacagagagagagagagagagagagagagagggagagagactatagaaacatgatgttataaataacaatagtgctgaggaagatgaattagtgtaaaattgtattttttgttctgaggataggttacatagatgattctaatccatttattatttttacattccaggctacctaaaagaagacagttatctcatatttggctgccagctttttatctttctctcgaccacttaaaacttcagacttcctgtcctgctggtatcatggagaaagtccaatacctcactcgctcagctataagaagagcctcaaccattgaaatgcctcaacaagcacgtcaaaagctacagaatctatttatcaatttctgtctcatcttaatatgtctcttgctgatctgtatcatcgtgatgcttctctgaagttctgctacaacctctagatctgcagcttgccacatcagcttaaaatctgtcatcccatgcagacaggaaaacaatattgtataacagaccacttcctgagtagaagagtttctttgtgaaaaggtcaagattaagactaaaacttattgttaccatatgtattcatctgttggatcttgtaaacatgaaaagggctttattttcaaaaattaacttcaaaataagtgtataaaatgcaactgttgatttcctcaacatggctcacaaatttctatcccaaatcttttctgaagatgaagagtttagttttaaaactgcactgccaacaagttcacttcatatataaagcattatttttactcttttgaggtgaatataatttatattacaatgtaaaagcttctttaatactaagtatttttcaggtcttcaccaagtatcaaagtaataacacaaatgaagtgtcattattcaaaatagtccactgactcctcacatctgttatcttattataaagaactatttgtagtaactatcagaatctacattctaaaacagaaattgtattttttctatgccacattaacatcttttaaagttgatgagaatcaagtatggaaaagtaaggccatactcttacataataaaattccttttaagtaattttttcaaagaatcacagaattctagtacatgtaggtaaatcataaatctgttctaagacatatgatcaacagatgagaactggtggttaatatgtgacagtgagattagtcatatcactaatatactaacaacagaatctaatcttcatttaaggcactgtagtgaattatctgagctagagttacctagcttaccatactatatctttggaatcatgaaaccttaagacttcagaatgattttgcaggttgtcttccattccagcctaacatccaatgcaggcaaggaaaataaaagatttccagtgacagaaaaatatattatctcaagtattttttaaaaatatatgaattctctctccaaatattaactaattattagattatattttgaaatgaacttgttggcccatctattacatctacagctgacccttgaacatgggggttaggggagctgacaattcgtgggtccgcaaaatcttaactacctaatagcctactattgaccataaaccttactgataacataaacagtaaattaacacatattttgcgtgttatatgtattatacactatattcctacaataaagtaagctagagaaaatgttatttagaaaatcataagaaagagaaaatatatttactattcattaaatggaagtgggtcaac

SEQ ID NO: 36684 - DNA, 12115 bp, Homo sapiens; identical to SEQ ID NO: 36683

SEQ ID NO: 36685 - DNA, 12544 bp, Homo sapiens
gcagtgagacaagggtaggcatgggaattgggaggtgcagccctgccccacgcctgttgggtaacactgagcatcaccccattgattaccccattgccaggcgtgggcacgggagttggtttgggagctgccagtctcctgggaggatcgcagtcagcagagcagggctgaggcctgggggtaggagcagagcctgcgcatctggaggcagcatgtccaagaaagggagtggaggtgcagcgaaggacccaggggcagagcccacgctgggttatgtggggccacaggggtgaggggcgggcagagggagctcagggtaaaggacactggtgggaaccaggggcatggagggaaggggatgtgtgcccatggcccgtgggtcagggggcaagcccaccaaggggcctatggctgcaggggccatgggtacggggcttgctcaggagagggaggtgggtgctggtgtcttctgagcctcactttgccctttggcaggctcctgggaagcagccacagaaatgaagcctgttccccaggagccccagggatggggacagaccccgtcctccctttgaggagctcccaggttagaggagaaggcagctctgtggacagacaaggattgggtcgggggcaccagggctgtgatcaggaggtgccggagaatcggggattggaagcagagagattcttggcagttgaagcgaaagtcggatctttggtttcagatgttaaaagcaacatgcattgcttgtttctggttctagaaatactacattcgcatttagaaagtctggaagctgcaggaagatgttgagaagacagtgaaaggcacgaggcacacattggcacatggtgtcacaaggctggtgtgaggagaggggctggggggcctccctcctcgcactgaggctgtgaggagggcaaatcaagtcgtctctgggagcctcggtttccctgtccttccaactgggtaataataatagctgtgaggctcagatgagatgtgcatgccagctacctggccccagatgccagctctgacttctttctgggccctgcaccaggcatggccactgccaagggaatgagtcccctctccatatgacaggtcccatcaggcctccaccttcctgtgtgtcttatttctcagcatctgcccccacagggcttttgcacacgttggtccctctgtccagatcacctgccctccaagaggccctcccctacggcttccccgcagcagtcagagccaggggtgggtctctggccacctctggaagaagccctggcccaccgatcatgtttgtaatgatattgtttccggtgtcattgttccgtgtgtagactgtgagctccatgggggctggccaagtctggggtggtcacctatgggacccaggtccagtcaggaactgcctggtgagcagccagaggtccccagtgtaaacccagaaaatctgagacgggtctcagttaatttataaagtttattttgcctgtaatcccagcactttgggaggccgaggcgggcggatcacgatgtcaggagatcgagaccatcctggctagcacggtgaaaccccgtctctactaaaaacacaaaaaataagctgggtgtggtggcgggcacctgtagtcccagctactcgggaggctgaggcaggagaatgacgtgaacccgggaggcggagtttgcagtgagctgagatcgcaccactgcactccagcctgggcaacagagtgagactccgtctcaaaaaaaaaaaaaaagaaaagaaaagaaaagaaaagaaagaaagaaagttcattttgtggccaggcgtggtgactcatgcctgtaatcccagcactttaggaggctgaggcaggtgcatcacttgaggacaggagtttgaaaccagcctggccaacatggtgaaatcctgtccctactaaaaattataaaaattagctgggcatgggggcgcatgcctataataccagctactcgggaggctgaggcaggagaatcatttgaacctgggaggcagaggttgcagtgagccgagatcatgccagttgcactccagcctgggtgacagaatgagactccatcttaaaaaaaaaaaaaagttaattttgccaaggttgaggacgtgcacctgtgacacagcctggggatgtcctgacagcatgtgcccaaggtggtcgggacacagcttggtttacacactttagggagacaggagacagcaatcaatatatgtaagaaggccaggcacggtggctcacgcctgtaatcctagcactttgggaggccaaggcagggatcacctgaggtcgggagtttgagaccagcctgaccaacatggtgaaaccccgtctctactacaaatataaaattagccgggcatggtggcaggcacctataatcccagctattcagctattcgggaggctgaggcaggagaatcgcttgaatccgggagatggagattgcagtgagctgagatcccaccactgcactctggcctgggcaacaagagagaaagtctgtctcaaaaaaaaaaaaaaaatacatatatatatacacacacacacacacacacacacacacacacaaaatacatacatacatatatatatatatatatatatatatatatatatatatatatatatgaagtacatcggttccatccagaaaggcagggacagcttgaagcagggggtgggggtgagggttggggcagcttccaggtcacaggtaggtgagagactgcattcttttgagtttctgatgagcctttccaaaggaggcaatcagaatgtgcatctatctcggtgggcagaggggtggctgtgaataaaatgagaggcaggggcccgcacggtggctcatgcctgtaatcccagcactttgggaggccaaggtgggcggatcacctgcggtcaggagttcaagaccagcctcaacatggagaaaccccatctctactaaaaatacaaaattatttgggcgtggtggtgcatgcctgtaatcccagctactcgggaggttgaggcagaagaattacttgaacctgggaggcagaggttgcggtgagctgagatcgcagcattgcactccagcctgggcaacaagagcgaaactccgttccaaaaaaaaaaaaaaaggggggggaggcaggttggccctgatcagtttccagcttgaattttccttttagcttactgattttgggggtccaagatattttcctttcacaccagtcagccctgccccagcaagcgcccggacccctgccctgcagcaggtgggcgagacaagaaagcaccttgcatgagaggcagggcttgggtccagctccagcccccatctgtttcctcatccgtcaggcagatgctgctggctccgtgattatttcaccgagcaccagatgtgcacatgtgaggacaggcgacgactgcccagaaagggcaggggttcctctgccccacctgcctcacctgggaaagctgtgaccacgctgaggccaggttcctgggatgaacatcaggacacctgtgtgccatagctcatcccagactcctccaatccgggtcttgattcaggccggaggcggtcatccctccaaaggcaccagggagccatggaagaggttagagctgagctgatgtggccaggagctgcttgagcgccgggtggaggctgctgacgctcgcatgccaggcaaagctttgggtcagggccctggaacctgggacctggaagcgctccaggccaataccgcccgctaccagagaagggcccaggccccacccaggttctagcccaagggcttgagcaaagacagtagatgaatatttgcagagccctgtatgctgcgtcctcctccaggccctcatgcaggggggccgcacactgagtgtgggggtcctgtgccaggaatgtgatcacgctgcccaggggagggaggcggcatctgcaggtgtggccaggaaggtgcccagcatggcttcctgtctcctcacattcttcagctgggacctgagccgggcaggggctgctctcctcatcttgtcattcacaagacacggacttctgccattggttcagctggctctgtccatgggcgagcactgtccctgcatcacatatgacaagaatgcctggtgcggtgcaagtgcagatggggccactggcctccaggacactcactggggatgccaaggccctgctcaccacccacccccactgccctcagcaatgcgggtctgaggcagcagccctgggcacggccctgtgacctgcagctgagggctgagattactcaagtccacacgcagacacacacacgacacacatggacacagacacccatacacacacagacacacatggacacacacacccatacgcatacagacacccatacacacacagacacacgtggacacacacacccatacacacacagacacccatacacacacagacacacgtggacacacacacccatacacacacagacacccatacacacacagacacacgtggacacagacacccatacacacacagacacccatacacacacacagacacccatacacacacagacacccatacacacacagacacatgtggacacacacacccatacacatagagacacccatacacacacagacacccatacacacacagacacacgtggacacacacacccatacacatacagacacccatacacacacagacacacgtggacacacacacccatacgcagacacccatacacacacagacacacgtggacacacacacccatacgcagacacccatacacacacagacacacgtggacacacacacccatacacacacagacacccatacacacacagacacacgtggacacacacacccatacacacacagacacccatacacacacagacacacgtggacacagacacccatacacacacagacacccatacgcacacagacacccatacacacacagacacccatacacatacagacacacccatacacacatagacacacatggacacacacacccatacacatataacacccatacacagatacacatggacacagcacccatacacacacagacacacagacacacagacacccatagacacacaggcactgatacatacacagacacccatacacacgcagacacacagacatccatacacaaacacccatacacacacagacatccatacacacacagacacacatggacacacacacccacacacatacagcacccatacacagacacacatggacacagcacccatacacacacagacacacagacacccatagacacacagacactgatacatacacagacacccatacagacacagacacacagacatccatacacaaacacccatacacacacacagacatccatacacacacagacacacacacacagacacccatacacagaaaggcacacaaagacacagacacacacatagccatacacatgaagatgcacagaacacaaagacacacagacacacaaagaaacacagacacccacacaaagacacacagacacacaaagacacacggacacacgaagacacacagacacccatacacgcagagacacagacatccatacacacaaagagacacagacacccatatacacatacacacacagacacccatacacacaaagagacacagacacccatacacacatacacacacccatacacacagactcccatacacatacagacacacagcacccatacacacacagacacccatacacacaaagacacacagcacccatacatacacagacacacacagacacccatacacacaaagacacacagcacccatacatacacagacacacacagacacccatacacacaaagacacacagcacccatacatacacagacacacacagacacccatacacacaaagacacacagtacccatacatacacagacacacacagacacccatacacacacaaagacagacagccatacacacacacacacatagacacacaaagacacaaagctatacaaagacacacagacacaaagaaacacacagacacacggatacacaaagacacacacagacacacggatacacaaagacacaggatttgcgcaccattcttgagcccctgggctgggatgctcagaatcccgttgctaggtgcctggcaatcctcttgagtgtccccctgagccccttcccccacccccagggtcctgatccttcctcctctccagaccccactggggttcccttgggccctcaggctaaagcccagaggggttcatgccctggggcagtctcagctctgccaacctacccccacctgcacctgtgcccacccataccagccccggagctctctcctctgcttctgcttccttctacgaccagcagagtgccaccccctccccagagcaggtgccaaaccctcctcagggctagggcatgcctatggcttcagtttccccatctgcgacctcaaagctctgtgatctctgaagcaaagaaccctccgagtccctcgtttagtcccagaagggagggaggcccaggggagagctctgttccatctgagtggtctgggtgtaggggtggcaaggtgccagcgtgggtgggtgtgtgtctgcgcaaggaggggaggtgcagggaagagctgggatggtgggcagcagggtcacccgaggtgtgtgtgttgggcttccagggtgggcgtccaggagggggatcccctccctggagtaggggaggtcaagcccagggccctccctcatgggcacacctgggaggcaggtgagttgggggtggtgcaggcagccccagccccgtggggtcattcgagtgggtctgtgtgtgtatgaggtggggtgtctgtgagcccccatgggtgcaggtggggcaagggtgtgcagaccctggggtggctggagggtgcccgtgaaggaggggcagccctggccacccagttcaagccaccccatccggcaggatggaccccttcgaggacacgctgcggcggctgcgtgaggccttcaactgagggcgcacgcggccggccgagttccgggctgcgcagctccagggcctgggccacttccttcaagaaaacaagcagcttctgcgcgacgtgctggcccaggacctgcataaggtgggccgtggagagtgggccccggcaggggctggagcagcgtccctgtcctctttcaggagggcccgtgccccctagtgactggctatgtccctagttttattcctgtttgtttaacagaccccctccctggcatgtggagtgtggcaggcacctgaccttcactcctgaacactcacagccaccctgtgatgcaggctccatggctgtccccatgttgcagatgaggaaactgaggcactcaggggttaacatcgcttgcccaaggccacacagccaggaagtcacagatcagaattgcagccatgcgcagttcccaggggacggcagtgcctcccataggagctgtatttatatgtccagtggtggtggtgcctgcgtgtgccctcctcaaattctagacccctcctggcccaggtctgggcctgaccactctgaattccacctccaccacagccagctttcgaggcagacatatctgagctcatcctttgccagaacgaggttgactacgctctcaagaacctgcaggcctggatgaaggatgaaccacggtccacgaacctggtgagccctgctggcaggcggcaggagggcagggcagggcaccgggtagctctggcccaggcccccttctgcccctgaggccccgggcgagtcactgattttctcgtctctcctgggattccatcgcacagggagctgaggccccaagtgtgcagtgggtgggctttggggtggcccttggcagggcctcactgtctaccctgtgcctcagttcatgaagctggactcggtcttcatctggaaggaaccctttggcctggtcctcatcatcgcaccctggaactacccactgaacctgaccctggtgctcctggtgggcgccctcgccgcaggtgaggagggcgttccgaaccccatgctctccccgcccagtagcccctcccaaagaggcccctggaatcttgctctgaggtaccctgggcctcacatgccctctgagcccagcccctggttgggcatggggaccctgggctcccccaacgacgtccccatctgcccctgcagggagttgcgtggtgctgaagccgtcagaaatcagccagggcacagagaaggtcctggctgaggtgctgccccagtacctggaccaggtgagggtggccctgccccagcagtgcccgacgtccccatatatcacccctgtgggctgaggaggcccggctggccccgagcccgccccgagcctctcattccaccttgcagagctgctttgccgtggtgctgggcggaccccaggagacagggcagctgctagagcacaagttggactacatcttcttcacaggtgagggggccaggccagggtcccagagtaggtggaggggatcatcaggagagagggtgggagggttgtggagggaggaggctggggccagcagtgggggcacgtggggagctggagctggcacagagtccgtctgcctgcataggccacgccctgggcacattgcagcaactggatccaggagtggccaggctggaggcaggtcccagtgggtgagccagaccggccaggagaagggtgaggcgggccaggactttctatgaagaaagcgggcaagagtcaggtgcctggagtgtgtggtcaaggccagttgaggatggggtctcctcaccatgtccctaggaagcccgccgactccaacacctctccagggaggagcaggctctgggctgggccatcctgcctggtccaggtcactgactggccactctggtttccttccacgcccagggagccctcgtgtgggcaagattgtcatgactgctgccaccaagcacctgacgcctgtcaccctggagctggggggcaagaacccctgctacgtggacgacaactgcgacccccagaccgtggccaaccgcgtggcctggttctgctacttcaatgccggccagacctgcgtggcccctgactacgtcctgtgcagccccgagatgcaggagaggctgctgcccgccctgcagagcaccatcacccgtttctatggcgacgacccccagagctccccaaacctgggccacatcatcaaccagaaacagttccagcggctgcgggcattgctgggctgcagccgcgtggccattgggggccagagcaacgagagcgatcgctacatcggtgagtcctgctgccctaccgcagcccacctgggccaagaccctttctcaatggagggcccacggctgggccacgagtctggactcgcacctgaaacccggccccactatcagagcccggccttgagccatggctctggtgccacgattccgtctctgtgcttctgagcctgtggccccatgaggccatactctggtccctcagccctggattcactgagctcagattccagggctccagggcccagcgtgctaaggtgaattcccatcccaccaccggctgtcctgaaaggccgtaacctctgattctccgagcccatgatccccaggttctaaactctgacggccccatcctgagcccccagtctcctgggccgtatgactcagcagctcatgggacactgcagctccaacattctgggacgctgctgcctcatgaactccaaggttctaagatcccatcacccctgactgtgagaccaaggtcgggggattctctgcgccccacaggccctgagcaggctggggaagccctagggtcccttctggggggctgtggggaaactttcttccctaaacactccaaagcctgaagcgctgggaagtcagaccttgggatcctggcctggagccctggcccatgcccctgtccccacctctaccctacccctgggggcagtcctgactgtggccccagggctgagccgtctctggtgcccgcagcccccacggtgctggtggacgtgcaggagacggagcctgtgatgcaggaggagatcttcgggcccatcctgcccatcgtgaacgtgcagagcgtggacgaggccatcaagttcatcaaccggcaggagaagcccctggccctgtacgccttctccaacagcagccaggtgggggtgcggccgggttgggggcaatggaggggctgaaaggggcacagactggcacctttcctttcacagcccttcccagcaaggctttagagcagcagatgcctcaagggtgactatatctaggccacctggtaccactgcatccggcgcaaggatgcctggcagagaggacagggtccaaacccaccagacacttagcgggtccatcctctgtcctggccagagcagcctgcacttggactgtgcaaaggttctgcacaggcaagcagaggcccggaatggaggtcagggacagagcagagcaggggcctgatagagcccagcgggtcgcggtggggcccgcataccacactgcagcatcctaacctcaccgtcgcgactcaaggctgccggctccccatgatcctgcagggcttcctggtctttgcgccatggtggtaatcacccccatggcaccccgaccgtcactgagagggtgctgtccccagaagatgcttagagcggagattattgcccgttagagggtggaggggcaggtgaggatgaggctcacctccgctgtggaatgtgcggggctcaagccctcttctcatgactagagcccaacacccaccttctcactccctggcaggttgtgaaccagatgctggagcggaccagcagcggcagctttggaggcaatgagggcttcacctacatatctctgctgtccgtgccattcgggggagtcggtgggtccctgcccatttccacccctagggaagcttggctttggtaccccagacccaggaagtcccttcactcactgttcaaccttgatccacaccctgggcctctcaaggcctcagtttccctatctgtaaaatggctctgtgagtggcctggctctctctgagctccctgccagctgtgtgccctggccggggcagtgggctgctgctggggctccatgggctgcctggtctcaggcccttgttctctgtgcccacacaggccacagtgggatgggccggtaccacggcaagttcaccttcgacaccttctcccaccaccgcacctgcctgctcgccccctccggcctggagaaattaaaggagatccactacccaccctataccgactggaaccagcagctgttacgctggggcatgggctcccagagctgcaccctcctgtgagcgtcccacccgcctccaacgggtcacacagagaaacctgagtctagccatgaggggcttatgctcccaactcacattgttcctccagaccgcaggttcccccagcctcaggttgctggagctgtcacatgactgcatcctgcctgccagggctgcaaagcaaggtcttgcttctatctgggggacgctgctcgagagaggccaagaggccgcagaacatgccaggtgtcctcactcaccccaccctccccaattccagccctttgccctctcggtcagggttggccagacccagtcacaggggcagtgtcaccctggaaaatacagtgccctgccttcttaggggcatcagccctgaacggttgagagcgtggagccctccaggcctttgctctcccctctaggcacacgcgcacttccatctctgccccatcccaactgcaccagcactgcctcccccagggatcctctcacatcccacactggtctctgcaccacccctctggttcacaccgcaccctgcactcacccacagcagctccatccactgggaaaactggggtttgcatcactccactgcacagtgttagtgggacctgggggcaagtcccttgacttctctgagcctcagtttccttatgtgaaagttgctggaaccaaaatggagtcacttatgccaaactctaataaaatggagtcggggggccacatagaagccctcacacacacatgcccgtaacaggatttatcacaagacacgcctgcatgtagaccagacacagggcgtatggaaagcacgtcctcaagactgtagtattccagatgagctgcagatgcttacctaccacggccgtctccaccagaaaaccatcgccaactcctgcgatcagcttgtgacttacaaaccttgtttaaaagctgcttacatggacttctgtcctttaaaagcttccccttggctgtggccctctgtgtatgcctgggatccttccaagcactcatagcccagataggaatcctctgctcctcccaaataaattcatctgttctgg

SEQ ID NO: 36686 - DNA, 5486 bp, Homo sapiens
cccccgtctagatttaaagcgcggctgcgcccggcttctgacgtccattgaatcgcgcgggcggccggcggcgagcgcggggctgcgccgggatcgctgcgccctccgccgctggcctctgcgacgcgcgccgctcgcccgagccacccgccgccgcgccggctccccgcgccgctgcgctcctcgccccgcgcctgcccccaggatggtccgcgcgaggcaccagccgggtgggctttgcctcctgctgctgctgctctgccagttcatggaggaccgcagtgcccagggtaagcgagtggggatgcgctggggaggcttggctgaggacaggggggtcgacttttctgtggtctccacttggtctgttctgagcaacgctgctctcggaagatgttgaaccaacttggggactccgggatggagaggagtgggaaaattgtaggcaatgacactttaggactgggaactgagtttggagctcggttatcttgaaaaaggaaagggagcgagctggggtcttagtagttagggttaaatgctccaagttctggccatgataactttagatgtgatctcctctgtttggctctgaagaagggaacaagtatcagtagtagcctggagatttcagtcgacccatttgcagtctcatctctctccctcccacatcttttggatacttaaaaaaaaaaaaggaaagaaagaaaagaaaacctgggggtttgggggagagatactgaattttatttggtggctgggggacgtggtttcagaaactttgcccaaacttggaaatgtgggtgctgaagattttcaagggaagtagctttctgcctagtggatgcttcttccaaccccatcccccattctcgcaaaaaaaaaaaaaaaaaaaaaaaagccaaattattaccccaaagtgctttgagcactttacagtttttttcccctctgcctcattcttctttctgacccttagctttctgtaaaacagtgagcagcccataactgacttaaattctgaaatgggttaagagcaaatttctgaagcttgccttttaaaaatagatttgtttatttcaattagtctttgggcagaatgtttaaaataataatagcagcttgcgatccaatgattgttaaagtcatattggtgattcatgagaagtcttctcgacccaaatccgaacattaaaaagggggaagagggagaaatcacttgcaaatatttcttgctaggtatgagataggtacttataaccgtgaaatggtaggaagactcccccctccccccaccttaaggcattactttccctgcttcagcgttaacattttaagtatgttgtaaactgccctcctgggcactgcccctcgccgtctgcatggcactgcgctgggttgcccgcctttagaggagaggctctgcctggtgcccggacgtgggcgcggaggaaagcagccctcggagatttcgaaagatcgcggtggccgcgggcgtgctccggtctggcggattgcaaaacgggcccgtcgggctggctgcgcctggaggccgcgcggggtagctccgggctgggccgggttgcttttttgctttcatttttcagaagtgccttttgcttgatctgtttctctctctctctctttcttttctttcttcctctctctctttctttcttcctttttttctttctttctctttcttttctttctttctcttctttcttttctttctttctttctctttccttctccctctctctcccctccatctctcctctctcctctctctcgttctcttactttcttaacccctgtcacaaataattcctgtacccgcctacatgaaaccagcatgtaaaaacatccgtcgcatcctgtttttgtcaggttctttaatctgctcttcgagtctctgcaggttatgaaatgggacgaataaaagtaaacagtctagtaaaagtcaatgcaagctgcacgtgttgtgtctgggtcactggtaactgacattgatatggctggggcgccctgtcttctccctctctccctccctccctctcgcccacctcccatctctgtgatcagggcttccccctccactgccttctttttccacccctccacccctttcgatttatttcctacttttctcccgcgtctctctcacttcccctcctccacgctcaccccctccccatccccgccgggtctccttcgctagccacctcgctctccctgccctgccaccgctcactgctcactcacccacctccccacccttgtctcttcacagctgggaactgctggctccgtcaagcgaagaacggccgctgccaggtcctgtacaagaccgaactgagcaaggaggagtgctgcagcaccggccggctgagcacctcgtggaccgaggaggacgtgaatgacaacacactcttcaagtggatgattttcaacgggggcgcccccaactgcatcccctgtaaaggtaggactccttcttcccaacttgcaggccctcagtagagggcgtcttacccttagcttccccactacctgactggggtttgggagtaggagagctttgttcctgggcttccccttcctgtcccttgccctggtaagccgtgcagactctaattctgcctgttacaggctgtagggaatacacgccagacttcttagccaagtgtggtggtgaaacccaccaacctgtgctccttaatgagagagatctgggtgtggggcacagcccaaggtccacactctttcaccaactcccaatattccaggagagagcctggggcccctccagcgcaaactcagggctgcatgattgcgcaaggcacccgaagccctcctggctgacctgcagactgcctggctctggttttaatccatgcctgtttctaactcacagaaacgtgtgagaacgtggactgtggacctgggaaaaaatgccgaatgaacaagaagaacaaaccccgctgcgtctgcgccccggattgttccaacatcacctggaagggtccagtctgcgggctggatgggaaaacctaccgcaatgaatgtgcactcctaaaggcaagatgtaaagagcagccagaactggaagtccagtaccaaggcagatgtaaaagtaggtcctaccctgttgagcaagactggatctgtcccctcctccagctttgtacctaaagtagaccctctagaagacccttgggggatggtgtagtccgcagtaagagcctgataatagtaatactgaaaccaaataaaggagtccttttctaacctctagagattcattaagaacactgaggggaccaacctagtcatagattctctcttgaaaactacagggctccctaagtgccttttgaaagctggatgcttcagtgtcatgatttccttggtaacttcaagtgctcactccctaaggactagaaggtacctattcatgtgtgtttccttctttgttccagagacttgtcgggatgttttctgtccaggcagctccacatgtgtggtggaccagaccaataatgcctactgtgtgacctgtaatcggatttgcccagagcctgcttcctctgagcaatatctctgtgggaatgatggagtcacctactccagtgcctgccacctgagaaaggctacctgcctgctgggcagatctattggattagcctatgagggaaagtgtatcagtaggtattctggattgaggaaggaaaaagagaaaacaggctagttctattattaaactgtggggttaactaataagtaaagcccaaggcgtccccaaacaccatagggagaaatacgctgcaatttggggaaagtgttgtgaccacagtattcctcatggaaaccattgtcttctggaggcattgacacatatattcaaatgccagcaggaagcaaggaacagtattccgtcttagaaaacttagaacttactcaattttacacatttttttaagtgccagacttgctggaagcgaaaaataattacttagcagttccagaaatctgttgtcagattctagtaattaatggaattctttcttttgtaaaagatcccacttgtgggaaataataagatacatatttaacttgagaatattgtaaaatcctgttcttaaaaaaatacccttttaatgcactaatgtagtatgtaagaaactgcaggggttttgtgcgtgtgtatgtgtgtgtgcatttgagtttcagttttattatccagcatttttgcataatatctccattacccccattagtaataggctattactattatgtttatataaaataaattatgtttatatttattgatagaggactagagaaagggagaaaagggggatatggggaaatcagtttactcatcacagatgtattatatcctagaagcaaagtcctgtgaagatatccagtgcactggtgggaaaaaatgtttatgggatttcaaggttgggagaggccggtgttccctctgtgatgagctgtgccctgacagtaagtcggatgagcctgtctgtgccagtgacaatgccacttatgccagcgagtgtgccatgaaggaagctgcctgctcctcaggtgtgctactggaagtaaagcactccggatcttgcaactgtaagtgcgatttttaaccttgctgccatttaaggctttcccaggcaatccctagggaatggacacttacaaagcacgcagatctcccataaatccatttctgttcaaattaggtagctgctaagtatcaccagcaattcaataatccacagaaaattctctgcgatgtttcttggcttttaggacttatctggtgatcatcaatggggttgcctctagaaatctatttccagttgttttcccctatttcttgtgttttggtagtgtgctttgctgtttgctttattaacatttgagtctaaactaactgcttcaaaagttttttttttttttttccaacgacagcttcatattatcacacatgggctgctgctttttgcagttgcctctactaactctgaattaaggacccaaagcagttatacctagaacacaagagcgctttttatctaatttcaggaatctgcccgtaaaacctgagccattgattcttcagaactttctgcagtttttgacttcatagattatgctttaaaaaaatttttttaacttattgcataacagcagatgccaaaaacaaaaaaagcatctcactgcaagtcacataaaaatgcaacgctgtaatatggctgtatcagagggctttgaaaacatacactgagctgcttctgcgctgttgttgtccgtatttaaacaacagctcccctgtattcccccatctagccatttcggaagacaccgaggaagaggaggaagatgaagaccaggactacagctttcctatatcttctattctagagtggtaaactctctataagtgttcagtgttgacatagcctttgtgc

SEQ ID NO: 36687 - DNA, 47252 bp, Homo sapiens
gccggctacaggaaattgacttaggcacaggaacttgctaatctcttttgtcacattcggattgctcctgctgccccacacacactaacccaaccatcttggggtggactccctgccagcccaactgttgtattttcagttcttccagtgtgaatcagttaatattctcgggaacgagggagaggttgatcctatgaggaaatcaaccacagtgaaaaggcttgggccgcttttgttttcacctgcttttgttgaacaaatttgatttccggagtcagtcattttactgtcaagacatttcttcggcattctgcaacaggtaaggattttgcttccttaaaagtatttctttggtgtcaaaagaaatttttctaattttatttagcttttactctaggccaaacatcgtaatgactctgagctacctgctgtaaggtgtagaatcaatttacagggggacgggggtcgggggggtgagtgttgctttgatattcactgcccctcaccacagtcctaacaagatttttgaaacatgaaaagttacaatagttggctttttggttttccagatattctagagaatgcatatgcttgtgactgtggctgagctcaactgtatgggtagtttaaatactacccaaggtttgatgaagtaaatctaaagatgctctaagttgtgcaaatatgaattttaaagttgtctagttcagaaaagaaacagaaccgaagtctaaatgatgtagatttcaatctggaatttctagcttgtgtttttcacctattgccaatgttaatgaccatttcccaaaagtgctctatgatgtataacatgtattttttaattaaatttaatctttcttctgaggtggtttgatttggagatatgctacgaggtaccagtcagtagcctgagttgtaactaaacaaagtttgggaaatcaccggttttaggtgctttactaaatgaaagttgccattgacgtattcaagcaggcaacaagtagttggtgtccccttattggttctaagctggtgccgtggaggatataagagaaatattttaaaaatctctactttgaaggaccctataatctggtagttgtgataagaagtaaaatttaggaagcaatgcaagatgagaattcagtgatgagtggggcagcacaggcttgaagagttctgtgaattccatggagggggcctgggggcaaactggagttgtcaggaagatctgggctttggaagaatgcgaagtgtcggtagaaggagaaggggcaggtgatttcagactgggaggaccttgtgggcaaaggcacaaaggcgagactgacctggagatgataaggccagttgaagagacactggagaagagaagacagtttgttttacacattgcaggaaatcagattagacagttagggtgtggacacaaaagcgaggaccttgcaggcactggggagaagtgaccccattcaatagtccttggtctccttctgccctgcggctgcgcttcctcggctctcacggcaccagcagaattccatgtgagagggagcttgtcgagcgtggcctcttcccacttggggctgctttctgcatccctgtgcctggctgtgggcctccatttgccctctactgtcttcccttaggacatcatttatgcagagaaaggttcgtgtggctcggggtaccagtaagacctccacctctggtttcttcattttaaggaggcccttcaattatccaggaattaaagtggccttcctcttgggagaacgagttggttgatgaatgataagcaagtctctattcctcaaaagccagtccccaaattccatgaaatatgtgctactttctttgcatgtctaaatgagatggcacgggtatgcttctgttctttttctggacgttgtttagagagtcagtagatcataataattcagacactttttttctggaccataaaatatctgaacccatataataacaaacatacagcacggtgaataagaacccaacttttgagccagatcactttgcatggaatccccattctatcattctatcatttctgggctgtgggaacctcagacaagttacttaacttcttcaatgctcagattaaaaaaaaaattcacaaaatatctctaataacagtaataataactgaaaatacctacctcagagggttgtcgtagagatcaaatgagataaaaatatgtaaagcatgtagcctagtgcctgactgaaaaaaaaatctctcaatagatgcaactcttatgattcttattaaggacttggctattgccacaaatgaaggtgttatgagccctggcttaagagcaagaagcctgcaaagctaactctcctaatcccaacattcctttccagggaaagtagggtgacaggtggaggctgggaattaacgttttttgagcaccaaatatggacaaggcacaggggttgggtgtttttctagtgagaatacatatgaaagaaggaaaacaaacttggaaaccgctattttaagccatttggtaacagtttctctagcttatgagatgagagaggtcctctcagtatccgctgcattacttgtgggcctccttggttgacgtcgctctctgaacgcttggggtggaattctagaggtgcttttcattagaggcagagagcatgacctttcttccttgcccagtttaaattaaattattttatcttacaatgtgttaattttagtgctagcaaggcacagctaaaattccatttctacttaggagtggggatcattgtggcagtgagtgcttatttgggtttgggatgcttggatctgggtgaaagccaggattaaaaagcatcctccttccccattccactctctaggttataaatatttttttggattaaaagcctcctttaaaaaaatgcaaatccacctggcatgttaattgtgcaggggattcctaattatgtgtgcagatgacgtgagtcacacggtgatagtgttccttctagagtcccactggtgtcctaagggaggagactctggagctttgtgtatgaaaagggatgggcacaagtcaggatggggtgcacaggtggaggctgggaggcagcatgacagtgtgggggctggggtgggctgtgagagcaaggagggtgtcagagatggaaaggatgaccccaggggggtggaagggtgccagaaacttagggctcctctgtgagctctttagccatttgactctagcaactgcttgaatgccctgaacaaccttttgacgacttgcacaagaagttgtcatactgttccccggatgtggacagttgttcagagaccacgatcatgtgtctggtgtctcactgtggaatagtggtttctaaagctggctggacagcaaaaccacctggggagcttttaagaaactgaaattccatgtctcataccccagccctcacgtgaggtccaggaatctgtgtgattaaaaaatacaagccccaaaacaacttggaaagtggtcgttttgcaggtggggatttaggaaccaagaatccagaactctcctaccagggccccagaaaccgtaagttgaataagtgctgaaatgaggcaaattgatctactctctattgtgattaatatcttcacacagcaagtattttcctttgttttgagttcattccttgagatgagttatcgggagcggggtgactgggtccaggatatgaggatgtttagctcagtcatacccgcattttaacacgcaaacgtacggtgccgctcatttaaaaaccaaagtgttgtatacatgtagaagctatatattattccggggcagcccaaagaggggatgttgctttcaagcgaaagcaccaaatcacattcttttctggtaaaatagaatactaatgaattgcttttggaagaaatttccagagcattactgaatgttcaagtgcttcttagagcacaagttgaacctttcttatctctgcactcagtttctcgtaaaactgaagtcacagtgacctcttccccatttcgtagaaaagaaacccaaggaagagagtggttaagaaacagaagatacggttctcatcacatttgcctgagaactacgtatagtcatccattcagtgcctcgttaagtaaataaatgattgaatcatttgtatacatgacctcatggaaaaaagcacggtaaaatgaatgtttgagggtgggtagacagaattattcaacccggacaggtgttagatgttcactctatccccccctttttttttgcattaggttttattcattatttgcatcatctatggacctaaaagcatgctcattgtcacacagatgggaacagggtgaattttcaatgatttcaatgaaaaaaaaaaaaagatgtgctgttgcaaaatatcaagggagatgtttacagtggtgttctagaaccggcttgctctcaagtgctgattgtaatattttcagaaattttccaagccagtgacattattgacttctctttatctgtgtgatggaaatgctatataatattgtgctatctgagcatctgttttcaattttgcattcagcgatgtcatgatggtggcttgaaattggctatggtaaaagtacactgtgaaaatcagcaaacacaataaatcaggctccccaccttttttttttcggggcggggggcaagcatgttgttaaacgtttactagcatgctactgaggaactgtgtaaaatacaaatatggcaatttgacgatatgtatcaagagccattaaagtgttcatacactttgatccattcattccacccctggaaatttattccgaataaataattcaaagaaaagtaatatgcatgaacatattcactgtattatcatttatagcagcaaaatctgaaaataccctgaacactaagcaataggagttctggcaacattaactccatgagtttttttttttttttttttttttttaagacagggtcttgttttgtcacccaggctggagtgcagtgtgtaatcacagctcactcagccttgacctcctgtgctcatttgatcctcctgccttagcctcccaagtagctgggaccacaggcgtgtgccaccacacttggctaactttttttttgtagagacggggtctcactttgttgcccagcctggtctccatctcctgggatcaagtgatcctcctgccttggcctcccaaagtgctaggattacaggcacgtcactgcgcacagcccatgggttcttttaaagtcattaaaaatcatagttatgatggttatgaaaatatgtttgatatgatgttaggttagaaaatcagaattaaaaattttaattacattctgattttgttgtgaataagaattaaatgtgagccgtaaaaaaatgaatgacagcatttggtatgttagaatggtgaaatagtagaatttgtttttattttgtttattgtagtcgtggtgtgtgttcatttaagaaatttggagaacacctgttaataagtgatcttgagtagttttaacatttaggaggaaggctatgagttttgtgaaccacatggggctttacctttaaccggtagatgttactgtgaatccctgggcagggtattgtaaagggagtttggagctaggcagtgtgagctgtggatgctaaaggggtttctttagagcagcttaaggaggaggaagaagtaagtaactgtgtcctgaggacttgctaaaagtagactgcaaggactgagaaatagcccagagaaaaactaccatcaaaggccagagagacaggcgagagaaggtttcttaggaagagacaaggagacgctgatctcagaggtgaacaacatggataagaaattaactccattttgacctgaaaaaaataggggctgacaccagaaaggaaatgatttttgtagagcaatggttctcaagttttatttatttatttatttttagttttttttaaattttttattttttgagatggagtctcgctctgttgcccaggctggagtgcagtggcatgatcttggctcactgcaagctccgcttcccgggttcacgccattctcctgcctcagcctccggagtagctgggaatacaggtgcccgccaccaggccccgctaattattttgtatttttagttgagacggagtttcaccgtgttagccaggatggtctcgatctcctgacctcgtgatccgcccgcctcggcctcccaaagtgctgggattacaggcgtgagccaccgcgcccggccagttctcaagttttagtgtgtttaagaatcacctggatgagtgcgggaagagttaactaatttagcatccaggttccatctccatgcattctgatacggttggtctagaggttggcaggaatatgcatttttaacaaatcctcccaccctatgaagactctgatgtgaattgcctgcagattacactttgagaaacactagtggaataaatgcaacagtttggttttgtccagggaaggtatatctgtgagtgtgtgtgtgtgtgtgtgtgtgagagagagagagtgtgtgtgtgtgtgttgaaggtgaagccgctacttaaaggctcagaattgaaggacttataatgtaaaaggggaatgaaaacagagaaagcccagagggacaagttatttatttgttatagaaacaaacagcaaaaaccaggaagctgtacttacgatattccttaaaggaatatagtttgtggcacaaaatcctcttccacagttaaacaattttgtccagcacttgaaccaattaaaagtagctgtgactaggggaactatgagcacagagaaagatggtcatggggagagtctgggacccataaacattctatttcaggccatcgagcggtggttattaaacccgtggtagaatatgggagtgctacggacagaaaacactctggaccttactgtatgataacattatgttaaagaagaaaagaaagtatattttttgatgaaatgtagtattttatatacagaactcagcactcaaaatagtaataacaattagacttatgccacaacaacattatatcacaaaataaacatatgaaagtgaatgacatcgcagtagccactgttctgagattatctgcttcacctggctttggaagtttagtgattgtaatagctttcaaatagccttcaatgtctcgtgctcttcttaaagtggagatgattcttttactttaatcacattccccatcgtcagggcctctgatctcttgagacatgatgtggtaaatcaaggataagttaacaacccatcttcacattggaggcgcaagtcacagggtctgtcggatgtgcaagggtctaacgcctgaaatcagacctctttctacaagcacgcgctgactattctattccccacctaacagggtttttcatggactgattggcttgtgctttggagcaatgtttcctaatcactagttttggtcacagattcgtttgacaatgtgatgagagccaaagactttctcacacagggccatgaacatttgctgcacagtcctaggggatataaggaccctctaaaacccattcatggactctcagggatctagaggcctcaagtgaggagctctgccctcagcagagggagcattgcagaggaagttctggttattactgacatcagattaagcccctaaagacagaaatgctgcttctccaattgatggctgaaatgagggtaagatggcggatacaggtgtagttttatagcatcagatccttaaaatgagtagcatgtggggctagagttgtttcccttcagataacatatgattaatgctctaaatccttagttctgaattctctcatgtgaagccagggttggttcccatttgggaaagcagtctctcaagatgccactttaatgtcttacttatcagctcgtgatgccttgggtggcacaagaaatgcaggcagggccgggcgaggtggctcacacttgtaatcccagcactttgggaggccgaggcaggcagatcatctgaggtcaggagttcgaaatcagcctggccaacatggcaaagccccagctctactaaaaatacaaaattagctgggcgtggtggcacatgagcctgtaatcctagctactctggaggctgaggcaggagaatcgcttgaatccaggagacagaggtttcagtgagccaagatcgtgtcactgcactgcagtctgggcaacaaagtgagactcagtttacaagaaaaagaaatgcaggcaggttgtaagcactgatctggccaactctagagtgtagtgagtagtgtggggtcagctgatgcccctaagcaacgtactggatacccagcccagctgcttttagggtgaaaggcattagcattagccggtgggtaaagtgctcccttctgggtgtaagatgtagttgtcttatctgaagctgaacatctggttgggctttgataactttgaagatagttcttttcctgtgtagccttttgatcacagaagccctgttggtcatcttccattagtgggtatctgacctgcaatttggggaactgagtgttttcagctgaaagctcagggctttgttcatttcctgtcctcccagactgtggtatcaggcagggtatggagacttaccccaaacccgtctgtttaaattagccaaccctactggaagtggtaagatgaggccacattctcatgtcacggtcatacagtggattgacactggatgagaaagagaaacgcacttcatcttcatccctccggagaaaaagaatgtgaaattgactaaatacatggtgagtcaaggttctcttggtgtgggatagcataaaaattggaaatctgtctttgagatagaaagggaaaatctataacaaatatgttccagtaatcagtgtgccttcatgtctataaccattttaattattgcacatccatgactacatttcttgtaagtttcaatatctattttaataataatattgcatcatacagtcacagccctcaaaacacaaatattccatgtacaccaaaggctggtagcaaagtctctactcctcttacctcctggagattattttcccctgccaggtcattatgtctagcaacctagttgcccatgcagagaatggactggcacaaatctcttccttggctcttttcctttctttcaggcaggacccctacttttaatttgtcttccctccaggtccagctgtcaccttcttgagagactctaaatatacaacccttactacgaacctttttctccctttcttgcatttttttttctcagttgccacaaaaaattcttctggtctttgttccagttttgagctgaaaatgatcccaactgtggttgagaagcataagaatgcctgtaattattccttctaacaaggaaaaggaaactcaatatatttagagtcaaatttaaatgatgtaaaatcaattacaaaaacctttaaggggcctaaaagtcccctttggcatactttttcttgataaaacctgattttcctcaagctctactctttgggcagtaacttgctgaaaattatatcaatagtagtctttctctgtcttcttcatgtgataaggaagtaggagagagggttggaggcacgtacaggaaataggaggggaaaagccagaaaaacccttacttattgacaataccacaatttcctatatgtgccaaaacaatattgtcactatattcctaaacacagaatatccggcaatatcagagaaatatctataataatttctactttaaaaatataatagtaatggatatttgttgtagcaaatatgtcatatgccttttaggttaaatatacttgtatacatcttatttgtaagtgtttatgtattaaaattgccatcaggctgggcgcggtggctcatgcctgtaatcccagcactttgggaggctgaagcgggcggatcacgaggtcaggagttcaagaccagcctggccaagatggtgaaaccccgtctcttctaaaactacaaaaattagccaggcatggtggcaggcacctttaatcccagctactcgggaggctgaggcagggaattgcttgaacctgggaggcagagtttgcagtgagcagagatcgtgccactgcactccggcccagacaacagactgagactccatctcaaaaaaaaaaaaaaagtcatcatcccagtgtttttcctccacgatgtgcaaaatctatagaaagaagcataaacattgcttcctaatgtgatagaaatacagctaataattgtaggatcatttgaattaacaaaaggcaactatgagtattttttctgagtcctatagctatctttccttttttttcatcctctacatttcaggaaaagcaattgaaatgtacattgtggcagtgtttctattacattctagagctatgaaaacacatggatggttttcaggatgcagcaggagggttctacgtaaaacgtcggtccagagttcaaaccccaaactaatagttttggatttccccaagtactacccacttaatatgtcaccaggaaagacccatcacacacatatatggaaggaaaaattaaagtttctcctccagcaggggctagatgcttgtggtttctgtttaaaaactagatggtggccgggcactgtggctcacgcctgtaatcccggcactttgggaggccaaggcgaacggattacctgaggtcaggagttcgagaccagcctggccaacatagtgaaacctggtctctactaaaaatacaaaaattagccaggcgtggttgctcacacctgtaatcccagctacatgggaggctgaggcacagaattgcttgaacccaggaggcggaggttgcagtgagctgagatcatgccactgcactccagcctgggcaacagagtgagacttggtctcaaaaaacaaataaataaataataatttaaaaaaactagatggtacaattgtgttaaaaaaaaaaatcaccagcgttttcagcctacgtttatatctacttttttttggacctgtgaccgatcaaccttaaaaagttatattatcttccagcttcctctgatttacttgtcctttctttggaggactaaaatgatcatactctttttatttccctacaatcaatcgagctatttggaatttaaatgttagtgctccttcctttataaatttggtcgtgattgattttatttctcaacaggtacgtagctcattattttatccattaattatagttactttttgtttcctttgccaattttgggagtgcttaacaactcttaagaactgtttcattaacgaattagtaaccaatgtaaaatgcagaataaataacaagttcagttgcctttatagtctttaaggtttgcttagaaacttttaaattataatcaagttttttcttttcctaccaaatattggccaaagtacaatttataaacaatatcatcagccagtcaggaaaacgagctaaatattccttcttctctccacttaatatgctctgttctcaattattattttgaatttttttaggaggctttcgaaaggccttttttcagaaaaattgtgagttttgggcagcaacatgaatgatcagctttaaattgttcatagtctttgaccatgtttaagaattattcctaagacaacaacgcaaggtgttttattataaaagcaagacttctcaacacaatggtgtctgctaataatagagaaaccaagaaacaacttaaaatgcccaacagaaatgtataaggtgataaaggtgacaaagtgagaccctgtctcaaaaaatatatacatataatatttgtatttataatataaaaaggcctatatatgtattcttatacatgaattcagaatatggaggtaaataaatatgttagaaattatctagtgtgtgataagattacatgatttaaaatgtttttcattttttcctgtcttttttataagtagcatatattgtttgtatataaaaaaggccaataatccttattaacagaatgtcagtttttggtgtgaggttaataaagaaattagttaaaatgattctgacatgagagttttttctgacattttgaaagaaacctaatgctttgaaagccctaagtctataattaaattgtatctaataaaatttagaggctctttagatttagagggattttgagtttctcaaagcatagaaaacgacttttagtgagagatgttggaattatcagttaagtttgtgagtggtttctgtttttaaaatatgagataattagcattagctagtatcaggctttaagcaaaatataaaatattcaagtgatgaatacagacgattatttctacattttaacctgtaaaaaggttcccaaagagatttttttttcttttttcttttagtgagacaggatgtcactctgttgcccaggctagagtgcagtggcatgatgatggctcactgcaccttccacctcctggggtcaggtgattctcccacctcagcctcccgaattgctgggactacaggaatgcaccaccatgccggctaagttttgtatttttttgtagagatggggtttcaccatgttgcccagactggtcttgaattcttcaagcatattcacccacctcggcctcccaaagtgctgggattacaggcctgagccatggcgcccagtcaagagatcctttaagaagcacattttccttatgcatcttaaatattcaattagaaaagaattgactttcaaatattttgaaagacatatcttctaggtaaatcataaatatattcattctgtgtaaagtaggaaaataaaggaaaattaccttgtatcttttcatggccatttctctacacagtaataccaaatatctaaaagtttgttaattcaaaatgccaaatattagttggaatatcatataactctttgaaaagttgattcgtttagtgaaaaagacttttcctcttaaacggagtgaaatctcgtgtctgatttgtgtaatattcctgattacattgtgtgcgtgtgtgtgtgtgtgtgtgtgtgtgtgtgtgtgtttctgtgtttctttccggcttggtttaacaataattcatgatcataagaggacagctattgcttgtaatgaacccagctgatcaatgaacaatgctttgtataacaattgtgtaattgaaagtgatacaatacctaccaacggggacttaaagcaaccaggattcatttctccacgtaacaggaattcggaggtctgcgtttccggccctgggccaatggctcaataagactgcctgccattttgttgtcttttgtcatggctgcacgatgattgctgcagcttctagccatgtactccattcaagacgcacgggaaggttggggtggaaaggaggatgagttggcagtggttgtctcattttccaggaaaccaagaattttcccggaggcctcccagatatcagcttccgtgtcattggtagaactaggttacacagccactccagctgccgtgaaggtgggaaacaggaaatagacttattattaacaattcccttagagcatacattcctaacaggcagggtgggtgggtgtggggaacatggtggagaatagggtgagggttgtggtggggcgtagatggggtggtgctgttgatatcatcccttaagggaaggatattgcttttgtgggagggaaaaggcaggaaaaatatcccactctatatgtataaagcacagttatacatacagcatatatgcagacatataatttgtctatggtattaaaatttcatgcatggggcaattaggaaaaaagcgtctaaaaatgctcttagggagatgatgttgaaaaaaagttgagaaatactgggctagaccaaacatgatccattgcctgaagcttacgtattatctattactgatgacaaagagaggcacaggtatggagtggcaaactaacaatgcgtgccgtagagaatgtcatacattaaattaatgaacagcttactttatgttgtaattgttgttggtcttctctcattgtactgtaaacatcttaaaagtgggaactgtgtcttatttcgatgtatatctttgtatattagcacactagtccctcaagaggtatgttttgtaagttgaatggaacaaacaacattttatttaacatatactttatttctattttttttaaattttatttatttatttattttgagacagcctctctctttctcaccgaggccagagtgcagtggtgcaatctcagctcactgcaacctctgcctcctgggctcaagagattcttgtgcctcagcctcacaagtagctgggattacagacgtgtaccaccatgcctggctaatttttttgttgttgtatttttagcagagacgggctttcactatgttggccaggctggtcttgaactcccggcctcaagtgatccgcctgcctcggcctcccaaagtgtaatgttgattatttttaatggcaaaaatgaagtgatgcaggaagacatttaagcgtcataggtgatgtcttgggggtagtttcacaggatttttagcgagctgtttgattgctcttatgtggatggtacaaagaccaaaagaggttttgcaaacagtggagtcataaatgattgtgcatgagataattagttctgatagttccgttagtttgtttgtaagagatgaaaaggaaataaaatggaaaaagagagaagatttgttttgttttgttttactttttagctggattgttttttctgtgcctaagctgcttcagttgtaaaatgggaattataatgtcaaaatccttccttctcgaattgtgatggtcaaatgaaaagctgtctgagaaagctgccccgagctgtctaacagtattcctccagctggactatgcttctgagtcatccgatgctttaaaaatacatcttcccaggaaaacattgtaaacaactcccagggtacataatgatttagatgattaaatttggaggctgccctgacttcactaccctgggcctcaactgctttataaattatgaatacagatacttcctaggactgtagggtggatagcaaatgaagcgaattaactgccaaatccttccttaacatcttcgttatgatcaatattatgaacctaggcaatcttcatccatacattggacacttgaccttgggatggattagacttcctcagtttcctttgtcctctgtgcaaaatctagaatattgccagcctatcgtcagagtgcaacacgtttgaggaattattgcatgattgatattgttgagagttcagattaatgtcacttcagataatccacagatgacatggaaaactggtgggctaccggtgctatttgaagtcaacgagggcttgcacttagctgggaatgggcgagagaataggattaatgcccaggaagatatatcttctgatcctcacctctcttttgtatataggtgattttttaaaaaacttccttctcctccaatcaaaactggctttgaggaaagaatgggactggatgcacatttgtgtaaacatgctaatggtaaaaaaaagtctttacctttcagggatatttgcatttcaacaaagtaccaaacctcaagagaaagggctgctccaaggatggaagatatatttggtagggagaggactttttatcacccttgattcactccatgtaagcagggaccttctggtaagatgctccctgatggggacttgttggatgctggccgtgccagctggctgaaacccccagggtcagacttccttgcaggggatccttatcatgtggatggcagccactgctgatagattggggaactgcttcctttgccatctccctatagggaaggttcccctaaactgagtccctaataatctcagagcgagacgtgtgctgtggggatcttatcatcttatcagatttttctaaactatagtccttcttagaagtgagaggcccagaacactctactttatgcaggaatagcagagatgactcatggttgggaagacactagaattcagccaggagaatatcattaaaagagggagaagggaaaacagactttttgtgtggtacaaaaacaaaaccctctgtatcattatgtgaacaacggtgcaaaaaagaggagacacagtttacccatgggtagctaactatgatagtgaaagttgccttgaaccttgttttagaaaaatggcaagtgtgggtctcactcttctagttcctgacttctctctctctctctctcgtttctctttttttttttttctctctctctctctctcacacacacacccatcttgggccaggtttgtaaagcctcatgggaaatggaacacggaagagtcttctgggaggttttaaaatttaattttagtcagatttagtaagatttcttcatacaaaacaaaacaaaaattctctaaaaaaaatccttgttagggtctggttaagacaactaataacaacagatgtgagggcatagttcctagttaccaaagaatcgctctggtgagagaggagtggaggcaaaaattccagatggtacctgggtagcgattgcactcagatgggtcatctgaggacagctgccctagaccgctgctcctgagcctctccattgtaattttccttcttctagttcctttttaaaaatttttcttttttgttgagatagagtcttgctctgtctcccaggctggagtgcagtggcatgatccccagtcactgcaacttccgcctcccaggtttaagtgattctcctgctcagcctcctgagtagctgggattacaggtgtgtgccaccacgcccggctaatttttgtatttttagtggagacagggtttcaccatgttggccagactgctctcaaactcctgtgctcaagtgatctgcccgcctcagcttcccaaagtgttgggattacaggtgtgagccactgtgcctggcctagttcctttattttaaaagcttaaatgcatgaagcatacagtactgtgaagacttgcttgatgtgatgcaggttccttaatctcctcctttgctatttggttcgcagatggtggtacgggtggcactttggggaaggcggggcggaaggaagctttctgatgaatgtttgcacagtatacgagaaggttacaagatatgggcatcatgcacaggtggcgaggtggttagagaaaggtagatggtgtttggggattaccctctggtacatttcaattcactttggggttatgagatttcagaaggttagctaatgcttacgtcctggggtgggctcttttgtatttctttgttgtctcttttttattttttagagacagagttttactatattgcccagactggtctcagactcctggcctcaagcgatcctcccacctcagcctctgagttacaattgtctcttgaaagtaatttcaggtaggcttggggctaccaaggcaagcctagggaagcctactacatgaagaggattagagtcctctggagaagttggattcatatgaagagatactaatcagaaagttgggagttagtcatccatggaaaacaggcatgtttgagaatcatattctggcagtgcccatccatgcattatcagtggagagagaaccttggctaatggacttccccagttttgatcccatggataagaccatgggggagagggtaaggcttaggctaatgcatattcttggatcattcagtcacctccttccactctgagtccctgttgaccagggaatgtcttggtgtcatagcttggctttccaatggctctccccgtggggaaagaatacacaggctgtgttgatggtattctagtcctgacgagagctgcgtttctcatggtcagcaaatgaattggcatccgatatataagcaaatcttgtgactgtaaagtcatatactttcttgttagttgagggaatcagatttctgagggtaagaggtgaagccaagaacatggcaaattcattatcttgataaaaactacccggtaaggctgcccattttctttcaaactgcaacaccatatgtccagcgaggttcctcttacgagacatcaggggtatcaggagtgggtgccaagctggagtcctgagaatgagggaaataggagaccatgagttttgagcaccaccgcaatttctcttctccttttgtccctcttgctttaggtagtaatgcatgccttaagataataaaaggtctgtctttgtgggctcttcattgccatagaaaaatgattggtatgagtttcccaaggcctcggataaaaatatttcttcagagagggttttgaaaacttatgccagttacctgggtggactccaatctttcaagcactgtgtgtcttttcctggtcctccctcgctccctccttcctttccttccttctctaaacagagtctaaggtaatgcccctctccagtttcttgggatagggaagggggtggaattacttctgactcacccttacccttatggtgtaccctttggggttctggctaaaatatatgtattgggaagtgggacgcagtggctcacgcctgtaatcccagcactttgggaggccaaggcgggtggatcacttgaggtcaagagttcaagaccagcctggccaacacccatctctactaaaaatgcaaaaattagcctggtgtggtggtgcatgcctgtaatcccagctactcaggagactgaggcatgagaatcgcttgaacctgggaggtggagagggtggtgagccaaaatcacgccactgcagtccagcctgggtgacagagcgagactctgtatcaaaaaacaaacaaataagtaaaatatatatattggggtccattagtttttccaccctgggtggactctgacctttgacttctgtcatccttgccccatgaagccatcggaactgcagctcgttttccgctttttcatcgccatttctttcagctgacaaatgctgtttacctcactggcttctcctttattcttaggttttggcctgacagttgctatttttttttttttttttagctctttgatacttttaagaaaatggtttttaggccatgcacaggggctcatgcttgtaatcccagaactttgggagaccgaggtgggtgaattgcttgagctcaggagtttgagaccagcctggccaacatggtgaaaccccgtctcgattaaaaatacaaaaactagccgggcgtggtggcaggtgcctgtaatcccagctactccagaggctgaggcaggagaattgcttcaacccgggaggcagaggtggcagtaagccgagatcgcaccactgcactccagcctgggcgacacagtgagactccatctcaataaaaaaaaagaaacaaaaaataaaaacataaggacttttgacaaaaatatgattctttaggcaagaggtttatttctctaagtgtcagtttctctgaaaactttgaggattggattggatataaatttccccaagcacaatgtgtgtaccaatggtgggaaacaagatctttttagggcaagcatttaaaaaatgtttttagtaggtatatgtttctttgaatgttttcagaaaaaaattataagtgacaatcaaatctatgatttcatctatttaattgcttaggacaaggccatatgagttcacttagagttgatttttaaaacataccacataaatgatagttcaaatatggttatcagatgactgaaatttgggggcaggattagaagatgatctttcagattttgactaacttgactattctggtctcaatgacgaaaggaaacaagttcccataagtcattacagtggaatccaatgatattatccaagaaaccaatattcctaggatcttagttctcctagaaatctttctagcatgctgagcaggatgggttggacacagtccaaatcactggaatattacaaatttaaaaaattgttttgagtggtgtgtgaaagagacctgctctgaggacttctagaatgagtgagaagggaacttacagacctactgagacttgctcctctgtcagatgtggcaggagggtcggggtcttggagttgttcaagtaatttcatcagttaggggttaatcctgacccaggatccagtcctgctgggccatactttcttaaagtgactatccagtgacactagcaaatgttacctcttcccgggaagaaatgacaggatgtgtttgtattttcttttacaaaggatcatgcgattttatttttactttttttttgttatagaagtggtatatgtctgtgaaggaaactcagaaaacatagataagcacacacaaaaaatttgtaattgcaccagtatgagcattgttaaaatcttagtatagtttcttacttttttcctctctctatttttactaaaaaatcaggattacgttgcacataccgatttgaacttgcctttctttgatccatataacaatgttgtcacatacttttccccacattattaaatattgttctacaatagtaaggaattcaatgataaaagaggcatattgtcttcctcccaccttatacaagttattttgtgtggcagcttgacttgtattttagaagtagagacaaattaaggcaaaaataaatagaaatggcaaattaattccacaaggagtgtgttttctgaaagtccctgctgctagaaacggaattaggattatgcctcctggtttcaaacatgtcgataatagctgtgtgtgctactcgagtggcgtcaaagatggatgtccaactccatattggagctgtgggtaacctagtgacagccacaaatcacccttctaagagcagatggtcagggagcacctttccagtttagagcatataccagttgctctcctgatggacatctggtccatgatatttgactgttttaaggtatggagtgctttgtacaaggtacaaaacttctgtccttggtatgaacatttgggaggcaagtgagtgataatgacccacggctgcctttttgtccggcaaagcacgaggatgctttggagaacggaaggatttcatcgagtccaaaggacactcacctctaggcctctcagcctccttggccacgtggttgttctgctactgagagtctgcagatgagctggtggtttctccaagcttccgagagctctctcaggtatttattatatgcacgttctgtctacaatgaccagtggactctaaactgggctggaacatgttcccaggaaaacatgcccaaattctgttctaccttgtgtaaatctaagacaggggctactgaacacagtcttggaaatcagacacgtgctagggccccctgtgcttagctcggctaatgagcccaggctgagggcttttttgcaggcatgccaaaaaatgcagggccaaggctgggggtggagaggtaaggctagggaagtcaaggaaggcatgaggaacagcttgggaggggaaaaagttcatctggtggcaggagctttaggctctctctgctccttcacccttttctctgttcaaatctgctctcaaggcagcatgtgatattgatggttcacagaaacatgaactaccagccttggaggggccctgagagcccatctagttcaatgcctcattttgcggatgaaaaaacaggtttggagtggctaaatggcgtaagcaaggtcgtgtcactaggagtagagctgggattcaagcctgatggtcagtccagggctctgatcaccacaagctgcctctatatacagtatagtgagaaagtctcaaccaccacattgactcttcatttatatttaatattatatttgtattttaagattgatccataatggaaggaattgtttagtcctgtactaaaggaatttagaaagagttgggtgactcaatctactgataaggaaaaagatttacaatctattactaagtgagaaaggcatcatggagtacagtatagtatgctgtagtttgtatataaaaatgtgtgtgtggctgggcgcggtggctcacgcctgtaatcctagcactttgggaggccaaggtgggtggatcacctgaagtcaggagtttgagaccatcctggccaacatggtgaaactccatctctactaaaaatacaaaaattagctgggcatggtggcacatgcctgaagtcccagctacatgggaggctgaggcaggcgaatcacttgaacccaggaggcggaggttgcagtgagccgagatcgcaccactgcactccagcttggggacagagtgagactccatctcaaaaaaaaaaaaaaaaaaagtgtgtgtgataattatacacatacattcatatatatatgcatgtggattcatgtaataatgtaatagctttggaaaaatgcatgagaaacttagtctgatggttgcgtctgggaaaatggcctgggcaccataggagggaggtatatttttcacttttatacttttaaaatgttactataggcatgtaatcactattcaaaaaatgtaaaaacatttaaagatgccatgtgagctcaaataagggagaaatatattgcttattgggaaggcctcatacaagaggtagcatctgagctgggctctgggatgggtagaagttcaccaggaagagccagggcaggaaagcttgcagcagcaggattgaagctgtcaaagcaggaaagaccagggagagtgtcagcaatgttgcatagtctggagaaattgcagcaaagtagtatgctgttgtttgaatataaaaatgtgtgtgtaattattatatgcattcgtacttacagcatgtgaatttatgtaataatgtaatagcttcagaaaaatgcatgagaaactgcattggctaggtaaagcagggacagggccgaggagaaaagtaaagagagagaactcggctggatggaggttatcttatacttaatatggcataaagggctttttacaaattggccccattgtccctttccaacatcatcttccacctgtgcttcagccaccatagccagctgtctattctccaaatacccacgtgcacacctgggcaccagccgcttcctctgcctgcatgcggtccaccagtcctatttctttctctcctccaagaccaagttcaaatgttcctcctctccccctccccaccccaccaccctggaagattttaacactctgtccttagtgttctcttggcattttgcatttacctttattatagaacttggctgtttaaattttaattttttgcaggacgaaccggagagtgaggtcatttatacgcagaacattgcgtctcctctctttaatttagcattttattctctgaggtcctagctatatggtactttatggtgatgaagtacagccacaccattctgcctttgtgtggccattgcatgacctctccaaatgaaatcatttcttctatagagaaaaaaaagtgaggatcagagacattattaactaagtaaaaaaaaaaatttttttaacctctgggcctagtctaaactacattaacattttctttattatcttctgccccattaggctccttaaaagtaggcctagtttaaagacaattaaaggcagatattctgtccctttttttagacttctatggatttgaaatgtcatgttaatagaacactatatatgcgtaagcaatgaactgaaccattaaaaaagaattttgctctggaatatcctggtagtttcagggtcattatatatttgttttgctcagtttcttgatctttctgatccttaatcagaagctgagcatctaaggaaatattttatcctattgctatgtatctataatattatctgtataaaaagtacatatgtctatatttcaaaagaagattgaaaaaattaagaaaatctgaataaacttgtgttcttagattattcctctttgttcctcttctcccttaggcaattgagggagtaactgctatgttcctagtacaatttattctatagagggacatgtgaaaggtgagctgagaattcccagtaaatctcgatttacccatcattgcagagacctttcctctgcctgggccaatgtccttctcggcaagggaagatagatcgcaccagacaaagtttggacatttatctttctacataaatggaaaacccttcccagattgttcaactggttgctttttttcagttactaatacaggaatacctcatttgattgcgctccacagatattgcattttacacaaactgaaggtttgtggcaactctgtgttgagcgagtctatcggcaccattttcccaacagcgtatgctcacttcatggctctgtcacattttggtaattctcaaaataattcaaacgttttcattattattgtatctgttatggtcatctgtgatcagtgatctttgatgttactgttgcaattgttttggggcacgatgaatcatgcccatataagatagcaaacttaatggataaatgttgtacgtgttctgactgctccggctgttcccccacctctcttcctccctttgggcctccctattctctgagacacaatgatattgaaattaggccagttaataaacctataatggcctctcagtgtttaagtgaaaggaagagtcatgtgtctctcactttaaatcaaaagctagaaatcattaagtttaatgaggaaggcatgttgaaagctgagagaggccgaaaactaggtctcttgccagttagccaggttgtcaatgcaaaggaaaatttattgaagaaatgaaaagttcaactcctgggaacacatgaatgataaggaagtgaaacagccttactgcttggacaaagctttagtggtctgggtagaagatcaaaccagctatacaatttctttaagccaaagactaatccagaacaaggccctaacttgcttcaattctatgaaggttgaatgaagtgaggaagctgcagaagaaaagtatgaagatagcagaagttggttcactaggtttaaggaaagaagccatcttcataacaccaaagtataaagagaggcagcaggtcctgatgaataaactacagcaagttatccagaagatctagctaaggtcattgatgaaggtggctacagtgtacaatagaattttcaatggaaacaaaatggccttctattggaagaagatgccatctaggactttcacagctagtaagaggtcaatacttggcttcaaagcttcaaagaacaggctgactgtctagttaggggctaatgcagctggttgctttaaggtaaagccagtactcatttaccattccaacagatcctagggccttaagaattatgctaaatctactttgcctgtgctctataaatggaacaactaaagcctgaatgacaacacatctatttacagcaatgtctactgaataatttaagcccactgttgagacctactgctcaggaaaaagattcctttcaaaatattacagctcatggacaacgcacctagtcacccaagagctctgatggagatgtacaaggagattaatgctgttttcatgcctgttaacacaatatctattctgcaacccatggatcaaggagtcatttcaactttcaaatcttattatttaagaatacattttgtaaggctatagctgctatagatagtgattcctttgatgaatctaggcaaagtaaatttaaaatcttctgaaaggatctaccattttagatgccattcagaacatttgtgattcatggcagaaggtcaaaatagcaacattaactggagtttggaagaagttgattccaagcctcatgactgacttgagggatttaagatgctagtggaggaagtaactgcagatgtggtagaaggagcaagagagctagaattagaagaggaggctgaaggtgggactgaatgtctgtaatctcatgttaaaatttaatgtatgaggaattgcttcttacagatgagccaagaaagtaatttcttgagacagaatctacttctggtgaatatactgtgaaaactgttgaaatggcaacaaaagatttagaatattacataaacttacttgataaagcagtggcagggtttgagaggattagctctaatttgcaagaagttctgctgtggataaaatgcatttcatgctacagagaaatctttcatgaaaggaagaatcaatcagtgtggcaaacttcattgttgtcttattttaagaaatagccacagccactccaacctgcagcaaccactaccctgatcaattggcagccatcaacattgaggcaaaaagattaggacttgctgaaggctcagatgattgttagctttttttttttttttttttttttagagagggtcttgctctgttgcccaggctggagtgcagtggtgcaatcatagctcactgtagcctcccggagtcaagtgatcctcccacctcagcctcctgagtagctgggattacaagtgtgcattaccatacctggctaattaaaaaaaaatttttatctagacagagtcccattgtgttgtccaggctgtattgttagcatttttaagcaataaaatatttttaaattaagccatgtatacttttagacatcatgtatagtgtaaacataacttgttttttttttttttttttttttgagatggagtttcgctcttgttgcccaggctggagtgcaatggcacgatcttggctcactgcaacttctgcctcctgggttcaagcaattctcctgcctcagcctcccaagtagctgggattacaggcatgtgccaccatgcctggctaagtttgtatttttagtagagacagggtttctccatgttggtcaggctggtcttgaactctcgacctcaggtgatctgcctgcctcggcctcccaaagtgctgggattacaggctcgagccactgctcctggccaacataacttttatgtgcactaggaaacaaaaaaaactgtgtgactcactttattgcaagattcactttattgcagtggtctggaactgaacccgcgatatctgtaaggtatgtctgtatatcatacccttcctgggcaatacgaacaggctgacctaattccttctaatgctgagtggattctatcgaatggatatggcataattaatttaacccctgcgtcttaatggacctttcagatctttccagttctttttttgctgtcgtgaataatgtagcaatggaaattcttgcatatcttgactacttgtgtagacacatcagtacaacgtgttgaaagaattggaattgctggattaaaaggtctccgcatttaaaagtttaatagatactggcaaggacttaaaggatggagtggtgcaaggggtcccccctaagtacaggaagtaagggggtatatcatttatatagaattttaaaacagtaataaaaccagtgtgggtctgttttttattatcaccatgcgctggcagtgaaaaagtcagagtaagttcttaatggtgtgtacagctttcactagagctttggggccaagttgcatcttcagcttctatggcacagcatagtcctgagtttaagctgcagattagacataaacaatgatagcacagtgattgtagaaaccccggaacagaactcgagttacctcaattccgttattctctcagagttttgtatttaaatttgaaacaacaaaggagaatgcaaactacaaagtataattaatgctgattggtaagtgcaagttttaattcatacatgaaatatcttactgaattattgttattattttttagagacagggtctcactttgtcatccaggctggagtgcagtgttgtgatcatggctcactgcagccttgatctcctgggctcaagccattccctgtctcagcctcctgagtagctaaggctacaggtacatgctaccatgcccaactaattaaaagaactttttggtagagatgtttgttcatttttgttttttgtttgtttgttttcagacagtctcactttgtcacctaggctggagtgcactggcgaaatcggctcactgcaacctccacctcccaggttcaagtgattctcatatctcagcctcccaagtagctggacttacaggcatgcaccaccacacccggctaatcttgctgtgtttcccaggctggtctcaaactcctggccttgagcaatcctcctgcctcggccttccaaagttctgggattatagatgtcggccagtacacctgacctgaatgatttttttaaagttcaattaaaaaaaaaagtaacttgtttcttttaaagctaaagaaggaataaaaaataaacagtctgttcctgattcttacgcattgctaggaaaataattttgtcacctagaggagagaggttgatagatgatcagttgtgggtgtcaaatacacgaaggacgccgctggattctgttcaagtgcgctctgcaaagatggtggtcttctgctcatcaaatggtgtgtgagagtgtctgactgaggaagaatctttaaaatgctgtaagaaatcaggcttgtagtaagaaggaaatcacccaccagcagaaaaatgtatttccggcctttcttcctcaccctctgccactgttttaggattgctcagtttcatcaaggtttgaaggataggcaggctctcactaagagagaggtagggagaggggaggtagagacctatgaatgggctcagaggctggactgccagagtctgaaccccagcatctcttctcattagcttgtcatcttggacaaggtactttacttctctgtgccctagttcccccagctgtaaaaatgagacaaaaatgatattgaccacatgcagtcttgttgtaatgattaaaggaggtaatttttataaagcacttcaaacagcgtctggcaaatgtgtttattgttatccttatctgctaagggccaggcattcatctaggcatgggagatagattcttttcagttgccttaaaaaaaaaatcctgcaaacgatgcatgattaattcacattttgcagttgtagttatgtgacttgcccaaggttatactgctgctcagcaagggagatgaaaatctaaccgtgactgtctgggtgcggtggctcatgcctgtagtcccagcactttgggaggctgaggcgggcggatcacctgaggtcgggagttcaagactagcctgaccaacatggagaaaccccatctctactaaaaatacaaaattagctgggtgtggtggcgcatgcctgttattccagctacttgggaggctgaggcaggagaatcgcatgaacccaggaggtggagtttgtggtgagccgagatcacgccattgcactccagcctgggtaacaagagtgaaactccatctcaaaaaaaaaaaaaaaaaaagaaaaagaaaaaaatatctaaccgtgactgtcaactccacaacatgggccctttgcaaacaattgcatatcggcagccttacacactgaaactaaaactaaatcacctcactccttccagtgctctgggctgcatatccagaacaaattattaaatgccttgacttcttttatagcttaagcaatctgcaagttaaggggttatcctacttctagagaatgctggaaagcttaatgatttctcctaaaaagagatgatccatctcgaaggaagtggatgagaaagggaacaggtgtttaaaaagtatttttatattaaaactgggagctgtggctgggtgtggtggctcacgcctgtaatctcagcactttgggaggccaaggcaggtggatcacttgaggtcaggagttcgagaccagcctggccaacatggcgaaatcccgtttctactaaaaatacaaaaattatccgggtgtggtggtgcatgcctgtaattccagctactcgggaggctgagacacgagaatcacttgaacctgagaggtggaggttgcagtgagccgatctcgccactgcactccagcctgggtgacagtgagactctgaaaacaagcaaacaaaaaacaaaaacaaaaacaaacaaaaaacattgacagctaccttttgagtaaaaagccatcagtacacaataaaatctttctgtgggaaaaaggcaaagaaataaaggttgctactgtgtgaataatttggcatgtctatctagctatatgagcattgtgcttaaaatattaaggaaattaagtatgggctatacaatgtaggcataatgtgtatctgaaaaaatcctgtgtagatggaaagtgtgctgactcagctggttcagtttctgggcctcgtgtgggcccccagcagcttaaccacttctctcaagtccttggtttcctcatgggagaaatgagtatgttgaattagatgacctttcaggcatctcatcatgctgagttttttttccgcagcagggaacatgctactttacattctgtttagggtttgctcagtgaagggggagtaccaggaatctggggaattcccagaatacctgggcactatatatatatatatatttgcaacacatttaatcataaaagattaatatccttaatctctaaaaggattttaaaagtcattaagaaacaatgaccgtcttgctggaaaagtaggtaaaactgatgacttacaaaagaaaaaatatatgttgtcaagaaacagatgagaaaattttaatcttcaccagttgtaaatgaaatgcaaatgaaaacaagtcaaacttgcaaatattatacccagtgagagttgatagagagatgcagtgataggcccatacatggaatataaattggttcaattttttatctcttctgttccagcagttgctctcatatctatttatcctaaagaaataatcatatatttatattaaaaatattcactcaatgttgctatagtgaaaataaggaattattaaactatccaacagtaggcaattggttaaataaatgatgctatatttacataatgaaattttatgcagccattttctatgtcaagaatcttgacatagaatgttaaattaagacctaaatgttaaattaagaaaaacaagatgccaaactgcatataaagtatggtattcttagttttggaaaaaaatgatgcactgaataaaaaaccccagaaaaatgtatgctaatattttacagcttttggttctaggtggtaactgatttttatcttctttggatcagtgttttcgaaatgttctataatgtgtatgtactacttttataatcagaaaataggatatatagaaatggtctggaaaaaatgaggagagaagttacaatagggaggtcatcttcaatctgtttggaccagcaagtaaaagcaggaaatgctgtccaccaccaatggcttaaatatgtgtgttggatggtggtggtggttggtggttctggggttggggatggggggaaccttgagatgtgatggttttcttagtcagagatggtgctttacagctgggaagtatcttgaacttggtggaggtctatccagacatcaggcagatttcatattttcacagacaaaggctacgtttacgtctaaggggaaaacacaaaatactaagatagaaacctccaaagccccctcaccttttcagacaacaagaacccccagggcagagggtcttcctcactctcagagttactttgacttctcatctggtttcgtgtgggtaatgcattttcactcttgagtttcttttctttttaaggtattttcattatgacgtttgttcttttgcaaagagctaattctgcagaattctacccagggagggccgagggaagttagtgaaggtaacgataccagttagaaagttgagtttgggtcatctcaggggcctcctttggcctcctttggcttatgttctagagatggcccttacttcccaggaatagatagtgatgtcttactgagttgcaggtagagtctgtattgaagcgcaagattttcttccctgacttgtctgggaatccttacccaggactgtggctttcctcttccatatccctccaccaggaggcaggctctaagcctctgtgctgtcatccttttgccacttccatgaacatgccttcaaatacttgaaaaagtcactatagcgtaaagtatacttttctcttttggtgatgcttttctgcattttctctataaccagagagtaagaataaaactacagcttgggacctggcgcggtggctcacacctgtaatcccaacactttggaaggctgaggagggtggatcacctgaggtcgggagtttgagaccagcctgaccaacatggagaaaccccgtctctactaaaagtacaaaattagctggcatggtggcacatgcctgtagtctgagctactcgggaggctgaggcaggagaatcgcttgaaccttgggggtggaggttgcagtgagttgagatcttgccattgcactccagcctgggcaacaagagtgaaacgccatctcaaaaaaaaaaaaaaaaagaaagaaagaaaacaaaagcccccacgctttaaaacttttaacacgaaaagttttgaagctacaccaaagaggagagaataggctaatatacccctgtatacccaccactcaacctcaatagttcttaacacttttccaatcttactttatccattgtttttgcttgttttctggaataatataaaataaatccctgacatcttattgattttcctcatcaatacatcaacatctctatcagataagggccttaaaatacaattgacaaattgattgataaataaggacctgacaatacagttatcacctaacaaaattagcaatagttcttaaatgtcatctaatacccaggccatattcatatttatttgaatatctaaaagaatataaaaaggacttcttttttttttgagacggagtctcactctgccatccaggctggagtgcagtggcacgatcccccctcactgcgacctctgcctcctaagttcaagcgattctcctgctacagcctcctgagtagctgggattattaaccaccatgacgggctaatttttgtatttttagtagaaacggggtttcgccatgttggccaggctggtctagaattcctgacctcaagtgatccacctgccttggcctcccagagtgtgtgaatacaggtgtgagtcatggcacccggcctggacttttttgagtccaggcctccctctgttgtccaggatggagtgcagtagtgtgatctcagctcactgcagcctctgcctcccaggttcaagcgattttcctgacccagcctcccgaatagctgggactacaggcacaggccaccaggcccagctaattttttttgtctgtgtttttagtagagatggggtttcgccatgttgcggctagttcaagactatccgcaacatggcaaaaccccatctctactaaaagtgatccaccccccttagcctcccaaagtgctgggattacagacgtgagccaccgcgcctggctctcagcctggacttttaaaactcttatgagtaagaagaaagaagaggtggcttggggctgaggatagctatgaacagctgtgattcaggaggcagaattattcagctttgctcatctcctttgcaaggaggagagaatgaaacagacctttaaaagggaatcagaagttggagttagtgcttctaggaattgtaaacgaattcagcagtgtagacctagaaaaattttcagagtcactgatagggattcacagaaattttctgtagcttcaagggaccagcccagcctttttgttcccttctgagaccacattaaaaagacaaaacaacatacaggaagcacttcttcaaaactgcgcaaatagcacatgcgtatcgtggacacatttttaaatgcacttaagcaaggagaagaaaatgggaatcacatacaaccccaggacccagagacaagccagtgggcaccactctagacattttcacagctctggaatctcctgtacaggccattttgaaacctgccattttgaaacctgctttccacccatttagcttaggaagccttttcctgtgtctgtgaatagacccgtacgatgttatgttaatggatttcaatataggagcaaattggtttgtgcaagacccacctattcttaggtgattttttttttttttttttttgctatacataacatagaagagaacatgtttctagctaaagatttcatgtcaaagctcatgggagaggaagatgaccctggctaccccacttctcttccccttcattcagtaaacgatagccttgtcatatgacggcagcctgtggctctcctgaaagcgctctgtctcttcagcaggccccccagtgggaaacacccacctcttcatggatctcacagatctgtctctctcctctggtgctgcctatgtttgccagcagcttctcccaggcccccaggcctacagcctcagaatcaccttgtttcaggcctgcgtgtcagttccgcctcgtggatgttgctggggcttctctccctctttcttgtctcacagcatctgctctggataaagtcatccttgatcccaacggcaggagcctcccacttgcctctttggtctttcccacctgcaatccagcctaacctgccacaagaatgagcttcctacagcccagcttgatctcccattctgggctccgccttttagcccaactgagctgcctctcacccttctaggtgccctaggtttttccttcattgctcatgtttctctttcttctctgtgcatctcaagctcagtggttttaagggtcatgttctaataccatggcctccacaaagccttccttgattcctgctagttgcaggtagcacctttttccctttgttggcactttatttgttcctccctcagatccttgctgaagtttatgtctggtgttgccattagactgtaagtttttttgaaggcagaagctgtgttttctttaacttggcttcaatgcctgacacagagtaggtgctcaaagaggttagtaacatttaagttaaaagagaatggattggtaacagtttttttattttttgagacagggtcttgctttgttgcccaggctggagtgcagtggtgtgataatggcttactgcagcttcagcttcctgggctcaagtaatcctcctgcctcagcctcccaactagctgggactataggcatgctccaccatgcctggctaatttttttttttttagtatagacttggtggtgaggcaccggaggcggggggcaggggtctcatcatgttgcccaggctggtcttgaactcctgggttcaggtgatcctcctgccttggcttcccaaagtgctgggattataggcaggagccactgtgcctggctagtaacattttatgtgccaaagacccagggattttaattgactgttaactgattttaactggagtcagctggagctaatagtgtgctgtggctgctgatgagcagaaggcaaccttggattgtataaaatcacaggctcatctcccataatccctccaccggccacttcctgctccccactgagcagcccacagtgcaacctccctgaacttcttctacttccccaaatcaaacatgtattttcatgcccctgggcctttgcacatgcttctccccacccccaaagcctttcttctctgttgcttatcaaaatcttactcatcctacagatcagctgtcaccttttaaatgcggggctcccaaatcaccactcctttctcccatctcgagaattaatgctccctctcctgtgtgtctgtagtactggttcatatcatcatcatcatagcagctactatttgctagtacctgttttgttccaggcactgttttaggctcatgacatacactagctcagaaccatcttacgacaacccctcaaggtaaattataataatggtaaatacttctacggtactcactctgtgccaggcactattcaatgtggtttacatgcactacccatttaattctgtacaaccaccttgtaaggtaggtatcattattttattttaatttttattattaaaaataataccatcaaccaactcacaccaggtaggcaccgttattattgcctatttacaattagggaagaggggcttagagaagttaagtgacctttatgagatcacatagccagtggggctgaaaggcagtatggttccagagtctgtgctgtagacactatgcatagttgactttgttgtcaaaggaaccgaaggtcagagacgttaagtaattgccccaaggtcacacatttaagtggcagacattggagccaaacccaagcctgcctgaccccaggtctacatgccccttcttactctgaactacctttctgtctagtaggagttggcaaacttttttgtgtaaagaccaaattgaaaatattttaggcttggttgcaactttatgttgcagcgagaaagcagtcataggcaacatgtcaatgaatgggcatgactgtgttccaataaaatgctatttgtgaaacctgaaacttgaatttcatataattttcacatgtcataaaatattttcctcctttggatttttttcaaccattaaaaaatgtaaaaaccacctgtaatcccagctacttgggaggctgaggcaggagaatcgcttgaacttgggaggcagaggttgcagtgagccgggatcatgccactgcagtccagcctgggcgacagagtaatactccctctcaaataaaataaaataaaataaaataaaataaaataaaatgaaataaaatgtaaaaaccattctcaatttatggccctacaaaaccaggtggcgggctggattcagccatgcgtgggccatagtttgacaaccttactttatagcatcgtgacattatagaatgattagataggcatgatttgcctttttgctctctttttcctagaacagttcagctcaggccccaaacatggatacccaactgagaaaacacgagtctttggtaaacaagatccacattccctaaaagaagttcagagaccacgtgtccttccctgagcacacctcttggggttgcaccctcaactccaagcagtttttcaggctattccaactattttgagaaaagaagtaggaaatgcatttccccatcactttagttttgagatgagtttctaagggtgctctgggtggttgcctagctggctagtcttgtatttgactctgaaattgaaccggactaagaactctagacctcaggcaacgattccttgattgtgctcctgggagtggaagagaccagtcagggcagagttgctggaccagaggaggggaaggggaccacggtcccggtgtgattggggaccagagggcaggacacacggctcagagaggcttcagagcttaatatgttgaaataataaaaggcttcaggacttggcaatgttttgttttaattcaactataaaggggtttaatatgcttcaggcttaggaacataaatactgcttaacattttttattctggtgaacttatgttaaaagttgcaaatcagcatcttttttttttttttttttttttttttgtagaaacagggtcttgctatgttgcccaggctggcattgaactcctggcctcaagtggtccttccacatcagcctcccaaagcactgggattacaaatgtgagccactgtgcctggccaagcaaaccagcatcttgcaaacaaactttcagaacaaaatctgtttcaaacagagatgatctatgtatgaaagtacactgacttaaaaatgatttctttctgtggttttgagagaaaatctagtgattatttgtagcaattagcaacacagtagggggaattattaagataggattcagattggtgaaataaattcttgcaagtaaaacttaagataaaatgccacttgagaagatgttcaccacaaaggtggtaaccttatttttaaaaatgctttttattgaagttttatctacatacaggaaagtgaacaccacgtgggtatacagcttggtggattttcacaaactgcacacacttgtggaaccagcatccagatcaggaagcaacagatgtcctttaaaacatcaagaactgggccggacatggtggctcacgcctgtaatcccagcactttgggaggccaaggtgggtggatcacctgaggtcaggagtttgagaccagcctggccaacatggtgaaaccccgtctctactaaaattacaaaattagctgggcttggtggcatgcaccttgtaatcccagctactcgggaggctgaggcaggagaatcacttgaacccaggaggtggagattgcagtgagctgagattgcgccattgcattccagcctgggcaaaaagagcgaaacttcatctcaaaaaaaaaaaaaaaaaagaaaaaagaaaaaaaaaaagcaagaactggtttattttcaggaagagaataggagtagagacctggtctgaagagctgggtacaacctagggcagtagctcatgcctgtaatcccagcactttgggaggctgaggcaagaggattgcttgaacccaggagttggagaccagcttgggcaacatagtgagacctttgtttatacaaaaataaaaaataaaaataattagctggtcatagtagcacgcaactgtagtcccagctcttcaggaatgtgaggcaggaggattgtttgaacccgggaggtccaggctgcagtgagctgtgattgtgccactgcactccagcctggcacacagagtaagagcctgtcttaaagaaaaaaaaaaaaagaaaaaaaaaaggggtggctaggaaaaatgtcttgaaactgggtctgcatagaaaacaactttgtttgagatgccttggagaaggctgatgggaattacagtgtgtgttggtgacacttggagctgccaatgctttgaagtcagactctagttgggtctaactttgcctctgccattccttgctgtgtgactgtggccaagattgccaacctcttgaagcctctgtgattgtgacatgataatctctaaaatacagcatctcttgttcacgattatttcctcagaacctgttacagtgcctgccatacaggacaccctaagtaaatgtcttttttaaaggacatgaataaaacaattaataaataatatgtgcaaagtactcagtatagtacttggaagatgttcaataaatgtaaaatcaagtcacaaaatgacccattgacccagtaatgccacacttgtgaatatacacattcccaagaaaatcatcccccataaaagtaacttaccggctggctgcggtggctcatgcctgtaatcccagcactttgggaagctgaggcaggtgaatcacgaggtcaggagatcgagaccatcctggccaacatggtgaaaccccatctcaactaaaaaaatacaaaaattagctgggcgtggtggtgtgctcccgtagtcccaagctacttgggaggctgaggcaaaagaattgcttgaacccgggaggtggaggttgcagtgagccgagatcgtgccagtgcagtccagcctggcgacagagtgagactccattaaaaaaaaaaaaagtaacttacctataccttacgtatataaagttatatctctgcacatacacttatgtacacatatatagctaattatggtgaaatacggaactaacccaaagacagtgaggaataggtgtgcagttaggaattgtcgaaaccgtggaaatctatttagctgaaatctagccagtgtgtagacaatgttgaaattttaaaaagcttaaatctgaaaaatatttagaagatatatacaagtgtctatttgttagatagtgaaaactagtaaggttttggagtgaaaaagtttagagatggttacaccttttttttctaaagttgcttaaggtttttggaattgcttccctttccccacaagaacaaagcactggccgggtaaggtggctcacgcctgtaatcccggcactttgggaggccgaggtgggtggatcacctgaggtcaggcgttcaagaccatcctggccaacatggcaaaaccccttctctactaaaaaatacaaaaaaatagccggtcatggtgatggatgcctgtagtcccagctactcaggagactgaggcaggagaatcacttgaacccgggaggtggaggcggcagtgagccaatatcgtgccactgcatacaagcctgggggacagagtgagactccgtctcaaaaaaaaaaaaaaaagaacaaagcactcagccccacttcccagctggggagccccatggcctcatccatcctgagaaaggcctgcttttgctgtgatgtccctgctaggctatgaaggggctattgaaggtgctggctagagatgggttgctgaggagcatggtgacttcctggccatttaattgtgttagattcatggtggaatcaattttcttagtgaatgaatcagctgctaccagcacaggtcctttgtccaaagctccttgaggaggatgacatttagatgtattctctgtaattgataggccatccccaactggcgatggactcatatttttaaaaaaagacagctgaggattccatcagcattttgaagtaagctacctccaccaaagcccagctaacttcaaacctgcaataataacaatcggttaataatagtcataatttcactttagctctatattatgatgtattgttctaaaaagactttctcgcaaaaccaagaagagagcatttccaaatgtacaaagtattgtaaaagtacaaacggaaattatttctgtattgttatcatttccacctgatccgtatgagctcacagtgaagagggcagggcaaatctgattccattttacaactgagaagacgagccatttcatcagagtggtggtttccatgtcaaatgtacatagaggtattttgggaacacagcagggggcatctgatctggcgggggcatctgatctggcgggggcatctgatctggcagcggctggggagcactggtggtcaaggaaggctttccagaaggagtgggagttgggggctgagtgaagagcaggtctttccagccaataggatggcacagagcgagcctgtggagggcgtcaggtggagaattggtgtctgttagcatggccgttagaattgaggccaaaaggaaaccaggatttcctactgaacagccctcagttctccggaggaggaaatgggttaggatgtctcttcccctaatccctcacttgtgtctatcttggtctctttgccagagtgggcagaagggcccaactctgttgcttttgcaacgtgaagcctcccttccctcctctgtctctgtgcgtgtgaaccctggaggcctgttgagggacccttttctatgaaaatggtagaaagaggaaaaagggcaagagcatcaaattatggagaccccggaggctctggaggtgaaggctcattaattctatctgattcaaagcctgagaagaacggcctggagggccactcagtgtcatcacccatgacgctctcgtaactcttccgtacgaagagacatacttgggccactcttgccagttagccacttgggaaataccacggaagactcactttttttcacccagaagcccttttagggagaatttctttaggagaaattccgctgaattcaagcccatcagactcacatgctgatgatgtaacccgcggcagctcactcctggacacatgtgacccattctgaagattatctgtcatgtccttatagggtatggctctgccttggactgcagctcctcccctacctcccctcctcccacagctccatatttaggcatctgccaaggctcctcccctcctcaaggcttatcatccatctttactgccgcacaatgatgcggtggtttgttttcgtattcactgcagcaggtaataaatgttcctactttggcttcagttttaataaaactatcagaaactgctttacagtttgggaaactgaggccctgaaagctgacttgatgggccacttggggtcagaactggctggcacatgagggtcacttgattgaacagagactttttctcctttctgactctctaggtagcaaagcttagacaggagtctctctctttctttctctttttgtagccatgtctgggtatgagacacacagaacaccctttgctggagaaacctcttttgtgctactttaaattccctacttagagttaataactgtttatcattatatttagtaattgttatttgagaatgttattaatagggactacttactgtgtgtttactatgtacatacaatgtgtttatattatgcacctgctaagaattttgcactctaggccaggcacagtggctcacgcctgtaatcccagcactttgggaggccaaggtgggcagatcacttgagcccaggagtttgagagcagtctggccaacatggtgaaaccccatctccactaaaaatacaaaaattagccaggcgtggtggtggtgcctgtaatcccagctactcgggaggttgaggcaggagaatcacttgaacccgggagttggaggttgcagtgagctgagatcacaccactgcactccagcctgagcaacagagcgagactccgtctcaagaaaaaaaaaaaaagaattttgcactctcagctctaagcacacttaatactctcaacaacctgtgatacagatataatattattacattgattttacagaggaggaaactgaggcttaaggaggttaagaaaatcttccaagttcgtcacataggtagtcggttgggcagctcagattcaatgccaggtccacctgactttaaagcccatgaccttaacaattatgccttattaatttccttttgcagatattcactcaggaaatttggctttagctcagtcagtttattggaaagtttatttaaataaccaaaagggctgagtgtggtgactcatgcctgtaattccaacactttgggaggctgaggcgagaagatcacttgagcccaggagttcgggaccagcctcagcaacatagtgagaccttgtctctacacaaactaaacaaaattagctgatcttggtggtgagtgctcatagtcctagctacttgggaggctgaggtgggaagatcacttgggaggtggaggctgcagtgaaccaccattgtactctgtctccagcatgggagatagagcaagactctgtctcaaaaaataaataaaggtggccagtggctgtgtgtggtgactcacgcctgtaatcccagcactttgggaggccaaggcgggtggatcatttgaggtcaggagttcaagaccaaccttggcaacatggtgaaaccctgtctgtactaaaaatacaaaaattagctgggtatgatagtgcatgcctgtagtcccagctgctcgggaggctgaggcatgagaattgcttaaacccaggaggcagaggttgcagtgagccgagatcgagccactgcactccagcctgggcaacagagcaaaactccatttcaaaaaaataaaattaaaataaataaataaataaatgtccgaagcatgtacatttttcctaattctggccctgctacactggggtcaaataaaacttaaggccaggtgcagtagctcatgcctgtaatcccagcactttgggaggctgaggtgggaggactgcttgagctcaggagtttgagaccagcctgaacaatataatgagacccccactctatttataaaaaataagataattaaattaaattaaaaaaataaaacatagaaatgtcttaagaggtcttggctctggactaagtcacaaatgcatatatttaagttgcctcttggtctaaggatctaaagtttaacggaagcctatggagccctcaaggagtccttcctcaaaggtctagtctcaaatggggtccatgaccacggtgtgtgacagtaacctggtgtgagtctggagaaagagtccaggtaaacatttggcaaagtggtccctccgctatggacattcaggatttggcatttcagatagtagtgaaatggataactcgatggcttcctataattcccagatgccaggttttgtgctaaatcagactctccacattctgaatccttacagtgatcacatgaggaaagtccttttcttattttcatttttatgagaaaaccaaggttcagagaggttaagtaatttggccaaggtcacctggcttacatgtgtttaaaaacatgaatatgtatcatgtgaattatttatatggctaactcatttgcaaaagctattaggtataattaaacaacagggacagtgggttgacgaggataaaaatgtcttggcagccggacgcggtggctcacacctgtaatcccaacactttgggaggctgaggcaggaggatccctgaggccaggagttcatgaccagcctgggcaacatagtgagactgtgtctctacaaaaaaagcaataaattagcccggtgtggtggcacacacatgtagtcccagctactcgggaggctgaggtgggaggatctcttgagcccaggaggtccaggctgcagtgagctgtgatgacaccactgcactccagtctgggcgacagagcgagatcctgtctcagaaaaaagaaaaagaaaaaataaatgttttggaaaggaatgccaggatttagagaagtgacttaaaaattatgtttaaatcagacgtgtaggtttgctttgtattgccctgcatgacacatgtcaggaagatcgccagggaggggaggttacaagcccaggttgcaggaataacctttactctgaattttggtctgaaagacttttccttcgtctggagctgggctggccttgtgatattgtgccacagcagacacgacactgtctccaaggcggagctcattgcctggggctttcccactgcactgaatgagaatttatttggcctttaatgaaattcagattgtcccatttatgcagtcctctgtttaagtgacaggcactgaatatggttgctttcaagcaagttattttgtttaaccaggggcctagcggagttcgggatacacagatggccaccaaaaatgttaaaagaaagaaataacttaatcctcacagcatctctgagaagtggttcctaaatttatcacaatcttgcagatgtgtaagctgaggtgtggagttcaagcagcgtgctcaaagccatgtgtaggtgacagtgcctgatttcagatgcagataactctaaggccagtctgttgcatctcttaccagtttttggaaaaacctcaagggaaaaaccacagcaaatttttagagttctagtaatttcttttcccctattacaacacatattcccataaaccaaggactgtgtgattagtcaataaacaaaaagaaatgcatatagtatctgtcgctcataacgttcttgtttcttgcagtttccaacatggctagatccatcagaaactgaagccgtggagaacgctctcggggcctttgccacttcttggagtagaagccgacagagagctgtttggaaacttctccttcacacaccaggttgctactgaggtctatttcatgttgcagtcagagcagttgcttgtgttttttagtgcttgagtgattttacagataaagtcagcttctgcttcttgaccgggaggcatttgtgtgtgtgtgtgtgtgtgtgtgtgtgtgtgtgtgtgtgtgtgtgtgtgttgggggaagacagatctaagctctccctgtgaggggaagagtggattgcacaagcggggttggatggctacactgagattaccccacatttaatcagtttgccaatgaggaagccccttatcttcaaaaaaggcaagaaagaaagaaagacttcattttcccccttctctttctgttccagttgaagactaggctttggaggttttcaaagcagacggtgcttggatgggcagggagaagtaacattctgcaaatcgccgtcagaggtcctgaggacacagacctacctggcttgcattccccttgctgaatggcgtgtgctgcagctgcccactgagggctcttttccctgggattctggacttcagagtaggacagcaggctgggaagatgctgagttccatcaagtgcgtgttggtgggcgactctgctgtggggaaaacctctctgttggtgcgcttcacctccgagaccttcccggaggcctacaagcccacagtgtacgagaacacaggggtggacgtcttcatggatggcatccagatcagcctgggcctctgggacacagccggcaatgacgccttcagaagcatccggcccctgtcctaccagcaggcagacgtggtgctgatgtgctactctgtggccaaccataactcattcctgaacttgaagaacaagtggattggtgaaattaggagcaacttgccctgtacccctgtgctggtggtggccacccagactgaccagcgggagatggggccccacagggcctcctgcgtcaatgccatggaagggaagaaactggcccaggatgtcagagccaagggctacctggagtgctcagcccttagcaatcggggagtacagcaggtgtttgagtgcgccgtccgaactgccgtcaaccaggccaggagacgaaacagaaggaggctcttctccatcaatgagtgcaagatcttctaaaccccaagagacttcacacaacacttatgtatgcaccccaaagactaatggggagagggagggccgggaagccaggaaagcttggtgttttctctgggtacaccccaagcagcgtctccttttggatacagttattgatgaggcttggccactggatgttttcactaactacactctacaagtgaactccttgcccaggccagttagaaaatcccttggggaactgtgatgaatattccatctttgattaaaaaagtgaaatagtctccat

SEQ ID NO: 36688 - DNA, 37346 bp, Homo sapiens
ggcaggccgagccagccgtgcgccgcgctccagggcccagggcgccgcacacgcacccacccacccacccagcctcgcagcgccatgggcaagaacaagcagccacgcggccagcagaggcaggggggcccgccggccgcggacgccgctgggcccgacgacatggagccgaagaagggcacgggggcccccaaggagtgcggggaggaggagccccggacctgctgcggctgccggttcccgctgctgctcgccctgctgcagctggccctgggcatcgccgtgaccgtggtgggcttcctcatggcgagcatcagctcctccctgctagtcagggacactccattttgggctgggatcattgtaagcatcaagtctgttttgcctaagcgcgtttgccaaacaggaatgcgaagtcgcatggtcgagttgagactaacccagctgcatgtgcccttccccgggttcactcttctaactcgcgctctgctcggtgactgatgcgtggggcactgggttttcccgggcggggcagggctggacgcgatagggctcctgcccctctcctgctcgcggctcccagcgcctccacggggcctgactctgacgctctggagctggggagttcatttcaaaagctgcttattttggtcagactgaacagcctcaataacaacagcggattcattcgggctttttccttatcctgttacccagaccccacccctgtccttaaacaagtggcaaaaagtgaattaagttcatctagtgaaagcaggagaggagaaagcctgtacttggagttgccacattgagtagcattcattttatgttttaaactgaggctccattagtaagtttcctgaaatgatgggctaaggcaggaaatgcgaatacagcaagcacagccttaatccactggagtctaaagtgggataaacccagggcgctggccatggcagaagtatatttgggactccaccgatggatgtactgttctaagttgaacagtactcagctgttgtgagtgttgaaacatgtagcatacttggcttgattaaatgaattctttaatgtaaaacgggtgccacttactgaatacctactgtgtgctcgccctgctagaggcctgacacatattatttctaatccccacatcgtcctgatgggatcgttttaatcattctcacttctcaaatgagggaacccaggccagactcacccagggtcatgagtgggtaaagcattcagccatgctgattcctctttatgctagactatatctgcgttttcctcattgaaccacactgccaccacatttggtttgtaactttaatattatgttatattacagtgtcttgtagcatattaaactctttcacatgcattatttcatttgagccacgaaacaacactttgaagtgggaactgttattccttttggatgtgaggaaataggctaagagaagttagatgacattctcaagcccagagattgaatgtggtcgaatcaagagagactagaaatgacatttttgactccttgtctcatattgcatccttactgctattactgaccacaggaactgtaactcacaaaacgtccctcaaaataattttgtatcagggacagacattagagagacctgatatatatgcatcgatggaggtatttcctaattaagattatttgaatacacaatttttgcatagtaatttaaaactttaatttttgtactaagaattcccatgaaattaccatgattggagttttctaaatcaagtgattttaaaaatagcttttcagtaagatatactgggtatttcaggcacctcaatgacgatccacatacccagggggaaaatatgtctgtcctttaatgccaggggaattaaaacaaacaaagaatgaagctctttcattcagtgtttttaaatatcatttgcaaatgtgttccccatccttcctttattgcagcttcaaaagctcagcaccaaagaggcaaattagatggagaaaaaacttattttagggtttaaggcatgaacataaaaaccatgcaactcagaaattttatgaactaaagctcctgtgggagatgatgttcctaattgccctggaagctccctgggtgttgcacaaagggcattatatacagccaggtctctgctctttctggttttcttttttatcatctaggattcatttgaagtttgctctcagtacatagccctgatgaaatctgtcatcttagattttctttcaactgagaatctatgtagaggagagcagctagtagagatgtcctgagactagtgaggagggtctctgaggagccaggccaggaacaactctcatcctagcagggccagaatttgggcatgtgtcactgtctcacacagacaccatgctctgcttgtcctcactactctgtctgtggttggtcacagggcactcttccaagctttcagggaagggaaaagataacgaggcagatggcaaagtgcagatgtgtacacaccacacctggtgttgagcaccagctcagccactgtgtgctgaataactttgagttttgggggggggtttttggagacagagacttgctctgtcgcccaggctagaatgcagtggcacgattttggttcactgcaacctccccctcccaggttcaagacgttctcgtgcctcagcctcctaagtagctggaattacaggcgtgcaccgccacacctaacttgtgtgccaaataacttgtatgctaacttgtgtgccgaataactttggacaagttacttaacttctctaggtttccatttctttactaacaaaatcagaatgataataattcctaccttttcgggttgccctgaggatgaaataaattaatacatgtaaagcacttaaaatagtgccaacgaatggcatgattcaatgagttagctttacttattagctgcttgggaagcagtcacaggcagtgtcactcttcagaggaaaggtggctttatttcatctctagacttgcaaaactatcatttttgactcgctacatttccaagactagtttgaaccctgaagaaaatatcagttttgccgtctcacctttctctgttctcagccaagttactctttagcaatcacagtggtatttgattggtccagtactttctgaatctttctggaggtttataaaaatgaacttggaggagagtggcctccccaaggtcatttttcctttgggatatgcagtgattcagggctggtatatcctgccgggttatatcagttttccctgttcaggagccccaccaaaccgaagcaatccaggcccatccctggggctgaggctgagtcacactggctccgggatataggctgaagccaagctgagtgaggcacccacgctgtctacaactttccatgcttcattcttctgtttccctttattctggttgcctcttctcatgtggtcatcacttcattttacaggggccactatcccattaacttggaatttggggattgccatttccttaacagaacctggatatatgggtaaatccacttaggtgacttctctttgaccaatgcctgggtgacttgatgaatattcaaggtgtggttacagactaaagaggcccttggtgatctatgatcagaaatttatgtccagtgggattttaggaaaacaaataggtcattttttatctatccataaatgtgactccaatccccaatcaaaagatgattgaagtctttttactttgattacaaaagattcctgtaaggggggaaaaaaacccagaatggagtcactgtggagactacgtaacctgtaaaagtgctgttcatgtattataattctttatagatggtttgagggttgtaagtcataccgcaatgacaaaacaaagtgaaatagcaacttttgaggatgcacttggctgggtacagaggatcctaggacagagaagtgtgttctgcattttattctgttaatggctttagtagctaagtcagatgggaattcaagcttgctcatttttctggaattcttattgatgaaaaatgtgtaaggattgaagtaatctaaggactttggggattttacttctcactcaaatgaatacaggtttagtttaggtaaagcattgcatgcttaacgtttggttttcccttcctcattcagtaacatctgtggagggtgtctgctgtgctacgcattggcctaaaaataatgaatcaactacctggaggagatctccagatcctgatggacatgtgcccttattatatctgacagtaatgaatacttccgattagaaaatttaacgtacacaaatatttttaagatccatttacctttcaaagtattccacttgcagtgatttatttgctttggcatctctactctgaagtcaatttaagtgcaaactcttgcttctcatccccagtgaatatgtttagtattcgatattctcctggcccttgtagggaatattcccatggaaagtgagaatttctttgccttattatgctttttagcttcccccactctccctccattgctcccataccccactcagtggagtaaaaaccctgagataaatactgcattaatcacattggaaagtttaaggcaagggcttaaaagaaagggaagaatatttcctttatttaatgtcatttgtaaaactcatcacatgaatctgtaatgattaaaagtcatgtcaaaaatttcagtaacagttttcgtatgttaacttatcctaagaaattcaagttgcaggtttattcaggttttaaaaaccgattttaagtcttgccttaatggaagggaaaattgggtggttatttattttaaagcagaatataccatgaaactcacaagcagacatatcacatatagcaaataaggaacaaatatagttgttattcagaatttataagtagggaaagtaagataataatttagctaaatggtttgatcatggttatgaaaagtaactggaagagagaaaggtttggcattagggtataggataaaccctcaagtcaagaagctaaatgtggtgttaactttctatagagttgtattgacatttgaaaattttaatctggaattatacttttaggagtatactgcatagtaatacattattcatcatattgggactttaatatgcttccaaaatataatgtcgcatccctggtatccctgggaaataatttttattatggcaactgccacaggattgttaggaactgaggagagataattacatggcccaactcaatctccactgaatacatagaacaataatgacaggaaaattattgtataggcataggaagttctcatagtaagtataaaaatggaatgcaattgaattattctggcaaaagaagttaatttgtgtatatatatatatatatatatatatatatatatattatatatatatatttggaaataaaatggaatattcaagaatttggtgaggccgggcatggtgtcttacacctgtaatcctggcactttgggaggccaaggcaggcaaattgcatgagctcaggattttgagaccagcctggtcaacatggcaatatcccatctctaccaaaaatacaaaaatttagctgggtgtggtggcacccacctgtagtcccagctactcgggaggctgaggtgggaggatcacttcagcctgggaggcagaggttgcagtgagctgagattgcaccactgcactccagcctgggcaacagagtgagaccccataacagaaaaaaaaaaaaagaatttggcgaatttggcgaaatgtttcctgaaataatttcagtaatagaataaagaataagataggttaagattgaacaaaatcattagatgttcagaatcagcaggagaaatgtgttttcgcctctacttacagccttctactaagcctgatgtgcaaaggccaagagagtgtttatataatgaggaaattgtccctaaatcttcttttttaaaaaaaaaaatgaggagaagcagcaggttctaatattttttttaatcctgtattgtggatatattcaactcagaaagttagtctctggaagcttttgagatgtcagtcatcattttggatttaattttttgatagaaatactggtacatagaattttgggataatcaaatgaaaaataaaataatttattctcttactttaagtaatattctcagggccactatatatcccctgacacataatggataattaataaatgttgaactgaaatctatttattccatacttgccattatcagagcttctgtttgaacatgcatatgcccatttttaagctatattcagtcatcccttagtatctgcaggggattggtactgggactcctgataccaaaattcacagatactcaagtccctgctataaaatggtgtagtatttgcatataatttatgcacatcctacatatgctttaaatcatttctagattacttataatacctaatacaatataaatactatgtaaacagttgacacactatattattgagggaataatgacatgaaaaggtctgtacatgttcagtacagacacaaccatcctttttttatccaaatgtttttgatccgtggttgattatattcatggatatggaacccattgatacagagggctgactgtagttgtatattcaaacacagacaaatttatttatgacatttaagacaactatgaggtaatagtaaggaatgtgttattactccattttggcttctggattctagaagaattcagaacatattaacttaacattacttagattttttatttcatgttataaaatggcaggactcaggaaggtcatttgacttatatgcactctcctaactagaataggacatattaggattgatgtggctgaatgctagatgttgatattaccactcttaaccttttacgaagaaaacaatggcataggtttctctaatgtttggtctaacagttgaatagatagattgccaatatgatgccctctttcagtgtggtctgagaaaatgggtgttttctagatttgctcttgcctttagctgtatctgagacatttctattaaggatggtctttcactggatccacttggttgtattgtggcctgaagggttaatgataacattaaaaggaaacacataaggttatgttgaagagttcagcatatatgtttctatgttactgtaggatagtgtattagtctgttctcacgctgctataaagatactacgtgagactaatttataaagaaaggaggtttaattgactgacaattccacatggctgaggaggcctcaggaaacttacaatcatggcagaaggcaaaggagaagcaaatcatatcttacagggctgcaggagagagagcactggggaaactgccacttataagccatcagatctcatgagaactcactatctcatcttctcatgagaagagcatagggggaaccacccccatgatcaaaccaccttccaccaggtttccccctcaacacatggggattacaattcaagagagatttgggtggggacacagaatcaaaccatatcagacaggaatgtaatctagtcattaaactttaattaggtataattcactgcaaaatgcagttcatttttaggtcttccatcctggcaaactaaggaagtactggtcaaaaaatgtccatcaaaatccagagctggatgggacctcatgatgtcatagtttaaccttccagttattatttgctgtaaatgttcaagtctaggtttatcacgatgagttcataagcttacagtgaacttcttttaaaaaaatagatgctaggaacaggctttacagcataagctatataaaaacctattccataggcacaccctctttcagatgctttggatgcagtctcagatctctgtgtattgagataaaacttggcaagagtaactgtcagatgcctgagtgaagcagctcactccatcaccctggttaattttaaaattcatatgtgtacacctacacatatggcattaactaaaatacatttttctttctgtcttagtcggctcaggctgctataacaaaataccgtagactgggtgacttaaacagcaaacattcattttctcacagttctggagacgggaagtccaagatcagggtgtcaacatggtcaggggctagggagggttctcttcctggcttgcaggcggctgccttcttgctgtgtgctcacatggtcttttctcagttcatgcatgtgaagagaagaagagatctctttctcttcctcttctcatgaatcctccagtcctgttggattaggaccccatgcttaggatcttatttaaccttaattacctcctaaaagccctatctccaaatatagttacttttgaggttacagcttcaacatatgacttacggggacacaattcagtccatagcatttccggtgagggttatacatttgcacagcaacctcagtgactcttaagctcgttttacagcttattattgaaagccctacggctttcttggaacagctagaagtctgagtgtttccgaggggtattctgagcccgtaatctgacacacggaggtacgatggggtggcgcggctccgtgctcatgccagtagtgagacatatggaggaagctgttttcattgcatttacagattgcttcttttgtcaaatttctgtaaaaataaaatcaagtaaatctagctagtgaatacaattctaaggttaacttaggcatttcctttgctgcattaactctttaaggcttaggaacctccacgctgtaaattcctgcatttctttatgctccagggagtatcctgatgtcaagatgtagctcaaggatactttggcttctgatgcaaaggtggctggctgagtggtaccattggggaatgcttatatgttcagccattgaccaagcctgctgtcctgtggggggtggtgattgcatactgtgggcaccccccacccgccctttgagccttatgaggtaatagcctttagtaggtgccttcactctttggtagatcttcattttgacacacatttaagggcttctcattggattctgttccctcacttaagaagtcctgagctgggctctgcttttccttcactaagtactgtattgcacaaacccaagccacccaagagggaaagaccagggaagactaaaacatgcagcctttcataacaattggtccaatctcagttccaaaacgaaaagggatggccacgatgggatactgtaagctctccagtttgatttttgagcatatttaaagttgatgctctctgagctaatgttgctagagccacggtccctaattgtgaatttcataaatgtgagtgtttcattatggtgtttcctggggctggcaaaagtccagtaagtgacgggacgttggaaagcagacagtttgttcacaaatgagcattctcagattctgctgaagaagttctgttggacctgcttctaatctttgcagaaatgagcaactctcccctggctgggagtgccgtggtactgagagaggtggtgagaaacctggaggaagcgcttttaagtggcattctactcagttgtttttaaagcgttagattcagcattcactgtaaggagcaattaaaaacccctttaagatatgttattatcaagccctctctcttgtatggaagataatgacaggagaccagaaaagggggagggggctgctaatgtgttaactagactttgacgagcgagagaattttagctttattactaagtgggggaaaaaacacttccttggctggcttccttctaaagtatcaggtgtggcatgcatatcaggccattagcctgatctcacaggcttagccctatctcacatttagctatgccaggaaagctatgaaggaggcattttctaagacaagggcaacagcatttcagtcctcatcaattctgttggaggttggaggtgctcttctctcagggagaaacttgcaggaggactgtgcctacctcaggaagatagtggggcacccaaggcagtgaagagggcaaactcggactccctaaggcaaatgtatgatcataaatgagaagggatttcttcatgaccgcatacagaattctgtgtacagagtttgaatcttttagtttatgagttacatgttcaataagtttatgtacttctcccaggctctttggtagtcaggttctgaaacagaaggaccaaacccacacaggttggctttgtctcataatctttccatgaacaagtagtttgagaagcctcttaaagggcttcggtgtgcattaagggcttgagaccaactaggaatttttaaatgcacatagggtgaccgtaactattgtgttatagaaccctcaagaaagaattcttcttcagtcaccaaatcgtgtgcgtcacaaatttttccacctcaagacctccctgaagctttgctccccttctctctgtcctcacacacacatcacaaaaagctcagtgtctggctaacccgtgttgccatgggaggcgagggggaaatgtaggagaggctgcaggctgcttggggacactgacctcctcatgttgaaaaggacaaaacactttcaaaggagaagtaatattataatatatattactttatgttccctcatactgtttttcataaagtactctcaattagaaaagccacttgataatatttttaaaggttgaacaagatggttctctcatttacaatcccattccaatgttacataattcaatttatattgatttactgtataatttctatgcactgtgctatttaatatgtttatatttattgtactattcaacatatatgaacccaggagtttaatatagaattatctctgcagtcatttctagaatgggacctaatttgagaactgacttaattatggctaagtaatgaaatccagcccatgactataccaccggagtaggctcaatccacatcagcaagattcctttccctcttctgagggcttgaaaatccccaagtgaaacaaataaactataggttgtttatttcttcccacaaatactgtttgtaacaattctgcccctcctgttgattcatgagaaaggctggaacacaatctttgattctcttacattctttggaaattgattattttgcaagaataagtatttatagaacttggtgattagtttttggtaagtcatcacaagagttagttaggagtagaagccacaccctagccactctccctctgtattttcatataccaggtatggtgcccccaagagcttagtctctgggtgaggaaacacaggtacaactaactgcaatttagttttaaaaacaaaatgccaaggtggtgccttaaacaatgtaccgtgctagcgcagagaagaacatgatgaaccctcagggtaagatcagaaaaagaaaggagagggggtctgaaatttgaggaatgactccagctttggagtaagggtagaattctggctctactaatgtagaatcattttccaaaaaatatttggtaatgatttttaaattttcatttctatgtgaatttgaacaaatgtcagtaattctgtgcaattctatgctttttaaaattataaacatttcaattgcataataacatagaaaataatgcataataacatagaaaaaaatgcccacttatccattcctagctttgctaaattttagtattttgtaataattgcttttttattattttttaagaaaggaaacattacattgtattgaagtctcccatgtttcatttcttaatcaaattcccctacccctcccatcttccccagagatatgtactatcctgaatttggtattttttatgcataagcctgttttcatactttgaaaatttgtatatatccataaccaacatgtcatattttaatttttatacagatggtatcatatcatttctgctcaacatcgtttttgagatttatttataatagtacacagatatcattcattcatgtttgctatactgaatttcactgttaggaatatacaacattggccaggtacagtggctcacacctgtaatcccagcactttgggaggccaaggcgggaggattgcttgagcctaggagttcaagcctgggcaacatggcaaaaccccgtctctacaaaaaatactttttgtagagaaattagctgggtgtggtggcagatgcctgttgttccagctactcaggaggctgaggtgggaggatcatttgaacctgggaggttgagacagtggtgagccatgatcgcaccaccgcacttcagcctgggcaacagagcaagaccctgtctcaaaagaaagtggtggtggtgggggggggggatatataacagttaattcattctcttgttgaagaaaatttgttttcaaaaatgattttttattttgcatttacggtgttacagtggatattcttgtctataactccctgtgcacataaagtcttgttaaggcatattcctagaagtcaaattgttgggtcataagatatagacatcgtcaaattactagctattgccaagtcactaccacaaatccaaattggactaacttacacctcacctccaccagtggtaaatcagagttctttacctatcttatttgtgtgcaatggtatcttgttttaatttgcattttggtgttgctactggaattgaacatattttatgttgattggccattttattttgtgttctatcatttatttattcaaaaaatattttctatgggttgttcgtttcttatttatttataggatttgttacttttgttacttaatctttatggttttaggtactacaaatatctttttctggttggtatcatatcttttatttatggtgttttgttatgaaaaaagatttaatcttcatatatttatatttatcagttcttttttttatggatttgatgtagtttaaagaaatttttccctactccaaggccataaaaatatttttctataccattttctaaaaatgttaaaggtttgcttttgggtattcatatctttattataagtggtttctttttgcaatgatgtgaagggtccatacattttttctcacatggattgataattgttttagcaccgtttaataaataatcggtccctttcatagtgatctgttacacccatttatcatctgtcaagtttccatattagatttgctttgtgattttccttagttctattgttttatttggctatcactatgccaataccattgtctaaattaaaatgatgctataatgcatcttgttataaagatgatggataagcagcccacccccaacccaccctccttcattttattcttcttcaaaattttctcagtgaatcttagccattttctcttgcatatacactttagaataggcttttcaagttccaagaaaaatacttttggtaatttcctgggatttgtactttctatacatgaccaaagatgatctcaccatttatttgagtcttctctaatgtcttttatctggtcttttgattattgagttcactttagttgctttgtgctcagttcatgtgtttttcatatcaattatttgatatttgattagacttattttgtgaccaatcttcataaacagttcttgaatgcttgggaaaaatgtggattctctcattttggggtttagggttctatactcaattttaaaattaagtttgttccctttgcctggaattgctgtcagatgtatatttagaatcttcttattctccctccatatttcttatcctgtctagtatgtttcatctctctttatctctctgtgctgtatcttgggttattttctcagattttctggttcacttttcccttcttcatttaggtttaatctgccttttacttgtcctttgagtttttactgccagcaattttaatttttcattctagaactcactgatgttgttactgatgttattttcacatatccctggtgctttaaaaactgtcctgttctttatgttttcagttccttccttcatgtgtttgttttgaatgtactttttataggctctgctcattacttccattatttggaattcttatagctctgattcttagagcgtgtgtgtgtgtgtgtgtgtgtgtgtgtgtgtgtgtgtgtgtgtacatgcatgtaagagctagccttcactaataattaattcttcaagtgtttgctaattttggtttgtgagttcatcttccaagaggctttatgtatgataacttgatatagcctatttgagagtacaacccttccagatgggtttgtcttgccatatgtcccagtgatgttacaggcctagaaccactttgtttccttaacttacttattatgaaaaatttcaagcatacacaagagtagatacaattgtataatgaacctctatattctcatcaccgagccttgataactatcaactcatgctcaatcttgtcttatctgtatgctcctatatttcctccacacccacacactacacacactacacagtggattattttgcactaaatcccagactttatatcattttatttataaatattttgctatgtaagtcgaaagatgaagactaaaaaataatcaatatactaataatacacctaacaagttaatttcttaatagaatcaaaccactgtttaaatatccatgattaactcattaatagttcctcctagatttgtcaaaatcaggatctcaataagatctatacactgcagttgactcatatatttctaacatttcctttactcaaaaatttaccctttgtctctcctttctattctctctctctgtgtctctctctctctgtctctgtctctctcccccttacaatttatttattgaaatagccaggttttggtttattttttcaggatcactttcatgttactttctcatcttaataggttccaggactaggaaagtagtagaaaaacctcaaactgcccccctgcatctgttgagacagaacaattttcttgatgacttccagtgctagtgggctaattgttttttcattttataagggatgctacgttttatccagcattttacagtgttttatagggagagagttttcctataatttagtccttaatattatgcagaaatgaaaccttttgatgctttttagaaatttattttggatcaacttgcaagtttcttatcctttctgagctgcaagtttctataaaatagagtaatattttttactttattgcattgtttgggggaaaatgagctaatgtataaaaagtaaggaatacgaaaaaggtacactttgtgggtagtgggaatagctgagcaggatttgacgaataagtgtgagtgaattcaagatggttgaaagagtagtaccattacactgggtagataaggaaagaaaagcacattttaggtcaaaggaacaagtcatgtcctatgactgttcagcccagttttcatccataatcaactttattgcttcacaattctgttggttatgcttattttgtcttttgaggatataactgcaagaattcccagcagttcctatcaaatatgaatcttaacccacatacacaaatttgtgttataatatgaaaatgagacccaaaccaaagtgattctatttgaagatctccatggtaagtcatacactgggatagctgtcagatttctcttcttggttttctgtaaattgatgaaacactcagccttgggttcactggtttaaaatgatgagctatttgcaattgtttcaagcaaggtttttggaacttttgaattgtagtcactttgtgctggcacacgtcttacagatcttcctagctttccagcctcactttggcaggaacatcaaagaaagcacactatatccataagatttgggggattcacactcctctcatccagctgctggtcacaagttccaactcatttttatcagttccattgggtggttttctaatatcctataaagcaacataggagatacaagtgaacatctgcaaagcacagtgtgtgctgagaaacagggcagtcacttaacaagcacatttttcttcccactctttctgtgcttggacaacagatctggctaaactacacagcaatgcaaattacaatgtaactttggtgggaaaaattatataaaattctagttatcaagtagtttcaaacaatgacaaaacctaccactttgaattagaaagcatgtatctagccatacaaagcgctttggcttggcacataagtattccatacttctttaccaaccaatcagaacttttatcacaaagtactggtgaatccattctcatttctggcaaatgcatgagcaaaattttcttaagaaaattgcccataaattcttagatattttgtttttacaatgtgttttccaaagagatctaaatttaacaaagttgtaggtgaggaagccctgcttttgcattataatttaattaattagcatttatttttgtttactttgaatgtctttgcatgctcatatgaaaatacatacatttacaataattcagatgtagacctgtcagatatcaactcctcaggtagaatgacagttaaaataataaaggggtggatgttaaacatgagctagacttaggtgtgattgagcaagtgtcttttctctttagatcctgaaaggaaatacttttctgtgatagaatttcttgtctagaattgacttttccctgagaaattttgacctggatttttaccatcttcttttaaaaataatctcgcatgtcatctttgcaaagtcagtattacaaattgtttcccccaactccctggaaagatgtggaaatgaccagatgaggctctgtgtcgaaacccaaacccctcgtgggcaggcagaacttagttcttccataaataggatttctacactagagcttttcatcggcaacttttactctaatgaaaaaaaaaaagtaaaatcagtgaagctctggggttggcaatacctaagacaaatgaaaaggcattgaaaatcttccagatatatcataggccaaataaagtagtcattcgcaaagcttcctagacataaaaagttgttgctagctacgattttgttcacagtgaaaaagaagcttctattttgagcttggttagataaaatgaagaaaaaacttttttttcaaggttataattagtgctctgagttttaacgctggtccactaatgttagtgtttagagacagattgttacaatgcttccctcctcttggtggtcagttctgccgtaaactcttcgctttatatttgcgcccctattacttctggaattcgccatggatatctgcacactaagtttggctgaaacaattgtgttttttaaaaaagtaatattaacttgaggatctcatatggccagaaaaatagttttaattgaaaagcatttttttttccagaaattaaatgattgtcattgtaaaaccacagtagtgtaatcagagaaacatgcagctgggcatgggacatagttcctaagattggcatttcctgggtagtagattatatataggtttgtaacagaaataaaaagagtcaggaaaagaagttttataactcttaggtatttgcaaactatgttaacattgttggaaagatttttgaaaagtgggtccttgctatgaaagcaaaatatcatcctagagatgatgaaaccgaggctccaagggttaacttcatcagtcagctagaaagtggtggaggtgggttttgaaccatttcactagacccagagctaacatgcatgcaccaccttgttctctgtctttaggtatgtggcccattttgctgtaatacttcacagttcccttttgttgtcctttctcgggggcattcataggttgtctatgaatcctgtgaattcttagatacttatagtggatgcatgttgttgaaataacagagccagcaaggctctcaaacatctacttttttttaaagggttgctgggcattaccaattcattttttaagggagaacatatcactttaaggatttattatttgtattttactaatcactgtatgtcatgtttgttgggaaaagaagctatgatgataattgctacattctccatagctcttctcaacagctgacaggttatctatctacttatttgtttatggtctgcctctccactttagccccatcaaggtagggatttttctctcttcttttcactgtagtatctccaagcctcaaagagtacctggcacatggtagttacacaaggaatatttgttaaatgagcagaatgagacgatttctaagttgtgactgagtgcttatatttacatctgttattcattttcagcttgaatttgagcacagtttgagttcctgtgagatgggggaaaacacctactacaattccaggcacgttatttatgatatttaaaagccaattattaactgtcattttctccattttgtatgtgataagactgagtctcaatgactaagtcacggtcccccagcctgcatggtcatttggacctcaaagactttctttttcacactgccttaggattggtgcttcagcaattcaggagaggagcagatggtagaatgttcttcagatctctgcagttcttgcttatagtgctgtcaggattccttcaggcaggtggctgtaccatgcagtggctaagagccaggctctgcactctgacagcacagccatcaattctgtgatatacagtatatttgctatgtgaccatgacattattgtctccattttataggtagggaaactgaggctaaaaacaattaaacagctttgtccaagatcatttagctagcaaagtaatttgagtcaagatgcaaactttaatgcccatgttcttaccactgtgtaaccctgtctccttaattatgtgtatagttctatacttgattttacagaatcaaataagcagttatcatttattgaatgaactgttacttgatgtttcatgctttgcgccattttcacctttctcactttatccaattagggaaagagtacattttgtgttcctttatcttgcttttacctaaaaatataatgaaaaagaattaataataataataacaaatataggaaggggatatcattcataattctaccatatttaagccctatgtgattaacaccaaaaattttgcctttaaaaaaaaacacattgggggaagctgattcaatgcttcttacattataaaatggatgagggattttgataagtgatcagcaaggtgggggttgtataagctgctgtcagctgctcatattcacatctggcatggactggtcaaatgacattacccttggcaatacattttcctgtgcctcagttcctctggggattaaactgtgattttctaaagggcaaagaccatatcttcttctttatactcccggtccctaccacagtaaaggttgagctaaattctgttggagagtgatacctagattagggtggccattgatagcaagatctcaaagattatgctgtaaccattcttcctctattcccacaaatcaggaaataagtactatgatttctccttggcactctcctctgtatctttatacagattctgtaggctgattgtagggattccaagcaattagtaatgagtaatgtgccaaacttagatacaaaccaatctcacttgttaatgagatacttctgtcaaaagagggacccagaaaaggcagaaatggggtggaggtgcagaagcatgctggagcattgctgatggacttgtgacagctgattgcatgcatctcttcacaactttgctcagtgactttgtgttggttatcttgaaatcagccatggtagaagtagtcacaccatggaaattagcaaatgctacaaatagcctttctctaactggttgttagacatttaccatcacaccactggagaggtggtgcaattttagaggtgattgttttgctttgggttagagtggctgatgccccttaacaatagcagaatgccacatcacactgaatgatttagagatgttcctcaaaccaccagtcagatacattgaggaaacaggctctgcaatgaggtcatatttaaatagcaatgaagacatggggatttctcccccaatttgaaggactcctatgatagcagagactaaatttctttatggggaaacaaatggagccaacacctttataacacaatagtaatacaaacaattcaggggcaatgaatgtatatctagccttttacatttctaaaacatcagttttctctcccttgaaaaatgcattcttgagatgattaaatgcaagaatacatgtcaagtgttcagcacggggcttaacactctgtaaatattcataaatggtatattagtagtagtagtatattattgtttataataaatgactctctataagaaattctactagtcagtgtgtcactctggacccctaaccatttcgataaaccctacaccagacatcagcatttagaacactgggcttacagcttagcctagtggttctcaaaaggttcatcccagcaccggcagcatcagcatttcctgggaatttgttagaaatgcgaattgtcagtgatgatgagcattttttcatgtgttttttggctgcataaatgtcttcttttgagaagtgtctgttcatgtccttcgcccactttttgatggggttgtttgtttttttcttataaatttgtttgagttcattgtagattctggatattagccctttgtcagatgagtagcttgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacatttaagtctttaatccatcttgaattgatttttgtataaggtgtaaggaagggatccagcttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggtgatgcgagctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacgtcccttataagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatgcgtcccatcaatacctaatttattgagagtttttagcatgaaaggttgttgaattttgccaaaggctttttctgcatctattgagataatcatgtggagaaataggaacttttacactgttggtgggactgtaaactagttcaaccattgtggaagtcagtatggcgattcctcagggatctagaactggaaataccatttgacccagccatcccattactgggtatatactcaaaggactataaatcatgctgctataaagacacatgcacacgtatgtttattgtggcattattcacaatagcaaagacttggaaccaacccaaatgtccaacaatgatagactggattaagaaaatgtggcacatatacaccatggaatactatgcagccattaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgttgtggggtggggggaggggggaggggggaggggggaggggggagggatagcatcgggagatatacctaatgctagatgacgagttagtgggtgcagcgcaccagcatggcacctgtatacatatgtaactaacctgcacaatgtgcacatgtaccctaaaacttaaagtataattaaaaaaaaaaaagaaatgcaaattgtcagtcctcaccccagacctattggatcaaaaattctgaggataagaccaatatttacccaccttttcaagtgatcctgaaccactcttaggctttgtcttaccataaggcagtggcaatgagaatccagtaaaaatgtttaagtcatgctaaaatattctctccagtctttctggaatcttgattggataagcagcctttaattgatccgtgtgaaatgttctgttgcatgtcatttaattttctggtctattatgtgttaacagtcctcctaagactatcctcaattaacagactgtaacatatttatcatttgttgaaaatcacttctaatactttatcttaatgtatattaaatagatgacaatccatagaaattctcttaagaaatatctggagaaacatttacagttctgctacttctcttggtgatcaattgattttgtaaacatgagaagagagttcatcttgttactatattgattggattaaagcactttaaatacaaaggtgaaagttgattaacttacagaaatagagtcccattgcaggtacacgatgaaacgggggtaaggaaggagaagaaaaacattgaaaggcatttgacagggtaaggttgtattccccagacaaccctgtcaagcagctctgttgacaacaaaaagaagaaaacaaataaattggaggttgtgtgaatgtcacaagaccagaatataaatacatatgacatggagagagtaaataccaataattctcattctcacaaaatgttttaggatgataccttccagctatgacaagaccaaaagggaaaaaaaataataagcaggtaaatctccgagacactggtccagtatctaccttttattcataatacaaaccctcaaaagacaccactgcagttataataggccaaataacaaagacaaagacaatgtgtgacaagactcaggactcgcacatccacaaaaaatggatttaacattcagagaccatttcagccctgtctaactttctagctcacaagagagaatgcagacttcactctgcatggacaaaaagatatcttcaggcagaatgtggaatttaggacttcagttttctcttcacgctaaaccaattgtagaaacacacatccaaaaataaagtgatgattaccgtctttcttttttccattaaaaatcactttaagcttttcttatcgacttaattatttacatgcacattgactaaatcttaacaagctcttaaatgctagttgccctgttgcctctcagcactagccttcccagtgccacacacgtgccatttgcctttgtgctctgtgacaccaccatctgggtgtctggtccaacaagcgccttcttgaaaaccttacataactccccttttcctgtgccatgggcttcacctcaccatatctaatgggagctctggcctggactctaggaatgtcattccagataggcctgacgggtctcactgcccattaacatgagctcccccttccctgctgggaagccagaatgccgtgtcttcctggcacgtccacgtcctgccaactcaggagacaaaaccattagtctaccatgagaaatctggttttctctccatggccagaaaaccttcagttttcagtaccagtaaagcctacccttctaaaacatgcttacactgaacatcaataaactctttgataaagaagtcttgttacaacatgcaaagctgtaggcaaaaaaaaaaaaaaaaaaaatgacagtcccctctcaccttagaacatatcaagccctatcagaaggccaagaaattaaaatatgttgaatacatttaagctttatagcaaataccctgtacaagaacctaaattgaagctttcaaaaatctaaaaggacaaatctaaaaggataatccatttcatgatttttagatatgacatgacatagaactataattataagaaatatacccgagatgctttctgttcaaaaaattcaaagattcttcataactgggtaactaactaacataactgggcccttttctgttttcagactctctctggatgggccactgtttcctatggtgtcaattgcttcacatatggtgatgactaacaaatccttgtctccaacccaggcctcgttcctgagctctaagcccatatagttgtgatttgtgtccacgtgggatcatcattccccactcccattctgcccctccttttctatcttatctcattaaatgtccacaccacccacctggcagcaccttcctgatctctccctctcttcagctcttacatctttaccttaatcagtcttcaaagcctatggattcagcttttttactgtcactcaaacacacccactccctatccctacctctacctgagctcagacacttatcatttctcaggtgaagaatggcctctaggtgatcttctcttcccaagaattgctcccatccaatccattcttcatagccagaaggaccattctaaaaggcaaagtcagccatgcccttctgctgctgaaaatgtcctagttgaaatcaaagtcctttgtgatctacttcctgcctattgctgcaaacacatcttttgccttttattttttttctctgcactggacctagaggaatcctcaaatgtttactctgcctttcttcatgcctttgcacgtactattactctctctgcacagaatacctttcctcacactctccttttagccactttctgcatatcctcaaaactcatctttctccaggaagttttcatcagggtagtcattccttctgggtattcctatagcagatgtagtcctagtacttttacaatattccaactcattatcctctcttttcccactggactgggagatccttagatgctggatagtccttggtgtaagggcctgttttgccatctctcatttcccaggatcatacaataacacagggcctgcttattgtatgtcctccataaaattctgtgaattgaataagtcaaatgctctagaatgaggtcatgtgttcctatgcaacttctttctggaagccagggtaaatgaaggctacaaagaagtagctactgctgaaattagaaattttgttcaagtagacgcactgaatcagatttttaaggtgctagttaggccttattactggaatgtgtctcttatggagacaaagaggaaagtcttggtaattgccaacttcagctggtagtctctagcgaagaaggcagttacgtgggagagcctgaccctgtgcacctacagacagaaactcacaggcatgtgcctagggatataagcaggattacaaacctcaatctggtgtgtcaccaataaacaaaaagtaggtctttctttgattgtttcaagttttataaattcttaatgtgagaataaatagtaaacccctacagttcttatcaaacttatccttcaatttagtattttttacaaatgagctttacaaaaaagcttcatcctgacttgaaaatgccatgttaggggctacatgaataacttcagtatctttacttttgtatgtgccagtcttctgctgaaaagctgcctccctgggtcctatctgttttcttttctctccagatctctccagtccatgccatgctcacatgttttaatgctgtgtctctccactgcaaatattccatcctgctattaaaccaggcagccatttccattcaatgatggaaaaccctggaaacagtctatagtaagagaaggcttggcttttgacttcatggtccagtagaaatctgaacaacctacaacttggcagtggatgagggcataggcagcttattgattatgtaaccgaagggagaagaggatagaagttttacctgaaaatgccatgttgcctttgcaaacagtttctccaccctaacagggtttgaagctggccctggggtaggaaatatggtttgaatctggcctatggtttgaagctggccctggggtaggaactatgaatatgtgcaaaccagttgtttaatgacttgctaggtgactctcagctgctctttcaacttctgtctctaggataattgtgcttatcaggaaatgcaattctgttgcttatgttttctattttgaaagtgtggaactttatcaatgttttaagctttccaaaattgaatgtgaatagatatactttgattagaaactctaaatcctagttctaaaaagtctagttcatgaaaaataaaatgcggtttaaataacaggttgagtatattttgcctcaaagctgctgtttctctggccagccttctttcagcaggcatgtccaccgtctttttgtcactgatacaccaaagcttggaggtcacttctggtttctccctctccaggtcctcccatcagttatgcaatagccaagatgtatagattcagcttttactatgcctgtcctccccatctctttctctgaatttgcatgctactatctgagctctggttcacctgatatattgatcttgctcagattagcaaaataataccctgatgttctcactgccaacccacccaacatcactgctaattttcctgaaatgtgtctctcaaatcatgtcattccctgctcagaaattttcaagggagtaccgctacttactaaatccatcccgtatccccagatattcatcctaccctttttgctctatatgttttttgtttttttgagatggagtttcgctcttgttacccagactggagtgcaatggcacaatctcagctcactgcaacctctgcctcccagattcaagcgattctcctgcctcagcctcccgagtacctgggattacaggtgtgcaccaccacgcctggctaatttttgtattttcagtaaagacgggtttcaccatgttggccaggctggtctcaaactcctgacctcaggtgatccacccgcctcggcctcccgaagtgttgggatgacaggcatgaggcaccgcacccgcttatatgtcattgttttaaactatgggtgtgcatttgctgttctttcagcacattctttgtgcagcccttcctctgtgctattgcttatggtgctgctttatcccaagctacctgatttgaatccgggttccaaagaaaaggctttgtgccttttctttcttacttacaatatgagaatcataatatcacctaccttataggattttgtagcaattataggagggaatacaatataaaacaattacaggaggaatacaatataaagcccttagaagagctctagcatgtagtaaatattcagctaatgttagtaatcatgtttcatttctttcaaggaccatttcaaatccgtgtcgtaatggaagccttttatatcgcccaactcaatgtaatttcttcctctttttgtacttctttgaataatatttaacatgaaatgtcctgccttagaatttggtgtgcattcattttggctttcaccggattgtaaactgatgaacactgagtaaactttattcatcgtcatatactctgaaggatcttgtatagcacctggcatatcaaaagaacttagtaaatgctggctaagtggaaatcaattgatttttactaattttaaagtggttttccaccagttgaaagaaaaacacagtacataaagataagtaaaagaaacggacagctttataacatggatgtgactgcaggaagatactgagactgatgtcatttgaacgcacaacgtaccctgataacatcctttcttctgtgttctcccttgcaggtctgcttagtggcctatcttggcttgtttatgctttgtgtctcatatcaggttgacgaacggacatgtattcaattttctatgaaagtaagttgtgattgttctttctcttttatcatcacatagaaagaaatccaagtacaaaataaaggagtgccttcttaaggggttgcatatctgattagtctagaaattgcatttttaggcaggccaaaaaatgttttaagagggcattgatccagacctcaaaggtaatgctgattttttttttaagtcttaatttccatgaactgggttggcctggaggatatgaagtctgtccttcagtgcccttaaaaggaatattgaaaattcatcagttcaacaaaacacttggccagaaaaaaggtatctctttcagtgcccacttccatatctcgggggttatttgggatattttaataatgaagcagtctaagtgtatttcctcttgtaggtgggatcactgagacagaaaaagtacattgggcgcatccaaatgctctgtgccaagactctcagggcaaagtgggggacgggtgatgggatatgcgtggtttggcaagcgtgtgtgtctttcatttgtgtgtatcttttttctgttagggacagtgcatttggctggagccaattcaagtacacagcattttcactgcacaacagaatctactccaaagggaagcaaagacactacctttcagagtataaggacatagacatagaacttagcaatcagagctagtagaaagcaaattccttcattttctctcaactactatagcaaataatacaaagctatctttaatctttttttttttaatttggtccactaacattgttttttcttctacaagaaaacatataaaaactggatttttttgttcactacaatgagaaaacatcagacataaaagtaagtgaatgacattatttgaaagttactaaggtgaaaaaaataaggtgtgttggaagattccagtataattgaagctgttgacataaaaaagcaaagggatgatatcttttaaaatcatgctataaaaagtaattaatagatacaaacatttacattataataactaattttaaaaagctggttacacaaaatgtatgatattatcctacagaaaaaataaaagctcttaatgagcatagaaaatacaattatctatgagtggtgggattatatttgcattttgcagtttttctctaattttgaaatgttctccaatagttataacttttctaagtaaacagttaatagatactacttttttaaatgatgaagttagaattttggtggatatgccttcatttggaaattatacttttctgtctgaggactttccttgaaagaaggccagatagagtagacatcagtctatgtttactatttgtttggagaggtttgactaaacagcaaggcttggtgattaaaaaaaaaaaaaaaaaaaaagccagaaagcttagtaagaaatggcctgttaaattacaagaacttcatccagtagctgaagaacaccccaaactaggtttttattagtttatgtgaaataccctcattttccccccagatgatcccagaaaacagcagagtcaaaagcatcagcttaagagagaccccaatgccatctcagcatctgcaccttagttaaaatagggagtaagagaaaaaaaatagaaaaaaaaaaaagtcactgccaatgtcagccaggttgaggattccccactaggaagatctcattagctacctctttttttccacccgtgacaggcattggcaaatactgaggcactttcctcttctcctgaacgtgacctttcttgatgcttgctgctagctctctaaggttgcatgctacattatcttcaggttgaaagtgagcttcagcccatctccagattttccaatgacacaacaggggacagctgacttcccttatgcttctcacactactgggggggcgaaggcataacatgcatcttcatagggcgtttctcatcagcatagccgcattttggtgcccccatctcgggaccctggcctaagctttgttagaggatttatttcctcctgttgaatgcccagatagccaggacaagcaaacgggccatgatgacagtctcattgtagtccacacgtgcacacacacgcaccctccctttcgcttagagaaaatagccacgggctcttttttttttctcaagctgggacagccctctgggggttcggggattgggggtagggtcccttcgcaggccctcgatgccaccagcgcgttcctttttcctccctgggctttgcctctctgcctctgggcttggctgggcatcggctgcaggtcgcgcttcctgcctttcctagtggcctgactttctcagggctcccctggaggttcggaaacgtgtcgggggcatgtgcctgcggaaacattccagggcacgttccctcctgcccacatccaggaggcccctgggctgcttgcggcagcctcctcccgagcagtgcgctgcagaagggcccttcccgttcaggccaccggggaaggtaattaaattggagcagaaacaccctcctcccgaggtcaccgaacgtgaaagctgcaggccgggtaccaattaaaggcagcgagcgagcggagacgcgcccgggcgctgctgttacataagcgcccggggccaccgcgcctccgcccgctgcgcagcgccgggctgatgggctgacacccgcaagacagatgcctcccgcgccgggcttttatcaagatatatttgctcggattctcaaggtcatcgtaaacactcttccttatagtgtattcgtgccatgtaggtaaaacaagccacttgattttaaattacagattctaacccagaagcttgttgctgtcagatgagttaaaagccatgaaggaaaaatgccacagcgctgcagataaagcctgcaggctttaggggggatcgagtatatatttatgtcttaaaatggataagaaacttgattccgtggctttctctagtttacttggcctgatgctttccggagtgggagaagccgagtcactaaagtgtgagatagatacgcacgatataaatttattcatactcagagaagctaaggggcatggtttttctttatgttctctttgggttctagcataaacggtttaattaaaattgagcaaccactgtgtttgtgtaaatgtttacatccttcctacaagccaagaatgcattgttactcccacatgacaaaataagacaaaagcagtcgaattaatatcctcagtcctcagaactggcagctctttccatccctactaatttgcttattatttcacaaatacttaaataggctcctgtataccagacgctgttctaagttctttacagacatcaactcttttgatccttgtaattatcctgtgaagtaggtgctattatgatcatcatgccaagtttacagatgaagaagtacaggtgcacagggattgatgaatttgcccagggaccatggctagtgaggggagaacctgactccctggttcacgctgttaatcatcagccagtactgctgcgcacttgttaaatggtcttgggcacatcttttaatctctgagccaaaaagtcatcttttaaaaatagacaaaattcccattttcagcaaatggatttttgtgactatcatgaatgagtaaaatctttttcaactatttgaattatttgcagattgagaatgagggattattgtcattgcttcaagatattgcccaacaaatgttacagaaaattgctatctaaggagcttggtgcggtggctcatgcctgtaatctcagcactttgggaggctgagtcaggaggatcacttgaggtcaggagttcaagaccagcctgggcaaaatggtgaaaccctgtctctatcaaaaaaaatacaaaaattagctgggtgtggtggcacacacctgtagtcccagttactcaggaggctgaggcatgagaatcgcttcaacccaggaggcagaagttgcagtgagctgagatcaagccactgcactctgtctcaaaaaaaaaaaaaaagaaattgctatttaaggatgtatgtatgttagaggtaggaaggttatcacaagacccccgcccccaacttccatccattgttggtgataaaacaggtagagaaaactccatttggggccattctactaagcagatgactaccaggtgggaaatgatcactttaacctgggccttccctggttaaaatcatagatataccattgttcccagagcaaactgttcccagttctctgctggctgtactgggaatacagctacgatgggtacacacacacacacacacacagaacatggtcaagacagtttaatttggctcttggcaccaagagtttgaagtcagtaatcaagcctgaatatttcagaacaacccagaattgttcaaatattcttccccattggttctacaaaataaatccatatttttaggctaaaaactccaatttttgcataaaatgtagtcactgaaaatattgagggccagacgaagtggttcacggctctaatctcaatactttgggaggctgaggtgggaggatcacttgaggcttggagtttgagaccagcctgggccacatagcaagactccatctcttaaaaaaaattttttttatgatggtaccactttgtatatatctggttcccttcctccaaggaacactaatattgagtataatcattgttatgtccctgagatataagatgtttctataaactgtttcacagatgaagatacttaggttacatctgacaatcctttaaatgatttgaagaggaaaaagaatgtgtgtttaagatctctttgatgaaaagatctaaagaatccatgatactaattaagatgtattaagaaaaaaatggctttaactaattctacgctcttccagtgaccttagatagacagtcaagctgtatgtaatccctgatggattcccttacaggcaaaccagagataagcttagggcaccagcaaccagtatgtacacccacacccacacatacatgcacacataccactcaagaaaaagaaaaagtaaaaatgtaaatacagcattccaaatttaagacttgaaaacacttgaaatcatcactgtgtggaacacactcatttggaggacttttgtacacatattttgtagtgtcacatatatgttttaattttgaattatatataagggaaggtgggggaagggcatcatcttctcagagctactttcctctgaacctggaaatgactggaactaatattactttgtgaagtgtccatttaccagaattgttctctgtagagagcaacttttgactgtggtaatgtaattcttgcactaagaactatgtgtactagtctcaaaagctggggactctgagccttacctagagtctcagcaggtggaccattaagattaacatttctagtaggtgagttcaatcacaaaaatatttcttgttccatagattttattgtggccatgtcagtgaacacccacaagttttgctcagaatattttaggtgtaagctaaatccctaaattgttcagagttcccacagccctgtagcagcagagcgagaactttaaccagactttttcaatcccaaagctaatctggaggccaacagtgttcaaaaccttggtgactgaggaaccatttagagttttttcaggctcaggaatcacatggtcgttgttgggcttggggtaagtttcacaggcgatgaagctgacgttgagtcacttgacttctggagccataatttattttctcccagcaacctcctactggggattctcatgtttatggatacagtttggcaatcactacattgaatgtagtcttttaaaaaaattaacttatgctattagttgacccatcattgctaattttggcccacacagtgtttgcattacaaaaacctgttctttacttcctagtcttgtttcagtcttaatatcagaagttcttgagttcaaaataagcacaacatgtcatccagggatggctagcttgtttgggattcatctaaactgctggcaatatctagacaaaaacattccacagtccagctaatatggttgtcacaactcttgaaaagggcccaacatctggatggcaagtgaaaatgtgatcagggtttaagaactacccactaataaataaacatggagctatttccatgtcttgggtgttgtgtttctaagaagagacagcctttccatcagaaaatttctgggagggaagaaaaagaacagttttgatgaattcgctttgcaaatcatcatccaatgttctttgtaaccagaaaggttttcttctgctttcttgcagctgttatactttctgctgagtgccctgggcctgacggtctgtgtgctggccgtggcctttgccgcccaccactattcgcagctcacacagtttacctgtgagaccacactcgactcttgccagtgcaaactgccctcctcggagccgctcagcaggacctttgtttaccgggatgtgacggactgtaccagcgtcactggcactttcaaactgttcttactcatccagatgattcttaatttggtctgcggccttgtgtgcttgttggcctgctttgtgatgtggaaacataggtaccaggtcttctatgtgggtgtcaggatatgctccctcacggcttccgaaggcccccagcaaaagatctaacattcttgctcaaagttgcgagagaaagtagcacatggagtagctgaggttaaacaaacaaaaaaaaattttaaacaaagaaaggaaaaaaattgacaataaaagtcactcttctaattgaatatttttatatttttatgaaacaaaagagcatttcttcaggtttctattgtattttttttaacattcttgcagagaaagcaagatccaaattgattttgggatattaaaagttaacagaacactgaacaaggaaagaatggcatagatctatctttacagtctggagttaattcctgttaactcattttatccattccttacataatcttctttcctgttagtccagtttgatggtgtgaatggtgaatttcaggcccagttgctaaattttgtggcatcttcctctagtccttcccacctccagtcatcagccccactctgtcttggagacaggcaggaggtgggggaagagctgaatctctttattttccctggtagagacatcttcaaggcatgaaatagcttaaagagcagagtagaaacggaagaggctttgcaaaaggctagataactaacaacacctgggttggggcggcggcctcttctcttcagctcccttagcttggctccgtaagtggatcacttgccaaatgctttagatgattgcctctcaataattgaaaggtggtggtagttgtattctaaatgatgtagaaggtttaaaaataattacattatgcttctattctatcatctaaaacaaatcattaaaactaatttctagctaattgttaattataattatgctcagaagtctatttaatgagctctgactgtacttacgctgcactgtcggtgttaagagaaattactctcacaagagcagaggcctgaagattctttcttctgaaagccaagcaccacaaggaaaaaaaaaattattaatagctcaggttaaaaacacccatttaaacaaaaacaagagcatttgtaataggaagtgtttatacaaacagcacatttgtgatatgttgaaaagcatctctcttggcaaccaatctatgtttgaggaagattgggtaatgctgatgtgttccattcatgaaactgtatttgatacataatcctattattaattcgtatgcttagtcaacctaggaaatcaaaataatgttttgaagttcttatttgagcaatatggccttgacttggagggtagttttagttgttttgtttttaagtgactgtggtttaaagcacaaatgccccaaggtggggagacttctctctgtgattattgttgctattaaattctgaactgtatccatattttaaggaaggagctaaaaatggaaattcatgaaacataaatggtatcaagaactttatcagtatgctttgttgaaagcagaaattaagataataattgagttcaattcgcctctccgcattgcctattgatacactttactaatcatgaaattctaacctaaaaggaaaacattttcctgcttgtcttagaagaaagtggaataattccactgattgtgataatggtttcaatttctacacaatataaatatccagtataaaggaaagcgttaagtcggtaagctagaggattgtaaatatcttttatgtcctctagataaaacacccgattaacagatgttaaaccttttaatgttttgatttgctttaaaaatggccttcctacacattagctccagctaaaaagacacattggagagcttagaggataagtctctggagcagaatttatcacacacaaaagttacaccaacagaataccaagcagaatgatgaggacctgtaaaataccttgtgccctatt

SEQ ID NO: 36689 - DNA, 37346 bp, Homo sapiens; identical to SEQ ID NO: 36688

SEQ ID NO: 36690 - DNA, 9956 bp, Homo sapiens
agacattctctgggaaagggcagcagcagccaggtgtggcagtgacagggaggtgaggagactgggggctgagggaggtgggccagggagggctgatgtggcacagtgggccggaaataggggccgggtcttgccttctactgacctccgccttcagccacttaggtcccttccatgcttccctctgaagctggggtgaggcccctcctgccaggtgccagacttgcttagcctctctctgcagcctctttccaggttcaacattgcttttcctctcactttttttcctctggccaaagattccccttattcccatagggccagattctcaggaagacttgagggaccccctaggtgcaaggtggccaagtttgtctctctgagacatttcctgccacacagggttagggtttagtgggaatgttgggcactgccaggtgctgttttccttccttgattacaaggcaagccaggcatgcacccaacacggggctgcgagtggatgaataaagcgtgctcagcgggctgcagagggctagccaacagggccaaggatttgggagcgtgtgtttccactttcttgaaggaggcagactgactcaagctgaacttggagtaattgatggttcggagattttttttttttttttgagacggactttcactcttgttgccctggctggggtgcaatggcgcaatctcggctcactgcaacctctgcctcccgggttcaagcgattctcctgcctcagcctcccgagtagctgggattacaggcatgcaccaccatgcctggctaattttgtatttttagtagagacggggtttctccatgttggtcaggctggtctcaaactcccaacctcaggtgatctgcccgcttcggcctcccaaagtgctgggattacaggcatgagccaccacgcccggccggtttggagatctaaaggaggggtgttccccagctgtttgaaagttgttgcagctgttgggaatggcacagcagaatgtgtaaacttagaaaatgaaatgaggagaggagaatacagacaagaggggttttaatggagagaagtatagattagaatgcagcctggcaatggaaaagggacccaggcttgggtgaggggccaatacgattcctactctgagctccagcacttgcttaccacctgtgtagtaagttactcagcttctgttagccttcattgcctcacctgtgagttgaagacaatagctcctggctcacggggttgttgtgagcgtgagagtctgtgaatatacacacagggggcactccataaatggcagctgttataataacccaagcagagagcaacaggaagtcaggtgggtgatggaggagtaagggagtagcgtccaaacaatggggaagggagctggcataagcagaagctctctgaaaagaccgcagcagagagggggaaagaacaaatcggaatgagctagactggacctgacccaagcctggccacggaatatgtatggcagggtggagaggctaagtccagtgactgagatattgcagaactgcagggtggaggcaagagagagaagcaggggaaggggaagagagctggaggagtttggccttagccacaccaaactgatgaaggcagccagaaattcctaaggaaatctcaaagaaagccccatgtcccttcctgaccagtgactgcctgcgaaatgggggagggagcatggagtccgaggctgaatgtaacctcatccatcccagcccacccctcttccccaaaccccaaatcacaaggattttcctgtagttggaaggatagggaggaggtgggggcagaaacagagagagacagagacagactagacgaatgtgtgtgtgtgtgtgtgtgtgtgtgtgtgtgtgtgcgtgtgccagcacacgcaggaaagtgtataggtttttgaatagtaggcctggtctcagaatgcaaactccttaaaggaagagaggccgccataagcagcgccatatacaaagactttgaggtaagaaaataaacttggaacttgattctaccatttagcagcagtgcaattgccgttgaggcaagtttcttaacctctctgagcctcaacttccttgtctgaaaaatggggataatattacaggactgctgtaaggactaagtgagatcacctgattttgcactgtgcttgagtgctagggcaaatctaaatctggggacagggccagagcctgacaaggccagagaagtcctgtctaattaaacatgagagcaaaacacgcgtgcagcaacaccgaggatatcaatacggggactttaacccgaagtcacaaaaacagtttggatttcaaaatcaggtcactcccctggatgtttttagaatgaaatccttgaggcattgatattgacatagggatcagttctccttccaaaggtaacagcaaaaattgagatcacagcacccagacaagggtccttagaggccccacagggagctactggctatgtcccagaagactcaagaagaaaaaaggcggggagttacaagaacctagaaactcaggggtggccaggatgtctgtggcacacccctgaagggcagagaagagaacagctaaggtttgctttgcagtttgaggaagcagcccaagaaaggtaaggaaaggaaaagcagaccaaatcaagaggcagcagaaaatcctgggacagaaggagagggaaagagttgtcaattgctacaacaaaagtaccttagaaaaaaaagagctgggccaggcacagtggctcacgcctgtaatcccagcactttgggaggctgaggcagcaggattacctgaggtcaggacttcgagaccagcctggccaacatggtaaaacaccatctctactaaaaatgcaaaaattagccaggtgtggtgacacgcacctgtaatcccagctactcgggaggctgaggcaggagaatcatttgaacccaggaggcggaggttgcagtgagcagagagcgtgccactgtactccagcctgggtgacagagcaagactccatctcaaaaaaaaagaaaagaaagagttgtcaattgataggaaaggggagaaggggctaaaagaaaataagacatagcagttttgaatctccctgttccttttttttttttttttcaatctccctgttcctaaaaagtacccacagaaagaaaagttatacctgtagccaagtagagcttatgggaaagagtatgtgctctgcgagaatcacttgaacccgggaggcggaggttgcagtgagccgagatcgcgccactgcacttcagcctgggctacagagtgagaccctgtctcaaaagaaaaaaaaagtgtgtggccaggcacggtggctcacgcctgtaattccagcactttcggaggccgaggcgggcggatcacgaggtcaggagatcaagaccatcctggctaacacggtgaaaccccatctctactaaaaatacaaaaaaattagccgggcgtggttgcgggggcgcctgtagtcccagctactcaagagtctgaggcagaagaatggcgtgaacccagggggcggagcttgcagtgagccgagatcgcgccactgcactccagcctgggtgactgagctagactccgtctcaaaaaaaaaaaaaaagtgtgtgttctggagtcagcttgacctggttcaaatcccagctctatcacttactgactatgtgactcttagataagtcctttcacctttctttgcctctgtttgctcatctgtgatatgaggataaagcaacacttacctcaaaaagttcttttaaggattaaatgacagtgcatgtgcaggggcctggcatataacaggtactcagtaaatttttttttaataaaaatgctacaatgttgaggtggtcttattattattattattattattattattattattattttctgagacaggctggagtgcagttggcgcaattgaagctcactgcagcctcgacctcttggactcaagagatctgcctgccacagcctcttaagtagctaggactatgggtgaatggcaccagccaccatgcctggataatttttgtgtttctttttttgtagagatggggtctcactatgttgcctatggctggtcttgaactcctagactcaagcgatactcctacctctgcctccttttaattttttttttaagagacgggggtctccatatgttgcctaagaataacctggccaggggccaggcgcggtggctcacgcctataatcccagcacttagggaggctgaggcaggtggatcacgaggtcaggagatcgagaccatcctggctaacgtggtgaaaccccgtctctactaaaaatacaaaaaaaaattagccaggcgtggtggcgggcgcctgtagtcccagctactcgggaggctgaggcaggagaatggcgtgaacctgggaggcggagcttgcagtgagctgagatcgcgccactgcagtccagcctgggcgacagagcgagactccctctcaaaaaaaaaaaaaaaaaaaaaagaataacctggccaggttattcttttattattattattatttcttttattcttttttttttttaagaggcagagtctcgttctgtcgcccagcctggagtgcagtggtgggatctcagctcactacaacatctgcctcccgggttcaagcgattctcctgcctcagcctcctgagtagctggaactacaggcatgcgccaccacgcccagctaattgttgtatttttagtagagacatggtttcaccacgttggtcaggctggtctcgaactcctgacctcaggtaatccaccagcctctgcctcccaaagtgctgggattacaggcgtgagccactgtgcctggccttttttttttttttttttttttgagacagccggctaatttgagacacctggctaattttttgtatatttagtagagacggggtttcaccatgttagccaggatggtctcgatctcctgacctcgtgatccacctgcctctgcctcccaaagtgctgggattacaggcgtgagccactgtgcccggcctttttttttttttttaaatataatagagacgagggtcatgctatgttgcccatgatggtctcaaactcctgggctcaagcaatccacccacctcagcctcccaaagtgctgggattcgaggcgtgagccactgcgcctggcctaggttttgtttgtttgtttgtttgtttgtttgtttgtttgttcgtcttttccgagacggagtctcactctttcccccaggctggagtgcagtgacgggatctccactcactgcaacctctgcctcctgggttctaacaattctcctgcctcagcctcctgagtagctgggattacgggtgcccgccaccacacccagctaatttttgtatttttagtacagacggggtttcaccatgttggtcaggctggacttgaacccctcagtgatctgcccgcctaagcctcccaaagtgctgggattgcaggcgtgagcccctgcacccagccggttattcttaataattctctggccacctgttctagagtgtaacacatctcaccacctgaagcatttcttttctttctttgtttctttcctttttttttttttttttttttttttgagacagagtctcgctctgtcaccaggctggagtgcagtggcgcaatctcggctcactgcaatctccgcctcctgggttcaagcaattctcctgcctcagcctcccaagtagctgggattacaggtgcatgccactacacccagctaatttttgtaattttagtagagacgaggtttcaccatgttggcctcgatctgctgacctcgtgatccgcccgccttggcctcccaaagtgttgggattacaggcgtgagccaccttgcccagcccctgaagcatttctttatggctaactgtggtgcctagtgcagcagctttgcatatagaatcccaggcttgggagaaagggcacccatagccctgcttccccatgctggttggcacatgacatgaactcactaaggctttttatttatttatttatttatttatttatttatttatttatttagctaaatgaagaaaccttgttctgagaagtaacctatgtcctgtggactgtccttctttccccagattctttcatcccatttcccaacttttgcagttgctgttaccccacccctttcctctacagcatagaggaccacccagggctgaatatgaggcttcttccacaaccagttgctctgctgtggagcatgcactggggtcaggaaatgactccagggatcactgcacctcctatggtccagggctgcatgtcctcctcacattcagtttcctgctgctagtatgatctccttgcaacttaatggcagaagtggcaagaggtgggagaagccttcttagcctgcctaagggatagaggagaatttcctccctagagcaactggcaagctcctgaaaccacgaggttgcaatatgcacttggggttgggggctgggcagcaatggggtctcagacagaccctataggtcaacaacagcattggggactgctcaaggtggctcacacctgtaaacccaacactttgggaggcaaaagtgggaagatcgcttgagcccaggagttcaagaccagcctgggcaacatagcaagccccccatctctacaaaaaaaaaaaattgaaaaattagctgggcatggtgacacatacctgtggtcccagctaattgagaggctgaggtgggaggatcgctggagcccaggaggtcaaggctgcagtgagcagtgattgtgccactgcactctagccttagtgatatagccagaccttgtccccaccctctaataaaaaacaacccacagcattagggagaaaaaggagagatcttgggtttgacagaccatttattcccccaaagcaactttgttatcttttcctgagaagatttttttttttttttgagacggagtcttgctctgtcgcccggactggagtgcagtggtgcaatcttggcccactgcaacctctgcctcctgggttccagtgattctcccacccagcagctgggattacaggcatgcgccaccacacacggctaattttttgtatttttagtagagatggggtttcacattgttagccaggatggtcttgatctcctgacctcaagtgatctgcccacttcagcctcctaaagtgctgggattacaggcgtgagcaacggcgcccagcctttttttttttttttttttaatggttagcctttgctttctacagacactatctgcagaagcacagggagcctgctgtagaaagacttctgtctcagatacattgtttcatcctacctatcctaccgctttggaacggtgtgaccttgaggagttacttatctgagcttcagcttcttcatctggaaaatgggataacaggcttcctaaatgggtcgaaagaaaaaatgtatggaacaacgctcagcacagtttgtggcttcataaatgagctctctttcctgtcctctttcctctccatattccggagaggatctaagcctcagggaaaatcctggtgaccttaagcttctgacggggccatgggggagggcctcagcccagagcctctgggtcccctggggtcccctcttcacatccacctgcctgtgttttatctccctccccccgcccccccgtggccattcttctggtggggctatggggcgggtgcggcgatggaccgggcgggcacagaacaggtgggtgcaggctgggtgtccggcgctgggacacaagtgctctgtgtgtagggtgggcggaagtcagggcgtttgatctgaattctaaagggcgttgttcagagccccacaaaggtctcattgtgcagacactgggtataaagcagcatatgactccccagcaccgggcggtgatgaattgggacgcaggcgcggagcccagggaccactccccctgcacagacatgagaccataggggacctgtctgggtggcctcagggataggcgctccccaaggtaagagggctttgttgagtttgccccaggtctggagttaaggagctaggggacagggagccataggggatggctgatatcggaacaagatgggcttggcaaagaaaggggctggcgggaaaagaatgttggatgaaagcgaagaagggggatggggctcagggaggtcaagtcaagtgagtgaggaggaggagaagctggcaagggagatggggtgacgaggaaagacatgaccatccttcctttcctgctactggctcttggaagagttgagggggggtgcgcaggcagtgctatggcgcccgactttccaccccagctttctgacagcttgcttcatggctggtgttttgcaggtgtgaatgaggcaggatgaactggacaggtttgtacaccttgctcagtggcgtgaaccggcattctactgccattggccgagtatggctctcggtcatcttcatcttcagaatcatggtgctggtggtggctgcagagagtgtgtggggtgatgagaaatcttccttcatctgcaacacactccagcctggctgcaacagcgtttgctatgaccaattcttccccatctcccatgtgcggctgtggtccctgcagctcatcctagtttccaccccagctctcctcgtggccatgcacgtggctcaccagcaacacatagagaagaaaatgctacggcttgagggccatggggaccccctacacctggaggaggtgaagaggcacaaggtccacatctcagggacactgtggtggacctatgtcatcagcgtggtgttccggctgttgtttgaggccgtcttcatgtatgtcttttatctgctctaccctggctatgccatggtgcggctggtcaagtgcgacgtctacccctgccccaacacagtggactgcttcgtgtcccgccccaccgagaaaaccgtcttcaccgtcttcatgctagctgcctctggcatctgcatcatcctcaatgtggccgaggtggtgtacctcatcatccgggcctgtgcccgccgagcccagcgccgctccaatccaccttcccgcaagggctcgggcttcggccaccgcctctcacctgaatacaagcagaatgagatcaacaagctgctgagtgagcaggatggctccctgaaagacatactgcgccgcagccctggcaccggggctgggctggctgaaaagagcgaccgctgctcggcctgctgatgccacataccaggcaacctcccatcccacccccgaccctgccctgggcgagcccctccttctcccctgccggtgcacaggcctctgcctgctggggattactcgatcaaaaccttccttccctggctacttcccttcctcccggggccttccttttgaggagctggaggggtggggagctagaggccacctatgccagtgctcaaggttactgggagtgtgggctgcccttgttgcctgcacccttccctcttccctctccctctctctgggaccactgggtacaagagatgggatgctccgacagcgtctccaattatgaaactaatcttaaccctgtgctgtcagataccctgtttctggagtcacatcagtgaggagggatgtgggtaagaggagcagagggcaggggtgctgtggacatgtgggtggagaagggagggtggccagcactagtaaaggaggaatagtgcttgctggccacaaggaaaaggaggaggtgtctggggtgagggagttagggagagagaagcaggcagataagttggagcaggggttggtcaaggccacctctgcctctagtccccaaggcctctctctgcctgaaatgttacacattaaacaggattttacag

SEQ ID NO: 36691 - DNA, 69636 bp, Homo sapiens
gaggggcgtcttgggcctggaggtcagtgtggcctcgcgtttgtcttcggtgacgggaagtgagtttcttgtgtagacgtctgtaaacgatcctcctgccgtccctgttcggcgcccgggaccctgccttcccgcgtggccgcaccgagacgagggagcctgtcacgcgctctggcgctctcctgacctcttaaggctctgtcagtcttaggtaacttgagtcagtaggtgggtgtagacgcctggtcaattcctgggaagcacagttcccctattaaccccttgtcataaagacgattttttttttttttttgtaaaacaaaatctgatgacaaaacaatgcatgtttggcatagagaatttagaaatgtacaggcaagtccaaagcaaaagtcaaaatcacctagatgatggagttatagatgttttttaatgacagcataggaatttggcataatttaggaagacttacattgtttccttttatttatttactttttttcctgcatcaaagccatgttgaatatccttgcagatgaatctttgaggtcacccctgactgtttccttaggataaattcctacaagcgaggttgcagggccaaagcatatgctcactttgaggctttctaaaggtagagggaaactgccttccagtaagtgtcccgatacttggcccgcattggaaattctcttttttcttaaaatttttttgcccattttattgtcaaaaattggcatctttaattgtattcacttcctttttagtaggaagaatagactttttcccatatcttgagtgccatttgtccttattgtgtgatttgcattttcctgtcttttgtccattttaaaacttgacattcatctttgtaaaaatgggttttgtaaggacttttgatgcttgaaaacttggcttgtgatatacgttgcaaatatttcctcaatttgtcagttacctttaattttgtttacagtgtattttggtatttgtgtagagtcaagcttattacatttctctatagtttctgcatttggtttttatataaaaggagaaacgggtgttttttttcaaattgactttaatcctactttggtagaagtgggttaggacaagctttctctccatatcaccatttcttcctctagaaatgcatgacccaccctgagttttggtgggccatgcatttctagaactccttaggtagggaattatccgtataagatgggtgccggttgtttttgctggtggtggtgggcggggcaacatctccaggtaggcaaacattagacaaatgtcactctagacttgacattatggaaagatgggctgatgcttggtgggtggtggtggccccatgacagtaacgagagcggagttttgccattgcgggagcatccaaccctggagctcatgactggaggaattgaaaggtagagtttcctgagaatggtttcctcctcttttctaccagcttttcccagtctgtagacatgataagtcactgcaaatctgcccttgaatctttctttgctttcgcttttgcttttttttttttttttttttgagacgtatcactctatcgctcaggctggaatgcagtggcgccatcccagctcaccacaacctccgcttcctgggttcaggtgattctcctgcatcagcctcctgagtagctgggattacaggtgtgagtcacaacacccggctaattctttttgtatttttagtagagatggggttttgcgatgttggctaggctggccttgaactcctgacctcaagtgatctgcccgcctcggcctcccaaaatgttgggatttcaggcataagccaccgtgcctggcctttgcttttgctttcgaaggggtgttcttttctgtgtacacaatggaaggagaagagccatggcctttcactattctggggccatctccatcatgccacataaaaagcatagcctttatttctctatattaggttcctaggttcctagggatgtcataacagactaccacgaacttaggggcttagaacaatagaactttatcttctcacatttctggaggtcagaagtatgaaaccaagttgtctgaaagtccatgtttcctctgaaggctcttagggagaattttttgagtcttccagcttatggggactcctgctattccttggcttgtggcagcaccactccaatttctgcttccatcttcacagggtgttcttctctgtgtctccctgtcttgtcttcttataaggacaaccagtcattggacttagggcccaccctaaatccaggatgatttaatcacaagaccccctcaactgattacatctgtaaagactctatttccaaataaggttacatgctgaggtttggctgaacatgaattttggtgaacaatattcaacccactacagttattatggtaatcatttccatcattctacataataaagacgtgtctttatttgtcattttaagttatctgtaaagttatgtaaatcaaaacatatcatctggtatcatttatcatgagatcatctgggggtctctatgaagtttgtagcccagtacctcatgtctttaaatcaaaattaatcaaatcaaaaagtgatgttatttgacttgttaaaatatactccaacagacggacaaaatgaactcctgtttcctaaaatgagatgcaccaaaaacagaatgtcctactcgggaggctgaggcaggagatgaatgtgggaggtggaggttgcaatgagctgagatcaagccactgcactccagcctggtgacagaaacaaacaaaaaacaaacaacaaaacaaaacaaaacctccagaatgtcacagccagaaggatgaggggttagttacgtatttttgcattattaactgctattaagtaagcagaaaccagcttcgaaaaagcatagccaacacaacttcagctggaaaatttccaactgaccccgatagactgcctgatgccagccaatggaaacattccctccctcagtatgcgcccccacccccaaacgccttgcagacctactacaactccagttggacaaaggactggtcttataaacattctttattgataaacagctgcagacctccagccaattttggccagcttatagaaattgcacataaaatgtctttgtgccctatagttcacctgttgatataaagagccaaattccatcccattttaatgctagaactccaccccaaggtgaacatggaatgtatgatacatatatgtttacccactgcacacatgcctgaatttcctcataaatattagtagatcctctgcaaccttgctcagtatgtatgtaaggctgactctgtaagacacagataccagctccttcctcccttctgcagcatgtgcatttttggttttttctgtaagctgcattccccaatctgcaggttgtatctccccctaaaaataaaatctcctttccttcctccgtggatctcctggtctttgtgaacagacataaacagcaagcactggagatgttgaatggttggctgcttgcatcttcactaaattatacaccttctttctgaagtggattttgtaagtcaggggttcattgagctttattttaagatgcatttggaatgttcgctattcctgttaattatgttgaagctcgtttgtgtcattagtgtaataatacattagaaggaatctttcagctggagttttcagatttttaatttgtacatttttatggtcatttcgaaaagaataaacttaaaaaaattcatagtgaaaagggggcactaggaatttgagggtagcatctcaggagcttctcatgtggtgtggagaggaatgggtgaggcttaagtcttggatatgccatttcctattcccatcatctctagttctgtgtcctcatggtgagtgggcataataatggaacacagttttagggttcttatacaggttaagggagtggcttatgcaaagcacctagagcagatctggcacatggacaacacctacaaattgttagctgttatttgagtaggaaattaatttctccccagggtttgcagatggaggaggtgtcattattgagggcagttttcacctgatataatcaagagatgcgtattctctagagcacctgagaatccagctatagtttatgctactaacttacaaagtcattagaaaatatgcccccactttcttcaagtaatatttggagaaatatggcatgcttatgtggcagactttaaggtgtgaaaatatataattgtatgaaaaaataatacgtactgtagaaattttgaaaatgcagaaaagaaaaactgatctgtaatccttggtgtgctttaaaataaaatttataattctactgacttaaatttggggaaccattaatcatcttcatcaaggaccttatttttggagcagctaactttgcatgttgaagccaaaagttaaatgttggtagtcacctcaatcattcattgtgatgtaggggcatttaagcgatattccaggaactgggatattccggggactgggatgtcttttctcgttgcaggcacctacctgagggggtgggaaacatgcctctggggctctgggactcaggtgaagagggagtacagaagcctgggagattcctctctgcttcggaacgtcggtgccacccaatccatgatgggcagcaggggattttaaaaagggagccggagaacagagagagagagagacagtaagagactcagttatctaagctaaatatcccccaagtgcttcttgaaaaactagccctttgtccctaatgcccttgatcttgattttgaaatctatcagaagaatttgcataactggcatttgggcttctttgctagattttgtattcctttaatttaatttgtttgtttgtttgatttggttttgttttagagataaggtcttgttctgtcacccaggctggagtgccgtgggtgtgatcatagctcactgcagcctcaaactcctggctaaagggctcaagggatccttccacctcagccttccaagtcgctggaaatacagatacaggcgcctgccaacatgcctggctgtttttttttgtgttattgttgttggtaaagtcgtacctcagtatgttacccagactggtcttgaacttctgggctcacacaatcctcctgccttgacctcccaaggtgttgggattacaggtgtgagacactgccccggaccttctctaacttttaacacaattcaaaatacctatataaatattaacatgtataaacacaaatatatataaataaacacaaaatacctatgtaaacaaagagcctgttataaacagattattttggttttttccccaagcactttaaaatagttaataaacttcaagtcagtgacaagtaaataaaatagtgagacaattggcttgttgcagccatgagtattgagaagccagcggctatttccctacctccctggatgtcagtgaaactttagatggcccatggctggtcagtttctgttctttaggagaaacaggtgggaaagagagcacactggaaacagccactcttaaaggcatttctattgtatgacagtttacttaaaaaattttttttaacctgccaggaaaaaaaacaaagttgctctttacttaaaggcctctgtggctattctgacccttccagtttatttgtttgccaaaagccctttaaacccagcctcctcctagactgaggtggtgttttctgggcttttccagctcccaagagctcctccctcacttctttcgcctcctgctgctctgttaccggggccccacctcccttggccccaaggcatctctgcacaggtctccgattggtgcacagcacagcctggccttttagggactgttgtcgcgcgtttaaagtgatagggaaagggtccagtggctgcttttatcgaccaatcaaatattttcctgacagatcccaaaatattcctgggccaatggagggaggagcccaagatgcctctgctgctccttggagagacagagcctcttaagttggagcgggactgccggagcccagtggacccctgggctgctgccagccccgacctggcacttgcttgcctgtgtcactgtcaggatttgtctagcggcgcattccctgacaggggtgtgttggggggagtcctctttccaactgtcgaaatggttatcaaagtgtttgttgctacatcttctgggtccatagcggtaggtgtctggtggactctttcttcctatactcttttctgaataacttagggttggaaatatggccaacgttggccttcagtttcttttttgcgtgtagtcagctgtggctctgcaataagtatgtgcgccctttgctttctgcatttgatttcatagtgttgaaaaagcatggaaagggtgtaatctggatggctgggtgtgaaaagggattcgagtaaggaggcgtgcttgacactagaatttttaacatgtgatttgtgttgtgttgccttgtgaatatcatagaagcagggacttttttgtatgtgtttctgccattcattctgcaaggcttaaactaatttaaaattgtaaataaatgatactttgtgtaacactgtttggagcggatgatgaaccagattgctaaaatgactctggggtgtaatcacttgtatatgccatgtaatgatgtaaccatactgaaagtgtaaagttagcatgtgtaatccattgtttgaggaaagtgatgtcacagtgaccagagcagacatctctcaggccacagttataaacactccaggcattcagacggccccaaaataagagctgaaagccgaccttcataaccagtgctttgtctaattttcttgagaccatctacctcttcaattctggccttcattctgtgcaagctggacctgccgtaagaaataggggtgatgaagtgacacatttctctttggaaatgggtcagactttgattttaggcttgaacctatatagtgtctgtctgtctggaactgatatttcgaccagcattttagcagcagttaggaaggctgtggagagaaaaaacagttttattaaacccaagagttagagaccagcaaggcggctgttccttttatatctagtttctggaggatctcaggtttcggctgggatttcagcagccactctgccagaaacagtacccagagtaagccattggctggggtgacagccccaaaggcagccgctgagtgccaccactcccagccccgaaagttcatgaggtttccagagagggtgagaagaaagcaagagaaaatagcttggctgtcccttttgctaagtacaactgagcagctattgttttagtgatctctagaacaaattagccgaaaaagatgagaacacactccaaatgtgaaactctgcgaaatcttttgtggctattgatgactgctgaaactttcagttgatctagaaggagtaaattttttggctattggataaaaaaatttttttgggggggaaaatggttttggtgggctctaaatacgttgttgatgctcattgctaaaaactttacctcttaccagccagtcctctatatattctgtagacctggtctacatattcttcagaagacaatcaataagttaatggatttttaaggtttatttgatgtcctgtgttcttgaagtttgggcccataatttagttagctttggatgacctggagaggcaatgttcatcccagggtcttggaaaagccattagttttggttccctaagcaaatgtttcagtgccacttgtaactgtatgaccttgggaaagttatttcaccttgttaagcctcaatttccttgtctgtaaaatgaggataagaatagtgcctacatcatagtgttgtcatgaggactgatgaaatgatgtgcgtgggtgccccgcatggtgtcaagtgtttatcagcactcaagaaatattctaatgattagtgaatgttatttatacttactagctgctattagttaatattagttgctactataattgttattattagttagttaatgaatattaattaggatttcagttacaattattagttactataattattagctaatattatttagtagatcagggtctatgatcagtatgtgtgagaagaattttccagaaccacatacatgagagaatttctgccttagccgtaagaatgagaattgattatccctgcgatgtcagtgctaatgatttttcatgggtagagaaatttcactcaaaacttcttggcaggaaaaccctagagtggcttcttgtgcccatgctactgtgtggcagtcagtctgccaagcctttcctacttatttcttcagcctgtacatttaaaaaatggattcttgcctgatacctcatcagtaagggcattctgacttctgttggttgaatgaaataaatgagaaaggaaaagcaaattgtagtctccttatgaggaattaaatacatgcagctgtgtattacatctcaattttaatagttgacttcaaagagctgtggcacattttaccacgttctggacggatttgggttaagagaccctggggagcaggagagggcgcgtgacttcttctaggaccctcctctcttccagaaggccacagtggggcaggggggacaaagggagagaggacagtccctgccgtctccaagatgcacagcccctggaaccgatctttaaggacagaccctcatagtggctcttgggcttcacagtcctttctccattttgattgacagtgtaaatatcgtgggaaaaatatgactcttgaattagatcgttgagtgtcattcttggaaaattcattcatttattggagcctcagcattgttataaaatagccatccaaatacctacctagatggcccgtgtgacagtgcactgggatggtagtgtgctatgtggtgcctgacagtgcaggttttcagcctaaggtacaaaatgcttttccatgcatcatcttcttcagttcccaccaaaacactgtgaggaaggcattgttacatccagtttgcagatgaagaaattggagatcagagcccttgctcagaaagcagccttccaagctaggatggaaacacaggtcgtctctggctcgaatccagtgtgctttatactacagtacagtgatctcagttggaaagtctcctaactgtacaagacaataaacgagaggtgccaagtgagtggcaataagaggtgctgctgtcagatcactctgacacagtctagtagctaacagtgtctgggtgactttaggacagagaacaatactttcttataagtaaatgtaacaggataggaaaacggagctctctgagtcttcactgaggtcccaaaggctccaaacaatgacacacaccccaaatacccccagatcctgtagagccactactcaggacagacagtgcagcctggggggccagcatgggccatggcaccctggagggtggagaaggggcaaagggggagaggtgaagagtaggagtgtgtccatgatgggaactgatggggtgctatgcacacccctccctctgggccataaagagatggactcttccaagagctgatactgtgtccctgggagtcagctcagcaggcgctgtgaggagctgcactttgcaggcccacaggagctccttgatcagggaccctgcaagggggaggattttggaggagaggggccccatgctagagccggggcacaggggtgcagcaagacgacagtgccggccaggttagctcatgtgctcactcccctcttccctcctctggcctggatcctaagacccttttctgcaggctcccagcccaggcagaactcaagtgccctgaatagcgtgataagcaatgcactgggctctgtttaaatgactagtgtttgggggattacagggggcaaacagatttcatttttcttcttctttttctccttttttggggatgagggctgagaaatggcacttaacacaatgccatgcgtccaacagtcccgcaatggacctggatgcaattgcctgtcttgtgaagcttaatcgcaagcatggtcttcccctcccattgtctccatctctttttgcctttctaatagaagaaacataagtcaagacttttggaaatatttttcatctattccaaaattatggaataaaatatagcttttttcccatcccacatcaagccctgaggcatggttgatagaaataatgttggtgaggtggcttggacctgggccagctgcctcccaggccaattcgtgctcccaagagggtatcttagaaggctttggagaaagagcagacaggggtttggaccgaataaaggagttgccttctgaatagttaattaaaagtaaaactgcctaaaatgaaggcatctctactctttgaaacagcaaagtcgtctctgaaaagatgtaagggaataagtgctttataaaatggcgtgaatagttatggacaggttggaaaagatgtgtagagaatgcgattaattaaaatgatgatttagtccaacaacctgtcatcaggtctgatgggattttgtaatgttgaaaattcagccgtgaaactgtggaatttggagcagtttccatgtggggtagcagtttccgtgtggggtagcagtttccatgcggggtagcagattccatgcggggtagcagatctagtgccaggcatccacggcacagctgtgggaggagggcaccttggtggggagcacgcacctcctcctttggttctcataggcctgatcctggggaattaccagagtccatatgccagaagtttaagagaaattccatcattccacacctttctgtctatctatatttatttgtccgtgcttgccccaaactgcagtacctttgttggcctgagtcttacagattgagtaagtgttgtgttgtggcaaacagagcctttaatttattgatccactgtctttagttccattgtcttttttatattgatggtataagtgttaattaaattaaatgcgtgattaccatttatataagtttatatgtgatttgtatacttatttatataaaattttataatatatattgactgtcaattttgttttaaaaattaacatagtaaatataaaatttaaaaaaattaagaattacttgatattaatttatattatataccatatataatcaaatcaccatcaagaacaaattatatataaatcatataaattatgtatattatgtaagttatattacattatattatataaattatataaaaatcatatatagttaaatataaaaatcttattatattatattgttatatataaaagtcatatataagattattataatatagttacatatataaatcttattatatataagattattatatattatatagttacatctataaatcttatatataagattattatatattatatagttatatataaatcttatatataagattattatatattatatagttatatataaatcttatgtataagattatatattatatagttatatatataaatcttatatatatgattattatatattatatagttatatataaatcttatatataagattattatatattatatagttatataatttggtcttggaggtgatttggttctagggcttaagtatccagatttgtcttacctttccttatattatgaaacacccagccgggcactgtgggtcttgcctgtaatcccagcactttaggaggctgaggcaggtggatcacttgagcccaggattttgagaccagcctgggcagcatggtgaaactccatctctaccaaaaattagccagacgtggtggtgtgcgtccatagtgccagctattcgggaggctgaggtgggagaatcacttgaccctggggagattgagactgcagtgagccaagatcgtgccactgcgctccagcctgggcaacagagggagaccctgtgtcaaaagaaaaaacaagaaacaaaaaaaacaagaaacaaaaaaccccaaacaaagaaacaccctaacaccctatacatgagtcattaaatttgtcaaaagtgaataaaatagatattttggtttacatgtctctaagaaaggagttgagtttagttaaaagagggtttgcatcgagatattagatttgggatagacatgtaccttttacagcatttgtttgaaaccctcaaagtgtagtccttcttgtaaacaaggcacatgaaaatgacaaggggctcttgtgctctgtaaaacatttttgtgagttgtttttatatgagatggtattctattcagaagacttttaaaaaattgagatattagatactgtcatgtcaaagaaaatttttaaagtttatttatttatttattatttttattttttttaaaatttgagacagagtcttgctctgttgcccaggccagagtacagtggtgcaatattggctcactgcaacctctgcctcccggattcaagcgattctcctgcctcagcctcctgagtagcgggattacagatgcgtgccaccacacccagctaatttttgtatttttagtagagacaaggtttcgccatgttggccaggctggtctcaaactcctgacctcaggtgatccacctaccttggcctcccaagatgctgggattataggcatgagccactgtgcctggcctaaatctcactttttttttttttttttgagacagagtcttactctttcacccaggctggagtgcagtggcatgatctgggcttactgcaacctctgcctccggggttcaagtgatcctcccgcctcagcttcccaagtagctgggattacagacatgcgccaccacgcctggctcatttttgtatttttagtagagacgaggttttaccatgttggccaggctggtctcgaactcctggcctcagatgatctgcctgcctcagcttcctacagttctaggattacaggcctgagccaccgtacccggccaagttttaatcttactcttaataaatggccatacttttgcctcagtatcctgagtgtattctatatccatattgtaccaattagttctgtggttttttttttttcacccaaacaagcagtttaagaatctgttcacatgaaggacttggcacaatgtcttgtgcaaagtagagagtcaataaataactgttgattgattatttgttttattaccctttctttctcctccttccctccctctctccctacctaccttccttccttcttccttttttctttttctttctttttttttttgagacggagtctcactctgtcgccaggctggagtgcagtggcacgatatctgctcactgcaacctccgcctcctggattcaagcaattgtcctgtctcagcctcccaagtagcttgcactacaggtgcgtgccaccatgcccagctaatttttgtatttttagtagagacagggtttcaccatgttggccaggatagtctcgatctcttcactttgtgatccgtccaccttggcctcccaaagtgctgggattacaggcatgcaccgccatgcctgggcctttttctttctttctttctttttctttctgacagggtcttgttctattgccaaggcaggagtgcagtgatgtgatcatagctcattgcagcctccacctcccaggctcaagtgatcttcccacctcttgagtagctgggactacaggcatgcaccaccacacctgtctaatttttaaattttttgtagagatgtggtctctacaaaaactttttgtagaggccccatctcgacaaaaatttgtttgcccaggctggctggtcttgacctcctgggctcaagtgattcttccactttcagcctcccaaagtgctgggattataggtgtgagccactgcacctggtctgattacactttttgtaagtttctccctgtggttattaaaatggggtccacacagtctgctgtaacttatttgccagtgtttataaaagatggcatcatacattttcaggagtgaattctttgaagaaagaaaattgtaattgcttttgtaattgtttatggggaaggagttctaagtgtgagagatggccacgttggtaagaaatggctactggcagatacagtcattacgtgttacacaggtagagaaaggacattcaaccatgttcccttaggtgtggctgcactgaactcagagaggagccaggtgtgagtaggaaaggaggaatctgtgggagaaaagggttgttttgttgtgtggcttttttatgtgctgggagaaacatcctccagctttttctagcctctgcttgtgcccttcccctccagtagtctctgtgtgagctttttaatctcctgtaatatttctaaagctacttttagttcaatgtgactaatactcttattttcataactgaatgaaatgcattttagtgtgggtatacttgatatttgaatttcatagtaaagtatcttttttattttattattttgctttattttttaaaaattaaactaaaaaattttttttgagacagagtctcactctgtcgcccaggctggagtgcagggcttactgcaacctccgcctcccaggttcaagtgattctactgcctcagcctcccgagtagcagagatttcaggcgcatgccaccacgcccgggtaatttttgtatgtttagtagagatggggtttcaccatgttggtcaggctggtctcgaactcctgacctcgtgatccacccaccttggcctcccaaagtgttgggattacaggtgtgagccaccgcacccagccttctattcttctttaaacaaaatttttattttatttttaagagacagggtcccgctttgtcacccaagctggagtgcagtggcatgatcagcacactgtaacctcgaactcctgggctcaagcaatccttttgtctcagccttccaaaatgctgggattataggcgtgagccacattgtctggcctcttttttctcttctttcccttttcccaatcccttgtcttcccaattctgacttactttttggccattaaagctttgcaaaaaattaaaagtattttgaagactgcaaaaaagatacgagagcatctctattccaattaggtcatgtgaaaagacaacattacaactcatctagttttgtagattttttttttttttttttttgcgacagttttgctcttgttgcccaggctggagtgcagtggcgcaatcttggctcactgcaacctccacctcctgggttcaagcgattctcctgcttcagtctcccgagtagctgggattacaaggcatgcgccaccacgcctggctaattttgtatttttagtagagatggggtttctccatgttggtcaggctggtcttgaactcctgacctcaggtgatctgtccaccttggcctcctaaagtgctgggactataggtgtgagccactgtgcttggctgtttgtagatcttaattggcttttgtgattccagaatctggcagcagtcagaccaaaaaatggttcacaaagctctgccccaccacacgtgcaggttatatttatcgccagagaaaaggaaataacattcagaaaaaggatgtgaggtacagacagctaggttgggttataactcagtatttgccttatttgaaagtggtttgaacagttggccgcctgtgattggctgaagcttgtctgctgtcaatgactgaaactcagctctggttacaaaggcaaatttctagttaggttttcagtttgtttatgtactaagctaggttgcagttcattacctaggactcctatggagtcttctaaagcccaaatttagttttaacagttgattatacaataattaattaattattttatttatttatatttttttgggatggaatcttgctctgtcacccaggctggattgcagtggcatgatctcggctcactgcaacctccacctcccaggctcaagtgattctcctgcctcagcctctcaagtagctgggattacaggcgtgtgctaccatgcttggctaatttttgtatttttagtagagacaaggtttcaccacgttggtcaagctggtgtcgaacctctgacctcaagcgatccacctgccttggcctcccaaagtgctgggattacaggtgtgagccatcgcacccagcctgattatataataatttaagcattgatgatactaaaatttcagaatttaaatagtcatttggttgaccctttataacaaagaggtgtgattctattattttccttgtttgaatacttaacaaaattatttgtgttgtatagtataactagaggaaggatttaatttttgtaaatgtaagcaaaatatttttcataaacagcctaatatttctctactcttgaccagattaggaagaaacagcaagaagtagtgggttttttggaagcgaataaaatcgactttaaggaattagatattgctggagatgaagacaacaggaggtggatgagagagaatgttcctggagagaaaaaacctcaaaatgggattcctttgcctccccagatcttcaatgaggagcagtactgtggggtgagtatgtgcttctattaaaaatcctgctgtgtgtgtgtttattagaaattttctaaagcagattaagtttgagtcagcatttgaaattattcacaactgtcaggtcatggtctatttctgccatccaatagctggatggtagatccattatgaataatcaatatttaagatttagaaaaggacagaaacaatatcatgatgattcagaagttttggggattatttcaggttctttgttttattttgaagaattgaggtcacatgttcagaaaatacatacatttagctaggaattctgttcagccttgcagtgtgcacacacgtgtatctgcagaggaacatggtaagttttctctgtcacccaggctggagtgtagtggtgcaatcatggctcactgcagcctctttctcttgagctcaagcgatcctctcacttcagcctcttgagtagctgggactgcaggagtgcagtactccacccagctaatttctaaattttttgtagagacagggtctccctatgttgcccaggctgctctggaactcctggcctcaagtgatcctcctgccttggcctcccaaagtgctgggactacaggtgtgagccacggtgcccagcaagttttcacttttataaaattgatttgtagaaataaagtcttactatagatacaagatacatttgtgtaactttaattagtttgaaaactgttctgggcattttggttataacaacaattttgttttatacatttgatagttcatttcaccatgagatcactttttttccccagagtttatagatcatacttaataaatcaagtcgttggaaagaaatatttttaaaaaaggacttcagaatatgagaactgaaaattaacttagaggtcatctaagccatctagggtttttgcagatgaggaaatgagagctgtgtgaagtagagggaatgtctcagcgccatgcgcctgggactgctggagccaggtggaggaatcttatctgacctcttctcttgctgcacagaactgctggttctttaggttacttttttaaaaaattgtttactgccactgtctgttttataaatttataaatgaatgtccacactcattcatttacctattgtctgtggctgatttagcaccatggcagatttgaatagatgcagcagaggccatatgatccacaaagccaagaagatttactatctgcttgttcacagaaaagtttgcggacctctcatttgaaggatgaattgtgtagttgttgggggcttgtattagcttcctagggttgctgtatcaaactaccacacacacggtggctaaaaacaacagaaatttattctttcacagatctggagactggaagttcgaaatcaagatgtgggtgcagggttggttccttctgaaggctctgagggagaattcgttctatgcttctttcctagcttctaaagcttgccaccggttcttagcactccttggcttatggaagtgtctctgatctctgccctcatcctcacatggagtgtgtctctctgtgttcacatggccttctcataaggacagcagtcatgggaatagggcccgccctcatccagtatggccccatcttaactaattacaactacaaagatcctatttccaaataaggtaaccctctttttttttgagatggagtttctctcttgtctcccaggctggagtgcagcagtgcagtatcagctcactgcaacctctacctcctgggttcaagtgattctcctgcctcagcctcttgagtagctgagattacaggcgtgtgccactacgcctggctaatttttatagttttagtagagacaaggtttcaccacattggctgggctggtctcgaactcctgacctcaggtgatccacctgccttggcctcccaaagtgctgggattacaggtgtaagccaccgcgcccggcccaaataaagtcactttctggggttccaggctgacatggatttatgggagacactgttcagtccagcagagggctatacaaacttatgtggttgtgttagcattcttcagaggcttaaccaaaagtcctgtgggtgtggaagtattttcaaacaatcttaatgtggtagcatatattaaggtgaacatgtggtccagttcaaattcctcctcacccctcgctcctgtcctacccacatcttccccaccttcctttacctgacccacatttctcaaaattgtggctcttgttggataaggaaagggataatatttttttaggggggatggtggtgatgaggaattttatttcttataaaatcatttctattatataattgaaaaattaatatatatgcccactgaaaaattaaggtgattcaaaatggtatctagtgaaaattattcccctccatttctatttattatttatttatttaagagagagagtcttgctgtgttgcccaggctggagtgcagtggtgcaatcatgcctgggtaatttttaatttttaaaattttttgtagtgacaaaggggtctcactgtgttgcccaggctggtcttgaacacctggcctcaggcaaactcctggcctcccaaagtattgggattacaggcatgagccactgtgcctggtatcccctccaatttctgacccctgtcattctggctaccttcccctgagccaggctggctctgtgggcctgtgatctgggataccacacaggaccccatccacaggagggctctgtacttgtttaatgttctcctattgctgtcttgaaattctcaaccatttttgaaggaagggcctcatgttttcatcttgcactggctcttttgaattctgtagctcgtcctactctgaggcagccagtgttggcaatttcgtgtttgggtttgcagaaattttctatgtagatttacaactgaatgtcatttaaaaaatcagagtgtatcatatacgactttgttttcttgacttaataactgcatctcagagttcacagtatagctgcccatgcttattttatttgttttaattttatgatagggtctcactgtgtcacccaggttggagtgcagtggcgcaatcatagctcactgcagcctcaaactcctgagctcaagcgatcctcctgtgtcagactcctcagtagctgggactacaggtgtgcaccaccacacctcgctaatgttttttattttttgtagagatagggtctcactgtatttcccaggctggtctcacactcctggcttcaagtgatgcacccatcttgcctcccgtagtgttgggattataggtgtgagctgctgtgcctggctgccccatattttaatgtctgcaaaatgttccattgtgtgtgacaattttttggcttggtcctctaatgaaaaacattcaggttgttttcagcctctcccccttacaaacagtgctgtaggaattatctttatacataacagatctttgtatccggtatgagtgtgtatatatatatgtaggataaattcctggaagacatctgagttaaagtacatacgcgtctcacattttgatcaatattggcaaatgctcctctgttgcagttgtactagtttacatttccaccagctgagtttgagagtggctagttctccgtgactttgacaacactgtgcatagcatacttttgcaactttgacaatctgtttggtaaaacatgaattctcattgcttctacctggatttctttctttatgggtaaattgaacatcttttaaaactacatttataaattatctgtgctttttctatgatttacctatgcatattctttgctgttttccaattgggttataggtaatgtttactggtttgtaagagtctttgcatatgaaagaaagtagccctttgaccatatgtattacttcattctcacgctgctaataaagacgtacccaggactggataatttataaaggaaagaggtttaattgactcacagttcagcatggctggaaaggcctcaggaaacttacaatcatggtggaatgggaaggaagcatgcccttcttcacatgaccacagcagagagaagtgcagagtgaagatggggaaaagccccttataaaaccatcagatctcatgagaactcactcactatcatgagaacagcatgagggaaccactcccataattcagttacctctgactgggtcccttctatgagacagattatgggaactacaattcaagatgaaatttgggtggggacacagccaaaccatatcaccatagatgttgcaaatatttcctccacatttcttacttgtcttttgactttcaaaagggattttttttttgcaatgcagaacttaaattttttttgtgtagccaaatatattaaatcttttctctttgtgattcctgaattcagatttttgttaaggaaagctttctgtgctcagaaattatcagaagaatcatctcatgtttccttctagtacttttccagggaaaataagattttaaatgtcttagtttgcttattttaatcatccttttaaatttaagtgagttacagtagacacaagattaatgtaggtgtccaccaatgttaactcctaggataaaattactacagttattttctgctataaaaaagaagatttcaaagtcatctcttatcccagtttgctgtgatctagtaatttttttttcattttaattgcggaggagaaagaaaaggttttccaaataatgactgctatttttaagatgtattttcctataacaaatatggatctaatgaaataaatatacaaattatttcatgtttaactgtttctattctttttatttctaccttcagagaagtatttgtagtttaccttatgagaagctttgcttaatttgcttttctgtggtctatggacacacttacaaaagtatattcatgaagaagagggctttgtttccagaaagtaggtaaaaatgattatttttatttgtatgctcagattttaaaaggagactcaaaaattctgaaggatatgcaggctcaaaataatgttagtctagatagtcaatgtctctttctacatgattaaaatgtatataactattatttaagtggtctccctggcttctgaagattcttggtcagtcatatgccatgcctgatgatggcagcaggtggaaggagaccccagaggcaagcagtagatttcattgggcagtgaggggattggacatcaagggtagtcctcagtgccttcctgcccctgccagtttgaacttctgctactctatgcagagcaaatgaagatattatcctgagagccagggcagacaactgttagattgagaaaggagacaccacactggaagccaggcacagttgaggccaggctccccgcctgacagaggaatgtgaactggaaagagcagacacatctcttgatgacaagttggcatctgtgcattttagcccaggtaagggccggagtgcctgcctgggaccaagatagcctgggcctgactgaacacaaacaaagaagacctagatcgttcagcacagaggtgcccatttagcagaggtatgagtgtctccgggtactcagggctgtaaggaaacacaggatgcaaacccagttagggtggggagagggcttctcaacatatcgatgttactgaacaaactatgttatgttcctaaaatttattctgaaatatgccgtatgtgataagaaatacataatttaaaaaggagtgatacagtgagcaaccattgtatgcactatccagtttaagaaggacagtatactattaccagaaatgtggaagccctctgtgtgcctctctccctgatcccatcccttcccctctgcaccagtgatagtcattggaaagaaagggtcttgctttgtcacccaggctggagtgcagtggcacgatcatggctcactgcagcctcaacctcctgtactcgatcgatcctcttgcctcagcctcctgaatagctgggactataggtgtgcagcaccacacctagctaaattttgtattttttgtagagatggcatctccctatgctgctgaggctggtcttgaattcctgggctcaagcaatcctcctgccttgaccccccaacgtgctgggattactggtgtgaatcactatgcctagaccttatttttcatttaaaaacctttgtcttcttttacctccctgaatatgcacatagtttactatgacacatgtgttcccattgcaattccttattcccaaacaaatataattttcttttagagagcctcttgttcatctgggaagcttgctaggcttgggttcttctctgtgggaaatgtttcaatttccttaatgaatggactgtttaggctttctactttttcataagttggttttcataattctgtttctataaattctaagatgtctagttttttttttttttttgaatcagggtctttgtctgttgcccaggctggagtgcagtggtgccatcatggcccatggcagccttgagcttgtttttaagttttaaagtctagtataacattttttttcaaaagtaagaggaaggtacagaaatttcccatgtaccccctgttcccacacatgcagagcctcccccattatcaacatccccccaagttttaaataagatattcttaagacctgtttaaaataggtagttatgtcttctctttattcctaatgtttctgttgtgtcttctctgatttttttttttaagtttatgttgttcatagttttttgttcgtttgtttgtttttggtcttttggcttattgattctttctgatctctctatacttatatctttatagctaatttttctcttatttttaaaatttctgcccttgcctgtatcattttttccttctatacacttttttttcctccccttaccttaatgttcagttagatgcttagctcacttttaacctttttttcttctctaatgtcaatatttaaggctagaaatttctcactgagtactgtcagttcattccatatattttgatatgcagtattttcttttttttaaatttaattttatttattattattattttttgagacggagttttgctcttgttgcccaggctggagtgcagtggcccgatctcagctcattgcaacctctgcctcccgagttcaagtgattgattcttctgcctcaggcttcctgagtagctgggattacaggcgccaccacgcccggttaattttttgtatttttagtagagacagggtgtcatcatgttggccaggttggtcttggactcctgacctcaggtgatccaccagccttggcctcccaaagtgcagggattatggacgtgagccgccatgcccagcctgcagtattttctttattgttaagtataaatgttaagatatttatacctttcttttttgacccatgtattgaaattatgagtacatttggagtttcttctactttattatatgcttttaatttttctcagttttgcagtttttttaatcctttcttgatgtaattttactaaagtctcttttttctaattttattttcccctttactcaattcaaataatctatccttttagtggttaacttagctattttaacatacatacttaaattagttaaagataatcagtaaccttacttttgtcccaaactttttttttttttaaagccagagtctggttctgtcacccaggctggagtgcagtcgtgcagtcttggctcactgcagcctccacctcccaggttcaagcaattctcctgcctcagcctcctgagtagctgggattacaggcacgcaccaccatgccctgctaatttttttggtatttttagtagagataggggttcaccatgttggccaggctggtcttgaactcctgaactcagatgatccgcccaccttggcctcccaaagtgctgggatgacagatgtgagccaccacacccagtctgtcccaaacattaaaagggcctttagacactttcaccctaatcactctgtttacatgtgtttggtttttcagtatttcagttggcctctcatcctgcttcacaaattaggcatttctatttgttggttgaacaatcaatgtttgttcagatttagatttacccacatatttactattaattttatctttacttcttgaatctgagatattccatctggaattattttcttcttcctgaatacatcctataagtttctttaagtgaagttctcttggtggtaacttctctaagtttttgtttgtttaaaaaaaggtattttccagacaatgtctttctttcaccttcatgcttgaaaaaatagttttactgagtctggaattctgggctgatgtttattttttctaaacacattgaaattattattttactttcacctggcctctaagttgctattgagaagtcagctgtcagtctcatcactattcttttattgggaaactttgttttttcctttttcttttcctccctttcttcttctgtccattctgtctccttttcttcttcctctttctcttcgtcttcttcttcccctctctctggttgcttttaataatatttctctacgatgtgtctaggtttagagttatttttatttatctactttagaattattgattgggcttcctgagactaagggttgttatctttcaataagtctagaaaattattagtaattggccaggcgagatgttgcacgcctataatcctagcactttgggaggccgaggtgggaggattgcttgagcccaggtgttggagaccagcttgggcagcatagtgagaccttgtctcaaacaattaaattaacaaaaaaaaaatgtttagcaattgtatgcttgagtttaggttttcccctataatctgtatttgcttctccaagagctcctataagacatctgttagctcttctcacactgttttcatacaataatatttcctccacatttttcatcttttttcctctctagattatttgttgtttgtttgtttgtttgtttatttatttattatttttaaaaatagagacagagtcttgctatgttgcccaggctggtcttgaactcctgggctcaaacaatcctcccttctctgactcttaaagtgctgggattataggcatgagccaccacacccagcctggatgatttctttgactgcatcttccaattagctaattttctcttcacgtgtgtttgtttaatccacatattgggttttacaattccgctattatatctttttattttcaggagttctttttggttcctttctaaatttgcttgattgttctctctaggtatttattctgttttcgagtttctcttttatttcactaaatatattaaatatagctgttttatattctttgcctgataattccaatatctgattctgatttttaattccaccttctgttatttcttcatgctctcactatgttttctttttattcccttatttatattgtaacttttggcttcaaactgctcatttttaaaaactttattagtggctatcttagtctgttttgtgctgctaaaacagaataccacagactgggtagtttataaacaatagaagtttatttggctcatagctctggaggtggaaagtccaagatcgaggggcagcatttgatgagggctttctggctgcatcaaacatggctgaaggtatcccaggagcaagagaaagggagagcccaaactcacagcctcaagcctttttataaatgtcatcaatcagttcatgagggtggtccccttatggcctcaacagctccccttaggccccacctcccaacactgttgcattggggattaagtttccaacacaagctttttggcggagacattcaaatcacagcagcggatactgtttgaggcctggggtttatttctgctagtttccttagaactgtatcaaacctagacacatcttaaactcagatttccttttaagattttttaggatcacacatggcatgggaatttgaactgcaacctctcatgaattctacttgtggttataaattctcagaggagaatattttccccttcacccagaagcaaagttgaatcagggaagtttccttccattctgttctgcctggtggggtattttctcattcatatttactttgaaggcagaaccctctgaagttctggtgtgtgtgctttatgaaactccccagcttgacgaggctccgggctttatctacatccccctttttcctcttcagtgtcaaagtgatggtaaaggtgtcatgtgtgtgtcagaaactctcagcatgatcggtggctttggtgtgtgcttattctcaggattcacgctctcactggctggactcttttatgccaggtcagcagtgtatttaaatttttttttttcttaattgggttaaaaattttctttgagacaacttttagggcctctaatctgccatagtagcagaactgggagttgaaaacctgttttatgttcattattttctacatatatttggtagcatcaagtcaaagataatgatgaattgttcttcagccttctgaaattctgaagaaggtatttggtcttaaattgaagcaaaagactagttcactcaactataataaaacctttcttgcctcgaaatctagagttggccaactaaagaagttttcagaactttatatatggaatttctgggaaatagcatagatttactttattacatttcaccaacttactgctactactattaacgtgttatctcatgtaatcttttaacaatgattagtaagtgtgtactctgggaatcaatcagaatttctgataccaaagttcctgcacttactcatgatgttatattcctttcaaccaagatttgaggcagcttccaaccatgtattcagtataaaagaataaaattaatcactgagagacttgaggcaatggataggaaaacaataaagctttgaataagagtaacacacaggaggctgggcatggtggctcacgcctgtaatcccagcactttgggaggctgaggtgggtggatcatctggggtcaggagtttgagaccagcctggccaacatggtgaaaccccgtctctactaaaaatacaaaaattagctgggcatgatggcatgcacctgtaatcccagctactcaggaggctgaggcaggagaatcgcttgaacccaggaggcagaggttgcagtgaaccgagattgcaccactgtactccagcctgggagacacagtgagactctgtctcaaaaaaaaaaacaaaaaacagtaacacacaggaatacataatacttttttctcaacagctgtgacctgtatttggtgttaagattttgtgggtttttttgtgagtcagggtgttgctctgtttcccaggctagagtgtagtggcacaatcacagctcactgcagccttgatctgccaggctcaagtgatcctcccacctcagcctcccaagtagctgggaccacaggtgtgtgccaccgtgcccggctaatttttgtattttttgtagagacagggtctcaccatgttgcccaggctagtcttgaactcatgttcaaggaatcctcccaccttggcctcccgaagtgctgagattagaggcatgagccaccacgcctggctggttttaagctttttgaacatacactaagagtagggtaggcaaagaacaactaagttggtttgtgtgttgccctgtaggacaaacacctgtgactttgtgagcctttttgcaacactgttgaaattgcatcaaggccctgatgatgaagattggcagtaataaagtagtctgggggaatatcgtttatgttttaattataaaaattgaaactcttctaagctattgacagctgcattactgggaaggtggtttagggctggacctgcctggtgaaggactggccctggtaggatctggatggggtggtagcttcattgagcatcagatttcaatccactaccaagtttccaatcactccagttgttcctattttgccaaaacagtcgccctctatgtcccccatggtcttgtgcctgttcgtattgggagggcctgagatgcatctgggcccttagagatactttaatcacagtatggacagcctgtatcatctcagtctcagctgatcagggaccatatgcatagggccagattataagtaaaccagctagtggtgtgaaacttggaaaagccatttactgtgtatatttgggtcttgtcagcaattcctgagcatgggtaggggtgtgtgtgtgtgtgtgctcttgctgtggtatacaagcacaatgaaagtgtataaaaacaaatgtaaagttcatggttagatttcttaactctggaggttagtcatctttgataaagcaaactgggatgactttttgtgtgagctcctaacttaaggactaagaaatacaaaagatcagtttccgtaaataaactggctcacaagtgtgcagtagttttaaactttctttttctttgcttcaaggattttgactctttcttctctgcaaaagaagagaatattatttattccttccttggtttggctcctcctccagactcaaaggtaagtttgaacaaactccattggggttcaaaacaggtaatactaaatgaaggtagaaatcaccgcatccaagactgtttaatacatgatgatctctaaattaacattactttagtacacttcttattctgatgcagtcctatgcatagagagaatgcagtttttactaaaaaaagttccaaaattatgcttttcatatttatgctgtgttttcaccttgttacaataaattttataatacctaagttaggaaatatcattactttgaataatcttaagtgcattcattaaatatgtaaacatttgagctcctaggttgtgtttatacaattattttgttttgaattgacttctcatatagctttatatgagttaatttcataatgatatatacccttacattatttctatttaaatgaaccaaactacattttggtctcataaaaatgggacaggtaagatctcgattcaacgacaaggtaggttttatcagatttttttcttccagtgacgtctcatctttgattatgtataattaaatagagagttatgctaataaagcaggaaccatgaatttgacttgtgtgcatgtttaattcatgtgacttgctaagacttgctgatggattgaatgtggatagggatggattccatgatgacttctaatcagtgtgtgtaaaaatccactctgagagaggaccatattgaggggggaagttaagtttgaatgagacagctgagtgaagaagtgaggtaggcaattgcatactgatctgtgtctctgcaaagtctggttggagacacacacgtggaagctgcgaacgcatgtagatggagctgaagtcatgaaaagtggatgaaacagagtaatgagagagttgacaggatggagaccagagtgggggtggaggtgggacttcaagtttaaagttgcctggaagatgagaaaccagttgaggaggctaagatggagagtagggaaggcaggaggagaccaggagcgtgtggcgtcatggaagcccaggaggagcttggctctttacagaagagggtgatgttagttgtgacaaatgcggctgagagattgagtcaggtgaggccataaaagtgaccactggctttgatgacatggaggtcattagaggccatgacagaagtagtttctgaggagaggtggaagcagatgtatgtggtctagacagagtggtctaaggagggctggtagtgagaacgagggactatgcatagacaattattttgggggaattttcccacagagtgaaagagaaaaatggcagacatcattgttttaaaaaatgccctactccttcccaccactggaaatttgggcagagtcccttgcgtccctgcttgctgccggttccctagcttcctctctcctccctatgttctggaaagttcccccatctctgttctttacccaagctcaatctctcgtcttaacccaagttctctgtctttcagtagacatctcccgtattcctactacttctcaatccccttcttccagaccccagacctgtgggtggtaggaggggagagtctagtttttacaaaggcccactagggggttatctaaacaaaagggaattttctatccttggtcaataataatgtggcaaagctttgaaatgacttttttttaaccttttgtaggtcaaatttttgacagagttactgtcttcaccaagagtcccaataaacagaaggggagacggtagtagaaaaatatattttctgtctgttcatcacaaattccaggaatcatgtcttccttatttcttccctttgcaatatctttttattttttattcctttttttatagcattagaatcttttattttttcatgtggctatagccttcatgatgatcatttaaaacttttgtctgatactctattacactgatgtatcataattgacttccttattcctatatgtttaatttttacttattattgtgtcataaacatgtttatgctattatggtgtcataatgtcatctaaatattttgtataatgttccatcaagttgatgtgccatgcatttaaaaaaatttttgttcatttatttattttttagagacaggatcttgctatgttgcccaggctagttttgaacttctgggctcaagttgtcctcctgcctcagctttccaagtagccaggactacaggtgtgagccactgtgtccagcataatattttttcactatgcttatatttttgaacctggggttgctcattatttttaattacaaataactctgcactgattttcaccatgaaatagtattctttattttggagtatttccttaggataaattcccggtagctctttcagtgagacaaaaatgcacacaactttttatggctttgaacgtgcctccagattactttctgggaggattataacattcatcctgctgcactgtggtggaccagcttcactgtaccttccagatatgagcattttaatgaccttgatcttaggaccattaaattgtattttagaaatttgtttctggttttactgtgctatgaggagggaatttggttttgataaatgtctgtcttaagtgtctttgtaactgaatgtatattttttcatttttgtgtgatattttattttttaagttgacaaataaagtgtatatttaccatgtacaatgtgatgttgtgaaatacgtatacattgtggattggctaaactgagctaattaacatctgcctttcattgaatactttttttttgtggtgagaacacttaaaatctactctcagtgatgttcaaaacacagtgcattgttatttgctatagtcactatcttgtaaaatcaatatcttgaacttatttctcctaacagactattttgctataaaagattgttttctgaatattaaaaaaataacttttttcaaatattacatatatgatattggaaaggtcaaatagtcctacaaagattactttttaaaaaaacagtcctgctaaacatttcatgccagaaaatgccttatattttcctgctttagtctgcagtgtgcttaggtgcagaattccaggctggacgttgctgcacctcagaaccgggaaggtgccgctccatcatctcttcccacttccagagctgctctgagatcacgtctgatgccagtctgtctccagatctttttatctgcctatttttgtctttcccaattctgggagattttagggtccaattttttggttttgaagttgtacgatgaggtagctggtagaggtcttcgttatttgtgctgggcatttgctgggaccctttaatttggaaggtcatgtgccttggctctgaaaaacaaaatgttagaggacttctatgcggattcatttccagttcattttcactttcttttctttttggaattcttcttatttaaatgttggacctcttggatgaattctctaattttcttatcttttctctcccattttccatatttttgtatttttctgctttctgggatattttcttaattttctaccttatcttccctctattggtagtttttttccatttctcctatcaatcatatctgaacttctcaaaagctcttttttgttgttatctctgcatgttcccttattaaatagcttcctattcttattatgtaggttcattatttttcttaattctgagtttattaaatatagttttcttttacatcttcttcaactcattgcattctctgttttctctaattctgtttcttctctgtttgctttgctttcctttttatttttatgtaagttgttttcctcagatgtttggtgatctttgactgtttgtatttaaaacaaagtactgagctggcagtggtgggtgcatgtctgtattcccagcaactaggaaggctgaggtgagaggattgcttgtgcctagggtttcgaggccagtcttggcaacataacgaggctatgtggtggtggtggtggaggtggtaagggtggtggtggtggtggtggtggtggtggtggtgatggtagtgctggtggtgatagtgatggtggtagtggtaatggtcatggtggtgatggtggtggtggagtggtagaggtggtgattgtggtggtgatggtggagatgatggtggtggtgatggtggtggtggtgacagtgatggtggtgatggtggtagtggtggtgaggtgggtgatggtggtggtgatggtagtggtggtgatgttggtgttggtggtggtgatggtagtggaggtgggggtgatggaaagtgggagataaatctggctgccagtgttctagaagcaagtagggaagggaatggagggtctcccctttcagaatgtgaacttcttatatagaccccttgttttcagtatggttgcctacttcagctggcctcatgcccaggaggtcatatttcctctagttcagcttctacagagacaaaaactgcttatttagaaggggacagtcacttgccgtccagggatgaggagggaaactaaatctacttcttctttctctcacatcgctctttgtaagcaattaggtttcagattttttctggttaagtcaattattactcaacgattccctttactgcctttgaatttccgtagacattttttttttcctgcaaaaagacttcttgtccatttaccctgttcttgtgaatttatccttttctttttaacatctttgttgtattgtcagtggggctctggtaagaagccaaagcaaatatctgttttcagcttctcatgattaactagaaactgcctgtagttttcaatggtcccagtcttcctgaaaaggaactatcatcccctgttattccattaatttctttccatatgttggttaatttaatttaatctatttttagttacataatttgagattaaggattttaatatctttgctctttttaaaaaaatagttttattgggatataattcacacaccacacaattcacccatttaaagtgtacaattcaatggcttttagtatatgtagagttgtgcaaccaccaccactgtctacttccaaaatactgtaatcatccttaaaagaaacccagtaccccttagctgtcaccccctaattcagccattcttcctgcctagggaaccactcaaatgctttcgttctctgcaggcttgcctcatctgagcatttaatgccagtggaaccatacaccatggggtcctttgtgactggcttctttcacttggcatcatgttgtcaaggcttgtctgtgttgtagcaggtgtcagcacttctttctttgttagggcagactactatccatggcacgaatggatggactgcattttacacatccattcctcagtggctgggtatttgggttgtttccacgttttggctatcatgaatactgctgcgatgaccatttgtgtatcttttgtttaatcgatttccaatacttctacagttgctgctttgtatcagaatctcttggacaattttaaaaaattcagatgcctgagttttactctagacttactgaccctaaattaccaggggagaggcccagggatctacatttgcaaaaagtcccttagttgattctgatgctcatttctgtttaacaaccactacactggagactcatttaactaatattcatgtatatgcttctccagaatgaatgtggtatcttatttgctttagttaagaaactcaaataggcagggaaattgtaaggccactttgttcctttccccattcctgattctctcctgcattcatcaatttggtatctctctttccacaagcaagacatctttttgtgctgtattttcaatgcctaattgttatattgtatgaaatctgctttttaaaaagacaccatggacattttattaatatttttaaacaacaatagtagtagcagtcgcaacaagaacaaactcttagccaggcattgtggttcgtgcctgtaatcctagcacttaggaaggtagaggcaggaggatagtttgagcccaggcatttgtgacctgcctgggcaacatagtgagaccctgttctcaaaaacaaacaaaaacaaacaaactcctagagggctagcaacttaacagatattgcgaagctccaaatgaaattccagccattaaaaaaagtaactcatataatagcattaatagatgtcaaagaaaatatatggataagtgaataatgaggctgacaagttcaagtagattgctccaggtcacaaggctcataatctgtagacctagaatttgatttcaacattttctgattattaacccagtatcctcttcactcccttgtgtttagggctacatttatagaaaacctatctacgcttaagtctattaaaattaaaaaactcatttgtcacatatatagataactatcaccccaatattttactctaaaattaataattaaaagagaagatccaaacattttttttctgccttttaaactagaatctataattcatacctggttgttgagagtaaactttttgttgtaggtcaaatatcgaataaatgatagaattagaaaaataacccgtttgccaaagccaatgtaataattgattacagcatagctaatgaatagataataaaactgggtaaaaggcattaggtgaatttgtttcttgggggaatcagttaaatttcctgtgctaaagtattagccccgccaaacattatttgctaaattcaaaggggaaaccgatctttataataaagagatctattggtcacagccttaacaaagtagccaaaccactgtcactactaatgggactcactgatatcaaatgctgcctgttgcaaacgtgaagtccatagtctcaccagtcaagtgttcttgctaaatcatttcacctgcatccaatccagtctccagctccaagttctagtctataaaaaacacagaggaagaggagcaagttaaataatatcacaaagaaagaatcagacaaaacaaaaatttggaacattcttcaagataactgacccagattcttaaaacattcagtgtcatgaaagaaataaataaaaagagatggaattgttctagactaaaatagactgaggaaatatgagaatcagatgcaattaatatgttttaagaggttcaagtctaaagaaagtaactgtaaaatatttattgcaggcaacttggggaatttggaaaggaattggatattagatgacattagggagttcttgttagttttcttagatgtgataaaaatactggagttacgtaagagaatgcccttgtttttagaagatgatactagaatatttaagggtgcagtttgataagacagatgaaaatgttagcaagtgttcaatctatgtagttcatctttaaaagcttttctttgtctttaaaattttcataatgaagagctggagcaatgcttttttttttgagacagagtctcgctctgtcacccaggctggaatgcggttgcgcagtctcagctcactgcgacctctgcctcctgggttcaagcaattcttgtgcctcagcctccagagtagctggggttacccgtgcccgccaccacgcccagctaatttttgtatttttagtagagacgaggtttcaccatgttggccaggctggtctcgaactcctgaccttaggtaatcttcccaccttggcctcccaaagtgctggattacaggcatgagccactgcgcctggcctggagcaataaggatttggagctaagcatatggcaatgttgtattgcctttgctcttattagttaaaagcccttaaaatgtcctagtcaaaacttgaggaggattgctctaaatggagaagaacacaactcaaataaaacttgtttcaaggcagaaagacacacaaatggcaaatggccgtgtccaaagttactatgtctaaagctgctttaagttttacagggaaaaaaacagactttagaaaattatgtggaaaagttagagcagatgaacttattttccagtgtgcagagtgtccaggatcaatctcatattttcagcaacaaaaataaaataaaataaatggttggaagttgatcaacatagatattgccatttttctttctctgagataatgacttgccattcatgtctagggacatcccacttcctagaccccttctcttgcatttctcctgagaagtctcagagttcacctctcttctcatcgaggcttttgtagtcctggtatttctttccatccataatctgtctcattcagcatgaaatgaagaggaactccagtggaaaagaacatatgattcagttagaaaaccttacatactttttacctgctgaccctgaatttgggggcaagatttttaacgttttcccagctataaaatgaagagagaaatatgaccacctacctcttaggggtatttgttttataatttattctttcaagagaatttatttgcgtacatgctgggccagacactgggctggttgattgaagggactttatggtctagaggaatagttagatgtgagcattctgtaagtagataaaataactgtctatgtgaatatggagatggtccaccaatctcaggccttatattaagtctccgaaaagagttgatacctcacttggtattggaagatttagtaggagctcagtaagtggaaaaagatagtcaagacactatgggaagatggatttatacactaaggcaatgaaatttatgagagtatgtttcattcagtgaagtcatactttggatggaatcagaggtttcagtagaacccaggatatggaagtgggtaaagataagagctgaggcaagaaaagttagtagggatgatattgtaaagggccttctgtgtctggacttttttcttggcaatgagaatgatgggaaaaggtcagtgtggagtgatttacatttcacaaagcctctgactcagacagcaacacagaagattgttagagataagatgcagaatctgggactatatctttcatatttacatcctcagagccaaatacagctcataactcgtagtaggtgttcacctctgaaattcgaggcaataattaactggggtaccaaagtcaatgaaacactccggagatattcagcaccattcttcaaattgaatgtaaatgggacaggtttgtttattgtaacttgctattttaaaaaaaattatattttgagatctatttatactaatacgtataaatctatttcagcctctgctgtgttttatcttatctcatttttattttaatatctaatctccgtttttagatcctaccctgatttgtgctcaggtactgtcatattatataaaactcttgttttgtggaagaaagggatggccacaggattatgaaacctggcctagagatacctaagaggccgtccagtccagattcttctcttctgagagaagcaacatgaagcccaaggagcttaagtgacttgtacaaagaaccccgctaattagcagtacagttcgtgctagagcctttggtgctgtcagcattgcttaggttgataggtgtttatactgtgcgcagggacagagtacttccagtatcctttgaaaagacgacatctgatttatggaaacattacttatcacggtgtcatgttgtagtaaacaagattgtggaaaggtgtcagcaaggaaaattaatctcactcaagctaaaaataggtactcttgacaattatgtagaaaatgcatgctcataaaacgtatcatcatatgcagcatcattgcttttagaacatttttcttgtcttagacaggctgttctaggccaaggaccagaccagttttcccaagagggctttgtaagtaagcattggttccataaagtcaaccttagttctttaaaagcatgtggtcatatctgattaaatgaacatcattcttaataggacatggcaggcaggacctaggttacataaccaatgttttcaattatgccctggcaagaaggaagacagattcttgttgaagttatgcaaataagtatattgccaaaaaatatatatgtattctgattgaataagcagattcaataagaatttttgaactccagaggaatcgggcagggagaataagaggtcatttacaagtgattcatttcagcttacaaaagcagaatctacaacattattatgatgtatggaaagcttaagagaaagcaaaaagggcttccttatatataaggaaaataagacattaaaataacatcaacagtattccagacaaaaattactatcatccctcaccaattcatttaatcctatgtaattaattcctattccactggatcttgtggatcttgggttagtcgtctaatgaacccatctgcttctcaacaaaagttctggaaaatttgactaagtccacggatatggtctcaaagttgttttctttttttttttttttttttgagacggagtctcgctctgtcgcccaggctggagtgcagtggtgcgatctcggctcactgcaagctccacctccagggttcacgccattctcctgcctcagcctcctgcgtagctgggactacaggcgcccgccaccacgcccggctaattttttgtgttttttagtagagacggggtttcactgtgttagccaggatggtctcgatctcctgacctcgtgatccgcccgcctcggcctcccaaagtgctgggattacaggcgtgagccaccacgcccggccggtctcaaagttctttaagcaatgccatcagaaacctgaacccaaatgtatttaacatataaccctttactgtggggctctgagcagtcattcttcatgaaagatgaagcatttttgcttgtagctcattacaaataacttcagggaagcatcaaagcaaaacatgctaacaaaaatatctgtagatgacaaaaaacttaaaatgggtgccatttattcattgcttataattttcaaaagtgaaagtctagaaagtcataacaagaataatatatttgatgagaaaatttgttgttttctgtgacatgcaaaacgaaactataaaatcaaccccccaaattttagacaaattacttataaacataatcattaggcctatttcaaagaatacagaaaacattatatctaatttacaacaataagtgggcatagcaaaaatcttgatgtaattattcagagacataatatactctgactataccaagcatatgataagaatatcaagaaacaagatgtagtaggtctggagtaggtcctaaacatctatttattaataaaactgtatgagtatatgatgggaattcccaatcgaaaaacactgttgtaaaacatgctagattcagattaaagaaggatcaagttaacatttaaaacaactgaagttatggttgataacttaagcacctgttgtctgataccaggcaaaacaacaatataatcaatgtctttttatttttattttttattttttgagatggagtctctgtcacccaggctggagtgcagtagcacaatcttggctcactgcaacttccgcctcccaagttcaagcactttcctgcgtcagcctcccaagtagctgggattacaggtgtgtgccaccacgtccagctaatttttgtattttcttagtagagacggggtttcagcatgttggccaggctgatcttgaactcctgacctcagataatctgcctgccttggctttccaaagtgctaggattacagatgtgagccaccacatccagcaatcaatgtcttttagtacattaatttagtcaggggaatattattatatcaatgaaagacatccagttatttaggcaattagatttgcccttaattgacagagatatacacagccataacaatgtttttttgtttctgttttttgaggcaggttcttgctctgtctcccaggctggagtgcagtggcctgatcacggctcactgcagcctcgaccttctgggctcaagcgatcctcccaccacagcttccctagtaactgggaccgcagatatgcaccaccatgcctggctaatttttgtattttttgtaaagacagaatttcaccatgttgcccacactggacttgaactcctgggctcaagtgatcctcccaccccagcctcccaaagtgctgggattatatacaggtgtgagccatcatgcctagctgtcatagcagtgttaaagtgttacctttacagattgctgttggtgtgtaactcctcagtgccaaagcttatacatcccagcgagggctgtccttctcatgggaaccacattaggaagttctaacattccaacagccagacaaacattgctcaaaagaggtttcaaatccctctattagagtcatagtaacatcttctattggaagatggattttcttgtagaacacatttcagtctaatgaataaggcagggataatatatctggatcatgtaacttttggccaaaagtgacttgtgatgaaaagttttgagattcattttccggtatcactagcgagtgcctattgaaagcatttttgagtaatggcaaaatatttaagtaagtgtggcatttcctggtgacctgaaggaggaaggccaaactggacagaggacaggcgacttcacttgaaggagtacaaaaggaagaagcagaaggagctttggaggaacatttgttgagaagcataaaagatatgaatttggagcacaaaattcattcaaaagatgttctggaattttctaatttgaaactacaagatgggtccttactgcaggaaagggtatgatatctcaccaattcatttagtcctgtgtaatgaatcctcattccactggatcttgggctagtagtctcaggaagccatctgcttctcaactaaagttctggaaattttgactaagcccactggtatggcctcagttctttaagcaataccatcagaaacctgtactccaaagtttctagcatataatcctttatgacaggcttctgagcagtcattcttcacggaaggtgatgcattctggcctgtagctgagcagagctgagcagtccgacatgtaacttcattgagaaccagaccgcagagttcaaggaggccttccagctgtttgactgaatgggtgatggcaaggcccttacagccagtatggggacatgacgagggccttgggccagagccccaccaatgccgaggtgctccaggtcctgggggaacctcaggagtgatgagatgaatgtgaaggtgctggactttgagcacttcctgcccatgctgcagactgtggccaggaacaaggactagggtgcctagttttaggattatgtccgagtccaaggattatatggaaggtctttgggtgtttgacaaggaagagaagggcaccatcatgggcgctgaaatccggcaagtccttgtcatactgggtgggaagatgacagaggcagaagtagagatgctggcggccgggcatgaggacagcaatggttgtcaactctgaagagctcgtctgtgtggtgctgagtagctgggcacattcccagcatccccccagccctgtcctttgccctgtgagacactgtgtatctagccccgaaggctttctggtcacagcacccttcccatcttgtctcttttggataatgcttgccatgagcattcaccaataaacttgttctctgttccccccaacccaaaaccctcaaacaaacaaacaaaaactacaagatgagcaacagagagaatgaacagtgttcaggcctccattcaagaagaccagagggaagaaggcatcaaacataaaataaaacacaaagaaatagaaattgtgagtgaaaggtacaagtttgcaagtcagatgctagagacctgatatgtgcacgagaggagttccagaaacaacaaaagaccagatggaagagggctaatcattcgagagatgccagggtcttccagttggagatgctgctgcagccccctccatccccttatcttatgactgcaggaaaaccagaaagggtgctgcctgaggactagaaactatgggagaatccctgaaaggttagaaagcaaaaacatttggtttgaagaaggaaatcaaggtccaaatgcctgtcagagatgggagtggctctgtgggccctgcacagcctcagtggtgtgttccagttgcaggaagggcctgggcatgggcttggagcttgaaaggcagagcccacttccatcctgctcttagacctggcaggggtcaacacagtggtcaacagagtgatcaacagggcagggcagtgagcactgagttgggtggggaggcacagcaggtctgagggaggtattcttactccagagggacagagagaagtttagatactggcagtcagcctcaaccctggctgcacattagaaatctctggggagctgttaaagctattaggttggtgcaagagtaattgcggtttttgccattaaaaatagtatgccagggctacatttgagagcaattaagcagaagcttcagtcagggagctcccaggtgaacctaatgttttatcaatgtggagagccacttctgtaaaggaaaacattgaataatagtgaaatcaagaattgtaaactatcttggaaagatctaggagttctggtatcactagtgagttcatcactgtggatggaactatgtgagaaaggagatataggaaaatatccattacaaggattctgttcatggatgagggtatggagaaaagaagggaaataagtgtaagtgttcgaaagggcgcatctcaattgcaggtgaactatcttgatgggaacccatgtattgtgtaactgtgaatgttaatagagaattatgtttaatgatgactattatgaataggaaactaaacagtagtgagatagagaagcatttcagaacatttatgttaacaaggccgggaggcagagctgaggaaaacagagtgaagagaaactttagccagcaatagtaaggaaagggaaaaagcataagagagaagacaggctgtcatgaattaatacagcagaagcatttgaactaactatatcagttgttctaataaatttgaaaaggctaaaattccctggaagaaaagagacgatccgtttggatttttgcacagctgttctgcagttgagaatatctccgaccatgattgtgcattttctgttcctccctttaatcctgtcaatttattcttcttgtattttaaaaatttatattattaggcacatttgtatttataattgttacagcttctgtaattatcagctgtcttttacaatttctggtaacgccctttgtctttatatctgtattatataaagctactctagatttcttatgcttatggtttgcctgggatagtttttccatcgatttcctttcaacttcctatgtctttgtttttataatatgttttttggagacagcatctgattgggttttgtgcatttttttttttttttttgagacagtctcacactgtctggagtgcggtggcatgatcatagctcactgcagccttgacttccctcccaggctaaaatgatgcccctgcctcagccacctgagtagctgggactacaggcatgcaccaccatcctcagctgatttttaaattttttatagagagagggtcctactagttgcccaggctggtctcaaactcctaggctgtagtgatcctccctctttggcctcccagagtgctgggattacaggcatgagccactgcacccggctggtcttgagcattttaattcatcttgataatctgttataaatcagagtatttagttcattaacaattaatcattgacataattgtgtttaggtttactatttctttattttttctattggcctccattttatttatttatttatttattttattttttatttttatttttagagacggagtgatctcggctcactgcaacctccgcctcccaagtacaagcgattctcctgcctcagtctcccaaatagctgggactacaggcgggtgccaccacactgggctgtttttgtatttttagtagagacgggggtttcaccacgttggccagactggtcttgaactcctgacctcaagtaatccacccgccttggcctcccaaagtgttgttgggattacaggcatgagccaccacgcccagccccatttcaatttttattatttaaaaatacaatttccattttatttttctccagagaatagtttttcttcagtcttctaaggcctcagctacttacatgggctttggtgggggtcgtggggcagcacccgcaggtctaagtaggggtggaggtgttcggtccttgcaagcttcacgagattgattcctcactactttgctttaatattataaactgcacaactcacacagtaatgtaacttcatatccagcttgggaagcacataggtgtcgaagaagcttgcttagaaatgtccctgactgctgtggcctccactttgtttcaaatgacaaatttcttaatggccttgttcttgggcacacatcaggtatagttcgtgcagcaaataggctacacgtggccatggccctttttggtatgacctttgttccttcttttatttgtcatcttggaggcacagactggagctggtctcccatttttattcctctgttgtatgcttttttgctttcttttgggctttatgaatgtgttttagacttcctttttaacttatctattgtatttttaactatgcctcttggcattatttggtagtggttgttctagtggctataatatgtatgtattttttaagttttttatttccataggtttttgggggacaggtggtatttggttacacaagttctttagcggtgatttgtgagattttggtgcacccatcacccaagcagtgtacactgcaccctatttgtcgtcttttatccttcacccccttcccaccctttccccctgagtccccaaagtccattgtgtcattcttatgtctttgcgtcctcatagtttagctcccacttttgagtgagaacatacgatgtttggttttccatttctgagttacttcacttagaataatagtctccaattccatccaagttgctgcgaatgccattaattcattcctttttatggctgagtagtttcccttggtgtgtgtgtgtgtgtgtgtgtgtatatatatatatatacacacacacacacacaccacattttctttatccacttgttgattgatgggcttttgggttggttccatattttggcaattgcgcattgtgctgccataaatgtgtgtgcaagtatcttttttgtataatgacttcttttcctctgggtagatacccagtagtgggatttctggatcaaatggtagttctacttttagttctttaagaaatatccatactgttttccatagtggctgtactagtttgcatttccaccagcagtgtagaagtgttccctgttcactgcatccacgccaacacctatattttttgattttttgattatggccattcttgcaggagtaaggtggtatcacattgtagttttggtttgcatttccctgatcattagtgatgttgagcatttttgcatatgtttcttggccatttgtatatcttcttttgagaattgtctattcatgtccttagcccactttttgatgggacgttttttcttgataatttatttgagttcattgtagattctggatattagtcctttgtcaggtacatagattgttaatattttctcccattctgtgggttgtctgtttactatgctgactgttccttttgccgtgcaaaagctctttagtttaattcagtcccagctatttatctttgtttttattgcatttgcttttgggttcttggtcatgaaatccttgcctaagtcaatgtctacaagggtttttctgatgttatcttctagaatttttatagtttcaggtcttagatttaagtccatgatccatcttgagttgatatttgtataaggtgagagatgaggatccagtcattctcctacatgtggcttgccaattatcccagcaccatttgttgaatagggtgtcctttccccactttatgtttttgtttgctttgtcaaagatcgttggctgtaagtatttggtattatttctgggttctctattctgtttcattggtctatgtgcctatttttataccagtaccatgctgttttggtgactatggccttatactatagtttgaaatcaggtaacatgatgcctccagatttgttctttttgtttagtcttgctttggctatgtgggctcttttatggttccatatgaactttaggattgttttttctagttctgtgaggaatgatggtggtattttgatgggaattgcattgaatttgtagattgcatttggccgtgtggtcattttcataatattgattctacccattcatgagcatgggatgtatttccatttgtttgtgtcgtctatgatttctttcagcagttttgtaattttccttgtagaggtctttcacctccttggttaggtatattcctaagtattttatttttttgcagctattgtaaaagtagttgagatcttgatttgattctcacttggtcactgttggtgtataggagagctactgatttgtgtacattaatttcatatctggaaactttgctgaattcttttattagttctaagagctttttggaggagtctttggggttttctaggtgtataatatatattcttaacatctcacagtctacttagacttaatgttataacactttcatgtaatatgtagaaacattgccatcatatgcatccattgactgtttcccatcctttatgctatacgatcatgtgtatcacatttccatataccattaactctactatgtaatattcccattgaacagtcttcttcctcttcttcttcttcttcttctttttttttttaagtaggaggtaatcttttgtgcttacccagacttttaaatttctgatgccttatgaagagtgaagtttccatctggtgtcattttctttcagcccaaagaacttcctttagtcctttagcattgtttcatagtgaaggtctgctggcaataagttctttacttttcttttatctgaagtgtctttactttgctttcattcttgagggatatttcaccggatataagattcttagttgacaggtttttttcctttcaacaccttggatgtgtttttttcccttctgtcttctgatctccatagtttctgatgagacatgatcttgtttcctgtagatagtgtatgatttttctctgggtgcttttaagattttcattttatctttggtctgcagccatttgattatgatatgcctacctatgtttttttttgtgtacttattattattggggttttctgagagtcttgaatctatatcatttaccaaatttagaaaattttcaaccattatattttcaaatattatttctgctccatttgttttcatttccccttctggcactctaattacatatatgttaaatcttttgttattattccacatttccctaaggcttaaaattttttcagtcttgtttttctttgatcttcatattggataatttctattgatttattttaagttcacttatttttgtatttgtcattttcattctgcatccagtctagtaatttttttatttcatatattgtatttttcaattctgaaatgttacacttgtttgatttttttaatttctatttttctattgagaatcagttgtttcgttcattgcaagcatgtttgcctttacatctttgagaatagtttaatagctgctttaaaatccttgtctgcaaattccagcatccaggtcttttctgtgttggtcttcattggttgtttttttctcttgagaatgagtaacattttcctggttccttgtatgttaagtattttggatggtatcttgaacatagtgagtcttgtgttgtggagattctgtattttgttacattcttctgaaaaacattgactattgtgtttgtttcagcaggcatttactttgttggacccaaacagcaaactctatgtttctagtagcagctatcctattacttaggatactttcagttgtaccaagatcaatctcagttatgaatcagagggtaaaagtctctttttttttttttttgagtaaagatcttgctctgtcacccaggtgggagtgcagtggcataatcatggcccactgcagcttcagactcctgggctcaagcagtcctcttgtcttagcctcccaagtaactggtactatgggcatacatcaccatgccttgctaataaaaaaatttttttttgtagaggaaggatcttgctatgttgcccaggctagtcttgaacccttggcctcaagtgatcctcccatctaggcctccagagtgttgggattacagatgtaagccatcatgctccttctgaaaagtctaaataaaatattagcgaaatatattcagaagtgaattaaagataattcaccatcatcaaacaatttattcagttgccataattcattacatgaactgattaatggagaaaaaccatatgattgcacctataaatgccaagaagatattcgatataatttatcagatatttctagttaagaatggattaaaatataagtagaaagaaacaaaacataaaatacatttatcagaaggtaattataagtatcataatgaaccatgcaatactgaagcatttctattaaaattagaagcaagataggcatgcctgtcatcaccatattattaaacattgttttaggagccgtagttattgtaataatgtaataatgtgtaataagtcttatgtatataagacatggataaaatttaaaattatctttatttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggtgcggtggcgggcacctgtagtcccagctactcgggaggctgaggcaggagaatggcgtgaacccaggaagcggagcttgcagtgagccgagattgcgccaccgcagtccgcagtccggcctgggcgacagagcgagactccgtctcaaaaaaaaaaaaaaaaaaaaaaattatctttatttgcatatgatataattgcatgcctaaaaatctttaaaattccagtgaaatgcattagaattgataagatggtttcttaagtttctagatgaaagaaaaatatacaaaaatttgtaggttttgtttacatcaataattataagtagtaagttaaaatgtaagaaggaaaagtatcccattcatggtagtgataaaaatctgtaaaatgtttaggaataaatttatcaagaaacatacagggcctctgtgaagaacatagtttaattttattctgaaggacactaacaaatactgaagaaataaacctgcagtgttcctggatggaatgatttaacaataaggaatgaaaattttctaaattaataaatgtttagtgctatttcaatcaaaattctattttttaatttttggaactaagaaacattatcttaaaatgtatttggaataataattgtctgagaggagccaagaaaattttgaaaaatactttgtgtaacaacttgactttccaaatattaaaatatgtcctctaagctacagtgataaaagcagtatattggtcttggaactaatacatgtatttatatgtatatctgagaatatatttatatttatatgtttatataaaatattttaatttttattttcattgtatcagtatttatatataggatagtgtagaaacatcaatttatatatattatagtaaatgacaaatatataatctgaatgtaatgggaaatgatgatttatatataatatagacataatttgccatctgtctggaagaaaacaaatgtagacgtcgactttacattatatgctaaattaaattccagatggattaaagctctagatattaataacaatataaagtaatagaagcatattttagagaataaaagttagataaatttgcccataaaaagactaaaaactaaaaaaaatacaacaaaatctgtaaaaactgtagactggaggaaaacatttgtaacatgacaaaggactaaaatttttaatatagaaagatactctaaaaatttatagtaaagcacaaacaactcaagtaaaaatgagcaatgcattcactgcaatgtctacaaaaaagaaaaaaatcaaataaaatgggcaaaacatatcaagacaattatttgaagaggaaatagaaatagctaaaaatttataaaaaatatgcccttatttccaataatgataaatgtataagtgaaaccaaaaatgaaattctattttcttctcaacatattggtaaacattagaaataacaatcatcttcactggttatgaggataaaggagaaggagacattcatatatcgctgtggggatatgaattgctgccacctttttgaaaactaataagaatagcctcaccattttattcagtttagtacagtgttatttgtggtggaagaaacatataaacatttggaacacccattgactgggaaatgtttgaataaattatcgtatatttaatatgaagcagatgttaaaaagaatgattcaataggatcaatcatatgaattgacctggacaaatgtccatggtacattgagctaaaaatgaagttgtgcatactgtgttcccatttctgtttcaaaaccacaaaaataaaagaaaaatgacaatcaattcccccttaaaatagcttttatgtattaggatgcagaggtaccgtatcacatttttaatactgattatcacaggagggtgggattggagggtgtgtgtgtgtggcttaatttgctcccatgagcttgcagagcctctgtaataaaaataacctgatattttaaaaggctgggacccattttgtaagttaaaagagcatcagggaggaggtgtagacctagtccttcccctaactcacaatgtgacattttctgcctttattttcctgtctctgaagtgtgggtggtaatgactgccctacctacttagtgaagattaaggatgaagagaaatatagtttgaatagttaagacattgaaatgcaagctattatccttaagaaaattctcaaacactctcactttacataatgcgggtgacaaaatcacccaaggaagcatcgtcccttcccaatggtgatgtagtgggagaggcactgagcaccacagaggtaaacactggtgtctcgagccatcgtccccatgcccgtttcctcaaaatgtctacttggtcctaatctctctctctctctatccatccacctgtccatctatcatctatctattatctattcatctgtctaatcaatcatctatcatctgtatctatccatctgtattagtctattttcatactgcaataaagaactgcccaagactgggtaatttataaaggaaagaggtttaattgactcacagttcagcatggctggggaagcctcaggaaacttagtcatggtggaaggtgaaggggaagcaaggcaccttcttcacaaggcagcaggaaggagaagtgctgaacgaagagggaagaaccccttataaaaccattagatctcgtgagaactcactcaccatcatgaggacagcatggaggaaaccaccccatgattcagttacctccatctggtctctctcttgacatgtggggattattgacattatggggattataattcaagatgagatttgagtggggacacaaagcctaaccatattatcatccatccatccacctatctatcatctgtctatctgtctatctatctatgtctgtctgcctgcctacccatctgtttgcccatccatccattcctccgtctgtctgtctgtctctgaacattatccatccatccatctatccatccatccatctctccatccatccatgcatccatccatttatccatctatgtatgtttacctgtctactttatctttctaccttatctatcttcttaatttttaatctctaaaattataagcctccctccatacaagcaatagaaaacactgtgtaaagatagaattcttctcctcatcagcctgaagtgggtgaactgaaactcctcacttaggcagtttgttaccctgcaatgcacataggttggatctttgacttatcccagtcggcattttggagtttggagatcctatgctctagtcgctaagtgacctaatgagtgggcagtctatgtttgcttcatttatatactgtgtgtctaaataagaaagccacagcatatgtggcctgtttttttttttcttttttctgtttttgagctcatatcctgggtttcctttatgaccagggatcagagaaggctgaagaaggtggagaaactgaggcacaaaaagagggcagtgaagatgtgggcaacctccctgaagcccaggagaagaatgtgagttttcgctttttcacagcagtttgactggattctctgctgttcgagacttttacagggcttgtacaacttgactctgggcacaagcagtcagaaagagggcaaggagctgagagtttagccagggaggaagcaagtaatttctactgatgtgttaagcactggaatcctggtgcagagagggctaaagggaagacaaaggagcctgaacccagaccaggagggagccggctggacaaggcttggagaatttgttgtggtggtgttatggctaggttaggtgtatgctctttataaacaagggacctttctgcttgatcatgattaatgacagactcctagcttacacccacccaggagccctgcccagtggggaaatagagctaagggagtgcagtatatctggcggaagacaagaggaacttgaggataaaaaggactccttggggagggaaattgacactcagttaatttaagttcaatcagggaaatagcagatcttggtgaagtcacatgattaattctaaaggggttcccatgcagtagcagcagggtaaggagtgggcaatgttgggggacactgtggttctgtgagtgccaagctgacataataggggatgggatgggccacttcttcaaggagttctgaaaatgtgctgggaaaccaggcgccaaggaaggagcctggtggggctgggaatggggtgcaggcattgttctgggcctccttagaggagaatgttagagggcttctccactgggtcagttgtagcaaagactatttttcaaaccctgatggtttgctaatttatttattctgggagaggtgtgggagcttttatgagagctggatcctcattcaccagatagaatgtggctagaaaggggctgagacccacacccacgctatggaaaaaggggtgtggggctgggcatccatttgtctttacctcaaagaacttaaattgggaggggctagggaaggaaattccctgatatttagacttatatttgaagtagactgctatttcaaaatgttgatattacaactctgaagtttttgttttaaagaaagacaaaatcttcaatcttgacctagaagttagacggtgtttcatggcagcctgtataattcagaaacaatactttaaaaattaaatatagtgaccatttcattatcttgtaattaaaacataatctgtttcacaatttgaactttgcatgagttgcctaatgcacccttacagtcatattgatgaatactttgaagttgagtttgcttcttttaagacatagagacaaagatgaaaagcattacaccccagcccctttctcccgtgagaccagcaggaaggtagcatatttataatcagatcctgcctcctatagccagggtgggctttgcttcagcttctcagccactgggctgggttagttctgtgaagtgatgaatcacccagcttggacgttctctttgctactacattttaaaattgtgagcctttgacaaagtcaattataatcttgtgaatcctggtaggaattaaaaaaaccattttttgttatttttgtgtgggctatggtgaagaaatgaccgtaagtgaaaaatatttttattttatatgaatatattactaacatcatattatcaaatttacttttcaactctttaatgccatttatcctacagaaagacagattctgacttcttcctgtttgaaaaccaacacatgctctttgatttactttaattcaattaaattagaaaaaccctctgtgattgtcagtaaacagatgaaaaatgttgtaaaaacatgattaacccttatgagtgtatatgaaaataggctgaattttaaaatttaagaaggagacaaacaccacttagatatttagaatgcttgcattttgtgcttcaagaacctactggcttgttttgacggtctctggtttgttgttaaaagctgagatggggccgggcgcatggctcacgcctataatccctgtactttggaaggcagaggtgggcagatcacttgaggtcaagagtttgagatcagtctggccaacatggtaaaaccccgtctctactaaaaatacaaaaattagctggctgtgatggcgcacgcctgtaatcccagctatttgggaagctgaggtgggaggatcgcttgaacccgggaggcagagtttgcagtgagctgagatcgtgccactgcactccagtctgggcaatagagtaagaccatctcaaaaaaaaattgctgaaatgggaggacattgtgggctatttgtaaaggcatctctcctcccagggcaccccaggcatagacaggctgacagggaatcagaaagacaagggagagctctgtgtgttttgaacattgattttgaaagtatgagacacatcctagtagtttcatgtaggtatgacacctcagataaatccaaggctttcaaactcctggctccgttgaaaccatcttgaggctatttctttttgctcctcttggcttgctgtggttaaaacagaggtgctcccctgggcttccctcattaaccaacacgctgcggtggatataaagtttagaatattcgtgggcccacatttggttcctaagactcctgggcaaggaatgtcagcttcctttattgctttaaattccctctatctgctccatgtgcccacctcatggctggcaggagcttccagctgggtggggtgttttgaagaccctgtcctcctgagggtctcacagccatcctggggtcgttagtggtgactgggcagggattgggtgctggttgtctgtggtggtgtttctgctgtctgtcccttggcatgggccagaccctctgttctggctggacacagactggcctttcacagtggctggccttctgaccgcggacgctgctgcctgtacagagtgccttgtgttacttaaatgccccagcggtccctggctctgtttctgtgtatgagcagggcctgggcagtacccctcctggaaaatccttctttcctccccagtctggccacctccgtcttgccaattccaagctctttttttttttttcctcagggaccgcctagctttatcaccccattagcctaaggttttgaaaaccaaggtctatactttcttccttaggggtggaaagccagaacaaataggtcgcctgtgggaagagaaaataactcttactctgacccctctaccccctcagctttgtgtagcagaaagaacaagtcacaattcatatcctggccttcagccacacttattatgagaaggaataaaaacagttttaaacattttattctgaaataactatagactcacaggaagtttcaaaaataagagtcttgtgtgcccttcacccaacttccccaaatggtgacatctcatctagccttaatgaaaccagaaatgcaatgcattggtgcatttctgttaactagatgacaaaccatatcaagtttttaccttttttttaaaaaaacctgccttcatttgtgtgttaaaaacaattgtcatgtgtgcagtaaaaacacaaaacgagcaaaaaacctctctccagcacctggcaatgttcagttgagtgataaaccaggtaaatgcctaagtcagggacaggcttatctgatctctgctatgaaacatgcatactcaatgcacacttgtaggcactcatacaattccatttaatggagaggaatatttacctaatgtttgacattgattaaaaaaatcaacagaaatggaaacaaaaactattatcttctttaatgatatggacttcccctgaccacctcctcaacttccagggttcttaaagacaagatgccaagatgtaaattctgtccttgataaaggattgaggcaggaggacttgggaggtcaggagggtgaacaccgaaaagaccatgacttcatgcctaggaagatcttacctgtaactttagaaaataggggacctcatggggcctggcctgataacccaggggagggtgaggggctaaggaaccggcgcctcaggagtaaaggaggaaaacagaaagtcagctcagcttctgggcattctctaagaaatgaactgcagactgggacatcatgagagctttagaaaatgctggaaacattgcaccttgtgcaggtttggtttgtgttttttgatcaaggtacaattatttaaaattgtatgctttgtgaacccagtcatcctatctgaaagtcatgaggcccttgcttgacagataacatgattatggtctgtaaccacccctctctggcttcctccaatagcagtcttgagaaaagtttcaaggggcaaacattgatgtaggtttgtgggaggagtcatgggtctcagcctgggtccctggagtgcctgcagctcgagaggactctgcctctgtcctctcatctctagccgctctgaggctggctgcccttgcaggtcacgctgggctagtccttcactatctcccacacctgccacctgttcccagtgaacgctgcctggcactcaccaccacggacacctgtccttagttctggccacgcaccacctctgcagtctgcttttctggccaagtttccaacaaaaatagctgctgtggaaggttctaagacttcccacttctgaggtttctctcttctggctttctctgaaaaacaaggtgaaattactttaaggtgtatgcttcctcaaatggtgattatgtgagatcttggcttaattgactggatgattataattatcttaaaaaaatgcttttgtgcctataattacttgccagccgtgaaagtcaattcaagcattttacatagataacttttaaggatctgcctaattccagtattttataattctatgaaccaaggttggaagcttaattattattatttttatttatttatttttagagacagagtctcattctgtcacccaggctggagtgcattggcataatcatagtgggctcgagtgattcttccacgtcagcctcccgagtagctgggactataggcacaggccaccacacccagctaatttttacattttttgtagagatggggtcttgctctgttgaccaggctggcctcaaactcctggcctcaagtgatcctccctcctcagcctcctaaagtgttgggtttacaggcatgtgccaccacgcccagccattatttttaaaactaatatatcccacctcattctatgggggatttgaagctgagctggagtagcattacacaaatgcagtcattcaacattttatgggcagattgagtgctgccacttgccaggcaggactccagggactgtggagggagcagtgaaaatgacagagtcactgcccccacagagcttatgttctggggaagcttgtggtggtaatacccaaagttcttccaagcttacttatcctttcgaggctaagtatttttatgcattctctgagcaatcacttcccctgagcaatcactttccctgctaaacatatcttttaagaaattaaggtcaattcagatattgataaagagtgctaggagccagatgcggtgtctcacacctgtattcccagcacttcgggaggctgaagcgggtgaatcacctgaaggtcaggagtttgaaaccagcgtggccaacatggtgaaaccccatctctactaaaaatacaaaaaattagctgggtgtggtagcgggtgcctgtaatcccagctccttgggagcctgaggcaggagaatagcttgaacccaggaggcagaggttgcagtgagctgagattgcgccattgcactccagtctgggcaacgagagcaaaacttcgtctcaaaaaaaaagagtgctaggttcctccatagttgttgctagctaactataaaagttgagacttacattcctataagacttcctactgccccccaggctagctctacggttgacagtatctggttaattcatttgtttcaactgaatataactaataaaaataattggattcagaagaatgtaaaactctacataaccaataattctatggtacatataatgaattttattctgatcctatgtgaagaagaagaaaatcaaagttctttgagatccaaagagttactaacagatttcatgtgttcttctatccaatcactaacacctatttatcgagcttgcctgttggttccagaaagtggcctggaggggccagacagttcccagagatccaaaaatgaataagacacaggttatgcccccaaacacacagactagtgagggagacagataagtaaatgatgattatgggagcaagtgagaaggtccttaactcaaccttatgggttaggaaagtctccttggaaatgttttgagcatatcctggaaggtgtggccaatgtgagaaaattgcatgtgactcagaatggctgaagtagagtggtgagggatgaggccagaggggtacacagagccagatggccttttcactgttctaaggaggtgtattagtctgttctcacgctgctaataaagaaatacccaagactgggtaatttataaaggaaagaggtttaatggactcaccgttccacatggcgggggaggcctcacaatcatggcagaaggcgaaggaggagcaaagccatgtcttacatggtggcaaacaagagggcttgtgcaggggaactcccatttacaaaaccatgagatcttgtgagacttactaccacaagaacagtatgggggaacccgcccccctgattcagttacctccacctggccccacccttgacacgtggtgatgattgcaagtcaaggtgagatttgggtgggtacacagccaaaccatatcaggaggatagagtatcttgaggagatggaagtttctaaagatgagggtagtacagtaaggttgggtgctttttggaacgatctctctggctgcagtctggagcacagattggagatgagaaagaaaagaggaggtgataatcactctttaggagcttccttcagcaacccagtgagcaaagatggtggtcatggcagaggaggggcgagacatgggcaggattaggcaggattaaagaggcacgatcaacacgtcgctgtgaaagcaacccctggattttgcaacaagtgccagactcttctcctgcacattatttgagcaccaaaacttggggtgtcaccagtggcatttaacgtaaaggttagtttgaagattcccagtgctgaaaaagtcctcttggcctgattcagacctggctggcactgtcaggctttcaagttcagtgcccgtctcagaaataggaaggtattgttctggaaatggctaaaaacatgaagttgggccaggagatgtgggagtgtgttggatgctgtataacttgccttctgtgatatttatttatttatttattttagatggagttttgctcttgttgctcaggctggagtgcagtggcgcaatcttgactcaccgcaacctccgcctcctgggttcaagcgattctcctgcctcagcctcccaagtagctgggattacaggcatgcgccaccatgcccagctaattttatatttttaatagagacggggtttttccatgttggtcaggctggtctcaaactcctgatctcaggtgatctgcccgccttggcctcccaaagtgctgggattacaggcatgagccactgtgcctggcctaccttctgtgatttttaaaattttactttatagacaaggtcttattttgtcacccacgctggagtgcagtggcatgatcatagctcacagcagcctcaaactcctgggctcaagtgatcctcccgcctctgcctctggatgcctggctaatttttaacatgtttcatagagatgggggcgtcttgctatgttgcccaggctggtcttgaactcctggcctcaagtgatccttccatctcagccttccaaagagctgggattacaggcatgagctgttgtactctgccaccttctgtgattttgatttttccattattaatcttgagaggctgcctggtagtgtaacaaagacacttaattaggaatcagtagacttgcagtgagtcctgattgtgttgactccttgtcctgtgacctttgactttggcaaatgacttccctctgtggcctcagtgtcctcatctgtataaacatggtgctgggtagagaatgtatatgactgcaagatcacattcagtgccccccgtccatgattccctgagctcactgcctgaattgtaaggcattaggaatttttagggactgctctcaagaaccacatctctctctttaatgaaagcaattgtggcactctggcttcagggaggtttatcggaccatttctgggaagggatggaaaagcttttgttttcttcttagaggcatttttaggagctgtaacctggttattttgctttgatctgggggaaatagaaattccagtgggctggtggcttgcacagtagagacctatttgagccttgggtgaccccacccactcttaccttgcaaatttctttctttacccagaaatcagtatttaaaatactttgtgattcagaaatgttatcattttgttctcatagaggaaaagtttttgacctacttttattaacttgttcaaacctgaagtaaagacatagttataagggcataaagtcagaaaagacatttttgttcaaatttttacattgcttgcatatggtctgaatttcgctagatagcactatcaatctttggtatgctttagaaatagaattgaatgtattactaagcagtattaataattacattttctcaggagttcaagtgatgggaaacggtctttaatctcacagttattttaagagcttgaaatataatgtatgaaagaagtagggatcacccagctatcatatctttgctatttacttattttatggataaactaatgtgttgttcattttgattagcttgtattttattatagtttgcttgattttcagatttgactttaaacgtacttgaattatgtttttttctttaattttgatttatggatgtaaggaagaagaaggagagacagccacagaagaggtacggtcgaccatctttaacagctgtgcttaatctgcttaataaaaacatcttttaggtgggaggattgcagcttgaggcacgttcttaataacataagagagcgatgcaacccacacacccagaaaatcctcctttaacatgctgagaaggaaagtaagttggagataagtttgtccgagggaggtggagagagaaacggggcttggctgtggactctgttcggagccccctcaggtgaaggtgtcttccgtggtttctcactgacatcaggccaggccaggccagggcactggctggagatgcctgctcctcgtccttttccaccctgttgaatgcactgggtttaggcatcctgcatggtggttagtggtgttttcattgagggagggattccacctatgtttatgtttttgaacatctttgaattaatcacttttattgtttttttttttttttttttttgagacagggtctcactctcttgcccaggctggagtgcagtggtgtgatctcagctcactgcaacctccgcttcctgggttcaagcgattctcctgcctcagccttctgagtagctggaattacaggcacgtgtcaccacacctggctaatttttgtatttttagtagagatgggatttcaccatgttggccaggctggtcttgaactcctgaccccaagtgatccacccacctcggcctcccaaagtgctgggattacaggtgtgagccactgcactgggcctggattaatcactttaaaatgctagagaactaacttaaaattatgaacacaagggtagggagaataatttactaagttacgtgtattgtctagatgtttcagcacaaggtcatcaacattaaaaagggtcccaaatgtcaaaagaaatccccccaaagaaacttttgttaacttttttttttttttgagacggagtcccgctgtttagcccaggccggattgcagtggcgcaatctcggctcactgcaagctccgcctcccaggttcacgccattctcctgcctcagcctcccgagtagctgggactacaggcgcccgccaccgcgcccggctaattttttgtatttttagtagagacggggtttcaccgtgttagccaagatggtctcgatctcctgaccttgtgatccgcccgcctcggcctcccaaagtgctgggattacaggcgtgagccaccgcgcccagcctttgttaacttttgaaatgacaaaattcatgatctttatagaaaatttaaaaaatgcagatagaagaggaaaatgaacatagcttttaaccctcgttacccagagataaccactgtagctacatacacacacacacacacacacacacactgtagctacacacacacacacacacacacactgtagctacacacacacacacacacacacacactgtagctacacacacacacacacaccccatcaatttctggtgaatactcttgtagtctccttttttttcatggaatgtgtctatatttggggaggtagtcagtacagatctgcttcatcattttaaatgttaatatatcaaaccaacccctcttcttagacctatagattatttctagtatattctacaccatgatttctcaatatttacgtctttccaataattatttcttttgtttctctcttgctaggccagcttcaaaatagaattttaaaaataagataaaaacatattgttaatttggaagaaattccagattatatatataggttgctgataacttttgcttcaagaaattagcttgttacaagaaaatgtaaccaacttgtgcatttaacagctcatcctgacaaaattcaatttgctgattctttttgtatttgattcttctaactatatatatatatatatatatatatatatatatatatactttctgaatttgtaaaggttatttgctgagaatggtttgttaatatgagtggagactgtacacttaggtgggattataaaacctgttaggattaacatatcattctaaagcaccattctaaattgaggactctgtgtttagaaggatgattttttttatgtgtgtgtatgtatgtgtggtatgtgtggtgtgttgtatgtgtggtgtatgtgtatttgtgtgtggtgtatatggtgtgtggtgtgtttggtgtgtgtgtgtgtgatgtgtgttatggtgtgtatgttatggtgtggagggtatgtatgtgtatgtgtgatgtgtatgtgtatattgtgtgtgtatttgtggtatatgtgatgtggtgtgtggggtgtgtggtctggtgtgtgtgtgtgctatgtggtgtttggtatttgtgtgtggtgtgtatgtggtgtgtgtgcgtggatgtgtgtctgggtggtgtgtgggggggtgtgtgtgctgtgtgtcatgtgtgtttccgtggtgtgtgtgtgtttgggcggtatgtgtgtggggtgtgtgtgtggcatgtgtttgtgtggcatgtgtggtgtgtgtatttgtgtgttgtgtgtgtttgtttgtgtgttgtgtggtggggtgtgggaggctttgacctctagtccagcattttacagtctttttctcactgtatccttggcccttatgcttcttaatactaatgtaagttttgttaaaataagacggaagaaatagccatggagggtgcggaaggggaagccgaggaggaggaagaaactgcagaaggagaagagcctggagaagacgaagattcctaggccttttcatgcttcatttcttccacttctccaggtagctacaggattctggggtggaaaagctgctagttaccgtactgtatgctatctgcggcacattttgcttagtaacaggagaaagggaattccaattcagggctgtctgtctccttccaaagccctggtctgcacacctttctggcggggtccagctcctttctagagctgcggggctgctgacctttcgtgggtctgtttcttgcacactagggcacagaaggctatggttgatgggatttctaggaaaaagtgcacctttgatgcagggaagagttttgttttgcatttacttcctcctcttcctctatataaactttgtttgagagaagatacagcaagtgtccttttatcagcattctgtaacctcaactcctccaccaaccacatgtacaactttaggggggtgactactgatgttcagaatgatggcaataaattataaccttaaaaaatcacaaagctggtgttgagtcatgaaagaaaattattgctgccacgggtttagtcgtcagtgcttggtactccatttccgtttctattaaccagaacgctcctctggaaacaccggggaacatggtgaagtccctttaggtatctttgacaagtaagctcttgctgccttctggttttaaacttcccttgatgatggaaaataattatgtaattcttactagtttgataagtgccacatattagtgaacatttattaagtgttaataagacaatagaatctgataatggatcttgaggacatgggcgaatgcttaaatattgtgagccatacagataggacagcatgcgtgaaaacccctaaagacatgaagtgcattagccgggtggggtggctcatgcctgcggtcccagctacttgggaggctgaagcctgaaaatcacttgaacccgggaggcagaggttgcagtgagccaagattgcaccactgcactccagcctgggtgacagagcaagactctgtctccaaaacaaaaacaaaaacaaaaaacaaaacaaaacaaaacagaagacattaagtgctataaaaatatctgttttttcctgatatttggcaaatacctaggtacatgttgtattattattaatatgattggctttgcaactgaatttgaggccatagtttattctctagggcaacattgctcatggttttgctctggagctataagcgttttttaaaaaatttaaaaaagtttagtctttttatctcccatattatgcctccactgaaaattaagacggctttttgggctgttactctcaggagataatgatggaatatgcactcattattctctaaatgagagacacttatcaaaccagtaagaattacataattattttccatcgtcagtagaagtttaaaattacaaggcagcaaaagctgacttgtcaaagatacctaaagtgacttcaccatgttccccaggcaggtctctagttaagaattggtgcatgtacaaagaagggtggatagaagggtttatttggagaaggaagaagaaatctttggtgctctttaaaaattggctgacaaatagcaatgctctttgcaccaaagtccaatttgaatagtagggatgtcccttcttaatagacttacaaaaaaaagctgatataaaaagcacttaatctatttttagagcatcttggagctagtgagggtggccatcacactttgttattggaccataaaggttttgtcattcatttgcttgaatgagaaagtgattctagcccacgatttgatgtctctccagggtgtttctttcatgctctggacccacagacttctactttaaagccctctgcttgccacttggttacaattccatttctaaggagtgggttgggactcatttttgaaaaaaaggaaactggcaagcttaagatattctacctgaagaatggtagaaaatgaaaatatgattatatttatcctcataccagaaacaaaacaaagcaaaacccacagtaacagactcattggtcctgtttaaatccatgtctgttcactcagcttggaaagttctttaaaaattgtgcagttttaatgtgataattataaagaaatattggatgtgaaatggcacagccgagagagaatctttaatgtagacagatggcttctttataggccatttccaaaaaagaaagaaaaaaaggcaagttacagttgtggctagcacattctgcctgtttctctgatgggttctagtttggaatccagtccctaatagtctgttgtgaggtcaaaatgtctgacagtgaaggagtaaaccaggcagcaccctaaatcccagccactgactcccgaagagagtcaataacctttaaaatgcgacatgatgatgcagtcaggtattctgcaaactatttggcttccaaaaacaaacccatctcataactcatagattatccatgcattttatttgaaaagacgattttagacagaacaaggcaatgaatggaactatgaaagaattctcatttcccatagttgaagttggagtcagaatctattattattattatttatttatttattttattttttgagacagggtctcactctgtcacccaggctggagtgcagtggtgaggtcatggctcactttgacctccctggtctcaggtgatcctcccacctcagcttcttgagtcgctgggattacaggcacgcactactatgcctggctaattttcgtattttttgtagagatggggtttcaccatgttgcctaggctggtctcgaactcttaggctcaagtgctctgcccaccttggcctcccaaagtgttggaattacaggcatgaaccaccacgtctgacctagaatctaaattgatgtttgagtcccagggcaaataatgtccaatatgagactggattctacctccccaaagcttgccacttaataccttcttctggtgtagccatgaaccatttagagctccgcctctgggaccaagctgtcaattcagcctattttccatgaaaacacagtgggaaattataattggagatgttgtcttccttatggtgtttgatatgtgtttatgcagagaaaggatataaatctagcttagttttccatgagacaaattccctttcctttcagtggggagcaaatgatgactagtggtttatagaataaaaggcaacactttcctttattgtatgttaagtgatgaagattgtggtaaacattctgtgtctttctctacagtctttccctaatatttgccttttcttttagaaaatggaagctatgaagcaacatttcaaatgtctctccacaaaccaaactcaacagaatactttggcttgaagccggcacacccagggttactgaggacttatgctgcctgacctggttagatgtacatggaggtatctcccgaatcatacaaaattaaatgtgaagaccgtttatgcataccttcatgtgcctgacagtcttggcttttgaagatttttttttcttttttgctctgcatagctagaccatcttattaataatactctgaaaaaaatgatttcaaggcatggaagttctctgtgatacaacaatagtatttcttcaaatgcgccttatgctacttatctcagaaacaggttttaaaatgaagtgctttccagagaaccatcatataaataaagattaatagaaaaat

SEQ ID NO: 36692 - DNA, 25525 bp, Homo sapiens
gacaaaaaaaaaggtctctccgatttcctctgctcaaccagttccctggctacctgaggccctgcttcacctggaggaagacagtggtaagtttccagcatctccaccacacctcagcgccagaggaccctcagcctccctcgcacacctctgggcagtttggtaactcatcccatctcctcctgccgcttcatcctctaagccctccccagggaacccaggaggcgtctggaacctgttggggacagtccctcacacctgccccattgagtaagggttcatgtggatgcccatcctcccccaggagtcccaaatctaagacactctgagactcctgtcacccacccccaccttacacagccggcctttctgtgcagtccttccaggaaactctggctggacctgggctctcggcttgactgcactctccccaagtccccagggcggccagtggtgactattcttgaaaacgagcttggcagaggatctggggacacgcactccagatgcaaacacgtttgcactctttgggctggaatcccctcgagcggtacactgcacccgtgggcttgctaagaaaccacctcacagagggcagattgattggacaaaaggcatttggtccccaaattgattgacgtgtgtgaatgggagttttcagaacaaagacccaaagatatgggggaaacaggctgggcgcggtggctcacgcctgtaatcccagcactttgggaggccgagggggggcggatcacgaggtcaggagatcgagaccatcctggctaacacggtgaaactccgtctctactaaaaatacaaaaaaattagcgggggctgtggcgggcgcctgtagtcccagctactcgggaggctgaggcaggagaatggcgtgaacccgggaggcggagcttgcagcgagccgagatcgcgccactgcacttcagcctgggtgacagagcaagactccgtctcaaaaaaaaaaaaaaaaaaaaaaaaagatatgggggaaattgccatttctgatgcttaggctcaacaaagtatggacatccatgcgggaacacagatgaaccaagggacctgcactaatgctcctggaccgcaaggggaagcgcagcgagggctgttggtctagatttcttgaactttctgagcagcattccttccttctgggcatggagcaggaccctcctggaatggggtcttatgccctacagtcaaacaagagaggtcagataatttatggccagcttctaaacacaaaggtggagggaaagttagagcaatatttttaggtttgatgtctggctgtgtggaaaggcggggttctgatttctatgacctgccctggggaaaatggattccagtttctaaggccagcttcggggaaaatggcactgagagacaggagagcaagagaaggtcagagaaacactttttcttccgaagctgcttctgaggccttcattttggggtattgttttctgatgcccaacatatctgagctgctgaacgaagggtagctgctgaaccactcccacggtgacttggaatggcttagccagccggccttgggccacctggctctggcccccctgcccaccaggactttggccggctctcgctcgcctctgcgatgtccgtcccaccctgtctcacccctgcagttttctgctctgtggagcgatgattgacacatggcagggggacactggttttgacatttgagcctgtgcccagcccttgcctggggaggaggtggggcaggagtcctgaatgagcatctccctacttagtgacagtcaggggcacggagaatggtgcccaggccaagggcagggcttgggccaagtgtgcgcagcgtggggtgtgtgtgctccagcggctcctgctgcggagggcggcatgaggcttgtttacctgtgtgctggcatctctggtggcccctgcaagggtggggaagtggcaggcagggtgaaatggggaaaagtgggctctcaactgctcctagcagcctccgggtctggggagggaagtgaggaggggcccagagctgtctcctggtcactcttctggggctctgtgcagacctttggcagggccaggctacaccacaccctctacaacctcccctgacttcttcccctaacccctcaccaccattcctccgcttttctctccccgcccctgcctcccctccattctctccttccctccacctcccggtcccatcccctgcccacactgcccctcctcaggcccaaagtggacaccggtgctgcctgagggtcagagtgtccacctccagcagcccgggcaccgggcaggattcaagctggagggggctggggcgggcgaagccgggcacggggcgagcccgctggtgggcggggcaggggcgggtccttcgaggggaggggcgggctcggccagtgagagcgcagaaaccgtggcacgggcgctcccggaactggcgattgcaaagcgcgagggctggaactcagacccagaggggcggtccctgttgcaagtcatctcccgaaagggcggggccggggctcatcccggaaggaccggtgtctaggtcaccctggagcgctcaccccaccggcacccgtgcccaagcccgcccctgcaaaggcaggtactcgagcacactccggagagggcggcctctgagccccgaaccccgaactccggcgcagcgtcgcacctctgcccaatgaggtgcccctgacgtgcctgctgcggctgccctgctccccccagcctccctgcatcccgggatgggggagggcgccaggcgcagctcccggaccctcaggggtctccccgccctaccccaccagcctgggttcggtacctcggggctcagatgtgcagtcagctgttaatgtggcaaaatttggggaagtcctctgcagccgcaaaatccagttcccaccagttggaggccgggcggggaagggtggggacagacagcactccgctgtgggaggtaaggcagagctactggggagcctggaaggctgagctatgtctcccctacgcaagaccattccagaagccccttggagctctggctgctggccacaggggaaggtagaccttccctgagagctgcactgtgttggggacagggccactgtgggcctacggagggcctccaggcacagggacccacatcagccctctggccacagaaggcgctgatgatttgaggtggactcagccaccactccgagcctctgcctccctctaaaagtggggcatggcacattcctgtgtcaggcaaccaggcactgagcctggcccacctgcaggggtcggggggagcagcttgtccctgtctcccctccccgggaggctgtgtgcctggagaccagagctgtcaaaagtggaggagggggaccccctgatgtgtcctctaaggtccaggtagcaggagagctccactggggagggggtcctgcagtgctgtcctctcttgcaggcaaggccaggcgggtgctgcctgggacccagtgactcagcacccctgcccggatcaactggacttttgccccctgctccgccagcctcctgcttggatctctcctgggtctccctgctgcgcctgtccaggatgcagggagctcgggctcccagggaccagggccggtcccccggcaggatgagcgctctaggccggtcctcggtcatcttgcttacctacgtgctggccgccacagaacttacctgcctcttcatgcagttctccatcgtgccagtgagtaacacaccccagcccctgcagccccagccagggctgaaccgctgttcctcctgccctccatctgggccgtcgcagagagtgggggtgggggtttcatgctgccagggcccctcccagttgggactcatgccacgcttaagctgagtaagttaaggactctgcctctggacccccgtcagcacatcctgtgctccagcttcagtgccagccccgggagaagccatggggagccaccccacttccctcctgggggcagcacctcctcaaaccttcctagcgctgttcctcctgcctctcacccggcagcctttgccctctggagtccctgccccaagggctgttcaatccggtgtggctctgggcggatcacccctcagagaggctctccttgcacctgcccgcagcttctatctctcccctccatcttcttgggtccttgttgtccactaaatgatctgtggcggcaaattgatctcaagctttttcttgcaagagatagaatgctgtcttattttattatctctgttgccaaatgcggaaacatttcattggcaaattcatgttagtttagtgtatcattcagtagtctataccacagtgtgtggctctggaagctgtaatagtaatgattaaattatattcaccaagtctggagaggcttgggaacaaagtctcacatcaccaagaagctcaggcagagtcagggccaacctcggcccttcctgtgtttgcttctgggaagcccggcgtgcgtgggctcagacagctgccctcctcctctcagccctcagagcctggacctgggcatctaggcgggagtggggatgggcctttggcaccattccgggcctggcagaggctcccagcccgagggtgagcctaaggatccctccccgccgtgcctcaggcgccccgcccactcctgctaaatggctggggccaagccctgaatctcctccctacccgtggggaaggctgggcaggagccttgcttttctcatcataaaatgggtaataacagtccctccctgtaggattggtgcggggaagagtgaatgagaagtcagaacccttcccacagctgggcacagagcacaggtggagtggcttcagccacccatcgactctcatggggagtaactccgtgctgagtgcccaggagctgaccctgatgtcagaacctgaaatattgcagagtgtaaaaatcctcaacagcccactccctcggagctgggggtccacacgcacaggggctgcagtgggaagggggcgaggtcttcctcatagagaaggcaaccttggagcagggctggaaggaagcaggagaggccccggggcagtggagagagcagagtggctagagtggaccggttgaggccagaatgggaccacaccccacctgctgctcaaagaactccgggctggtgatggctgtggaggaggtgagaggtggctggattttgcatgtgttgtcaatggactgtagtgggtgtgagagaaagcagggctcagggagcactgaagatctgggcctgagcccataaggaaggaggcatggacaggaggagagggaaagatgggagcccagttggggacgggttgagtttgagacgattttcgaccccagtggagagccgaagggagctggacacaaggcagttcagcacagaggctctggggccctgcagcatggagacggtcatgggctgggctcccccagagggcagggaggctggaggtcggatgagctgggggaactggcagtggtgatggaggaggggcaaaggacccagcacagcccagagcagcagaccatcgtggaggagggaagaagccacgaaggcaactgtcactccagtgggaggcctgccaaagcggaccactggaggcagcagtgtggggtcaatggggacctcagggagaggggagacagcaggaggttttttgtccttgcaatagtttgctcagaatgaaggtttccagcttcatccatgtacaaagcacatgaactcatccttttttatggctgcatagtattccatggtttatatgtgccacattttcttaatccagtctgtcattgatggacatttgggttggttccaagtctttgctattgtaaacagtgccgcgataaaaatacgtgtgcatgtgtctttatagtatagtcccctggggcctgctccgagggctgggagagaaggaaagagatggaaagagaggaggctgcaaggtgaggcagctgctcagagctccgccctcaaatatgtgggagtagctgtaggggagggtcaagagaacgcaagagaagtaacaggatgtgagcatgctccattgccaccccctcaaaaggggattgtgcagagaaacggggagagaggagcactgggagcttggtccagtgggtgcccccacagaaggggactgtgcagagaaacggagagaggaacattgggagccctgcccttgaggaggcaaaaggttgggatgtgacgcaggcagggaggatgacttgggtaggcgaggacaggtgggcaggcttggggatgagaaactcagcatcctctatgaacagacacttctcaaaagaagacctttatgcagccaacagacacatgagaaaatgctcatcatcactggtcatcagagaaatgcaagtcaaaaccacaatgagataccatctcacaccagttagaatggcgatcatgaaaaagtcaggaaacaacagatgctggagaggacgtggagaaataggaacacttttacactgttggtgggactgtaaactagttcaaccattgtggaagacatgtggcgattcttcaaggatctagaactagaaataccatttgacccagcgatcccattactgggtatatacccaaaggattataaatcatgctactataaagacacatgcacacgtatgtttatcgcggcactacctacaatagcaaagacttggaaccaacccaaatgtccatcagtgatagactggattaagaaaatgtggcacatataaaccatggaatactatgcagccataaaaaaggatgagttcatgtcctttgtacatggatgaagctggaaaccatcattctgagcaaactatcgcaaggacagaaaaccagacaccacatgttctcactcataggtgggaattgaacaatgagaacacctggacacagggcggggaatatcacacactggggcctgtcgtggggtggggggaggggagagggatagcattaagagaaatacctaatgtaaacgacgagttaatgggtgcagcaaaccaacatggcacatgtatacatatgtaacaaacctgcacgttgtgtacatgtaccctagaacttaaagtataataaaaaaacaaaaagagagaaaagaaaaaaaaaaagagaagctcagcatcctcacactagcggcgctggggaggggagggatggaggaggcagaggtttactaggggaatgtggggtgattgtcaggtcaagctcacaaacaaaggagagatctggcagacagagggctttcccatcctcgagggagcagggatggagctgaaggaagaaggagtctggggttggggatgggggggttaccgactgcccttgggactgaagtgctctggggagaattcgtgtggaccaagggggacagtggaaagaaggggagtgggaccccaagactgagcttagggaaaggtccaggggagggggcgggggcggtgtattagcatctggggctgccataacaaagtatccaaaaccctgggggcttagagcaacagaagcctattgtctcacagtttgggaggccagaagtctgagatcaaggctccctctgaaacccacgggggaggatccttcccacctcttccagcccctgggagcccagacatcccttggcttgtggccacatcactctgtcttcccatggatttttacaacgtcatccatccgagtgtgtctgtgtcccaaattctcctcctaatgaggacacgggtcacattagatcagggccctccctcatgtcctcactgtaacctgattaaccccatttcctaagaatgtcacattctgaggttctggaggttaagacatatgaatttggggggtacacaatgaagcccataataagttacatcactggaaggagagtcgggaactcagaggcaggggcagggggaggagcggctgcagggggaccaaatcacagagaattagggcaggatataagggtgtccctgggagggatgctgtcatggacctactcctccggaggggctgaagggctggggcctcacagagcagactgtgtcctgctgggcaatgggccacctcttggaggtcacttgggggccttgggacaatctgttgctggccaggacactgctgctggcgtcccccacaaagttttgaatgaatgaagacaaaatggtgggggtcaggtgcctctctggggcgtgcccccagaggggaaggaccctagaggccaccctgggctcccgcctaggagaggagttgcaaggaccttagagaccacaacaggcttccgcctaggagaagaggagcagggtccccctgggaagggcccctcgatggtcatactgtgcagtcaacagaacccaggccctcggtcccctcccaccccctgcccatccagggaccccagattctaggccctgcagtctttcccagcccctcccccgggctccctcctgtgtttcagtacctgtctcggaaactgggcctggattccattgccttcggctacctgcaaaccaccttcggggtgctgcagctgctgggcgggccggtatttggcaggtacagtgtgtgtgtgtacaggggctctccccacagtgacccaggccccctctcagacgccatgggctcagacgggccaggttccctgaccccacaccggacccccctgggatgacggcactcctgtgtcacaggccgatgggggtgcagaagaactttggcccctggtaggctcccgggtgtcccacccacgccttccactactcctgcctgtggccagagagagagtgtgactggtgaacacctcgtggctgtaagcaccagcccgtaggcctgccgagaccaggcaggagggactttgggggctccatacaccccgggtctcagtgctgtgggaacactgagcttgagagaggacagggacatcctcccacaagccacagcagacaggggagcaagggacacgtattgggagttgcctcttcagagcaacccgtaggcagaaatgaagggttccgcaggcagcagaccagcagcgatctctgggagggtttccagtggcccagaacagaagggagaaaggcgctgctttctcagacccaacctgacaaacgccttctgtaaaacgcgggcccaccctttggtcccctgggattccaccatttatttttacacggagttggtctttgccctgggtcagactcccagctcagtgaagctgtctgcgcacagccccactgggacgctggggaaactgaggccctgagaggagggaggcctcccagcagccgcccaggcgcccccgccctccatccccatcccgcactccagcctccctggtcagccccgcctgggcagcccctggacggggggaaggggacactgaccgcctccgtgagggtccgacccgcccctcggcccccaggttcgcagaccagcgcggggcgcgggcggcgctcacgctctccttcctggctgccttggcgctctacctgctcctggcggccgcctccagcccggccctgcccggggtctacctgctcttcgcctcgcgcctgcccggagcgctcatgcacacgctgccaggtagggccggggggactggagtccaggtggggccgggtcgggggcagcctgcggaggacccgggacacctccagggaggtctgcgtgcgcgcggggtctggccctaagggctggacgggggtggggggcgacgtggggcgtggcttgtggaggggcgggtcagggggggaagggccccaccgaggggctttcgccgctcagctcccccgccccgtccccagccgcccagatggtcatcacggacctgtcggcacccgaggagcggcccgcggccctgggccggctgggcctctgcttcggcgtcggagtcatcctcggctccctgctgggcgggaccctggtctccgcgtacgggtgagtggtgggggccggggcggagtctgtgggtcaggacgcccgcggctgggtcggccccgccccgcctcctcttggcctcggtttcctcttttgctcgtggggcgcgagtggccacgtgatgtggctactggggacgtctggccccgcgcgaggcctaggcctgacctcccgggctggctggccctggatagggccaggtgatgtcccagtgctgtccggggcgcgactggactgccaagctgtccacgcacagccccactgggacgctggggaaactgaggccctgagaggagggaggcctcccagcagcctcctgctggggacaggagcaccctgggactgggatgctgtggcagcggggctgagctgttggacggtgcccagagcacacctccctctccggaggtctctagggctgtgctgccggccttgtttgagtccccgaacgttctcccagcattttcactggagcctgggctggggactgatggctgctgatggctgtgagcaggaggtggagtggggtggggtgggtagtttgaacacctcaacattgcccccaggactctggttctagaatacagcggcagacaacacaggctgagtccctgggatgaagggaatgtgataggaattcccgtaacatcaggctgagctacatggagcaaaaagtcacaaagtagaactgggggctcgatggatgggatcactagggcctgtctgaggaggcggcatctgagtcgaggcctgaagcaggagagggaggcaaagaaaccacggtgcagaggccctgggtgtggaagccagggggccgtgtggctggagggaggaagaaggggcaggcaccaggccggggtgccctgggtggcacagcaggggtgagaatggggggtgagctcccctgcagggagaccggtaggacagccattgtgccggccgaggtgggggaggacagtggctggaccagaggggaccgtgatgagagaaagcagagggtagattctggctgggttttgccagtgggtgggatgtgggtgggaactcaagatggcagtgccaaggccgtgcctgaccctggggagcctggcgccttgcgcagaggcccaagcagcctggggtgccactgggatttgggtcttgttcaggcccagcctgggtgcctgtcaggcactccagggagctactgagtaggcacccagataagggggagaaatggggtgcatcttcaagtgtggatggctcggagccctgcgccccccagcacttcatgtttcggggctgggaggtgaggagggagcacgtcctgggagccaagggccactggatttgtgggggtcagggacccgtgcctctaccgctggtggccaaggaagccacagtggcccaccatctgcagcagggaggccaccccagtgctggaccagcaccaccccctcaagtcagtgccagccgcagaagcctcatgcaatagacggatcaagggaaatggggagaaaagagagggggtcgggaagtcgtgctataaatgggggcagaggtgggtccaggaggctatgctcagggtgggaggagccatggggaggcgccccagggagagggaagggctgatgtgggagccaagcacactgctgggagggtgtccctggaggatggggcttagggcacttgtgtgggcagctctggtgggacagcagggacggctcaccctggggccagggggctggcaggtgtgaggtgtggggagccggcaccacccagggcctgtctctccagggtggccagggtgaggaagggcgtgaggagggcacggggaggagcactgggccccagcaggtggctgagctgggcggctgccatcccagggtgctgcccacccccaggtactctgccggctcagggcccagccgcctgctgccgcctccttccctggccagccttcctcacctatgaaatgggccctcccctgcccttactcacccacaacgatgctgggagggtccgagctcgctcaggcagtaagccgtggccatggtgctggagcagctcagcacacatgcctcctgcaggcccgtctacgaggccacaggtcccctcctgtcctcacctgccctttcccccatcacagctgctgacccagaagacaccactcatgtccctctccctcccagtagctgccaagacggcctctacctctgcccacacctgccagaacattccattcgcttccctgcctccattcatcccaagatctgaggcgctttacaatcttgacgtttcataatcagaccagctgtgacatttcctttgatgggaggggtaaccgaggcccaggagatgatgaggctccctccatggagctccccagtccccgtccaaggcccaggcagtgtgggactccctcaggttcctcataccacacccaagacacggggtgctgcttgggcactgtggcaaaagctggctgcccagagtggtggtggcacaggagggctgcggggttgaccttgtggctggtaatctgcctttgtccaacccagacagggtgagggaggcccacacctccccctcgggggctcaccgaaggcagtggggccaggtgccagccaggctccaaagcctggtgccccatggcaagggccagccccctggccctcttggtccagctgccccaacgcctgcagcctgttctggctcctggcctggtgcggggcaggagtctggtgcagctgtgaacatcccccgccttgcagccttcctgcccttccttgatggaaaccgaggcacaacatgtgtgggctttccctccctgcccacccacctgtgtatcccattcctctggaaggccccagtcctgcctcatccgcacccacctgggcagcaggtgggaggaggaagtggacttggcacccacaggctgcgggggcgggcactggtataactggtttgggcccagcctccagagcccagggctgagaggccaggctggcctgaggagggacccgggacctgagtcactgcacacacgctgggtggggggtggctctgtgactcatgttctgagcccagcccctcacagactggggagggatggggaggggccatagagtcctatcctgagccagacagcagggagccctgcagggtttgccttccccaggtggacaggcagccaccagggccatgccggtgccatgggggtgccagggccctgtgggcaggacacccctgcccagccaagaaaaaacaaggagccaggggcactggagctcagagagggaggaggggatgggaggggaggtgagcagtgtcccatacgacccagggcaccccaagcgctgagcggaggctgaggagtgcaggggtgtttgtaacagggcacctgctgtacagggaagaggctctcgggggcagatagatgcagggcaggggctggcaggcagctgagggagcagcaggatatgggcgacccaggcccgccgcccccccagccaggtgactcagctactgccttagttcgtgtacctcgcagtgcccaggacactccggttctttctgttcttcccacagtgggcaggcagcaggccccgctgagatggttctggccccgctgtccctcaggacagccctgttgagcagcaggctggacaggcctcctgctgggcccgtgagtcactccagtctcagagcccatttggggcaggagggagcttgtggtttggttggagggctatgtgtttggggaatggggggaccaggtacgaggagacacgaggactgggaagggtcaggccagaggggcctttaggaccttctggggcacgctggaagccagacggcagctgcgttaggagtggcatggcaagatgttcattttcaaacatggttctaactgcagcatcctggagcacggatgacttctctcagccctgggctggacatccagggacgctctggacagccccctgccccatcgtcttgtgagctaggtgtcccacaaagccaggtcccagctgacctagcctcagccccacctgtgggttcgctcctggcagcaggatgacctgggcacatgctgtcaccttgtgcgtcccctttcagagcctcagagtaaggtgaggcttgatgagggcttgtcaccgtagaacacacagaagcccagacttcagcagaggttcctggagacgcgattgaaagccaactccacgccctgctatctgggcagcctcaggtgtgggctgcggttggtgggcaggatgcaggtgggctgcgccctgcaggtccagaggggccccagaacagtggagttaggggcagccggcagctgtgaacccagccctcatttgcatataaggaaatgaggtcacctagcaggtaagcggcagagaagggacagaggctgtgggtcccctgagtcctgtccagtgtcctttcaacagcatccagacagacactcctgtaatccattcaactgaaagagcaggaggagacaaagacaaattaacctgtccccaccttcctggtcgtggctccactgataaaagtgttggatgagccccgggaagccagcgtgcccctgcgtctggcaggtcgtggtgaggttgaggggggctgagcaggaggggctgacggcaccgtgctaagggtgcttccagtcaatggtcccgggggatgcccaggctgtccggcgtgcagaggccccagggctggggccagcgtgctggatttccttcccactcccgtttccctcctggcagttcatttttggggagcaggagagctgtgactggggaaggacagcctgcgtctcccccagcagccacccacggcccctggcacagtggtgggacctgactccctacctcctggggccctccagggtcccccagccccaggctttcctgttgcccacagcagcacaggcctttggtttacccaccaccgctcgagggcctggcttcctgccaccatgccttgcttgtcaccagcctcctaaaatagccatcgaagtggtgcgtctgctcctgtgtacttctgggacatctggcaaataaggcaggttttgcccctgcccagccagaccctgagctgtgacacgcaggcctctgaggccagggtcccaaagaaagggcccgtctctctggggctggccacaggggccagttgtccctcctgcgccatacatctgtgcctgctggctggagggacaagctgtggcgcccgagcccagccgttccccttccctggcattttcccaaaggaagggcccattcgtgcggaaccccagcagccagaaaacctgagtagctgacgtcctgggcggtgggtgctgcaggagtcggagctgccctgatggattggcgggggcagcagcacaggtggggtggatatgccagcacccccctagactgatgtgagcttaggggtcccacctcagaaatgaggggtggccaatgcccagactctctggactcagaggtggccccactgactgtcctagtcagtgtggctccaagtcccctccttgctctggcaaacggatgcaggtaagtgtgtgtacaagtttgcccgtgtgtgtgtgtgtgtgcgcatgtggctgcggtgaagaggggcgaggaaagtcctttctttgaactccttggtggggacatggtggcctgtggctggccttgtttttgggtgcaagggcatcttccaggaccctgacccctactgggtgcctgtgccctgaggccctggccagggcagatttggaggatctgttgaggttggggcagaacttgtgctgcgtgtgtgaatggctcacacatttgtccgatcatctaatgatcactgcggtctccgcgcagggtccaaccctggaccacctgccctcaggggccagattctagccagctggtaaagcgagtccttctcagatggcatgctgtctgggaaggagggctggggcctcaccaagaagggcccttgcaggctgtataggagtttgctcagctgctgagaggaaggccgtggcggtccggcacaggcctggaggccttacagacgagctcagtaggaagccccaacttcctcctgtctctccctgaggggagggggctggctgagcccccaggaggcaatggtgacagttggaacagccagcttcaggtgcctccgtccccaggagacaagacctgccgattccttccaggggaatcacaggccaagtttccaggtggggactcatggcagggaagctgacggtacagccagagtcccaggccttggtagtggcccaggaaggtgggaaggtggcaaagcagcctgaggggcacctccggggctttgcaaggctctgggatcccagcccaaagccccctccaagcccagcatgccccacactctagaaagtggggaggggccaacaggaggggggtcggtttctgagggcctgctgaatgccaggcccacccttgcccacgctggggaggcagcatagccatccccatgacacagcacaggtgcccaggtctcggagagcccctcccagggacatgcacaccaggcttgccctttggagcctctcctgaccttggccagcgtgggagctgctgttcctgggaggatccgccacctgccccaggcgctcaccagcctggcttccacagctgctacccacaggggctgccggggcctgcatggcgtggcgagggtcagggatggtgagcgccccacccattccttcatccatcacctaataaatgtgctctgagggtcccagtccccactctttaggccacagactgtggggatgtgggaggtcagatttaagctattttagtgcaaccaaaggtgcaggttgggggatgtggctggggcgcctgggccctgggacccgcaccctgtgcagccgaggctgttgcccgcaggattcagtgcccggccatcctggctgccctggccaccctcctgggagctgtcctcagcttcacctgcatccccgccagcaccaaaggggccaaaactgacgcccaggctccactgccaggtaagccccgccaggtacaccctgcccagatgctggggcaatggaaggcattggctaggcctgcgtgctccagccaaggggtacggggggcctgaggggaaatctgggggctactcacaccctcctgccttccttgaacccttcccagctgctgacatcatagaagccaagtgaggtgtggtcatgaagaggtggaagtggggctccggcaggcagggaggcccagagaggcaggaaggcccagacagggaaggcgttaggaggggaggcccagacagggaaggtgctaggaggggaggcccagagaggcctggggaggaccaggagggacccccccaatggggtgggtgggccagcaaggctccggaagctctgagtgtccagggagaggcgagggtgctgcccgaggggcactcattggtggagggcagaggatggtcaggctggtcccatgaggagaggccaaggctcctcagagggggtcccctcaaggctggccccctgctgaacgcagcccctttgtgccaggcacgtggcagggcccatgcctcggtgcctagggactaagagcccagcctgggccagagggacccacctgggaccatcctggggcaggaggctgtcatggaattaacctagaaagtccagggggagggccgggtggagatgggcctgtggcgagcacagcagagccagagaggcaggagcccctgagacaataaggaggaaggactcggtgagccgggctgggggcctgtggcttcgcactcagaggtgcccggtgggccaggccacggcggtgacttgtggccacagagagtggtacagtattgccattgtcttcctctgggctggtggcctggtcatgctctgccccaggccccaggccaggaccatataggaagcagctattggtcccttgttcagggactgccgcaggcctccgccactgcatgcccaggttgaggccagtctacctgcgtgcagagaatgcttttcctaagtgcctctggggattcagggggcccctaggaatgcgtagaagtgtgctgaggggcggtgcccaacctggcagctgggagcatcaccagctcccattcccacaagtgagcggtgctgaagccaaggaaggaagctttaccctggcgggcgcaacagggccctccgaatggcgaggcctgcagccgggcgaggggtgggcattgggacaatggcctttgcaggcctgaatggcctctccgtgccaggcggcccccgggccagtgtgttcgacctgaaggccatcgcctccctgctgcggctgccagacgtcccgaggatcttcctggtgaaggtggcctccaactgccccacaggtgagtcccaactactgccccaacagcggccagagcctggcagagtcccagctgcggccagggcccggcccttcctctggcctgtgccccacaggtccacacagatgtggtagagcaggcaggagcgggaggaaggcagaaaagtgtctttcccacctccttccagcccctctacactgcacacctgcagatcccagggtgggcccccacgggcagagggcctggctcgcagccatgcatccctgtgtgctcctcagctcttaccctcataccctgtggccccacgtcctctccagacagcctgagatgcagggacagcaggtctgagtgtcaccactgccttctgcagcatgctggccctgggccctctcagcagaccgtagggcgtcacggaccacagataggatagcgagccacggacaagcccacgagcagccctgtccctcagaagccccgcctggactcctctaactgagaagccaggaagcaggatggagaataggccctcagcactccaactggcaccggcccctgtcccacccagcccacctaggccagctctgttggttctcaaaactggaacccaagttactaacctcagtaacaggccctttgagggcccttttttttttgagaccactgaccaggctggagtgcagtggtatgatctcagctcactgtaggccccacctcccaggctcaagcaatcctcctgtctcagcctcccgagcagctgggactacaggcatgggccaccacgctcagctaatttaagtgtttgtagagacagggtctcactatcttttccaggctggtctcaaactcctggcctcaatcagtcctccctcttcggcctcccaaagtgctgggattgcagacgtgactttgagggctcttataacagagagccgtggtgggtcttgggggccaaatcctcccacgtggtcagccctgggtccctcccttccagcaccttcctgctcacagtccagagcttagcaaccacacgagaggcactttccacaccagggatacggcagaatcccagggaagggtctcattggcccggctggcatcacaggcccctccctgaaccagtcaccagccagggcccagacaccctgattggccaggctgctgaggcgggagggaggtgggcgccaaggtcggggtgtgggggtactcacccctgttcccctgccccggctcagggctcttcatggtcatgttctccatcatctccatggacttcttccagctggaggccgcccaagctggctacctcatgtccttcttcgggctcctccagatggtgagtgggcacacagggcctgctggggggcacggcaggggtctccagtggggcaggcctctgagagtagaggctcctccccggcggaggctggggagcccttggcctcccatctggcacatgtcagggtccacagggaaccaggcatacaggccagggagggagagccaactgcagtggtgggcacgctgtgaggacagtggactccggcctctgatgggcagctggctgggatctgtggcagcccacctgcccaccagctgtgtgaccagagcaagtctcccaaactctccaaatctgtcccatgaggccaaagtgcccgccttgcagggtccttggcagatgagatgacctaacgtggcaaagtggttagaccagcgtgggcccctttggaggtcccataggagcaagacgccagccctcagaggccacgctgtcatggtaggataagacgccagccctcagaggccacactgtcatggaaggatgccctgaaaccctggcagctccgatgcggcaggtgtctgtctgccagccccccagaaccgctcagctcccgggccggggcgagacacctccaccaccagctcctctgggcttctggaccagaccctgggtggtggggacaggtgatgatttgccaccacccaggatggctgcctgacagccagagtgcggggcgggggggctattctgggacccgccagggtgggggtgggggctctcggcctctccggaagcctgtggcattcctggcacctccaagccatctgctcttcagcctctgggcccaggactagactagtgctaaaatagctgctcctgggaggggctggacccccaccgtgggcagagagggcctctgctttttggggcaggaggggccaccctggcagggtaaaaagagataaacagaaaaacaacagcaacaataatagtaacaatccggggttgttgccatggggcctgttctgaacaggctgcgcccagctcactgcgaggaaggacgcttagccaggccctggctgaagcctgcagctgggctggacacagcagtcattggcctgtgttgtgggggacttgggcctgccatggctgcagtggggaccctgcctgagacagacagagctggggtggtgaccaacaccgtcggggcaccctcgcaggaactgggcctggtgaactgcccagggacggggaaggagcagggtgaggcatggggaccccgacacaggttgagcagcgggagaggaggctgaggaggggaaggagggggcccgcagagtagcccccagaccccaagtccggtcagggacaagcttgttagctccaggttcatgtcacaacctgcagggctcctaagttcaagcttttttaaacttaatgggcaaactgagacgcaacacaaataggcttctgaccttggtgtctgagtcctggatctgaagtccttcacggcactcactgtgagcccctcttagacgcactgcacgaagtgagcttgccagctcttcctttaagaaacgtgttaggccgggcgcggtggctcacgcctgtaatcccagcactttgggagaccgaggcgggcggatcccaaggtcaggagattgagaccatcctggcgaacatggtgaaaccccgtctctaccaaaaatacaaaaaaaaaaaaaaaaattagccgggcctggtggcaggcacctgtagtcccagctactcgggaggctgacgcaggagaatggcgtgaacccgggaggcggagcttgcagtgagccgagatcgcgccactgcagtccacgctgggcgacagagcgagacgccatctcaaaaaaaaaaaaaaaaaaggtgttaaaatcccaaaaaaccctaagataaagcaagtgtgaaagtaagatttttaaaccatttatggttccggttggaagcagtttctgttctgcctggcaggaatttgggagggtgactggtcccctgcagaggtgctgcaggctgggcctgccctgtgggcagatactgagcccaggggctcctccagccggggccacccctgcactcccaggcgcgttggcccagcacgccctgcttagtggaggagctgagatgaccagatagagagcctcgccctggcctgggagcagcctgcggccaagcctgtcccaccgagcccatccccgggagcagcctgcggccgagcctgtcccaccgagcccatccccgggagcagcctgcggccgagcctgtcccaccgagcccatccccgggagcagcctgcggccgagcctgtcccaccgagcccatccccgggagcagcctgcggccgagcctgtcccaccgagcccatccccgggagcagcctgcggccgagcctgtcccaccgagcccatccccgggagcagcctgcggccgagcctgtcccaccgagcccatccccggtgtccctggtgtgggcctttccttcctcccttgtggagaggagccccgactcctcagggatctcagacccatcctgacgcagtcactgctggcggagtagggagagaccccggggcttgcagatgctgaggggccttctctgcagaggggccctggccaccacaggccagtctggaggtccccagctttgggggctggccacagtccagacgcccctccctcgcctcccccatacccacttctaccctctctgtctggctctaggtgacccagggcctggtcatcgggcagctgagcagccacttctcggaggaggtgctgctccgggccagcgtgctggtcttcatcgtggtgggcctggccatggtgagggctccccgctttgggcccactcacctgaccctctcactgggcaaggccacctgggcggtaccatctgtgcttaagcccttggggactcctccagccccccacacccacccggggccagctcttcagcagggacagcagtcagggtggggagggacaggtaagaccccagagaggagcctggtcccgtgaggcccccactcagctcggcccccgcctgccgtcccaggcctggatgtccagcgtcttccacttctgcctcctggtgcccggcctggtgttcagcctctgcaccctcaacgtggtcaccgacagcatgctgatcaaggctgtctccacctcggacacaggtgagtgtggccagcgagtggagcagcctcctccaggaagccctaggagctacccggtggggatggggtgggcagcctagggtctgtgtggggtgggtagggtggggggcctggggtctgtgtgggttgagtggagtgggtggggtgggggcttggggtctgtgtgggatgagtaaggtggggagcctgggtcttgcatgagactcctgccctaccacctagcccagctgggggcaggccaggggcctgggagggggctgcccgcaggtggcagttggcttggccctgagaagcacctgaggactttgcctgccaggcctggaggccccggggacttctgggccctcccccagcacggggagtggggcacacaagtgctcaggagcttcctgaatgaatgagggagtgaatgaatgcataccagtaattaaatccaggaatcccctaggccactgcaggggacacaggtcccctagacatagattcccccagtccccacttccgacccagctttctttcttgaggccgaagagagccgctcatgcagactgggggtgtcctgggcccgatgttatccaggctcctgccccaccccaggcacagtgtgggtacacactggccagtgcagggggctcctgtgggctggttgaggtcaaaggactcaggagtcctttggagtactggagattcttccaggcctccccagcagcagatccagaaagctcagggcacacatctgacactccatccacctgcctgtctgggaggcagcagatccagaaactcagggcacacatctgacactccatccacctgcctgtctgggaggcagcagatccagaaactcagggcacacatctgacactccatccacctgcctgtctgggaggcagcagatccagaaactcagggcacacatctgacactccatccacctgcctgtctgggaggcagcagaccaaggtctagaggcccggatgtggccgggctgcaaagggcaggcctattctcagggctgcctgggaacctccaaggccttcggggactgtgactccatggtgcatgggctgatgcaggctgagccaggagggcttcctggaggaggttgggcagcactttggagaggccaggaggatggcacaggagaggaaggcctggggagatgaggacccggcctggctgggaagaggcccctggaggctgagggagaccaggcccaggccattgggccacgtcatgcgcagacaccacccctggcctggtaggagccagcatctggttcccagcagcagcttggaaacccagcgacagaaggggcaggaactgcaccctgagtctgcagaagaggctgctcttaatggtcctccatgctgggccctgagcccaggtggggcctggccagctcctcatcacagctgaccagccctgggagttccaactccaggagacctgggctctgaagtccctggagccagagaccctctgggcacgggaccagaggcagtgtcctcccacctggagtcctggggggtcctcccgcttggcgagtgctgccccccttgttgcccgagtgttgacaacagccacagatagtgcccacgtgcccgtccatgctgcgggtagctggccacaggggcgtggagatgcggtgtcagggacagagcaggctgctgcgcaggtcggggctgtctggggagcctcggaagccgctcggtcttgctctggggacaggaggggcaggtggaggggccctgcatgggcttccaaagcccctcccagccctgtgagggggagttccatggagtagtaggagctccgcagggtggggcggctggaggaagggctgatggccaggaggggccgtgggatgggggtgtcatgcccactctgaactcaagccccaacggtgtctcacaggccaggcttagcctccccactgcatcaccagccctcggtggtggcaggcaccctgggaaagagccgtgagagccagctccctgacagcctgggcgggaggttccgggccccaggcacagatgccatctcccttggcaggcctggcagggcggggccttctgcggtgacctgtggtcccattcccaggctcctcctgtgcttggaaactttctggagcagggaagagactcagcccaatgccctgggaagcaccctgcatggctgagaggtcctcggggaacagaccagtgggtagagagagctgtgtttgctccaaaggctgggcgggtggcagggggtgggggactggaggttagaagctggcaggtggaaaggatgggtgttcaggggagtatttcaccagactatgcaaggtgcggactgcgccgtgaggtcagggtgggtcaggagagatgggaggccatggctgtgttcaggaagtgggcagttggcccagggagctgcccagggcctgactacccccatgcaccccccagggaccatgctgggcctctgcgcctctgtacaaccactgctccgaactctgggacccacggtcggcggcctcctgtaccgcagctttggcgtccccgtcttcggccacgtgcaggttgctatcaatacccttgtcctcctggtcctctggaggaaacctatgccccagaggaaggacaaagtccggtgaccgctgcccagacacagactggcaataaactcctactaaatccctccg

SEQ ID NO: 36693 - DNA, 15309 bp, Homo sapiens
aggcgtgcgaggagggggcatggcggatactgtgttgtttgagtttcttcacacggagatggtggctgagctgtgggctcacgaccccgaccccggcccgggggtgagcgccgggctccgtggggaggaagcgggggccaccaaggtaacgcctctgggagagcggagggcgcgtcaggcgtccgggttcgaacccggcccagccccggccttgcagggcaacgtctggccctggcttcctcctttggaaagtggcgttcgcgacggtgccggctcggggttattgctaaattgagcgcgatgattcagggtaaagcacttagctcaaggcctgagtaagcggctagtaatcataataatgctgttattgggcgtgtgctgaggactcgcctcccccacttactaggtgtgcgacccaatgacttaatctttgtgtgtcctagttttctcttttgtaaaatgagtatcataacgtacctaagcctcagcgtgggacatttatttattcgacacccacttattgagcgtctgttgtattccaggcaccgttctaagacagaatcccttccttgtgaagcttacatttcactaggggagtcaaataataaaatgaaatatgccggctgggcgctgtagctcccagcactttgggaggccgaggccgtcggatcacctgaggtcaggagttcaagaccagcctggccatggtgaaaccccgtgtctacaaaaattagccgagcatgatggcgggtacctgtaatcccagctactcgggaggctgagacaggagaatggcttgaacctgggaggcggaggttgcagtgagccaagattgtgccattgcactccagcctaggcgacagagcgagacttgtctcaggaaaaaaaaaaaagagataatggggttttgccatgttgcctaggctggtcttgaacccctaggctcaagtgattctcccgcctgggcctcccaaagtgctaggattacaggcgtgaactaccgtgactggcccgggactgtgtgtgtgtgtgtgtgtgtgtgtgtgcgcgcacgcgcatcctgctcggtcgcccaggctggctggagtgcagtgatgcagtcatggctcactgctgcctcgacctcctgggctcaagcgatcatcccacttctcagcctcccaagtagctgggaccacaagcgctgctggcgccaccacacctggctaattttttgtattattattattttttttagtagagacgggttttcactgttagccaggatggtctccatcttctgacctcgtgatctgcccatcttggcctcccaaagtgctaggattacaggcgtgagccactgcacccggccaatttttttttttttttagtagatacggggtttcaccattttggccaggctggtgtcgaactcctgaccttgtgatccacccgcctcggcctcccaaagtgctgggattacaggcgtgagccaccgcacctggccatgtaagacatttttattggctctggtttccttccagggttagaagccccagggaggatgttgcttgttaccatctcgatatacagatacaaacctgtcataagtttaaaacatcataaatcaaaaatgcatttagccagatgtggcgacttgcacctgtaatcccaggtactcaggaagcagaggtgggaggatcacttgaggcccaccgttcaagactagcctgggcaacatagcaagacctcacctctaaaagaaatttttatttttatttatttatttatttttgagacagagtcttgctctgtcgcccaggctggagtgcagtggcgcaatcttggctcactgcaagctccgcctcctgggttcacgcaattctcccgccgcagcctcctgagtagttgggactacaggtgcctgccaccacacccggctaattttgttttttttttttgtatttttagtagagatggggtttcaccatgttagccaggatggttttgatctgacctcgtgatctgcccgcctcgggcttccaaagtgctgggattacaggtgtgagccactgtgcctggccaagaaatttttaaaattagctgggcgtgatgacacatgcctatactaccaagaactcgggaggctgaggtgggaggattgcctgggcccaggagttcaaggctgcagtgagctatgatcatgccactgcactccagcctgggtgatagagtgagaccctgtctctaaaaaaacatggggattactcagtgaaccatcaaaaatttttggactcttggagctttgtcatcattggaggagacagacaagtaaatgagtaaagtgtctggtacattgtgtaactgctatgaggaagatacagcatggcccagggagtatgcatcagcctgggggtgggtaataatgtcccaacactccatatccttcctggctttcaaacgagaaaccctggagtcccaacacctgccttgtctccctcacctgcagccctcccccaggctctgcccagtcagtctaaatacctttctcacgtggcccctcctctgccctggtccagtgctttccgctctcctgtgaaatgagcctgctcccttctcccagcccattccacctgtcacatcttcaccatgctaacaactattaatccttcagatcttagcgtaacaatcccttcctcagggatgccttccctgagcccccagtcaaatttggatctcctttatacattctcctggtctccctctcgcacttttttcttggtaggcttcatcatactcaataaggatgtatttgattttttttttttttttgagacggagtctcgctctgtcgcccaggctggagtgcagtggcgcgatctcggctcactgcaagctccgcctcccgggttcatgccattctcctgcctcagcctcccgagtagctggaaccacaggtgcccgacaccacacccggctaatttttttttttttttttgagacagagtctcggtctgtcccccaggctggagtgcagtggcgcgatctgggctcactgcaagctctgcctcccgggttcacgccattcttctgcctcagcctcccgagtagctgggactacaggtgactgccaccacgcccggctaattttttgtatttttagtagagacagagtttcactgtgttagccatgatggtctcgatctcctgaccttgtgatctgcctgccttggcctcccaaagtgctgggattacaggtgtgagccaccgcgcctggcaattttttttttttttgtatttttagtagagacggggtttcaatgtgttaggcaggatggtctcgatctcctgacctcatgatctgcccacctcggcctcccaaagtgctgggattacaggcgtgagccaccacgcccggctgatttttttttaaagagagtcttgctctgtcacccaagccggagtgcagtagcatgatcatagttcactgtagcctcacactcctgggctcaagtgatcctcccacctcagcctcctgagtagctaggagtacaggtgcacacaaccataccctgctaatttttaaattttttgtagagataggttttcacaatgttgcccaggctgaccttgaactcctgggcccaagcgatcctctggcctcagcctcccaaaaactcacacctgggattacaggtgtgagccagcacgccctgccaggatgcgtctgaattgtgtatctgtatgatcctttaattcacatgcgtctcccccagccggagtgtactttgtgcgggatgggcctgggtgtgtattgatgaccactggatgtcctggctcgtagtgggtcctcagtgtggacgtgttgaggaggtgaatgcagagcctgtgccgtggcaggtggggatgggtggggactgggattcatttggcttatgagcagtgctagctcttccctccctcccctcatatgagtgcttcctgtgtgcactcatggcttctcactcttgatttcatttgatcttctgatgacccagagaggttggcatggtcctccccgatttacagatgaggcggcggaggctttgatggacggagttccttgctctcaagtggcagagtcaggagcgcgaccaggcctcccacttccaaagcctgtgctgtaaactctcacttgcatttcccagcatttgccctgggaaggattttaatgggtttctgtggtcaagcgagtgtgggaaactggcttactcagctctgctcaccaccagcctttcagagcacacgaatgtgcctgggaccttgggcaggggttccctacccagctgccactacattccgatgctggagtcccacaccagagactctgacgaacccggttggggtgaggcctgagtgtcaggcctcagaaagctcccaggtggctctcgctgcagctaggggtgagaactgcatcgtttcccctcactccttcctcctggggagccccgtttttcagggggcctgtcatgagaaacggcttcctcagtcctttctctttattggccccacctcctctctccattccttctctttggcccaaaagggttcctctgaaccagacaggcctcccgtttcctgagggcgtctgtgcagtacttgcacagtgttgactgcatttagtcctcaggacagccctcccgattcacagaggagggaccctgtgcttggtagaggaagggatttcgaggtggttcagcaagactcaaaggcaaaattagaactcaggcttctggccccagggcttctgggtagcgcaggccgcctttcccaccagcttcagagctccttgaggacagggatggtggctccttcatctctgtccccacagcacaggtgcccaggagccacagccagtgtgtagggcttttgtgacctcctatcctgcctggtacggtggttatttgtggccattctcctgggctgtcacaggttgtgaactggaggaccggccagaggggccaggaaggcctttgttctctaaggaggagaagcccttggaggaagcagccgtggcttttctacctcagaggctttgaagacaagggaagcctttgggcaaagagaggattcccctgagtgcatgtagtaaagagctaaggcgctgtcacccattgtctgagaccaggcccgaggcgccccgagaatagccctgctgcgccaggcctccatccaccacaccccgagagtgcacttgggcagccccttatctgaggagggtgtggggcgggcggagcggctgtcagataggtccctgcccggaacaccgtcctgagcatctgtggctgggagctccagcgaggccctcctgggaactggggctccatcccgaaggcagtgggagccatagccgggtttaaactgaggtgcgcctggctcagatttacattctagaaatgtctccctggccacaggaatggactggatggagattggcctgggaagggccccgctgttgcaggagcttaaggcagaggctgtggtgggctcaaccttccgggctgggccaggggacaggatggggagttctgagtgggcagaggcaggatctggacttgctcaggatgccttgctggaccagggaggagagttgagggcaacagcagggaagtcctgcaggcttctcgcacccacccctcactcacccatctgtgtgccagcacttctgtctgtgtgcttttcttaaccagggctgctccttccctgggttccccaccacacccctgggcctggcacagagtggctcagcaggtgggcgttgaacagggtcagcctctgcccaggagctagcaggtgcctagagaacaatcgaggggtagggcagacacaagagacaggaaggggtggagcacatggcccccacccgcctccctcccagttcagggcagaatgttctcttaaaggcaaaattagaactcaggcttctggccccagggcttctgggtagcacaggccgcctttcccaccagcttcagagctccttgaggacagggatggtggctccttcatctctgtccccacagcacaggtgcccaggagccacagccagtgtgtagggcttttgtgacctcctatcctgcctggtacggtggttatttgtggccattctcctgggctgtcacaggttgtgaactggaggaccggccagaggggccaggaaggcctttgttctctaaggaggagaagcccttggaggaagcagccgtggcttttctacctcagaggctttgaagacaagggaagcctttgggcaaagagaggattcccctgagtgcatgtagtaaagagctaaggcgctgtcacccattgtctgagaccaggagctcccaagtgtctaaaggggctttggtttgctttttccgttcatcctccttggagctcaaccccttggcttcagtctggacgtgtgaatcttcctttagctcaggacatttttctcctgtgatctctctgatgatttcttctcctgcatcgttccctgtatgtcctgtaggcaccacagggaatattagacttcctgcatctcttccaagcatcctgtagcttttctctcattttttcctccctcctgtttttcttctgggaggtgttatctgtcttacaggtttctctgttattcagttcccttgttaaaaagtgttgattttggccaccatatttgttcatttccaggaactctgctttgtgtctgattgatccttcctgtgtggtggatgtcattagcaccgacactgataagacttcccttccacctttcctttcatccggtctgtgtgtaaactcagcagaggcaggcgtggggagccccagaaatgcaccggctctgggctgggctctggcagattcatatgaatgggagagtctctgtctggccagcccttctgttttgttttgttttgttttgttttgttttgttttgtgactgagtctcgctctgtcacccaggctggaatgtgttggtgtgatctcagctcactgaaacctctgcctcccgggttcaagcgatcctggtggctcagcctcctgaatagctgggattataggcgtgcgccaccacgcccggctaatttttgtattttcagtagagacagggttttgccatgttggccaggctggtctcaaactcctaacctcaagtgatcctcccgccttggcttcccaaagtgctgggattacaggcaagagcccccgcgcccagccccttctgtttttaagaaagataaacccctaacctctgaagagcttttgcagtgacatgggcatggacaccaccaggtctcgctgtgatgaggtgggtggaggcttctcccttcctcctccgccctttcttccctgcctcctgctcctcctcggcccctcccttttgctgtgattccccacagcccttttcagttcagccaggatctgaatggcccctgtccagggctgggtacagtggggccagcagtcacacagccgtgtatccagctgttgccacctgccagtcacaccaccactgtgagcaggtactgccattagccccatggcacatgtggggaaactgaggcacgggatggttggctaatctgcccaaggtcacagagccagtgagtggcggggccgagattcaaacccaggcagtgtgaagttcatgaagggaaaagctgaacttgctggaaccccttcagactccacgctcctggcctggctgaaggaccctgctgactctctcccccagctcacccctccgggggctgccgtcctggctgtgacctgggcctggtgtgccttcacagcccactcctgctgttgaactccccctcttccctcaggctcagcacagtcggggtgcttcctaggggtgggagtgcaccctcgcagcacacctgcctccctcttggcagtcgctgtgagcatagtgaagccggccattgcacctttgcccattccccgggtgaaacgccagctccagcagggcagggactgagtctgtggcccactgtggctggcattcaggcaacgtggcctgcgttgaccctcaggttggctgcacttgcctgcaggggaaaatgccccctctgcagcccactctgagggccccttcccttccccgcctctcacccctgccttggcacatgccctttgcttggaatacctgccacctccggccccctcctggagggcaggctctgcactgcactgcccgggccccttgcactcagtctcccagcccttcccagattgtcagttggcatcatttgggcacctgtcaaccctgccaggcaaggtaggtgagctcctggaggacactaggaaatgtctgtggcatgaatgagggagggacataaaggagcccttagcgagtggggacacagacgtgttccaccagagtgcagcctggccctgcctctgggagctttgctgtggacacagacgtgttccctcagagtgcagcctgggccctgcctccaggagcttcgctgtgggaggaggtgacacgggagccgcagctaccaggcagcgagctctcgcccgggctgttctaggtgctggctacaggagcccacagaacagacccccttccttcctggggttctcctccagccaagggcttcatccctcattggctggggccgtctccttgtttgacagatgtggaggctgtgaatgcaataagtaaggctcccggaactgccttgaagtactcaggttgcctttaccaacccttactccttgtgaggatcctggaggtagctgccattaatattcccctcctttgggctggacgcagtggctcacacctgtagtcccagctacttgggaggcagaggtaggaggatcacctgaacccaggaggtagaggctgcagtgagccaagatcgtgccattgcactccagcctgggtgacagaatgagaccctatctcaaaaacaaacaaaatgaccctcttttttacatgaggaaactgaggcacaggtattcagccattggcccaggtcccacactggtaagtgctggggcggatctggacccaggcggtggctctgcacctgcgccgctggtagtgctgccatgaaggacccacgggcaggggtctcttcccactctgtctctcacacacacctgcccgtctcctgcagtcatcggccccttccatgagcctctgctgtgtggccggccctgctgtgcctgaggacactggaggaaagcagatggtgacaccagagggagacagtgcaacaggaagccgtgtcgttgtcacccatgagggcgaggcctggcaaggggccaggcagaggaagggccaccttggcttcagatatgggcgacctcagctcaggcccccccgccattcccagcgctcctcacctccgtgaggccctcaacagccatggctgtcaccccacccaccctcctatctggacctgctggggtgtgaaagacagtcccgtgctgagggtgccttggatgggttcttcttaacctcagagcccctgtttccacctggaattacagccttctgtgaggctggaaaggtaaaacaagaaggctgtagaaaacgcctgccacacagtatgccggtcctggaataacattttgttgtgacattgatgaggaaaaaataatgattcccgggaccattgtctgggtggtggttgtgggttctccctgtgctggtgcaagttcctctgggctctcctttccttgtgcatccttgggatgtgtccgctgggtgagctcccgggtctccgtgggcccagtgtgagtgagtgtgggcccgtgtgcgccctgtgatgggatggcgttctgtccagggtccattcctgcttttggccctgccaggacgggctctggccacccaggaccctgagctggaggaagcgagtaaatgtcttactggttttttgttttttatttattttttaagacagggtcagggccgggcgcggtggctcacgcctataatcccagcactttgggaggccgaggtgggtgaatcacgaggtcaggagatcaagaccatcctggctaacatggtgaaaccccgtccctgctaaaaatacaaaaaaattagctgggcgtggtggcgggtgcctatagtgccagctactcaggaggctgaggcaggagaatggcgtgaacccgggaggcggagcttgcagtgagccgagattgcgccactgcactccagcctgggcgacagggcgagactctgtctcaaaaaaaaaaaaaaaaaaaaaaaaaaagacagggtcttgctgttgcctgggctgcagtacagtggcatgatcatggctcactgcagtagcgacctcctgggctcagatgatcctcctgcctcagcttcccaagtagctgggacacgggtgcatgccaccacacctggctaacttttgtattttttgtagagaaggggtttcgccatgtcgaccaggctggactcgaactcctggactcagctgggcgcgatggcccacgcctgtaatcccagcactttgggaggccgaggtgggcagatcacctgaggttgggagttcgagacccgcctggccaaaagagaagaaaccctgtctctactaaaaatacaaaattaaccgggcgtggtggctcatgcctgtaatcccagctactggggaggctgaggcaggagattcacttgaacccgggaggcagaggttgtggtgagctgagatcgcgccgttgcactccagcctgggcaacaagagcgaaactccgacctcccaaagtgctggaattacaggagtgagccactgcgcccggcctaatctttcttaaacgtatgtatagctcacatttatttcagtgtttaatatttcaagtgttttcatccttatttagaagtttggtgatgtgtttgtaccagaaatatggcattggaacttcactcttgtttatgttaattaacctgcgtgaaattggtttcatcatatgtcattttgcttaaagccatagtttccaagagcctgttgacagcattaggtaaggacttacggtgtcctttgttgatgcacgttgtctcatcagccagtctgttaagcaccacccacatgccaagctctgtgttggctgctgaaggccggatgtgaattggtcagcctgggtccccaccttcacagagctgtgtcctcatccagggacagtgtgcagtgggcagggctggggacgcaagctgggagggaggaagggaaggaagtcggtacaaaggctcagaagtctgagcgaatgtcctcagggggcagaggagagggtgagggagggatggaggcagctgggcccgcaggctgcaagaagccttcctcggacacgctctccaggctgggagacccgctccagggctggagccaagcagagaattcgcatccccattcggatggctgcgctgatggtgcagccctggagggaggaggcggtagctgccattcccaagggaaggtgggggtcaagggcaggagagggagggctgcagggctcaggcctggtgactgcaggctcctgagagcagccagcgggagggtgagcttccttcagctcagggctgcacacctgccgcctctgttcccccacttctgctctgccaggctttctctgaaaaacctggcgcctcacgccccagccgtcctgggatttctggtgccccccagtctgggcctcctcccttcctctgcttgcagcaaaacacccgaatgaaaaaaaaaaaaaaaaagatccatggccaggtgcagtggcttttgcctgtaatcccagcactttgggaggccaaggcgggcggatcacttgaggctaggagtttgagaccagcctggccaacatggtgaaaccccatctctaccaaaaatacaaaaattagccgggtgtggtggcacacaggcctgtaatcccagctactcgggaggctgaggcaggagaattgtttgaacccgggaggcggaggttgcagtgagccagcattgcaccactgcactctacctaggcaacagagtgagactctgtctccaaaaaagaaaactcgccaggcgcggtggctcacgcctgtaatcccagcactttggaaggccgaggcgggcagattgcctgagctgaggagttcgagaccagcctgggcaacacagtgaaaccctgtctctaatgaaatacaaaaaattagtagggtgtggtggcgtatccctgtagtcccagctactctggaggctgaggcaggagaattgctagaacccgggaggcggaggttgcagtgagtcagagattgggccactgcattccagcctgggcaatgaagctagactccatctcttaaaaaaaaaaaaatccatgagcatctcctctcctccagccatgccctccacacacacaggcacgtggacagacaccgagtgcagccctcctacctggggcctgcctctgccagcacagtcccctcctgtatggaccctggcctaccctccagacactacatggcagccactgtccttttcgagcacccaaacgaagatctgcctgtcccgagcttccacgtgttccccagggatcttggccaatattataaggcatgatgatcatggttgacttccacagccccctttcctgtggcccagcctccagcccttgggcaggtcacctggagcatcttggtggagtcgcagcgcccacttcccagggcattgtgagggttcgcgctgaaagcacgtgcagcctgtcatgggggttatcaggaaaagtcatggaggaggaagggagcctggggaagacccccattgttcctgagggaagggggagctggttcttgggggctgatgatctggggatccagagagcctgcaaggtctgcagaggtgggtgagggagccccagcaccctagaggcctgcccctgccctggccgggctgtgccagagcccctccctgctcacccctgaactgacgagcaccagcaagttggtctttgggtcccctggcaggtccccccctgggtggccccgggttcgtggtggctaagggcccctgagcatctctcccctggccttctagggacagaagatgagcctgtcggtcctggagggtatggggttccgtgtgggccaggctctaggcgagaggtgagcgcggcccctcctgctctcccccagcctggctggcagggctgggcaggccccgggcggggagggttgcattgctccatgcaggagtcgggcctgtcttcctccctcttcctggcctggccccacggcctcagcttggtactgccccaccaggctgccccgggagacgctggccttcagggaggagctggatgtcctcaagttcttgtgcaaagacctgtgggtggcggtgttccagaagcagatggacagcctgcgcaccaatcaccaggtgggagcaccccggcctgcccgtccagcttcctcctgagggcaagaccaagagagtgggaggggaatcccccggcgccagagcagcggctgccgggacccgcccagagctttcccacaggcggccgcagctcttgctctgtctgatcctctaagggaagccaggaggctgcgctggggcatagggggtgtttccggaacttctccagcctaccaggagtgagccatgcatgggcagaaagcccctggtggctgcctgccctacccccagtgtgatgctgcttgtcccaagctggtctagtcccccagtgacacccaggctgtacctgcccttctgcatcttcctgggccgggtccccagcttttctgcacaaccctgggaggcgagggcaggacccacactccccagggcacaggcacccactccaagtttggaagccctgggccctaccagagcactggaggccaaggctgtgactccagtggttctcaggaagggggccttcccaacctcagcccaatctaagacctgggttcctgcttaccctccctgcgcttcaaatgtacaggccccgaccccacccaccagcctctcctctcccccaggggacctacgtcctgcaagacaacagcttccccctcctcctcccgatggcctctggcctgcagtatctggaggaagcacccaaggtatggggggagctggggccttgtccacacctcccttcctcctgtttacccagccccatcccacatcaggcctttccccaggcctaaggggtgccccagacctcgggtgctggcctcccctctcttcccatgctggtctgtgttccctcctcagttcctggccttcacctgcggcctcctgcgcggcgccctctataccctgggcattgagagcgtggtcaccgcctccgtggcagccctgcccgtctgtgagtcatggggggtggggggattcttctcatcccttgagttgctgggggcttcagagttccagccccactcctgtgtgtgtgcctgggaggcaggcccagttttaagtcacctgctcagccacacggctggtgcaggcccatctgtgcccctggctccgtgacgtcgccagccctgcagagagaactgtctggcggttttgaacatcgtttcccagcatgggagccgaggtggacgcaatagaagttatcctcactgatccttcgatgggggcgacggcaggctccagggaacttgcagcctgcctgactgggtgtcctctgtcagacaagctggagccccattcctgcctggggacagcctgccccaccacctcccccaccttcagttattttgcctctgccggttccccaggcccactcatgggggcccccggggcccccgtggggtaggaccgagcaatgcataccacagaagcccgtgccgggcgcttccctggggccacatccgtggccctcatgctcctggttactcacacagctcagggatgcggccccgtgggcgggaggaaacagcccaacctagccactggggtgtcagtgcaggacgggggtgagcgcctaagagccgtccaggtgccctctgcctcccccatcccatcctcaagcctaagccaggccttctcttccaggtaagttccaggtggtgattccgaaatcctaagcctgcctcgcacctgctgagccgcactgctgcccctggcctcaccggcctcaggagacggtggggccgctgcatttcggggtggtcttgggaatcccaggccctaggggtcacatttgctcaggaagtgggtatcaaattgaggtgggggtgtcagaggaggcaaaggggtcccagctgcggtcaggactgtggtgggattcccgcctcggcagcgtcactgcccagtagctgctcaataaaggctgtgtgtgtggaatctg

SEQ ID NO: 36694 - DNA, 54690 bp, Homo sapiens
gcggcgggcggcgggcggcgggcggcgggcggcgcgggagggcgggcggagggaaccaggccggccggagtgtgtgcgccgcccgcggtccggtcacgtccccgcgtgggcgccgctgcccgcgtcgtacggaacgagggcgccgcggccccgtgctcgccgccccgccccgccccgccctgcccggagcagctcggcagatgctctgtgctgcggcccggaggtgagtgagccgacccgcggccggccgcgcgccgctgagcctcaggggtcgggggcacggccggggcatccaccttgcccccacttgggactcttcccaggcctttgtgccccggatccgccaggacgcagcgtcagggatgcccctcaggggtgggggacaccaagggcggggacgcctgcgaggtgggcagggggcggcctctggtcgggcaggtgctgggggagggatgcgccgccaagccgatgaccccgcgggagggggcggttgaggacccgggagggtggacagagggcgccggggatgccgcgcggggccgccgggcgcccccaagcagcggctgatgcggagcccgggcgggccaggcgagctgcgggagcggcgctgaggcgggtctccctagggggaggatcagggaggggcggccggagccgatgcagggccttgcctgaaaccgaggagagggccccagaggcctgggcccgaggacctgggcccgcagacggacagctagcagttctcggtcactgctcttgcagcgagcaggttcctcacaggcatttagaggaagagatgagtatcgacctgctgcgattgtaatacgttcccggctcaatattttttcccttaaaaggcggtgggggtgtttgggggaggggagtgagggcctcagggctggcgctccgtatcctgcgggcgatccgagggggctctgcctttagggcggtgctgagccttcctgggtgatgatggcaggattcggcctaggccgagaatgggggctcctgttaactgagacaagaggatgatgccaagcgagaccagcgttccgcgtagtccgtgttggggtggagggacccgcctggtagagaggtctgtcttgcttggggagacagctgagcccctgaccggctcctttctgcccaagtgatttccctgccctggggattgagctctctggagaaggctccttggccaaattcaattaagcaaatatttattgagtggtcactcccccagagcttgacgctggggtgcaccgggtgggagtggactgggcctgccctcccaggactgattgaccaccgcataggggaaaacgtctctactcgaccaaccccgcttgagtgcaggtgcaggggcctcgggagggacctcagagtggtgtcctgggctggggggtcaggtgagctcgtgggcaacatgacatttgaactggagcttgaaggacatgggcacagctaagctgggcattgtgggcagagaggagagaatagaccgaggcacttgggcagttaggtctgatgggagcacttagcatgcctggggagtaggaggaggtatggcgggaaaggccggtgggggctgcacggggctgagggagctgggaagtggaatgaccccactgctggttaactgtggctatggtggagaccacggcttcctcatctgtaaaagcgaagcagttccatgaccccatgagctggggtgggcctggagaagagctagctttaaagactggggaaggctccttgcagtctgagactgtgcttccaggcacttctccctcgggcacagccagggcactgggtaaccacccaggcaacccccttgttaggattgagttgcctgtttcggggatgatgcttagctagtgactctgtgcctctgggatgtggatgtttgagagcagtaatcgtggcagcctgggagcatccatctacggggtgcagtgggggtgtggatggcctggcggtgcttggataaaatatgcgccttgagcaagcctcattctctaggaatgaggagatgctggcatctggtttaaaagtcttcctgtgtgttcctctaactgacgttgattttctgagacaggaggtgaataagacataatttctccccctcggaaattggtgtcactttcccccctaagtcagctccctcatttctggggatgtttttgctctccctctgaaggggctgtttgttactcatctttgtagtgtgcctaccctccccacccaacacacacttggctttggccaaggcccaggttgatgcagcgagaacagggcctgccctcgtggggtgtgcagtctgtgctgagcagggtgagctgctgtgctctgtgcctgtcgcctggactgttgcagggacctggcatgtgactgtgggtttgggacacagggaatggattcttccctctgtccccagcctctcagtccttttgttttctagaatctcaggaggaacctcagagacctggaggccccaccagagtggccagaacctggtgcaggagtatgggtggggtctcagtctggccctcaggagcttctagaacaattccaggaatttgcaggtaactggattgacttcacaagggctgcccagggcccccgcagagaggccagtgggacaggaatgctgaatatagcaattcaggaatgctgaatttagtcatcttgtgtgtgaacacatgtgtgcggcttcctcccctggaggcaaggaaggcagccctgtgctgtctgtcccacgctagcctcagaatacttaagacggtgtgtggtggcaaaggcactctcactgctgctgaccatggcaggtgcacgggcacactggaggaggcaggtcagcatgctgctctcccgaaccctccagcaaggaaacctggggtagccaagcctctgagcacctgtgagcactgtgcttggctggaaggagcacaaagcgaaatgaacagaggcgtcagtgcagatgccaagggtcagccccaggcagaatcccagagcagaggctatgctgcggcctgggcagaatgaagagggacgtgggagcacccagactgttgtggctccggggtggtgaggtgagcattccagtctaggtggcagaagacctggagtcaggtcctggtcccaccatcctaggtccagcccctttttctctgaacctcattatcctcatccatacccaaagccaagagtgccctgccctgtccccacaccagcccctgccacacattttggccctttcgtgcgaacaccgccaggggaggcgcttcacaggattgaaccaacagggaccgcttgacagatcctagagcacataggaggagacatcagccctctggactgagccggaggagcagaacctcacgcgattcatccattcatttgttcagctaacatttaccagcgcctgctgcatgccaggcactgtgccaggtgcaggggtacagcagggacgtagcatccactcacagtgctcacaccagacgggcaggggttgacagtaacacatgttactaagtgctgcactgtggagaacactaaagcagaaggtgggggacacgagatgggggtgggggactgacacagtgccatgcagaagtgctgggtgagtggtgtggctgagcaggggagagacagcaggtgcaaaggcgctgagcagacactccctggcccctggaggccccaccagagtggctggaacctggtgcaggagtgtgggtggggtgtcagggccaggtcctgcaggactcagtgggccccaatgaggcaggaagaccttggcagggttggagcagagaagagactggagctgccctcccaggaggagctaatctacactttgaaaagatctctctgctgaggtgggaaaataggctagggtggggtaaggctgggggccatgaggggctactgcaacatcccaggcagagaggctgctgacccaggggtgggagctctggaggccctgagaaatgcaggtgggagatttgtttttttaaagctgcagcttttaaaggacagctgcagttttggtctgaaccagtagaaagatggagctggtattggctgagaagcaagatacagaaaaacccattctggagaggtggggaattaggaggtgggtctgagacctggagagccattgatgggcacatgtggccagagggagagcaaggctggaggtggcaacctggagcccctggcactgaggtgtgtggcaggccggggaccacgtgaggtcacttagggatcaagggtaggtaggatcagaagaggctgagctgggctcctgggcctccactgtggggaggatgagttgagaagcatcgagaaagagagattgaggattgacgggcaagtgaggtggaagcacagtcacagtggcgcctcgggaggctggagaagagcgggtcccagagagcaggtcccctgtgtcaagcaggcagggcatgcccagggactgagcaatgcaggcacagctggccacatgattttgggggcccccatttgaaaattattaagggcctgacatgatggcgcacacctgtaatcctatactatgggagactgaggtaggaggatcacttgaagtcaggagtttgagaccagcctgagcaacatgtaagagcctgtctctacaaaagtaaaactaaaattatgcattccagaacagcaacagcagagcattaaaactgtatggatgcccaagtgagtgcccaggaagctggctggtcacagggacctcaaggataatattggggatgtagtggcccctgtggagaaggaaggcctggagggtgggcccgcaacctgcctgctgcccagtccccacagcatttctcctcccttccctgagtgggcgggtgggttgcgttggactttcagggccgctggagtcagtcacacccagcctgtgagcttcaccttggcaccatggcccagggaacccaaagtgaaaactgcagcaggcaattgcctgctgcaattcttcactaaatgtcttgcttcttgccccttggtctgtggacccttgggcaagaggcagcaggaggcacatcttgaggttgaggtttagatggtcccatcagcaggccctggacctacatggccacagcttcacacagcaatggcttctttgcgttcatctcttttccaaaggaagctgccacatcacagagttttgagttatttgcttctaaattaaggtgtaactctcttttagagacgtccctggagaatccatcaaaaagtgctaagaagcgagactgttaaaagccacagtgcagggaggggccttacacatagtgtcaagcccgggggtgttccttctagcagcctccaaccagaaacacaccccgtccccgagggctcagccaggcctctcatggccatgggggaccgtggttgtggttagagcaaacctttcaggagacccttggcccctgggatggagagctgccaggacagaggtccctttgtgaggtctgcccctgtgagtcacggaggccaaggtcctttgtgaggtctgcccctgtgaggtctgctcctttgtgaggtctgcccctgtgagtcatggaggccaaggtcctctgaggtgtggagagtggacctcatgtgcccagtgccttagtaggtctgggcagccccgcatctgggcagcatggtccctctcaccctggttggtcataggaagggtggctgaggaggaggctgtgctggaggctggcatggcagtgagggctggctcttaggctgtggccctgctccagacagggctggtggggcctctatgtagaacagcgccatgttcctgaccatgtttcctatgccctttcctgctgctatttttttccccttagcactcgccacagcgtgacctgctccctatttgattcattcatcgtatgtgtttgtgtaagctccatgagggcagggacgttgcggagtcaccattgagaatcgccacccagggagtcgctgtggagggactgaatattcgcagacagtcatgcctcagtggccctgtccagccccttttgccctagggctgagctgtgtgctcgtgcgctgcagaacccctgctccagctcaaccctctgctcctaagaggttgtacctttgggtccccagagatgtgtctctgggcctcaggtttggccaccaaacacaaaccaccctcaggtggatgctaccagctgggccccgtcaggcccaactgtgggttactctcaagccagaggcaggtggacagatgcctcgggctgacgccgggccactcagtgatgcaatgtgactcagtggggcctttgtcagacacggggattcacagagtgatgaccttcagaggcatgtctatggaaaactgtcctaaggggatgagccaagaccctgaaggtagtaaaggaacatgatgatggtagagtggcctttccaggtggcccctgtgccccaagatcaaggagtggcctctcaggccagtagaggagctcagggcaggggaaggcaccaggcctgggtagaagtccagctctgcctgtgatggtgaccctgcgaatgctttccactctctgggccttccttgcctttgagttggaagctctgggctgggtcaagtgtacagatagtttccttccttatctcaactctggagtgaccgtccaaagcatgctgtgctgaagaggattctaaggctgtgctgcagcccagagggaaagagtcatggtcgattagtgatgtctgcagcgggcacgggaggcaggatttagatgagcttgccagtgactggtgaacctcaccactgtaccccctcctatctagcagctttaacccaccctatctctccttacatgccccttccttagtgacactgatgctaaccccttattgggaaggactggcctccgtcttcctgagtcccatgagcagctcaggtcattgcttgctgactgtctcttctctcatttgatgcctcactccctgtagtgacctcagggtccaaccccatgcttcgttcatggcagcctctttctgtacactgaagaatgaataagtgaatgagtggtagagactcaaccactctacaaggccgggagcctcctcttggatgtacacctgatgttgatctctgttccagcaaggagcccctagaagccttcttggaattgggaggctggatggccacggaaacaaggtgctaaaccgtgtggtttcagctccaggtgttgcaggagtggggtcagcaagggaggagggggcaaggtgactaaggagggctgaggcatgtaaagtaccaggctctgtgtttgtggggcccggtggtcctgtctgaccttggctatggagcagctaatcaggcttccccagaggcaaagctgggaaaaccttccaagctgccaagaggggccttctgaagacccttctgactatgggtgggagaacttggcacctacagccttcaccctgaccccagcaggccctgaccccctgtgaactggtggtacctcacccctactcctcttgcacccccacactagtggccctacccctaactgtggccaggccaggggaggagcaactccaccatgagggcttggccctcatgcctcctcctgcccagctctgcatggcatgtccctctggccttagctgccccagctgcatgtggcctcaggccagccccacccagccctcttgcttcctgtggccctgtagagtggctaccaggacccctgctggtgagggcgggtgcgggtggcctgtctccgagctgggctttcctccagcatggtcaccccctcacccgctcagttacctctgatatgctgtgcaaacatatttctcgatgaaatgctgggaagaaaaataattagagtgttgcctccattatccaatttcggattaatcaaactctctttgtcctcggccaaaatctattcatttcccttaaacactgggccagtgccaggcattgatttcctctatgataacaccacgcacgcaagcacagccatgcccagccttgccccaccccgtggctgggacacagaggcactggtggggctgcccttgtccccccaacactgcccacctcctccaaggagtctcctggccacactgacacccccatctctgtcgtggctcctggagtgcttggcctcagtctccagtgtgtttgtcttgccacgctggctgttctggggctctccctcctcccaggatggtgtggaatggatagaggaggtgtggagggtgtggccactgcggtccccagggaccacagggaatgggctgcagccccaggctctgggtgggccagggtttgggggattatccccatcactggcacaggaagaaggccaagggggagggccagggcttctaagggggctgaggggccatgcaatgtatgtggggtgggagcacacttgcaggggtagcaacagaagcccagccccaaagggcttacaagatgaggggacatcctggctcccgggcctgagggcttagtagtggggcagcatcaggatcggccaagtccaggtgggcgggggctgtgcgtctacccgtgtccacccagggaaggccacgggcctttccagaagacctcccagaagtccccaactatcccctccgtgagccacgttgaccgattcctcactcagtcactacgagggcctgggattgatttattggcacctgcttggtgctaggtccttgtgggcacatgggatacatcaatgaacaaacagaccaacagtccctgccctatggcacagtgggaaagaggtgggcgataaacactctaagtaaattatacagtgtgctagaaagggaccatgcttggggcaaggcagcacacgtggtgtggctgtgtgcgaatatgggggtcattttccatcgtaaataggatgggcagggaggcctcctaaggaagggacatctgagccattggatggggagagggcgcggaagcgaagtccacttggctttctggacaaagagttttccaggaggaaggaacagccagtgcacaggccctgagttaagagtgagggatggtgctagagaggcagctagaggcagcatggcaggagtgggggagggggagcatgggcgtgggagtcagagaggccaggcattgcacagccctggtgccctggctggactttgactcggggtctgcccatgtcaagcaagcgtcgggagcaaacatgagaaggtttcaagcacaagtgagacatactctgcctcatttttacaaggatgcccctggctgctggtggagcacagggcacagggggctggagacagcaagaccagagaagtcatactgctgcaaaacagatgagaggctggggctggctagcgggagtgagtggtagaattctggacagtcagggcaattaagggttcccctgaggctggctgggtccagccacaacctgtggtgccagcctcagttctcaaggaaagggacgcagggaaggcgtgctgggcatgtagtggacaccactcatgcccctaggtccccaaggtaggggatgggattgtgggatgccacacatggaggcagagggcaggaggttgcagggcctcaaagacccagaaggtgaaatcagattccccactcaagtgagggtttgatggagtcagcagtttccttccctggggaaactggggagccaggagcctggggctacggctctctccaaggcagcaacctctttgatttggctcttaatgaaggccccacttcttctctgctgtcatggccaccctctcctccataggtggaacctttgcatattgatttatttatttactcctggcccagagaaatatctggcttgatttcctcctgagtcagtgttcctcaggcgacactatcaccctttgtctggtcagccgtggtggctgtgggccaaaagacaggacaggtggctgagggtgtccagagccaggacagcacagggttacagggaagggcctccctgttcatctcatctccccggtcatctcatctccccttcctttagcagaaggacactgggaggcccagccggggcatagcctggggttgtctgtaggatggggacactgtgttcactaaccgtagtccttcctcccatctgctcggactatggcttcaggataggcagagagctttgaggaggcaaagaaaggaggacctgtttctaaggtgagacccgttgcggatctgcaggtgcaaggcccatcaggcaggttgtggggagagtgtagagaagccaacccagtggcctgggccctggttactgtggagtggctgcaaagagcccacaaacacggagtcacatgtcctcaagccatgaatcagtgatgtctttcatgtgcgtatgctctcatttttcaaacactgcaaaagctattgtgataaatgaaatgcagagtcatttacaagccttgaggaaatcttggcgcgcaaaaaccctttttacctctgtcatcagcactcactggattaatgggtgctctcccttctcactgtaaagcatgctggcttgtgtcagtacagggttggccctccagggcagcgggcactctctagaacccccttgcccttccacatgtatccctttgagtccgttgtgattgtcccaaacctatttgtgccagttgtactcattgtaatcacagcctggaatactgtgtaaactggtgggctgtgactgtatagagggcttctgtggaaatgaaagtggttgctttggaaaagcctcagtaaaagccgtggttaggtttggtgtgggcaagccaaccacgagtttggggacaaggagtataacagcctaaagttcagattccgggtcctttgccacctcacttgtgttggaaaaagtaaacgagatgtcacgcaaggtgtgctgtggtttaagcaagaagtggcataaccccagaaccggaaactctgatttaggaagagtttgtgtctctgaaaattgacagatatatgaatgtatgtttatctgagttaagtgaaaataaagtacacgtgtgtcatttcttaggtcttcctgctttaattcacttttcagtagatcagccagccagcagtctcaggtttgattgcaacttttagccatcaacagttattagaaatatatgttataggccaatcaggttataggccaatatgttataggccaatcaggttcatgcctgtaatcccagcactttgggaaggagacgcaggtggatcatttgaggtcaggagtttgagaccaatgtggccaacatggcaaaaccctgtctctactaaaaatacaaaaattagccagccatggtggtggacacctgtaatcccagctacttgggaggctgaggcaggagaatcacttgaacccagcagatggaagttgcagtgagccgagatcgtgccactgcattccagcctgggcaacagagtgagattccatctcaaaaaaaaaaaaaaaaaaaaaaaggccaggcgcagtggctcacgcctgtaatcccagcactttggggggccgaggcgggcggatcacgaggtcaggagatcgagaccatcctggctaacacagtgaaacctcatctctactaaaaatacaaaaaattagctgggtgtggtggcgggcacctgtagtcctagctacttgggaggctgaggcaggagaatggcatgaacccaggacgcggagcttgcagtgagccgagatcgtgccgctgcactccagcctgggcgacagagcaagactccgcctcaaaaaaaaaacaaaaaaaaaaaacaccccagaaatatatgtgtaataatgtcggaatctgcaggttggtctttttcgttgtgtttttttgtttttgtttgtttgtttatttgttttgagtctcgccctgttgaccaggctggagtgtaatggcgcgatctcggctcactgcaacctccgcctcccaggttcaagctcctgtctcagcctcgaaagtagctgggattacaggcgcacaccaccacacctggctattttttttttttttttttgtatctttagtagagacagggtttcaccatgttggccaggctggtcttgaactgacttcgtgatccacctgcctcagcctcccaaagtgctgggattacaggcatgagccaccgcgcccggcctcgttgtgtttttttgtttatttttgttttgcatgtgaaggatcattccataatacttggaaaggttgtaaaccaggagtctacaacagagccaaggccacaggggccaagtatgaggaggaggctgcttgatgacactgcagaactcccacggcaggccagcctggaagcccctctttccccaggactaggattcacaaggcccttggagccccagcccacccaagcggaagagtccagggacaacctgcagggaagtgtgaggttttctagcataagaggacatgggggatgggcctgaggaccaggagatgctggtttcacagagctgaggctagctgggctctcagcctggggtgtgcagagtccacagtgtcttccccccaaaccttgcccccagaaactcccattttaattcaataaggtgtgaagtggtcaagatcatattaaggtggggcgtgagctggctgggatgggaaagggcacgtgggagactgggagaccaggcaggaggctccagggaagttgggagagtgaaggaggagggtgggcaggagaagtttcaggaagaggactctccacacagacagaaggaactggaaaccataccaaaggaggggtccttaggggctagcctgcagctcggagaggggcaggtgtgatgcacatttgagaaatatttgtggaaagcagaagcaagagggctgtgggaggcctggggtattgggggtagtaggggagggtagacccaggcagaggggtcccaggggaatccagtagagctggcccacagagtcccagggatatcacgggctccaggaggaggccatgggtcagcagcgacctcaggtcctgaggcctgtggactgcagggtgacccctttgcaggctgctgggaaaggtcattttaggtaatgctctcaaaagggagtgctggggaagcttccgagctctgtacaaatattttttggtgttcctccatctatccatccatctgttctgcgaatctttcacagagcacctgcttcgagggaagcagagctggtgcttgggggagggagggtagagcaggagcccagaccaacctgcggtgggtaccctggggaaaccacacacaagccattggaggcgaaggtgggaggaggggatatgggccagatgtggtcagggaaggtgcctgcaggaggagccggcagccctgaggctgaaaaaggaccagtttgtggggcatcccttccatttcttccccaggggaagtccagtcccactgccgaaccagcggcacaccacacctgttcaaggtcgcgcgggccaggtggcaggcccagactgagtccactggggttccagggatcctgatgctgcagtagtcaggggtcctcatcagagaaggaggttctccctgggcttcacagggctgtgttttcagccaggtggggtggaacagggcactgtgagtgtggtgggtgggagatgcagccagagaggcaggaaccttgcttcttgtggagttaacaaggagggaggggtgagctatgcaggcgatctttccccagagggcagttcctgggagggtagcttgtccctacccatgtccagtgtcactggcattaaggcaagtggggtttttatcttccccggaagatgtggctttttagtccaaaaatacaagcagtccccaacttaggatggtttgacttgcagtttttcaggttatggtgcaaaagcaataaacattgagtagaagccttactttgagtactcatacaaccattcattctgattctccctgtcagtacggtattcagtaaattccacaagatacgggttagattcttttgtctacctgcaggctaatgtaagtgttctgagcacatttaaggtaggctaggctaagctgtgaggttcagcaggttgggggaagtcaacacattttcaacttaggatgggtttatcaggacataaccccatcctaagtcaaggagcatctgtaggtgttgtatcaaaagccttaaaccatcaggccttcttgcagacagccacactggccaggatgaagcagcatggggaagccttgagcactggatgtgaacatatccttgctcatttttgccttcatccccacctggtcctgagcacctgcgcttcgtggcccatgatgcaatgcagccttgagagctgcagccccgcccttcactaccccaaggcccagtggggagctggacagagagccattcagtggggatgccacagacagtgtcgtgctgggaaggcagggaagtcaggtccctgctctcccagatgagtgtgggcgtggacaccaaccctggctcacttgccagaggacgcactgtctgcggttttgtggtcaccctaccatcgcatgtccaggtgacatcgcacgtccaggtgccattgcacactggaggttatgatgcagaagtgctgctccaggaggccataccaacccccatcctgtcctgggtcccttggggccacctgccactaggtggggagcctcatctggagcccctgagttttctggaggcagctctcaggctggaacccccacctcagataggtggacatggtttccaggcagcttctccccaggctaagcccgtctgctgcatctgcggggtcagctctgggaatcaccccaccccttgatgtcctcagcgattcctcactgctgccattctacatttttctctgtgtcctcttctccatggtgctgagctttatttgaaatggcctggctgccttatgtgctcaccatctccccagcgagaatacaagctccttgacacacagactcagcttgttccccaccatgtccccctgtccccaagcagggccacacacagtggggctggattctgggagagcaaagtattgatcatagcaggttgagtgactgatcagttgcccatacagatctgagggtggaaggcctcaggcctgggcgcacgtgctgggtgatttaggagcaacgggagaagcagtggaggatgctctgctgagcagacaaatggaactgagccagggagagggtgacccactttgctgagataagagatgggctccagcctgaggacaaggggtgcagtgtttataccacagcccaacagcctccatcccttcaacaccagtaccagtgcctccgccctggttgtcccagcttgtcccagcagagagggcctctggccctggttccccatgtaccccacttgtgtccccaggaggcacgggcagtggggacagagcagggggctgcaacaccatcgaaccctaggaggtggcctaaggccacagctatgagtggcactaacccttccccagaggaaggtaatcctttttgtttctctctcaatccttctccttcaaggagaaaatcccagtttggtgccaacgtggctctcacaccctccagcaggcgctaatccccgctgtttaagcaacagccagtggccttgcctggcccctcggcagggtcccgcccctggctagtggcagaagcggttcctctacactgttttgtatttagattacttctgtctacggcgggtgaccctggctttccactgaaagtaggactatgaagtcattatgaagtacattttttaagtaaaaaaggcagtcaatttaaagaaaaatgctgagtaaaaacagcaagtgatacccaggtgtggccaggttaggcaggctgcagtcccgtggggcccagttggagggcttggtgggagcagaggcctgcagactcccagccaggccaccccgggaaatcacctccatctttgcgctttgatttctacagccgtaaagccgaggccacctcccaggcctgcttttagcatgagatgacgtgtgtgagcaaagcactcggcccagcagtggcagcagacggggtggcacggaggtgcagctgtcccctgcgtgtctccagccacgggcctctggacctaggttccctgggcaccttcctctcctcccagtggcctcagccacccgagcaggcacactatagttgaggaaagcacagcagagccacagctgggacccagagtcccctccctgaccccaccatgcccagcttccctgagaaagaccctccccggggcccagcccacagttgcccctgacctcccatgaagatgtgtggaaatggctccatgaagagcctgtgaggacactggaccatgaccagaccactggagagaggggaaatgcagtcatggggctgcagcatctgtggagcccacttcccactgggtggggccagcatgacaggattgaaggcagtgggacagaagaactgggcaacacaaaggacacctggctcctcagcaacagagagctgccaccgaggaggcccctacaggtccaggccaggccctgggaaacccatgatgggacacatggctggggcaggacagggagtgtgcagcttgtcagctggaagcacatgcggctccgataagtcgggcgtaaaagggcagtggaaagtgcttcctcattcggcgaggaggaaacctggtaatctgcaatggccacaggcacaggcttttccagaccttcggtttctaaaatagtatcatggtgggagctgatgtagggacggcggctccagagttgggggcagcacccactctttaagagatgatagaatgagcatggtggctcacacctataaccccagcactttgggaggctgaggcaggaggattgcttgagcccaggagttcgagaccagtctgagcaacatagtgagacccccatttctccaaaattaaaaagattagctgggcgtggtggcgcgtgcctgcagtcccagctactcgaggctcaggtgggaggatcgcttgagcccggggggttgaggctgcagtgaactgtgatggtgcactgcagctgggtgacagttaaaataagataaaaatgcctcaattgagcttataaccgcccaaggggttcaccttgcccgctgcctagacagagccgattcttcaagacgagaattgcaatagagaaagagtaattcatgaagagctggctgtgcaggagaccggagtgttattattactcaaatcagtctcctggagcattcaggaagcaaagtttttaaggataacttggtggatggggggtagccagtgagccaggagtgctgattggtcagagatgaaatcatagggaattgaaactgtcttcttgttcagtctgttcctgctcagtcagttcctgggtgggggccacaagatcagatgagccagtttattgatctgggtggggccagttgatccatcaagtgcagggtctgcaatatttctcaagcactgatctcaagagcagtttagggagggtcagaatctttagccttcagctgcatgactcctaaaccataatttctaatcttgtggctaatgtgagtcctacaaaggcagtctagtgcccaggcaagaaggaggtctgctttgggagagggctgttaccgtctttgtttaaactataaactaagtttctctccaagttagttcagcctacacccaggaatgaacaaggacaacttggaagttagaagcaagatggagtcagttaaatctctttcactgtctcagtcataattttgtaaaggcggtttcaagcttggcctgcaggttcccatactcacgcagcaagtcaagtgatctgagttatatgaaccatctacacgcccaaaatgtgggttcagggtaccccagtgcgtttcctcctgctggtccctgcatgctctgagctgtgggctggcttggggttggagccttacccactctgccccacatccttgtgtgaggaagggcctgtggtcacaggcatcagtgagcctggagatctgtcactgcgcgggcctcctccctccccagaccagctgctgggtgccaaggtggagctggcaggtacaggagccgcggctgcctggataaaaggcgtctcagcaaactggggtcaggatgggggtggggcagtgctgagtcatagccccgcttggggcatgccaggcagctcagcctccacaggggactccaggacagggtgagtggcaggtaggcgcaggcagccctggggtcagctccggtagggtggaaaggacttgttggtctgaaatgggttccatgactcctgttgccaccccaagcctgggacagtggacaccactggtccccacattgaggctagagagtcctgcaggttcagggtgtgtggtaggtatctggggagggctgggagcccatcgggcattaggggtgtggccttgctctcccttgctggccctgtggcctgggctgcctgccacctcttggggtcctagcttctgttaccagcaaaggtggccatctgagtggcttctattgggcctcaggcatgactgcctgtgcctctcccccagtcacagtctgggtacagttccgtctcctcaacaagcctaaactatctccctgggggcagggtctgtgtgttgaaccatcacttcgtcttggctcactctttccgtcgcccaagctcagcatggggcaggctttcctgggaggtgaggagggagggaggcaggtagctagggacctggagagtgaggggctggactgccgtctctgaggaagtcaggcacagtgatgagggagctggtctataagctgataagtcttcccgcccctggcttagccggcttgggcagtgagaccttcggtgaccttggctgtgggctgtcttcttctgcctcagccgggggcactgactctgtgctgtgctggctgttgtggaggaggccttgagcaaagctttggggacagcctggaggttacgggcagggcaggctggctcccatggcctggtgtggtcctggcgagctcaggctatggtgggtgtgaccatgggtattatgttgccccagctctatgcctagcagcaggctgagcctccagggattgtgcctggggagggaagtggttcctagagtggagggcatccaggatgcaaaggtcccaagagaggtggcagcactttccctccatgaccatgtacccatcctgactcagggctatcactcaacatctgttacaggaacagacttgagagggccacgtctggaaggagggtgatgagggcaggccgggcctgctggacggtgggtgagaagggagggtcttgagggggatgtccatgtgtgggctgaaggatctgtcccgaaaccacaggaagcaagcggccctcagcagagggttcctgagtgggctcagggcttggagatcgtgccttaggaatctttgggtaggtgagtcaaggaccaggatggagctccttaagagcctacagccaagagatgctagtttcctgaggctgctggggaggaggcaggcaggtgcagactctggcctgagcacagcccactagggcttcttggcctctggctgccagcatgtcgaacctggtgcctggccctatgtcgcactaagtcctaagcgacctcctggtgaatttgccacacccttcacgctgcaaacactacacatctgctgggggcgggggccagggactggatactagctggtgttcactgatacagtccactcatctgtactgagccctggccataagcacagcagggtcctgtaccacagggacagctgacagtccccctttcccagtacctgccactttctcctaatatgtcccctctccaagagcagcccctgcttcagcctactggctggtccctggagttccctgatcgtctccctgttcccacccagccgccactccatcaccaggcactgtgcaccgtacagctcacacatcttgcagagcctcactgcatccacttcccccagccctcacctgtgttgctccccttttatcacctggatgtttgcatccaggagcctcctctggtctggcttcagcgcagcagccagagggatgctggtcacacagggcaggtcatggcacttctcacccaaaccctggctggctcctgactcgcccttaagtgacctcctaccctcttggcaccagccacatggcctccttcctgcccctcagactggtcaggcatgctcccacttcagggcctttgtgccggtggttccctcatccctgatgcctgcttgcctccctccttcaccacctgttcatactcatctcttaccaggaggccagccccacccacctttgctgacttgcagcccgcatgtgccacccccaaccctgcccacctggagctccatttccactgtagcactgggcaccttctgccacttgctgcttatttactgcctgtagtctgactcctgccctcccacctgagcaaaaatagggaatagatcttcatctgcctcattcagcagccccagcccaagtgccagaatcaaagccatggtttagcaagtaagtgtgggatgctggagagcccctgacccatctcccttctgccccagtcgcctcagcctagctccacaccacagctggttcctcctctccagggcatctctgctcccaggatgccacatgcaaccacatgcagatgcccacatgcaccagtacacatgcagctgcacacacgcacaaccacatgcagacagaggcatggacctgtgcatgcacacccaaagatgtgtacatggacctgctcacagacatgtacatggatctgcgcgtgcacatgaacagacacatgcacacactggcatacaagcaaccagacacagacacatccatgcacctgcactctcacagacacaaacagggacctatgcatacacgcacacataccgcaatggacctgcatacacataggcacctatgcatacacgcacacataccacaatggacctgcatacacacaggcacctatgcatacatgcacacgcaccacaatggatttgcacacacacagggtcctatgcatacacacacacaccgcaatggacctgcacacacacagggacctatgcatacatgcacacacaccgcaatagacctacacacacacagggagctatgcatacatgcacacgcaccgcagtggatttgcacacacacaggcacctatgcatacacgcatatgcaccgcaatggacctgcatacacactggcacctatgcatacatgcacacacaccacagtggacctgcatacacacacacgcaccgcaatggacctgcacacaggcaccacatactgccacaaacatgcaggtacacacatggcttaaaacctttcagtggcgtcctgtttctcttcagtgaagaccaagggctcagttggacttctggtgagccctgccccttcctcttgcctggtacctctctcctcctctccctcagtccagccactctgaccttccttcagttcccctttgtgttagggatggtttgtccctttcatccctaacacacatccccacacaccgcagggccttacagcatgttcctcctctgcctggcacactcttttcctggcccattcctctggtatttctagccatgcccagaggcactgtggtggggggtcctgggtgttgagctctagtgatccatcagtggtttctgggccagggaacaatgtggtcatcaactcttggcctttgtctcttggccaaccatcatcaggttccatcctgggacttggggagtcctagcatgtccagtaaagcccgggttagactcagagagagggctggctagagccttgtgtaagagccaagaagtcaagcctcagaataggtgggactgtcataaggtcccatttgaaccacagccaggctcccaacgcaaggcttccttacatccgtgcacagccctgtcccatgcgtggtgcccctgcacagggcgctcatacccccaaacacaacacagccccacagagccgcagggagaattctgggtggggccttctgcttgtttggttcaggtgatctgaaagacgagggtcctcaagcaggggacctccccttggttgtgactgttcgtcactgccccatgcaggtgacagacttggccctgatgcatgtgattgctacctggcctcagtttcccctttccttgcacattgccctgtcgttgccggcgcacactgatcgaagactgcatgagcagcccttagctccaggcttccagacaacagcagttcagggcccaggctgccagcccagtgtccccaacctgctctcctgattccccagccttggagccagggagcacatacatcccaaagcacaaatcacacatccttggacagagcagcttctctgcccaccactggggacagaaggggcgcctggctgtacctcagattttcaaacgtggaattgagaagaacagtcatgacaacagaggacacctcccactgggttggacactgccttctgaaaggagcatgttggcttcctgctggaatgatggtgctggtagggagaaccctgggtccccaggcagtgggctgagggctttggacacctttccacacctaaggggctgtcaggtcgtcagcagggacaagggagcagccacagggtctccatcctccatgcgctcatggttcgtgtgcatattacacatatcatgtacatgtcatctttaagcagatgttctgcccactgtgtgctggagtgggagggtcatctcaaggcttccattctcagatgtaattttcagcctcactgggattgggctgagtgactgtttaatcactgccctcttggcagagatgtttctagggcgttccctggtgcacttctcatcggtggctgcctggtgaagcgggaaagttcctcagcctctccattgattccttccctccctccctccttccaccaaccagtgcttactgaacacccactgtgcactgggcactgctctgttcccagtggggaacgaggccaggacgggccctcctcacccgcactctggctgggggtaggggcgacggcagcacacaaggtcatgtaggtcacacattagctgagggctgctatggaggaggaggacagagggcaaggtgacgctcacagcgacaagcacagcagggcagtgactgctactggctgtcactctctgaggaccaggcttgtgctggacgctttactcttcacagatacctgtggccagtgagggacaggctctgagatgggagtaagtcgccagaggccacacaacctgggagaggcaagcaaggcatgaaggatgagaccaccctgagagtggtgggggtaatatcagggtctgaccaagggaaagaggcggcattagagcctctggctgtcagaggctggcagggctagggagcaggtgtgagaggccaccaccactgccaggagagaccagaacctctgcccagggagaggacagcccaccaggggcctgcttcaaagcaggatcgccaggactagtggtcaaggtctgtgaggggcaagggacagtgaggggcacggatggctgctgggaggatgaagtgccatttgctgagggtttagcaggttgagtttcagatgctggtcacacccaggagttgagggtggggccttggctgttggggtctctctgcctcgggccttcccaccccagggcctgtcacagagttgatgggtggtattaaaggggcgaatgctgcctgtggcaggatggggaggctgcgtgggtctccggacagggacataggtcagggaaggagcaagaggggtgcgtgtgagttgggtggggcctggtgccaccctgggctcacagccggggaagaagcctgagctttgagctgcccctcgtgtggggaggcctggcctaagcacccggcaaagtcacaggggcatcctagggtgtgcccctccctgctggcaggaaaggtggatggggaggccctgactcgcggggttggtgaaagattctgcctgaggcctctaggccaccctgccttgccctggcctcggtgattactactacccttgggagccactgtgacatctggtctcccaggtggatttccccgcagcaccacgtgcagcccccagctccttggtctcagcccaagcccccctctacctccttctgcaggagtgaggcagcccctgcccactgtgcttaggcacctcacggtgctcccacagcctgaagcctccaccttgctctggtccctgcctatctgctggctcctgggctggcccatcagagtgccctcaagggaaagcaggggccaggtctccctcctggtgcttttcctccctgtgatcagaagtgacccagctcctgcgggggtaatgagagtcagggaggcgctcagttatcccagggctgggccgaggcctggccacccgtgtaaaacagggcaaggctgagctctatcagtgctgtctgggagaagggccccagggggcatcacaacagggtgaccttattgaatcctaactggatgcggtagaagtgagtccagcatgggggctgggtgggcagaggcctcgcacacaccctcctctccctcatgcacctggcttcaggtggactgtccaggcaacagcagacatatgtgttacaccatggtgtgggccctacagcgccccatggaggagagggggttggatggattgttgccggctcattttccaaggccagtctctgctgctttgctttcagaagagctccctttcactgtccagcctgaggtggggctgcggggaggaggctcacgcttttctctgtgtttggcaggtgaagggctggatgcacagtgggagccggaggcggggggctgcagggagcacaccagcgaccggccctccaaccctccagccactcagcaacatcgccacagcaaccagcaaccagacggcagcagccgaggcaaacacaagcggacggcttcccaccgtcgccgaggacagggaatgactacggcaaatcaggccactttgccaactagggaggtggagtgtcactagtggggaggggcggccaccgcccgctgcacagagcgccatgccggctggagaagaggcgctggggcaggggctgcagtgtggctcggcctcacccccctgctggcactgagtgcctccagggcagctgggctcttgtctgcctggtctcagtgtcccctgtggcaagagggagaggtgccccatcccgtgctccttgtctgggcccgctgctgccagaccatgggatgtcggcaaagctcagaggaaaaagaagcagcccggcggtcccggagaattgaccgccacctgcgctcagagagccagcggcaacgccgcgaaatcaagctgctcctgctgggcaccagcaactcaggcaagagcaccatcgtcaaacagatgaagatcatccacagcggcggcttcaacctggaggcctgcaaggagtacaagcccctcatcatctacaatgccatcgactcgctgacccgcatcatccgggccctggccgccctcaggatcgacttccacaaccccgaccgcgcctacgacgctgtgcagctctttgcgctgacgggccccgctgagagcaagggcgagatcacacccgagctgctgggtgtcatgcgacggctctgggccgacccaggggcacaggcctgcttcagccgctccagcgagtaccacctggaggacaacgcggcctactacctgaacgacctggagcgcatcgccgcagctgactatatccccactgtcgaggacatcctgcgctcccgggacatgaccacgggcattgtggagaacaagttcaccttcaaggagctcaccttcaagatggtggacgtgggggggcagaggtcagagcgcaaaaagtggatccactgcttcgagggcgtcacagccatcatcttctgtgtggagctcagcggctacgacctgaaactctacgaggataaccagacagtaagtggggccgggggttttcctctgcttgttcctgctgtcgtgggttcctggaagcaagaggactcgtgaggtccaggacagtctgcagccagaaagggaaccaggcgcaggcctggccctgctgcacgataactgaggcagctccagcaaggtgggggcagagggaacagggtgtggagtgcaggtgtcatgtcccatgcctgaagtactcagggtgtggaggccacagggcaagagagtgtgaggctccgccgggcatccatgatcaatccatgtgatagtttggcaaatccatgaagctcctgccagcaccagtctcctaccagcatataggtccaggaacagcagccacccctgcaaccccatcttgagtctgcaaatctggcagagatggggttaagagctgtttagaagggataatcccaggtcctggtggaaaggggacgacgtaaaagcaggtgttgggattctttcacagtggcatgggcgcagcccgagggagacctggacccagtgtgaagcggtgggggcttgagagtggagttgctggagagggtggggagccgggtgaagcagcagggcagtgtgctgaggcccagccaggacagaaggtctagcacacgaagggggccacagccaggagtggcagcggtggaggccgtggcaggcaagggaggggctgtcttgcccagcaggattccctgagcacagatttcaagtctgcccttaagagagaggcctttgaccctggggatgggggagtgggggcaaacaaggagtcacgaagttgtgggtaccctggggctaggggagggtgatgctgggagacaagggctcagcctctccacttgggagcactggcctccgaggtcactccttgcttcacccagtcctaaggcaagctttattctttaggttcagcggagagcaacaatggttctagctttggacctgtgccccagccagggaacctggacagctctaggcagtggccatggtgctaggagcctgagtgttctgagagagaggatctttggctttcctcaggcagctggggaggcgggcttgcctccctcccctcctcgcatcaggggtctccctggaactgtgcctaggtgttgatggtgtgcctgggggaaacgaatgacggacgggcaggcaggtgtgtacgcaggcggctgcgtccaccctgttcccagtgtgtatctgtgtgctctccagggttctggccccttaccctgtggttgccacaagttcagccccatgtgtggttctgggcagaggggacatctcagcagatgagtgaggtcaggctcccttgatgaggcatggccgtgggcagagcgcttggggctgagaagctgcaaggcaaagtgaggtgctcaggccagacccttgggacagtgccatggtgggtctgccagtcacacgggcttgcgccactggcctcacccatcaccacagtggcaggcgtggcaaattccccgggcaccaggcctggctcccagttgcatcctttgacaggccgtgcccacaggtgtgctggacacaggaggcaggatacctgggtcctgagtcagtccagtttttcatggagggctttggctgtcatgtttgctttctgaacttgtcagtgaggagatgacccaggtgtcttcacagatgggcccaaggctaggcctttgcctgcctgcagccctcttggctcttactggcctgtgcctgccaccttgctgcctctctctcctctccttctgctctagccgtggtcagcttgttttgctccagcagtactgctctgtccagccttaagcttgtaatgatcctgatccctgcctctcgtacccctgcccttatcctccaggtctcatcccaagtggcgcctcctgggaggccttttctgacctagcccggcacctgcttactcctccatctagtgatgtgtgagtgagctcctcggggcaggccctagatgggctgggtggcccctgtggggcctcacatctctagctttccctctcccaggcctgtccctggggagagccatggtgggcagccatgggcagggacagcagccactggcctggtctcagggatccctgtgaggttccaggcattcaaggcactttctaaagggaggggctggcagccaggctggcacacccaccaccatcaccctggtttctgcaggcctggggaagtggttgttcaccagaaaaggaaattcttgatgagaaacccaagcgaggctggaaattcactggattccaaatgattctgacctttcatgctctaccagtaatatctggagatggaaaacaaacaggctgcagaggaaagacaatcccctcccgcgattcctcccgcaggctgggctggccccggaggtgagctggcccccagagtggtgccggcagtgaggacagcccgtctccagccgggccagggccagagccagtgctggcacgggctggcacagggctgccactctgctctctccttttggaacgtgctgaactgtcctccctgggccctgtcaaaggcaaggcagccaagaacaggccatgctcgttttcacaaaagccgaatgaaccttggggcccagtgccagggctctggacacggctcctccatagccctccttccgtgctcagcttccaaggcctcatcttccctgatgctggcagtgcctccccacccccacgcctggcgaaggagccacagccccccggcccacccgctggcttctgcgtcagcacgttgccaaggagaacgtcagtgtctctgggctcccgggtgtgagggctgcagtgagtgcagggcagcacctcagagcagggaaggcagatttccgggtgtctgtggagcatggcagcgagccacatggggagccacgcccctccatgcccacggttcccaccctcgtccgaaggaattggcagtcccttgccctgactagggccaagtcctgcaggtgtgtcaggcaccccagtgcccccaagcccaacacccagctggggcttcctcaggcagcacaggaggcctgaacacagcccagcaacacaagggggtttttctggcgcacctgtcccctgaatgatcctgtggggcagcagcgcctgttatttttgtcacagatcgaggcactgaggctcaggcacacagctggcgctggcgggcccccagccctcaagtccacaaggacagctcctgagaggccatgtgtcacaggacccaccacgggcctcccacttagccagagccatggcagaggctctgcccctcgtctttagtacattcacacaagggtcagtcagcaaagacagtcactctgctgccctaggagggaaaggcaaagtggagaagctggcacctaccagcccacactgagggacagacacaggtggctgtgaccagcagagcctgggtcttcactcggccccactggaggcacctgagggggtaggtgggcacttgttgcccaacctctgcccttgcggatcagctaatggactctgctggccaccaaatggtgtgggatccttcagaaggcaagattaaaaggtctagttgtaaagcatcaaatgttctcatgtggaaacccacagggagctcactgcccatttcccgacggagctgtcagcattcccagccctgtggcgggtctgttttgcacctgtgatggacctgctgtgcaggctcaaggctcaggctggggccaagtatgagggtgagcacaactctcccagcagcacagggaactgggggacaaggaggaggcagtcacaccagcccagctacagcttcatttccacaaagcctctgctaccagggatacctgccctgtctttctagagctggcaggcagcagttcccagcagtgtccccattgtgctttcatctaggacccacagtagtcacttgggccccacaggcaggctgggtcacagcagggttcaccgtgggaggcctggtgtctctgccacttatctgagagacagctggtcaacatgttatcagtgagggtatccaggggacgggggacataagaacatgccttttgtggggcaagttctgcaggtggcaagtgcttgagcagccagcctccaggcaggtggtctatgcctggccctggatagtggtcccttgtcctggggccattggcttcctgaggaacccctccccactccagggcaggtcagcagcctcagcacaccacgagggcaggtccacacccacccggcacagcctgtgctctgagcagagggcctggcacacagtgggtgctctgcagactttgtggagcgggcgggaggcggtaggcttgggaagagctggagctccagagccctggcttctgggtgcagagcagctgggacactcagcccttcccaaggagaccctatgggtgctggtccataacaggagtgtatgcagtaccctgaggaggggctgcccaaggccgtcctgtgaacacagcgtgttcctgccaccctagcgctgtggtttatcatttagcccaaaaagggtgcttgttttagtgcttttaaaatggagtttaaacatttgtgccataaaatggcgtgttgtgggtgaaacaaggtgtttccagtaagacaggcttatacctattgatgacagagctggttatatttgcccaaggagggaattacaaatgggcaatagccagacacagatgataccctctccccagcataccagggcttagattgagaagggaccttatatatcctttagtgttcctaaccagccggctttgcagatgaggaaactgagcctcagagaggttccttcacataccgcagggctgagactctggctctcagggagggtcctggcactggcccctgggaattccagtggcccccctcttcaccatactggtcccacatcctgtgggtgctggggttctccagcaagggccttgggggtatagactgggttccacccttggagctgctgtgtagccagccttccctcaggagagtggaggacagtgacacctgggcttgggagaggtgagtggctgtgaaggttgacactcccctcgtccccttgtctcctggcctagtcagtggcaggaccacagggagccctagcagaacatggcctcactctgcctcctgttcctgacctggtcaagggcatagctccaagccagaaggcctgccgcccttttcccgacacacacaggtctcccaagcagttccttctgatcttgcaatgtgccagggccacatgcagtttgtctgcagcatcctcaagttatcatgaccctggaacagcagagcctcctgaccagatccagaggcagggccaggctggcacactgggctcccaaggactggacagcccccatggcagtgcagcttgagaggctccacaggggtgggagacacagaggaccaagcccacagcagcaccctgatggcacctcgcatggcaggcatggaattgggagcagggctcagctggccacatgatatccccagcccgcatccctctctaagcttggcctggcttcctctctatggcctgttatcctacccgagcactggagcgatggggccagcctcaagagggctgggcacacacctatagctgggccacccgtggcctagaggccccaccaacacttgtgaacagcccctgccatcccttcagcaccggctccccgcatccaagttcccttgcctcattgcccaggactcagccttaactggggctgcggccacctcagtgggccttcagccgctctgagcctgtggccagtgctcagtgaatgatgggtatctgctcgcctagggtcccaggctttatgcgtgaccccatgggatgctggctcaagcccaagatgggagggggatgagcagggaggggtggagaaggcagcatgtcctggcacctatttgaggcccttgctagcacttcagtccttgggttagctccttccttcctctgctcccagggaggatgcagccacaaggcccctgtcaaaagcagctgctcctttcctgtcacactgggagcttccaagggtggggccatttcttagcccgccttgtgcagtggctccttgccctgggtaggtccttggtcagaggtcagccacaaggcaagaggcggcagggccctgggctcaagccctgctgcttgggctgcccccacacctgctctgcctgcagggccttttcctttggcccccaactcctcatcatcatgaacctggtggctctgtcgttcagtgcatcagccacccctccatgatggtcacctcctgctgtgtcactagaggccattcccagggcacaagctgtcactgaacacagcagtgcagcagccaggaggccaaccccatcactctgtctcttccaccatgatgacgttgtcaggtgccttggcagaacctccatggggatgcccatggtgttcctcagatctctcagacaagtgttcctgccacaacaggaggtcagccagcgtgggctctgctggggcctcctttatgggaaggcaggagtcagtctcttgccctagtgctggtaagccttgagggaggagggaggagagaacaagagagttctcttcggcaccatgccaggcagggctgcttcctgcagaggagagtgctgagacccagggctagtggtggcagagcctccctctctgcatgccagggcagtgaggggctagagctggctcatactggctcacaagagctaatttttcaattttcaggatgtttgtgagctgtttgacattatatttgtggcttcaaagcagccaggtaggagtaatcacaccccaggaactggcaaatactacaaaacagttctactcctccccagcccccgcctccatgccagttgttagacctttaccagtgcaccacagccagtgactcccaagcatggcggggagagtctgccagccaggctcagtcactggtgtatggcaggattgatccgctactgccatcttactgaagaacccgacagtgtccttgcctgtcagtctcccactgtgcttccccagtgactcccagctctgaccctgtggccgcgtgggttgcatctgttcgtgtttaccccgctggagaaagggaatttgccagagcggctcttcacttgcctgcctccctcccgctcttcctcggcagatttaagagaatcctactccacagagagcaaccttgcattggctaacacgagaccacaagctgggggccatctgatgttctccatctgagaacaagccctgtggcatccttgcaggaagcagtccttgttcacccagtatgtgtgggccctgggcctgacaaactcagtctagggacagaggcagtcctatcccttcctccctcaggtcagctggggatggcatcaagcaggccctggaggacctgtgtagccagggctggcctcaggctggcttccccagtgcctacaaatgctggccgcatgctctctgtgactggccctgagcctgccctaggaaacagttttctaggtgcagagaagccaggaacaggtgcctcctctgtcccaaagaccaacatttgcaggagagacgggggcctagacgttgggagcaggcctgcacagattgggatgaacgtgggggtggtgatctgatctggaccttgcagaatccagtcaaggctgtgggggagcagtggggacagtcaacaaaggcaggactgagggggctgtcgggggccatggagagcacagagctatgcacagtgccctgcagcgggatgacggaggaccaggcggtgtaaggtctaagcaggcagggcaaggtcgcaggcacagtgtccagtccccagtgtggcccagggtgggtgtcgctgcctgagcgccctgtgatgacggagccagggttcagccccaggactgtgtccctcccagtttatacacctcctgctctgcctcgtgatcaggctggatgctcacaatgataccctgtctgaactgttccaagagcttcagggcagagctgcttcccaccccacatcccctcaacctgcatcggctaggcttgcccaggccagtgggtaattaatttcctgagcgcattagctctgctcagtacacacacatgagaacagctctgggttttaagacacagattactattgttttaagggatttgtataatccagtaactgaaaaacaattttccactatctagaacagactccaaggtggaggctaagagtgctgggggccttgctgacttggggatccctagtaaccagtgtagatggggggatctgccactcaggggagtcctgtgactggccatgaacaagacaagcagtgaggacaggatgcagcagcaaggctctgtgctgaccggatgcatagccctcttcacctgaggccccactggctcagtctagtttctggagggattggaatgacagtcagctagggtgcatggccctgggcatctcaggggggacacccagtgttggccagggcagagtgaaaggtgtttcttctctctgcatgtggctcccgtctggatagtggacaagcttaggccagcccaggagcctggctgcagctcaccctaatccctgcttcatcacacctcgtggtggacatgtcctcagctcaggtactttctctaatttcattaataatgaaaccagagtcgactgggggccctgggccttgtatcctaaggttcccagcccaggccggccagggccacagccccacacaccttttcctggcctgtggtgaccaggggagaagcacagcagcatcctgaccaagggggcccagagcctcgaaggcaacttggctcagctggaggagtgactatgggcaaggtcctgccccacagggccacccagctcaagcagtaacaacccaaatatgtttttttaaaggatgaatatttttgaaaaccatctttttggccataggcagaggttccccactgggatctctccccactacccccagtttctcatgtccctcccaggaaagagcctgagcctgctgcagaggggttcacaagcccttgagcctacaggtgtgggtccgaggctgcagtgccagcggctaggagtgcagagtgcacccaccttgctgaacaaagcaaaggcaaaccaggcaagggtgtcggccttgggttcctggggatcctctggagctgaaactaggaggggtttctcacactgtgctttcttcgcatggtgatggcgtgcaagctcctggccaggcctgtgtctgtgttgacagcttccaatctacaacacacctgtatcatgctgtttgttaatttcccttcagcgactgacactggctggtggggagcaggggtgcaggttacttaaaagcagcaagatttaacacaaaaacaaataggagacagttctcagctgaaacagaagtggactggggctttggaagaggccagtcctcccagttgggcaggagagcttatggggtcaaggtgagagcaggtgggacccaggtgctgagggtgcccacggcctccctttctgggtctgggtgtgaagccagggagcaggacacaggagctccaggccctttcggagcaaatgctcccaccatcttggaattttctgtcccaggactgggagtctttgagcattgttaaggcaccacctccagtcacgtgactcccgccacatatcacacttaccctggggctctgcctcctcagcaactttgaccaacacccttgggaatacagaggctcccatttggacctaagaccctgcaagtcagtgatggttgagatctggtgagagcaaaaaagcaaaacagagtgacatgagggtaaggggggtggcgccttgggcctgtgctggagaacagcagccacccacctgcagggctggacaggggtgccaacatcctggaggctgcacacagacttctgggagagctctgcccagtgggtgaagcccagctgaggcatgagaaagtgctctgtgtacagcaccgtctccatctcacactgggccctggcactgtgggtggggccctggcctggctgtggcccagggtagtcatgtggacttgtgtccatctggactgcccaggtgaagactggcccagcagcacagttcctgagctcctgcccctcccctggctagtgaggaggtagggcagttctggaagtactctgaaggctcaggctgtaggataacatgtgtgtgctggctgacaacagaatagtggaaatggaaggcccagagacgtgagcggttggcagagcctggcgcagggcatgctggtgcactgcatgcacaacctctaagcctcccagcccgaaggggctccccaccacacagatgaggaaactcgggtttcaggaaaagttgtccctgtggcaaagtgggggccttctgacctggacatcccgctgctgcccaggggaatgggcagggctgggaagcagccacccttgccattactacgggtcaccccaccccctccacactgcacacacagggaaaccagggagggcagacaggactgcccaggcaaggtggcaaagccgaactgctgcggaaggcagggagcagcacgctcagctgtttctggcaggttcagagcaagggcttttcaggccattagggcctgagctagggctttagcggcagcctgttatcttgtttaaacagcccttgctgtttgaggtgccaggcttagctggtgctgttactatgagcactacagttgtcaccaggcatagttgcaggggggagggggccaccggcaagcagaggctctgacttctggactcggctggaacacacccctgccctggcccccatcccagaggagccccatctgtcgctggcctgggacctacaggcctgagtactctgtaaaatgggcccctcccaagctgcctgtgccctcctgagctgcctacatgggcagctgagcagccctgtgcgggtgggcaggagcggtggcctttcttatccccagggaaaagtcgagggcctcatgaaaacccagggcctgagagtgtctgaggacaggagttgtggccaccccaggttgtcaatcctcctgtgccactcgagagtctccacttcagccaggcaagtcctgtgaactgggggcctctgtctgcaggtggcagcagctggggtgtagggagcagaagctggggcgggagcaggggtcccaagcacagtgttccagcaagaagcaccggaacccaccaagggagcgcagcagtggagtcgggtcctgggcctctgcacacagaaccccagggggttggccgcagggtgtgaaaatcaaacccacattttcattcaccagaatacgggatcagatagttcctgatcgttttaaagccggaagagcacctgcttatcaaatgcctcttcagtctgttctgccagattgacccattgaccgacgaagccacagtgaggaaggacacagaccagctgtcactggagggccagcccagggcaaggcctgctgcgggggaggaaggcccagcccgagtcccttcaaagcctcctataggtgcccatcacccaccccagccacaccctaggcatccacagaagtggcgggtctgggtgtgaggcctgtgccccccgccctgatccagcccatctgtgggccaggagcaggtgcatctgtgcagaagggtggggccaggggcacacaggtggggagcagccaggcaatcccaacccctgcccctgtacacagctgccacaccaaacgcctgcagcatgtgccatctggccttgcctgccatccaccccgtgctgggcagagcaggggagagcggtccccaagcagacagcactgctcataggcaggccatgggcaatgagaacaggggccaatggtgctaaaagctgtgcagcaaattaaaagggttggggttgtgactagggcttacttcaagtgaaggagtctgatagctgaccagctacacaaacccaaaagagcagcccatgcagggtagcacagcaaaggcctcgaggtgacagagacggaagcaggagtcaggagacagccgggagaggcctggattacacagcctgccatggaaggcactggagggtttgcacagggggcaaccccagagcagaagcaggtagatggatcctgaggagacatgaccatggtagaatgggaaggagattgtccaggaggtgccctcatggggcagaactcagagccatagcccaaaactggaccctgcatgcaatgtcccagggccccagcttcctgcctcataagctgtgtcatggcctaggacctttcttcccaggcaggagtcagctccacctgctctctggctggcacagcctggtgctggccaccccaagtgttagcatcctctgcctgctggagaggtggtgtccctatttggggactcagtactctgaagtcagggttttgccatgctcttctctgtccttcgaggcaggagacatgctgtgcatgctacaggagcttaggaattgtctgagggtgaccagtgggggtccagaggaaaggtgctaggaagacatggaggcttccaggggaggctgggcctgaagctcagctccatatccgatgtgtcatcgtgggaagagcagtgtcttcatgaggcctggacagtgcctgggtgggagatagctccagcctccttggaagacctattgaccacgtttctcttgtgacgcacttcactgtcacccagaataactgctgtctcacagctaccaggacccgagcctctggggtaaggtagagttcaaggagaaccaaggcagcccaagtgagcctggcagcagagccgagggcagccccaccaaagccacggagccagccctgctggcatccagaggccagggtgggcctgccctcccatggccccgagctctgcccccaccctttaggattgcaccctgccttgttaagggatcagctgctgctcctctcaggtctttttgggagtcctgaatctgaagtgagcctgggagaaagggagtcagacaggagaggggtgggtgctgagccaagtgagggtctcaagaccaaggggaccccagagcatgggtacccagggcctacacttgggaggcctgtggctgggccaggaggatgaaccagtgtggagttgagagccatggagtggcagagaatgggtgccaggagctgaggtgttcaagctggaacagagccctccgtgcaggcagggccgagcctgtctccctcagcatctcagatgctcacagaaccacgggggcagcagggttcagtgttaaaggccaggctagaggaatggaaacagctgccccagccctggaagctgtgggagtggtggttgccctgcaagagaaggctcagagcataggcaggccttctgctgggaggcaggacccagcagttgagcaggtaccagccccccacctctcagttcctgaggctggccgtcagcaccatgtgccctgtgctgtccccgcagactggctccagggacagacaggagctcactgagtcattaaccctcaatccaattctccaatctgtcaaggtagcattgaggtttgcgggaggaagagggaagcactaaccagattggactgtaagtgaccctggtcatccagctctgtccccagacacctccccatttcctgaggctagtagcagtgggaggatgaccaggcctgaggggtggttcgggctgtctggtgctttccttggggcaagggtagtgggccaggcaaaggggcctaggcaagccaggtaacccctctgagcaccactttccacatctagaatggaaatgttttgagcctcgtgagcccaggagcctctcacagtcacttctcggaggtgaacagaactggagggcatcacggcagcccccacacaagaggaagtccagactgacgaggccacagggtgacaagagcgagccacgttctggggccctcccaccaggaggcccaccccacccatggtgctccagccaggaacaggtcaccagaggtcctcccctctcccctgcccactgccctgtctctcagggcacagcaaggcaggtccttaaagagacagagggagagcagggtaccctcgctaccagagaccctctcccaccacctgagcagatgggcagtagacagtgtttggccaaccaggctgtgtgcccctgtgggcacctgccccagctcaagggtcagcagcttcacctgccactggtctgctgtggtgtgagactctgagggtgagggtgtccaccctggttgtcatagaaacagcagtgcgtctgcagagagttcatgccaagctcagcagagggaggaagcagctggcctgggaggcagctgttgtcattgactcctgagagctcagtgttgggaaggacccaagggcccaccacactctgaggctggcgagcacacggggcaactcaggcctccctgcccaccatctttctttgggcagctgcaccatgttgtctgtcctcttgtccacttggggtcagcgacgattccatctaggtgctgggtgaaccaagcacaggggtgctgcctcagagccacttcgaatgagggggtaggatagcactgggattccagcaggcgatcatcatttgctggggggcctgcgcgccttccctgtgagcgtgagcaggaatgactcatgcctcctccacctgctctcacactgagcctctgccggggagtggcctcactgtctgcctggtttttgtctgtctgcccctttgtctcccagtcccattacctgtcatgcatcctaagctcctgaggacagagaaggtggagagtagcagagccagagaggctctcctgtgacgtggctggctctgtaccgagcagggggtgcggccacaaatctccaagcccaggccaggggagagaggcaagcgcactggactcggttccgcctagtggcaaagaggcccagaaaagtctcaagtgcttgggacagggccccatctgcatgtgatgtgttggggcctctggaaacggagatgccaaggcagtcttctctgaggtcagtggtgatgccagagaggtgaggctcaggccattgccagctgcaccagagacaccaaagcactccagggtcccccaaggtcactttagtagaacccagtgaccatcttggacaaacagcttattttactgaggcaggagctgcggcccagagcagaagtgacatgcccagggtctcactgcagtttggtgggagaattaggtttcagaacacaagacagccagtacctcccaggccccttcctcagggagccagcagggtcgtgggcaagcggccaggctccacagggcaagcccctttggacttaaccctgtttgtgacagccctggtccctgacagtcctcagatcccggtggcagtgggcagtgggctgtctgaaaccaaggtgctccttatttccaaaccagaggtgtctgatcacagagtgtgtcactaggagcatgttctgagaagccagggagcctggtgcccaggttcccatccttagaccagtcctctgtcccttgcagccttagtctcatccacagcaagactggagccttgggggtaaccaggaaaggacaggcactgcccctggcattcatgcagggaccaggagggccagaacacaggcaccctcagcctcctgtcttcaccccgcagcccaaaggagggctgcctgacctccgggcctcacttctctcccagcaccaagaaagaggttcccagctgcatttctggtttctgaggggcccttctgcttccccagctgccacagccccaggccctgcctgggggtctctggaggaagcagaagaggcatccttcggccccgccccaagcacaccaggctctagggcccagtgctcaccaggccgtttgctctttgcctcccaagaccgtgggaggtccagggacctggtcagtggcaatgccttccaccaggtacatggttgaagaggtgcggggagcatgccagggtgcagccaggaggccagatgaccacaaccaggggtatgacagccctggacacagcaggtctgtggccacggcaggagggcgagatggacacttagcaggaggctgggctgagctcctggtggagtcagggtgggactgtggcagggagacccccttctccagcaaggacagggccacttcctgagaaatggagcatcggacaaacaccagcggggtgggaatggcaagtgctcaaggtgagcacgatgcagctgcgacctgtagactggctgcaatggggagcctggccaggagaagccagagacggacaccaaggtcagatcctgaagcacagaagaccctcagtggggatagggacctggctgcagggagcaaggtggccagtgtggacccatcaggaaggcaggggcctggtctggggaccccacagctccagctgggcagagctaccccatgctgtgctgtgccatggaataccagccaagagaccaggagcagggagcgttctgataggaacatccagctttcaggtctgacgtggcccattttaccagaagaaggggacctgctctgagcatagcagccccctctgcctggaacctcacagggctcacctccaggctagcaccctgcccctgcggctgaccctggccaggaagacacatgttagacagctggctggacttggtgcctgctgtggctgcaactcccctgggaagacagttgagtgttctgacgttggctaaactgcatctttacaacagctggggccccagcgccacctggccctgtgcccaggcaaggccctgctggtcccagcatccttctctcccacagatcttaccccggctcccaccccagcactctggccagcaccgcctccctgtttcatagtcccatcaacccctcacacactggctcccagctgctgccaccaccttgagctgtctcggatagcctcctgcccatacccctttggcctgagggtagatgtaggccaagagcttgcacctacaagcttccccaaaagggaagtgaactcaggaattcctgatgaggattccaggactggctggggaagcacggggttgcaagcgaataagctatttcctttgcgactgataccatccttggagtggatttcctctggtgccttccctgttccacagctgcagaggcatctagcacagggggccaacaccacaggcccctccactcggtacacctgccaggacctcggcgcatcatcagatggtggggcccactcgccctctccccactagagaagtctgggaatgcctgtgtcccagaccccctcggcagcactcaggatggcccaggcaggttgcagaggctcctgcccaccaggcctgtcacacagagctctgggaaatggagatgggcagtcagtgccagccaagggcaggcacccgctaccgatggaggcatgttggtcactgtgtcagcagtgccccatgtccctccagccacaccctgcccagcagacaggcagccccaccaaggtgtccccaagcttccaccacaaagggaggcccagaggggtgagaggcttggccggtactttgtgaaaggtgacagcatgaagctcatctctgtatgaaacctctgcctcggcccctcagtcagggtgctgccctcagagcctggtactcggtggccctggtcaggcctggtggctcagctgcaggctgggtggccgcagggctggcctgtccatggtgaatggagcgcattcatgtctacaaccccgccccacagctctgctctcggcgtgaaaaagctgaattcacggttcggatgaacactcccagcttttctacagtgggctgacttgagcttctcagtctgtaacagaactgaggacttgctctacagatgaggaaactgaggcccagggtgggacagaccggccccggccccacccttcccagcaatgcggctgcatccccatgcctctgtgcctctgccagcccctcctgcaatgccttcccttcccctcagcccccagaggtccagtcaaaacgtcctgctcttgtattacccctcgccccctgcattcctgtggtgtgtcacctgtcagagttgtagctggccagcactatctgcagcagtgccagctgctcacagtcacttgtgcctgggtgtggggactaagctgtccatgtgtatcccacatcagccctcagccccctcacgagggaagtatgcttacatattctgtgtgtgtgtggttatttttttggaggggggacaggttcagaacagctggcagagcaggaggttgggcctgcattggccactccgcagctgccacaccggctccagcattccctcctgcctgtcctcacccaccttgttgagagcaaggctgtctgcttgcctccatccctcacacaagagcacctggagagcctctgcccagggaggtgaggaaagggagagggcagtggggactgccatgaaggcatctcagaagctggcagggctgggggttccaggtcatctgtgtcccagggatgatgctggttccaggaagagctgaaaccttaatgtcacgtgcattttatgtgaggtttgaggcccctagttgggccagctggccttgctctgtgctgtggccacagcaaactgcatggggtcctgtggagtaagggacctagtggagagtgagtggacagggagaccagatgggtcagtacagagccttccccagccatgtggccatatcacactggcatcacccacctattccccaatacaacacagtccgggggcccctcacctggctgaggtatgtgacaaggctctgagctgatggtgtacgttcagcctgagtaggtgtttgcatgtggttgcccccaaaccagtgtgatttggggctgcatggatccagagtagggaggtgacggtcccaccatctctggggtgtgtgcaagggtcagggtttgggaaggggttggacaagaccagtgtccctgaggactgcctacctgctgggagctgacatgggaatctgggagtgcgtctggcctcctggagggggtctcgggttgcccagaggggagcgaggaggaggcccagaacataccccttcctagaacaggaaggtggggtgaccctgcagggtggcctcccacacctcagtgatgcctcggtgacccctaaggcagaagatgcgtgaagcaggcatgaggccctgagcactgctggccacccctgcaaatggaggggccccacctgaagttgggggccggggctcatgtttgagccattttgactgggtctttttcagtttattttctaaacctcagtttatttgaagcacagtacatgattgctcacttcaggaaattctgttcaagttttcctagcagagttactcattccttcatctgtgcaaggggagggtggtggtcataatcaccaccctgatccccctaccccctgggccctgtgtgaagatgacaaggcagtgcggttggctgagggcctgggccaggccaagcacaccaggaaggtgccgcgcatgtgccagatgggccctgaggccgctggggtcccacagcaaacaacaaaacagtcaaacaggtgccagcctctgtcatgtgctcaccacgtgcccaggaccacgtctgtgtgtgcgtttgcctgggtaagccttgcttcgtgaagctgccatgacctccgtctcctcactgaggggcacagggcaacaggctgccaggtgaggggctgaggggccttctgggggccactggcctactcgaggcacagtgagttgtgggaacgaggagtaacttggaggtggagctgcgggtgcagagggaaaaagacacctgggtcatgaagggctggcctgtccgcctgaggggcccagaagtgcagtgaggggatgacgtggctacgcgcctgtgacagggcacctgaggacatttgcagtgcaggagggagagcgcttcagagcaggccagtgtccctcccacccggcccagtccctggtccctgggtagtcactgagctacctcatgcaggaccatggtcttagcaggacacctgtggtggcctgtgaggcagggacaggaaggatgccccactctgggctcctcagggagctgcaactacagtgcaggatgggctgtgatactcagcactgtggatgtctgtcaaggcagggtgtaatggactggaggtcagaacgtgtgaggccctggatgagcctctcacctccccacccccagcccaggcgcttgtcccacacagctgccttggatgtcattagctggaaagccgtgagtgcctgatggggaaggagtggggtgtggggaggtgtttaggctgtgacaaagggatgctaactccaaaaacaggcccccagtccagaggcctcttaaaatgcaaatatgccgcacctgggagggggacaggcccctggctgagatgaggaagcctggaggatgcctctgttccctctcccaccgcaggcccatgagctctcagaccagcaggaggctgatgctggaatatgcgcgcacctgctgggggatctgtgcgcctcagctccaaagtacaggagctagactccagtgtccatgtcaggtcccatccagctgggatgcaggaaaccaaaggcagccctcccatgacccagcactgagggccagacctgttaccaggaacgttggtaactggaagagcctggtacttggggctgttctgtgccccacaaacagagggaccggctgtaaggagactggcctgatggggaatgagaggggctgagccagaggtgccgacacggtatgttttaagtaaggtccaggtggctgcaggcgggatggaaacacatccaccattcatcacatcggccattgcatctccaggctaaggggccacaggagcctcccaaagagccaggctgacctgggccctgtggccagcaaagaagtgttgctggctgaatccccatctgcagcatcgagacctctcccactccgtccggctgagctggccctgcatttgggtagccttccctcagctgcctcatgctgggacagagggaagcaggtcttccgatgagacctcgcaggtgagaggacgtcccagtgccaaggcgaatcacagtgggtgtggcgtggagagggcccactggggtgccagtggtagccacagggcaaggcccagcagcttggggttcttcccgtgtcagcacctttgtgccttctcacaacagtcccagcattgtacagatgaggaaactgaggcccagagaaaggaaatgacttgtccaaggtgcagcatgcaccggcagtgagtaaaccccagaccctgtgttcatggccagggacatctgcccctttgtgtcaccaggagaaccttggtggagaatcaggagtgagaggcctcaccacccccacaactaaccaggcgcaggctcctctccactccctaccttgccccggccgctgacctgggaatgtccttccaggtgccggacctggtctggccagcagtctggcagccacgttcaggggaaataccccagacccgcaggccagcaagctggaagccccttagggatgggctgtcagctcccctgctgtagtgagaaagccacggcctggggcagagtcccttccacaatggcaagtctatttggacctgtctgagcaggagctctcttctcacaaatggccaggaaatgacttccacaccaccccagggactgcatccagctgcctggtggctgaaggcctggttacaaatcacctcaccattccccgacgccaagcagtgagattcccaccattgcacaagcttctcacaggaactgtctgctccgtgttatttatataaataaatgtgcagacaaaccccagcctcctagaaggcgccatcttgctggtaagcaggccctggagagagcaggatgggcactggagccctgggctggcatcacagcagtgaatggtggtgtgtttctgcctccctcttccccgccccgccccaccccccgcggctgccttggcagccatagaggtgaaggcaaggagggcttcttgccagaacaggacactgtggcagttggaaaataccaggctctcaactgcaccctggggagtcagcccctcttgaggccttgggccccatatgtgaagtgaggagccctcccccttgccatggggtcatggttggcagaggcagctcctctgaatccagggtctgtcaggctgatggaggaagtcactgcaggacaagggggtgatgcactaccatggggcagggccacatgactccaaagctgcatccagctctaccccagtggcccacaggtgggctgcagcaggacaatgtttaaccctgccaggccagggagggcaaaaccccatgcaggccaggccaggccaggaaggagaacagagccacatccaccaagggcaggaggacccaggggagcccacaaaggccagatgggtgcaggaggcacagccagtcatgttttgcagggtgagcagagcatggacaggtcagagggctatgaggccaggccctggaggccagcagaaggcatgctggggcttcttgcttcccatatgcatgcttgagtcacagtttccagagctacagcttcaaatagacggctctgttttcagtggtggtgatttgagtgtcaggatgccgctttgcccacctgtctgcactccaggctgcaagagtgcaggcaccgctgtgacacaggctcccgaggtcaccaggcaagcaccagggcccaggctgggcactaggtcagaggacaagactgggcttctggcctggcaacacctttccccactgcctcctctgcagttgatctttcagacccaaatatgaggctcttctctaggtttggcctcctctcatcaacttcagctggtcagggtcctgactttgtaaccgtctgtggttcttcagcctcccgctctgtcttgtcccccatctctgagagctgcaggcctctggtctaggaacaaacccacgatgcagctcctgcctcacttgctggtccatcagcaccacactgccagcaccacactgtcccatgctgggccctctgaccttctttatagccttcctgttctataaagattacaggatgggcacccaccatctcctaagcttcacctcctactagggtggagcccatgtgcagtgaaggctcagcctgcgtcagggacgctgggatggagtgaggcggcaagctcaggtgcttcccacgctctgaagcttcctgtctgagcccggaagtgaggtatgtggttggtgcctcctgcaggctttcctgactcctgccagacagggcccagccaagaaacaagaccaggaaaccaggcgtctacacagagattttgttattatttgaggcccatcatctcctcggtgcccactaaatattagtcagtgtggttcccatggtttgtctcaaggaatagaggaaaccaggaagcctgagcctgaaatgcctgcaaagcaaggggagtcctgggcacaagcaggggcctgagctgagggaagggcccacactcgggagatgtttgtctgtcctgatgaggctgccgcagtggcggaatcctgataagagtgtactgtgaggcaccgtgcccacctccagctgccttgtgagataagtacctgagtttccatgacctctaagtcaggaacaggaggctcaaagaggtgtccagggtccccaaggtccactgagaggcatcagcagggaagcagtttagacaccatggaaggggctcctagtgcattgggacagcttgactcaccccaggactcacgggggccacagtcaggagtgtttcatggcgttggacaagaagagtggctgccttggccttggagagagggggtccacgtggtctatcggcccctcccactgctgccagctgagctctccctacacacaggtgccctgcagaggaccagtctggtttagatctgaggcttcagatgaccagtacacgtgaactgtttccgcatcagtgaggtggccctcctgctcctcctcttacctaaattccactgcctgcccaggaggtgatgggctaagctgggtattaaaaccatctcaactgtcatccccaagtgacccatcagggctcagagaggcagacccaggcctagcacccactctgtgcttgtcccctcacccttgaacccccaggtccataccctgctggtggccagatcacgcccttcccaaccccggaggaagccccctaccccaaaaggaccctgccatccctgcctggctctattcctgcagccccaggactcccacctcaagctccatcacctggcatgagagctgatgtggactcagggcgcgctcagcaagtgtttgctcagtaaattaataatacgtgctaatggtcatatctgttatttaactgatgcaaaatttggggtcagaagcatagcccccaattacagcatcatttctatgagaaatgacagctctgttaccacagtcctctatgatgtggcttccaggaatccattagagctaattactccctcagcagaatgtgacattcctagaccaccacttatctcacatttgggaatgtgcagccaggttcactgcggaggcgctggctcctctctgctctgctggggatgagatcttgtgtgttgcttgtctctgcagaaaggccagcacccccatccccagacctgaggctgctcactcctcaggactcctgttattccgaagctcattctaaagaaagagcaagattggtttggaaaaacagtcttccaggtggagtgcagggttccagggtaatgacgggtacctctgggtatccttcctttctctgcacagatgctgccagagctgttcctcagagaactcaggggctctggagagcagggtttctatgcagcatcctcctgggcacccctgccctcaggcagcctcctttgggcccaccctgtaggagcagcaagccagagcacctggttgtggggcttggagcacatatcctgcctctctgtgcctcagtttcttcatctgtaaaacaggagtgggcagatgtgagaacagactggcagctcgtgtccagctgtggttaccagcgtcattgtcactgcagtcattggtgatgctgttgcttcgtgcctgagtcatcactaccagctgcagttaccacttgcattaccacggtcactggtgatgtagtctagtcagaaaagttcctttttttttttttttttttgagacagagtctcgctgcgtcgcccagactggagtgcagtggcatgatctcggctcactgcaacctccacctcccgggttcaagtgattctcctgccccagcctcccaaggagctgggattacaggtgtctgccaccatgcccagctaattttgttgttgttgttttatttttagtagagatgaagtttcactgtgttggccaggctggtcttgaactcctgaccttgtgatccacctgcctcagcctcctaaagtgctgggattacaggtgtgagccacggcgcctggccagaaaagttcttaaatccaaagcatcagatctaagccagattggttccagatttttgatattttgctcattgagtttatcttagaagcaggggtagcttttgccagcagcaaattccaggtagttactccttttagaagttagaatttattcattttgcagggaagtggtgaactggggagtcagacaagagcatcatgcttcttaaaagcccagacccctggctataacacatcgaagattctcagaagagaattgaggagcggacaggcgccacactccgttgtggtcactgcctcttcctggcccaccacactcctgtcctctgcatgtactgagagctctgtccaggatgccagggtcctgcctcggcagagaggcggtgccagatgccccacagcagctggtgggagtgcccacagctggagggcaggggaggagcctggcctctggctggtgtttccttcccagctctcaagaactggagactttggttacagaagtgaaggctgctccctcacagacttcctagtgtccgatggtaccacatggaaggatcagagttttgaaggactgggccagaacccagatagggcacaaggctgccagcgcctgcattgagggagctatgatgtgacgggggctcctgcagaagatggccttccttgtacaggtgtggggcagcctgtggatgggcagtgggaagatggggggtcctcggagctggaggtgcccagcggtttaggaggctgtgcttggcacatctgtagccccaaagctatatgttgagatcactggcacccagaggagagacccaaaaggggcaagagaacatcttccaagcacttgccactggcaaggagggtgctgccggctatttccgtgggaggtgggtgaagacatttaacctgggcttccccagcagaaggaggtgccattgcagggaccagtcttgggctgagaccctagcaaaggcttcctctggcagggctgcaggtctagggtctgtctctgcctgctgcgggcctgattaacgccagtactttcctttccccagagtcggatggcagagagcttgcgcctctttgactccatctgcaacaacaactggttcatcaacacctcactcatcctcttcctgaacaagaaggacctgctggcagagaagatccgccgcatcccgctcaccatctgctttcccgagtacaagggccagaacacgtacgaggaggccgctgtctacatccagcggcagtttgaagacctgaaccgcaacaaggagaccaaggagatctactcccacttcacctgcgccaccgacaccagtaacatccagtttgtcttcgacgcggtgacagacgtcatcatacagaacaatctcaagtacattggcctttgctgaggagctgggcccggggcccgcctgcctatggtgaaacccacggggtgtcatgccccaacgcgtgctagagaggcccaatccaggggcagaaaacagggggcctaaagaatgtcccccaccccttggcctctgcctccttggccccacatttctgcaaacataaatatttacggatagattgctaggtagatagacacacacacatgcacacacacacatctggagatggcaaaatcctctaaaatgtcgaggtctcttgaagacttgagaagctgtcacaaggtcactacaagcccaacctgccccttcactttgccttcctgagttggccccactccacttgggggtctgcattggattgttagggataggcagcagggctgaggcaaggtaggccaactgcacccctgtcgcctggaggagggccagctcgctgcccgagctctggcctagggaccttgccgctgaccaagagggaggaccagtgcagggtctgtgcaccttccctgctggcctgcacacagctgctcagcaccactttcattctggacctgggaccttaggagccgggtgacagcactaaccagacctccagccactcacagctctttttaaaaaacagcttcaaaatatgcagcaaaaaccaatacaacaaaacgagtggcacgatttatttcaaactaggccagctgggattccagcttttcttctactagtctgatgttttataaatcaaaacctggttttccttctctgacattttttttttgttttgttttttggtttttttttttttttggccaaatctcgtggtgtttcgcagaaaaaaatccagaaaatttcaaatgcagttgagtattcttttttaaatgcagattttcaaaacatattttttttcaggtggtcttttttgtgtctggcttgctgagtgtaaaagttgttatctggacgatctgtctctctgctccaaagaaattttggagtgagtggcagtcctgcgccagcctcgcgggacacgtgttgtacataagcctctgcagtgtcctcttgttaatggtggggttttctgctttgtttttatttaagaaaataaacacgacatatttaaagaaggttctttcacctgggagcaaatgaacaatagctaagtgtcttggtatttaaagagtaaattatttgtggctttgctgagtgaaggaaggggagcaaggggtggtgcccctggtcccagcatgccccgcgcctgagactggctggaaatgctctgactcctgtgaaggcacagccagcgttgtggcctgagggaggccctgctgggaccctgatctgggccttcctgtcccagggcctatgggcaactgcgttgaaaggacgttcgccaagggccgtgtgtaaatacgaactgcgccatggagaggagaggcactgccggagcccttgccagatctccctccctctctccgtgcagtagctgtgtgtccgaggtcagtgtgcggaatcacagccaaggacgtgaagagatgtacgggggaaagagaagctggggattggatgaaagtcaaaggttgtctactttaagaaaataaaataccctgaatggagccc

SEQ ID NO: 36695 - DNA, 16372 bp, Homo sapiens
agaggggtctggagttcctaggtgaaccccagcagcctaaccctgtcaagtctgtcgagcctctggctggtcacacgtgctgcggaatccactcagctttcctcaggtgcagtcaggtccatcctgcagagggaccttctgcggacctgttctttcacctccctaacctgaagattgtattcaaaccaccgtggatcgctcacgtaaaatggtcactgcgcctaacacctgggatcccgtaacccttatctatcttggcttcagagagttttttgactagttccaactttgctgaagcttgtcaaaggtaggtgacggctagttggaacggaaaaattttacgaaacttcctattctcagaagtaaaagggaagagagagtgcttaaggaagaagggaagttgagggtgggtaaggagggagcgggagttagtggtagattgtcactgtgtttaagatttccccaaggcgaaaaaggcgaaagatatcttgctagatccctagaattcgaaggcattaggagagggcggggatagcaaacatcgcgcgaattttgagaggcgctgggactacgtaatcccgcgatcttatgactaaacgaacgcgatttagggagaagtaacggtagcgataaagggattgggtggtggtggtggaggggtggagccaacgattacgcacgttgtgcgtgctgtcgtatagctgtgggaggggccatattaccgcgtaggctaaccagtgcgcttaatagctgtaggtccagtgtaagagttccgctattcggtctcacacctacagtggactacccgatttttcgcttctcttcagggatgagtcatgtggtggtgaaaaatgaccctgaactggaccagcaggtgagtcaaagtaagcctaccgaggctttctacgggaccctttacttggcctgacggtttgtggcgcactgttaattggtttttcagtttcacttctggtgggttcgtgtgttatgtgactgggactctagggaaatggggagagaaactgcatgagaccatgacaagaccacgtacggaagggatcgtgcgatggcagtaacgttaatggtagtggttacgctggtattctggtatagtactgggcctcacgcaatggcggcttttgtgtttgcttgtcccgtggagacgcgcatgtgcgaccacgaacccgtttgtgagggggcgggggagggaggcggttcgcaaaagcggaccgtttttatgtccagggtgaggctcttatctggcgcccctgacgtattcgcagtagtgtcattgttaagaagaaagtgtattcaggccacccagtttgtgtagcgagaagaaagagtagtatggtctttgctcgggcaaatggccagagtctttgtgtatacaattgtgtgacttggcagcgctgtgttccttgagcagaggggccaggcctgtggaattcttgaagacgagtgactataatatagcacaacgtaacaagtatcctgtatcttgtttctggtggggtcccgtagccacggagcaaccgttgcccgggtgctgagcgtgccgaaactgggcttccggtatggaaagttttgtgacgcagaaggaccggaaagggatggtggggagggtagggaaggatggctgccgcgtgcttctcttgaccctgtagaaataatggaaattggacgcccgcggaaagacacctggaaggttagagatccagcattgcgctacacccctttgttaattcagtcactggacagccgcctagccgagagctgtgcggtttttatatggtattgtatctttactttaggcgatacatgcagaagtcgtccggtagaaaactaacctcgaatgttgattagcgggacaggttatttgtggtttactttcttgttatcgccgaaggattgttgatataggtttaactgtgtttccattaagggcagatcctttggaagtttgggcgatgaggcagaagataggtggtctacgtgttagatcaggctcgttttctgtgtcaggaacctaccgcgcttttgcatttggcacaccagtcgtttgcaagcttatccctgcatttctgcctcccaagtctaggggagagaatgaataaagagcatacattttttttttaaccaaaaaataccgtcggaacttcttagttgtaattaaagcttagtgatgctaaatgattttaaattttgctgttaggtgtcgtttgagggatttaatggtctgcctttgaaggttatttttccactgacgacgtattaacgcctgcagtttactgagacttgacgtgttaaatagaccacagaaatagaaaattaagagcctgggcaatacgcatttatgttttctatgtaattggcatccctttaactcttgataaaccgtgctgtctagttcactagaattaagtagtaaattcagatggcaagatttttaagtacagtagtatcttaattgatgattcatgtaatgtgatagtatcttgaacttatatatgtaagctttctacggcatagaaagtttgtgcaaaaaggtgaccaaggtgctcttggcattggtcttaacgtgttttttgaaaaaaatctattttaacgtacatggttttttcccccacccccgccaccgcttcagagttgttctaggtaaggtattatgctgaaagcccttaaagcgaaataaccttttttctagttttaaaatccatcagtataaggaggcatgaattgagattggatatgtcattttagaaacattaaatacgagatgtgttgctttttaacttcgcaaccaaagacctccgaatttgatgtttagaatgggagaaataaatgctaccatctccataaagtatcgaacattaagtgacagctgtgtaaagccgcgtagtactcaaaacatagtgaagtttttttttttttttgagcttttgatgtttaggaatttatctgcattaaaaatagttgtaccgtcttcagggcaaagataaattaaggaatcttcaaatgattttaatgtccatttatttttagggttagaatatcaagaaaaccactgtcattgggaacatttcactatcatgactgtagctaaattggatgttgaagttactgagaaattgatggtaaatttttttagttaggaaagttttcacttcggaaaattgttaaggaaaatttgttttgaattaatgaatttgaactcattactgtgaaactgctggtattcagctgatgccatttgcatttgtcatggttggtagacctggacatctttaaaatttggcaggtaataccaggccgacatggcagctaagtttgtggtacaggataagattggaatctaggtctcatttgtcttttgtgatgttatctgttcttgtgtatcagcatgtgagctattgatatctcttctagcttgctaatctggacctgaactctgaaaaacagagtggaggagcaagtacagcgagcagtaagtaaaactttttttaaaaatggagtgtttatcagagcttaatgttaatgtcttactggacttgttaattttaaatttacatttttttctttacaacttgactatatgaaaatatgagatattttggtgtgtctgggtaataaaatacactgtttacctatgtctgctgaaaatacaaaaaattatcctggcgctgtggtacgtgcttgtagtcccagctactcatgaggctgagatgggagaatttgcttaagcctgggaggctggaagcttcagtgagctgagatcaggccactgcactccagcatgggctacagagaccttgactcaaaaaacaaaacaaaaaaccaagaaccttaatgtaatacacattatttttagaaaagcagtgccattcatttctggcccagcatgggatataagcccatccttgtgaattgacctgcattgtgttaaacctaatgaaagaactttaacctgtgcatttatgtgctacacctactgctgttgccgacgaagaacctaacattcagtgataaaaccaagctcatctgattttaaggtgatgagttagctatattcctgtgaaaggaaattagttataaagacattcttttgaaatacttggtcttgtttggttttggaagattgggtgaggttagtatttggataggagagtaaggctggtggttattcagtagtatccctggtttgagtccaggtttcttactgttgttcaacaaggaaagtagttggtatgctttgaaacaaaacaaaacagaacacttttaagttttataaatttatttcaaactttgtcgttatatgaacattacagatatttaaatggtagagacatttttggatatttagttaaatccaaaagtaggaggtttagttcaaatttggatttttgagttacaaaatcaggtagttaagtactgtctacttcataagttcttttacttcttaatcatagactggcctgttgatttaactgaaaacacttgatttgttttccagatcattttcactttccaacttttcatgtgtttttatggtatcactttaatctaccagtacagaattttttttctttttttgagacggagtctcgctctgtcgcccaggctggagtgcagtggcgcgatctcggctcaccccaagctccccctcccaggttcatgccattctcctgcctcagcctcctgagtagctgggactgcaggtgccggccaccatgcccggctaattttttctatttttttttagtagagacagggtttcaccttgttagccaggatggtctcgatctcctgacctcgtgatctgcccgccttggcctcccaaagtgctgggattacaggcgtgagccaccgtgaccagcccagtacagattttttaaaagcctcttactggttagttaatttagtatagcacataagagtcttttttccctagtaggcttttatactggggtaattaccatgtttaatggtcagtgttgattcatgaagcagttattggaaatagatccttttaaaagataattgttagataaccactactagctactgaaatatttgtggtttgcaatgtattttagagtaagcattttttccgctcatcttgcaaagtagtttattgtataaaatacaggttttaaaagtttgttttccaggacctattttttaatagacattttctaaaagcagtatcttggcgatgttataggcttctaattttacattttctcttttagaagggcgctatatacctcctcacttaaggaacagagaagcatctaaaggtacgtctttaaggcaactttgtagacctaacctttagcagctaatcaaagcctagggaagaaagtaactttaggaggtctataaatgttttttgtcccctcctgtgcctctttcagactgtctttaagaactagcactttctgtttttggaacagtttgtataatgttgaatgatggatagttgtttcctttggcaaactgagcccaaagaatctgagttttgtatagtggtttatctgtttgtaaacatttatgttttgaaatttgaaaccagtgtatttgtggaaatgccttacgtaaaagaaactgtgtagtgataaagacctgcttgctgctgtctggaaaagttagcacagcaaaagtgggtttttttttttttagactagttaacagttgttaagattaccacttttggccacatccaataagctggtgagattgtctggtttcagcctaaacaacttcatttgaaaggtgttgcatgaaatgccttaaaacacttaggatggtttactattaaatttgtaatttagaaaagtttaattggggtgatgttttgagtgctgcatatacatcaaaaaaattctaggagaaggaaaggtcaggaaaagtatttaaaaccaaaaggaaagaaggtaatgataaaggggtgtggagtgggtttgtatttctatgtttagtctgtagcctctttaggtctgtttatcagaagaccacttagctaatgattgtattattttttcagaataactggagaattgttattctgaaaaaatattgcatctggctggaattgcatcaaaggtttattaactgccttaaggagagttggcaatattttagtatttgaggggatggaagagaccttaaacatctaacttcctaaatctgggaagtacaatcgatttagtacaatagatctagatttaggaagtacaattattcatttgtctaatattggagatttaaaagcaggggaaaataactttattaacttgtaactttaaacattcattgaaatgtttgaatttaggtaagtgtgtggttgtgaagtgagtttactcttgtcattttttttttatcagtttgtagacatggaaagtaggcaacaatgagggtttttttgttttaacacaagtataccttattcttaacgagcatattaagattacatagttacttttggacttttagaatttgaggctattttagaggtctggtagagcaaagtagacaacatggaaattccttgttttgtattgactacttccatttagctgatctgtttctttttggtgttactagacaaagctagattttaaaagatgaattaagatgctcagctaactagtcctgtttatagtattgttgatagatagcaagttgacttctccaggttcttcattgaatgagtccttgtttactatgatgcttgctacatacagttgctacatactactatgtatgagtagtttttggtcataaactgcatagagttggagctgttttttttttttttttgagacggagtcttgctgtgttgtccaggctggagtacagtggcgcgatctcagctcactgcaagctccacctcttgggttcatgccattctcctgcctcaggctcctgagtagctgggactacataggtgcccgccaccatgcccagctaatttttttgtatttttagtagagacggggtttcaccgtgttagccaggatggtcttgatctcctgaccttgtgatctgcctgccttagcctcccaaagtgctgggattacaggtgtgagccatccctgttttaatccatctgacatatttcttctgattatgtagctctcttagttcaagcttttctgtaggtaacccacagtccctgaggtaatcttttacttagctgggccttcccaaaatgtgtattatatatagcatatgttaaatgtttaggtttaacaccttttgtattattcaggatttgtcaaggatgggacataactaagaaactaacaatgggcttgcactagctacaagttcagcttaaaaattgggaacttggaatccctcttagtcatagcttaaaaaaagactcatcttaaataatttaattggagtaggtttatattttggatatgtaacatttacacttaaaaaatgaatgaaaaaaattgttacgatagtatagtattaatagcatagctatgttacatgcaagctaccttgttctcaggtcatgagattactttgcttcatataataatctctggtggaagaaaacattaaagcttttaacaattctgcttatgggacttgtagaccattggtcccataaagataacataaaggaagactacatgtgaaggacttcatattttgaaagatgcaaattattcaaaagtcttgtcaccttctgatttttgcttttttattgaaggattccatgataaagacagttcaggttggagttgcagcaaagataaggatgcatatagcagttttgggtctcgagattctagaggaaagcctggttatttcagtgaacgtggaagtggatcaaggggaaggtaaatctcagcttgtgtttgtatacagtagaaatttagaaattttaatttggtaggttctcattcttcatactttcagtggtcaagcatatctttaacagattactaatggatttaaagcagaatgttggtttactcattgttttgttagcagtaagaggtctttattaatttattaaattagatgaatatggtatttgacacagtgaaatctgtttcaacttaaatgatacttaaagcctgtctgtgacagctttaaacacttcatttttgatgtgtgttataagttgatcttaaaaacctaatggctgtatttaatcctttctgtttttcacaaataggagtaaaactctaaaaatattctcttgtcacatgtctactttcatataaaggagaaattcaagtgttattcctgctttcctactagtaaatatatttagatgatactattttaaatgaagatgtaaagtacgtaactagttataagtatctaaaaacctaattcttagcatgtgaggtctaagctgtgtgattttataaaaatttttataattttcttaaaaatgaagacataaattacattttaagtactggttaattagagggccttacttcacatgagaaacgaatattgaattgccagtatcttcgaagggtggttgtgttcagtaattcaactgatacccaagtacgtttctagagcgatgataatctaacatgggctaaatcgtgtacttctgattgcttgtgctattcagatttgatgatcgtggacggagtgactatgatggtattggcaatcgtgaaagacctggctttggcagatttgaacggagtggacatagtcgttggtgtgacaagtcagttgaagatgattggtcaaaaccacttccaccaagtgaacgcttggagcagtaagtttttgaaatgtatgttaattgttatgaaatttattgcttagtataacatgtatgtaataattgtttgatttcagagaactgttttctggaggaaacacggggattaactttgagaaatatgatgatataccagtagaggcaaccggcagtaactgtcctccacatattgagaatgtaagttttttgtttgactcttaaagttattaatgcaaacccattggattatgaaaaaaaaattaatgtcattgttaagaataatcctggaattaaaaatttaccaaacttatgaagcatccattatttttatttatttatttttttgagacagattctgttctgtcacgcaggctggagtgcagtggcatgatctgagctcactgcatcctccttcctgggttcaggccattctcccacctcaacctcttaagtagctgggactacaggtgcacaccaccacacccagctcatttttgtacttttagtagagacagggtttcgccatgttggccaggctggtctcaaattcctgatctcaagtgatcttcatgccttagcctcccagagtgctgggactacaggcatcagccaccatacctggcctccaaaaacttttttcaatgtagattaaacccaggcattttcttaaaaaatgccatgaatcttttactgaaatcatagcatctgtaaactaaatcagacagtttagttggttacttccattaatatgttagtataaaacagaaattgcgacagatacagcattttatatctgctatgtttacttctgtatttacttgtatttgattaacctggttaaatttcttggcagtttagcgatattgacatgggagaaattatcatggggaacattgaacttactcgctatactcgtcctactccagtgcaaaaacatgccattcctattattaagggaaaaagagacttaatggcttgtgcccaaacaggtaagcttactcaatacaaagtgaaagttaagaatacctgatcagacttactttaaaagtagtatgttctgaaggggatgtctgaatcctgtgtttagcatttgaggtaggtaaagattagctgaggatgtgtctttttgtgtatacctttggatccttgggatgaaactaatatttttatctggacatcttgaggaagcttatggcaaaatcttctttaagaaatagaactgcgtattttacagttaactccacgggagttagcaaactgcagcctttaggtcaaacctagctcttgtttatttttcaatagctgtattgaaatatagccatacccattggttacgtctatagctgtagaggttagccagagatgtggcagagagactggcctgcaagagccatgtggctctttacagaaagttcactgacccctgttttaccttctaacagtatgtagtgattacaaagaaatgttgaactgaaagttgatgccacttttcagaaaaatggttgtgttttgtacaaattgaaatacattgtttaaaaataaagcacagtactcactttaggtttgccatataaatttactgtaacttcctagaaaattggaaataaagtaagaaaaattttcttacaattcaagggcatttagaacactttgtcatctgttaatattcagaaatgataagccagtgttttgttttcaggatctgggaaaactgcagcatttcttttacccatactgagtcagatatatacagatggtccaggagaagctttgaaggctgtgaaggtaaaggttttgttataaaatcagacatttttgttttaaaaagctttgcaaagccctgttgacttttctaacggatgccagatacaccttattttcatttttttttttttacccctttcacccactgaaaataagtttgtagatgtaatctgcaaattataaagagaaagtgatgaatttttaaaaacaattgaagttttgggttatgaatttaaaattatatttatgttttaggaaaatggaaggtatgggcgccgcaaacaatatccaatatccttggttttagccccaacaagagaattggctgtacagatctatgaggaagccagaaaagtaaaatattcattttagtgattattgcttttcttatttgtcaaatgatgttgttatagtcactgacatgttctttgcttaaagttttcctaccgatctagagttcgtccttgtgtagtttatggtggtgctgatattggtcagcagattcgggacttagaacgtggatgccacttgttagtagccactccaggacgtctagtggatatgatggaaagaggaaagattggattagacttctgcaagtatgtcagtttttatatatggggtgcatctatttctgtattaaaagttgattacttttgttgtattttactagtactgctttaacttcaataatttaattttctacatagttttgaaaattgcagttaacgtttttgtaaagagtaagtgaaattttatttgaggctctgagcttcattttaacaatcaacatgggtaattcggttgttaccttgagcatttcatctcatgattttgtgtgtgtttgtgtgtgtatgcatttgttgagtatatgtcaaattgtgacactgcaatagttactacttgagttactatattagtgcaattaattacacaactatatatagtaattagtttctcagatctaataatccagtatcaactgaggtttttcgtaataggtacttagtgttggatgaagctgataggatgctggatatgggatttgaacctcagatacgtcgtatagttgaacaagatactatgccaccaaagggcgttcgtcacaccatgatgtttagtgctacttttcctaaggaaatacaggtactgtttgacgtttgaactttcattcagaacatttgtgtttattcattatcttcagataatttatgtattaaaataggtaattgagtatttttctcactgtttcagatgcttgctcgtgactttttggatgaatatatctttttggctgtaggcagagtaggctctacctctgagaacatcacacagaaagtagtttgggtggaagacttagataaacggtcatttctactggacattttaggtgcaacaggtaaattatgaataagaatagtgtcagttacatgtaaagataatctctttacatatcttctggcctttcctgtctttctaaacatggctaaaacaatgcttacattaattggctctgtttgcatgcatccaagatgtattttagcacaaggactagaattaagccagttaataatttagattaagtagtgatgctaattcactgtgagtaaacaaagccttataatttttcagggagtgattcacttactttagtgtttgtggagaccaaaaagggagcagattccctggaggatttcttataccatgaaggatatgcttgtactagtattcatggagaccggtcacagagagatcgagaggaggcccttcaccagtttcgctcaggaaaaagcccaattctagtggctacagctgtatgtatattttattttttaatttatcatgtgtggatagtgctttttttttttaaaagaagttaatttttcaggtggcagcacgaggactagacatttcaaatgtgagacatgttatcaattttgatttgccaagtgatattgaagaatatgtgcatcgtattggccgtacaggacgtgtaggaaacctgggtaaggggtttgttagttcatttttttttaattgtgatgcatacagccaggatttgacacagaatcttaaaaatagaatgtttatttttgaggtaaaatttcatatcagattaatcagccaagtaaaagtttttctttcagtatctttgatttggttatattacaaattacaatgtcgtattttagtttctttcttactatattttatacaggaatataagaatactccactactttatggaaacttcatgtactttttttgaacactttaggccttgccacctcattctttaatgaaaaaaatatgaatattacaaaggatttgttggatcttcttgtagaagctaaacaagaagtgccttcttggttggaaaatatggcttatgaacaccactacaagggtggcagtcgtggacgatctaaaaggtacacactgtttcgagccttcactcttgttattgcttactaggggcaagaagctttcagagttaacttaaaagtgttaaacagttattttcaacaataataaacattttgggcaagggatgattattagagagggtgacaaggaattaagtgttaggtccttactcctgagtcctttagaaacactgttagaacacattgggacattaatgggatggttcccattggaacataatggaattgaactgaaaaatcaaattgggaattgcagggtttaagcagtaattttcagtttaattgaactttgtacttaacactgccatgccatatttttgcttacagtaatagattcagtggaggatttggtgccagagactatcgacaaagtagtggttccagcagttctggctttggtgctagtcgcggaagcagcagccgcagtggtggaggtggttacggcaacagcagaggatttggtggaggtaatgttaatttttcttttaggaagggctttttgtttttcttttttttttttttttgagatggagtcccactctgtcactcaagctggagtgcagtggcctgatctcggctcactggaagtgactctcctgcctcagcctcctaagtaggtgggattacaggtgggtggcaacatgcccagctcatttttttctatttttaatagagatggggtttcaccatgttggccaggctggtctctacctcctgacctcatgatccacacaccttggcctcccgaagtgctgggattacaggcttgagccaccgtgcctggcctaggctctttgtttttcttacgagttctctttttcaaagcataattcattggggagatttgatttctgagggacacaaaatccaactctagatttcttttactggttttatgttaaagtacttgagaaaaaaaaggtattaacgaatgacttaatttctctctaaacatttttcttgataggtggctatggaggcttctacaatagtgatggatatggaggaaattataactcccagggggttgactggtggggcaactgaatctgctttgcagcaaagtcacccttacaaagaagctaatatggaaaccacatgtaacttagccagactatattgtgtagcttcaagaacttgcagtacattaccagctgtgattctcctgataattcaagggagctcaaagtcacaagaagaaaaatgaaaggaaaaaacagcagccctattcagaaattggtttgaagatgtaattgctctagtttggattaaactcttcccctcctgctttagtgccaccccaaactgcatttataattttgtgactgaggatcgtttgtttgttaacgtactgtgactttaactttagacaacttactactttgatgtcctgttggctcagtaatgctcacgataccaattgttttgacaaaataaatttactaaacttggcctaaaatcaaaccttggcacagaggtatgatacaactttaacaggagtcatcaattcatccataaatataaaaagggaaaaaaacttaaggcagtagtctgcattaggactgtttgagttttgcagacttggggttgggagaacatcttaaagcattaaagcatagttttttgtatggccaaccttactaaattaagttctgacttgctcactctatcctggataggcacttgggaacttacactctttaagccattccagtcatgatgaggtggaatgtatcagtataccaattaatatttttgaaagagctcttttaggttaatttaagtacagcaatttctcatgtaatgtttagggagtttattctaacctaggcaaacggcatgctatcacaagaaaggtttaaagctttgataaaatgggggagatttaatcagtttttttaatgcctgctataaaaatttgaaatattagaatggccgaccatggcagtgaccaggcctcactacaggcctggttggattctggtctttaatgcatgctagtgttgatgttttttggtcaagaacggtttaaacaggaaggattgtgcagcaggctttaatttaatgtagattcatactgctctgttaaagctgcattgaaatgttaaaatggcttacacttgcagactttgcaaatcttaagactaacaaatccttgaaatcacacagcttgcaaatacgtactaaactgcacaaggtgtgtgttctatatgtgcagttttagcgtattttagttgcataggtttccatggtatttatagtctcttgtgctaaatttggccaaagatgattgtccaccactaaaaatgcctctcccacttggaattctgtactgattttgtggccagatgcaatgatctttaaaaacaaatcttttcaatggcataagaagttgacaaaaatttcttaaagtgcaatagattttcaagtgtattgtgccttgttctaaaacttttaagtaggtgcacttgacagtattgaggtcatttgttaaggtgctatttcaattagtgtaggtttagactcttgtacatttctcccataactttttacaaagtattttgttgcacattcagagaattttatatatatatgtcttgtgtgggtgtcctcgaccttccaatcttatttcgtctcttggagattgttgaatgcagccagtgaagaagtagattcctaaattttattggggaccatggaatggtagttgagaagaaaactatttgcacacaacagattttagatactttttgctgctagttgtgtaatatttattgaacattttgacaaatatttatttttgtaagcctaaaaatgattctttgaaagtttaaagaaacttgaccaaaagacagtacaaaaaacactggcacttgaatgttgaatgtcaccgtatgtgaaataatatattttggggtagtgtgagcttttaatgttaagtctgttaaacttgagtcaaattaagcagacccggcattggcaatgtagctgtaattttctgacaaaatttaagacaaaattgtcaacttgaaactaaaacatgccaaggttttgatatacttgtcttaagatattaatgaaacacttctgaacactgataggaagtgtccacatccacaaagtttctcttgagttttgttatgtgttttgttgtgtttgattttcagtgattgtctggtatatttacagtcctcaaacatggttatttctgtcagtgacttaacattcggttttatcagccagcagtattcttcagtaaataaagaatggaattgctgaatgtaatcattgaacctcgagtcactgtaaaagttcagtaattgcttattgtattagttttagatgctggcactgcatgtgctctgtttattctgattttactaaaataaaaagttcaaaagtc

SEQ ID NO: 36696 - DNA, 480026 bp, Homo sapiens
atgtggatacctacggagcacgagaaatacggcgtgggtgagtctccgcggggcgaacttttattctgctctggcccgagcgagtgcgcatttctcgtccttgcccccgcgcccctctcgctccgcccggttgaaaatgcctaatcctggcatcgcgcagctggtacggggctttgccgagccagctccaggcagagggctgcgcaccaggctctcgccccgcaccgcctgctcggcgcgccccgcactggttcccgaagcgccgggacagcttgggggagcgcgcggccggcccgctagcttcgggctctgcctgcggagtttggagtggcgactgggcgtgtgtgtgtgtgtgtgtgtgtgtgtcaagttggaagaggaggcgaatggggtttctctccttccttacccttcttccccaaagcgacagggagctgcaacggttcctctgggtggagagggagacaacaacactcgggcagagagaacacccccaaaacagtagggaggcgcaaacccttccctctggctcggatcgacattcccggagtgtggaatgtggcagggtcctggagagagccgctctgacaagctgagccctctctgaccctcctccctctctgcgatcccggatttatggggtgtgtatgttgcggggcgggggcattggtaaatttcaacatctgcgccgctcggttctttggtctttggagaagaacgggtatttcagcagtgtttttacttctggccaccctctcgaccccgggtgagcgcagtgggggcggtgtggcggtacagggctgctgagtgataaatggggagggggatcggaaagcctggttcttgggggcagggagatagcttttaggaaagcataccctgacactggcgttcggagaaaaaggaacaggatagctctcgctgttctgtgtaaaggtgaacaacaaaggacattaatgttgactgatgaatacaggagtctcccttccttttcctcctcccatttcaggcgggttacagttcccgtttttgttgtttgatttcagctgggtcgccccttgacagttactccttttagggttgagactattaagaagccaggctctccgacaaggctgcagccggccaaatgcaattataacctcccagaaggtctaacagaaagcattatggattttactaacactctttatttcctataatgccctgttctgccgactggtgtactttgtgtgtgtgtgtgtgtgtgtgtgtgttttaaaattgaggacaggtctagtgatttaggtgatgtgtagatatctgcttatgttctaaattcattttcctgcaatttaaaacatctggaaagccttcccagggagtcgtagtccgaggggatttttgtttttttttttcccaactttgcctggggataggactttggggtccattgaaaggactgtaggattcaacaaaatcattcccacatttcacgttagcttccattctggattgtgactaattaccaagacaatagtttgacctgaacccacctttgggaaaggtttccagctttccctccttcaaagtgtcagaggagtctttgccagcctctttactggcaaggagtagatgttagtagttgttattttcgttctcctcactcttctcttttttgggaggtagattaacccttgctagggaaaaagatagtccctttgctggactggtgagggacccgagggcatcgcctcctaagcggctttaacactcagtgcaggaagctcagatccatccaggcaaaactgtcctgcttggagtcgatcccagatgttgctttcttccaagtgttaaattatacagattatggatgggatttattttcttgatttcttcatgtgccaggtcacagctggggtgctggtatcgattagttcctctcttgcctttctttacaagcggtgggcagaggcttaaaaaccactctgggatttcctggaatggcaaaccggatattatcagtcaaatgttttgggctgcagcagacacctcggttttgggtggttgtgatttgattgcagagtaggggaggcagaagggtgtgctcacaattgagaaaaagaggttgaatgagatgaaggacgagagcagagagagggtcttttgccccaaattactgctgttgttctcaatatcacatgtgccagaatgttaattaacctttattattaatttttgagcatttggattgtggaatgcttagctgttttttagaatccatctgttaggcgtgtgtgtgtgtgtgtgtgtgtgtgtgtgtgtgtgtgtgtagtgaaatttttgctaggatacttatgtgtggactttatttttcaccatggagggcactgtttatagctgcttatattgcaagttgtttgttttttcttttaaccttggttaatgtttgtgtttttctcatgtagttcttacagatgttaaagaaaagatcttatgggcacagatctttgttaccaagtgtagtggtaatttagtttcttcattctttgaaataaatcagtctttgtaacagaatatgtgacgttttagtataaattatatatttctgcaaaggtactttttatataccctcatttatgtatgagataattatgcttttatatacttatgattaaattttaagcagcatactgtaaacatgggtaaaattagttaaattttatatctgtaattaaatgtatcggagatggaaattctttttcgtaactgatgtataggcaccgtcccatttaatgaatgattaaattcattaaaacaacgaaaagtcagtcataagtgttctgattttaggaaaaggtatagtgatgaagttatagttctgaggaacagggaaccttgtcttttagaaatcatgttaagaggcacagtgataggcaatttcaccttaggagattctagttagctcttgattctgggctagacactgctgccagctgtgtaaccttaggtaaatcacttagcctttctgggtcccagcgtctggggcaagtgttaactaaagccttccctggtactaattttgtagagctcttccaactaactgtgttctttggttagaaaaacatcttcattgtgttgagactgctatgacagagacacttttgttgtgacatatctcacttggtttttaagtaagatcagaggtaagcaaacgctacctggcaagctgccagaactgaggtgctggttcctctctttctcaatttgtttgattctctctggctagtaggagctccatgggcagtgactgaagcattttgtttgttttttaaatgtattttccttgacaaataataataatatattttttaagttttcatttttttttttttaatttagagacagggttttgctctgttgcccaggctggagtgcagtggctattcataggcgccatcatagtgcactatagcctgtagcctcaagctcctggttgatcgcctcaagcaatactcccacctcagcctcctgagtaactgggattactgacatgcaccttctcacccagctgtatatatttatggtgtacagtgtgatattttgatgtacgtttacagttggagtgattaatcaggctattaacaaattacacctcatataattaccatttttgtggtgtaaaaaacatttaaaatccattctagcacttttgaagtatacaatgcattgttatttattgtatctccattctgtggatatcacctcccatctgttagaatggctgtataaaaacaatgaaaggtaacaagtattggtgagagtgcagagaaaagggaacgctgtgcacatgttagtgggaatgtaaattaatacagctgttatgtaaaacagcatggaggaccttcaatgaactaaaaatagaattaccatatgatccaacaattccactgcttggtatatattcacaggaattgaaatcagtatgctgaagaaatatctgctatcccatgttcattgaagcagttctcaaaatgtctgagatatgaaagcaacctaagtgtccatcatcagatgaatgggtaaagagaatgtagtatctatacacaatggaatattatatagtcttgaaaaaggggaaaatcctgtcattttcagtaatgtggagggtattatagtaaatgaagtaagtgtaagtctggcacagaaagataagtactgcatgatcttgcttacatgtgcaatctaaagaagtttacttcataaatatagagattaaagtgatggttgccagagtctgggggaagagggtggttggggaaagtggagatgatgatcaaagtgtacaaagttttggtgagacagggggaacatgctttagtgatctatcgcacagaatggtgactaaagcattcttgatcgcatactcaccaatttcctcagattacctctacctcctgcatgtcctcatctgttagcacacccccccattcctcccccctccccaccccgccttaaagtggtgggaattattcatggagaaagctaagacctttgcagattgtttttgcgttcatttgtccaacaggcttttatgcacagattcacagatgagtcatggcatcttcctgagctgaaggctgcacccctcaaacctagccagatgttttacatgtgtgagcttagttaagcttgacaggagaacacgggctggattgatcggtgcagaaaatccatgaaccttataagaaacaaaactcagaacaagctgatctgaagtcacagtgtcatttaaaaaataaattgtgtggtgcgagtatcactcagtcatcacataaattcctgtattctatttttcttgaaggagtttttgaactcatctgggtaggaatcatgttcctttttaaagccccttctatgttggtggaagaagatgcaccttctcgtattcatacaggatagttaggtgtctttctccttagaaagatgctttaatcatagcgtatgtgtgtgatagagcgtaataaggatgtgtttcctttactcttagttttttgtagtttcttagctaacagtttcttaaagtgttttctattagtggtcctatgatgtatctacatagcatgtaaagctaaataataatgttctgcttggaattgtttgtgacatttagagcctgacacaggattctaaactttaagtgggaatagaagagaaatgatttatacctcccagtaaaataccaccgaagggccatacagacagtgggatagcagcttatgttcttgatctggcctcctatgggaatggtctataaaaatgttcccctcttttggtcattcccctaagtgacagttcttcacaaggcccctgaagccacatagagatgctgctcttcctctatgatcttgtttttttttgtttttttttttttattttagaggctgttatggtagctagtacgagggagattatacaaatttcaagaaatttaggatttcctatctctagctctattcttttccaaaaggagacaacattttctgagttatgtttgatacaatatgtctatgtttctatcacagtgacttcatgctgtgaatatatacatcagaggaacattaaactctaatgaaacccttctaaaaggctgtaaccgtaacacagtaatacaatgttttacttaaaaagtgaaattattttatctgagtctaccctttgaagttgaatggtaatttctatttaagagatgagaaaacagtttcatagagtttaagtgacttactctagattagtagcttttaatcttgtttgactattacccataagaaatatagttaatttcctgacctagtatatatataaatatcccccagtaccaccccacacacatataattaaaacagcacttgcttatactctatgtaatgttctattcttttttgttaaaaaaaatacttgtcactaaattgacttgttaatgggtcctgacccacagtttgaaaaacactgctttaaatgctacatttgtgataccagaaggactgcaactcacatcttactgggtttctgtgaagttcctttcatgacattggcaaggagttgatggtggtggtggttattgtctttgatagtcagatatgtgggtttattttaacaaagaatttaattatccttttttccttcagtctaagtcaaagtctgtcttctgtagtatttcttattaaagatggaacaaatatttaaagccatcacatgcattgcgtaagttttctcttttagtacttgtatgtcttcctaccaggacctttttgacaaggattacataatgaccaatattagactcttctgtatcatgtcctttgacaacactctctggtcactataacagaagagtaaagataatggtttactgaggtactttgccagttgtaggtttaccactcactattcttttgtacctttttttatgttgctgatcattattagaaagacaaggcaacttgtataacttgttttattaaaaaagtgaactatatgcttatttggctagagtatataagacaaaaaaataaggaattaaagttccccaagcctagcttcatttaagcaacttaaacttacttcaggaacaactcttggactctctggcatttaaaaaaaattgtgccaagatgacattgggtaactactaagtaaataaaaatcatcaaaaaagtggaatgcctttggtaacgtaactgcagtaaaactgatatgcagtaccctgaggaatgtatggtaatcatgatccttttggaaacttttatataacttttattggaaactgcaatataaaatagcatttgtggagcacttgctacatgtcaagcacagttctaagagcttgtcttatattgtcatttaatcttcatgatacctcatgaaggaggattcagttatcactcatatttcacaggaaattgagtcatacagggattaagtaacttatttaaggtcatactgtaaatggtggagctaggattggaacctaaattgtcttgcatagaaactgttctcttagccattacgccatgttacctagtatgacagtggttagcagaagtttgaatcagtaatcccaccccttaaagtttatgtgacaaaataaatcaatagcaacaaaacactttatgcacagagttgtcccttgccgtgttgtctgtgaaacaacttacatgaccatgtagtcgttaaatcagttttggttatgagcacgttggagcatcagacaatcatgaaatgaaatattttcataaacaacactatttcaaaaatatattccaggtatctagtgttaaatgacaaaagaagagtaaatatagactatgattagagctacataaaatgtgtagcctatagagaagaggcagtcgatgcacagatgagaacaatttttttgttagaatatatagattatcagtaagttcttttttaaaaaatctgtttggaaatatgagcagtattgaattttaaattacacattgttatttatgaaggaagaggtggcataaaaatgagtaaagagaggcactgcagtaactgaggtgagagataagtccatgaatcaggttagcagtcattgtcatggtgaagtgtggatagatctgagagatatttaggaaatgaaagcaacaggtttggtcatcagatatgaggagttaaagtaaggaaggagtttaggatgttgtcttagctcaggatactataacaaatatagactggatagtttaaacaaaagaaatttgtttctcacagttccgcaggctaggaagtccaagatcaaggtgttggctgagtcagttcctggtgagggccttcttcctggtttgcaggtggacatcttcttgctgtatcttcacgtgggtagggggaaggggtcatggggaggaaaggaagcaagctttctctcatctcttcttataaggtcacgaatcccatcatgaaggctccccctcatggcctaattacctccccaagtcccccatctccaaataccatcacattgaggattacagtttcaatatgtgaattttgggggcatataaacgtgatttatagcagatgtcttcctgtttttggcttgggtgcctggatgaatacaggtgccattcaacaaaagaaccaactttttttttttttttttttttctaggcaggtcaggcttatgtaagatgaagatttttgtttggccaccttgagtttgagatacctgcaatttttgagatacctgcaaaacattcaggtgatgaggtctagtagaaagtgagtctgcaccaaaaaagagaagttctgtgctgaagagtgtgattaaagattatttggcttaggagtgaaggctgaagtaatgagtctaaatgagacttcgctaattgctttgactttgattatgtatagtctgcctgttcattctaagttttaacatgacagaccccaaatttcaaacagcagtcatctcgaggcattttattaatatgggtacaaaggattctcaagtaagaaatattagctgtccatttagagttggtcgtaaactacattttacagtcttttcttgcttccctctagggcgttgcctagctaaggcattagttatttctatgtctgtgacagtcttctcccaaacaaatatttcatgccagattgtgcacgtttgtgagatttcccagtaaggatgttgaaaaacagagtgcacgaataatatttcaatgaacaagatttatacatccctgaaacagcatttaagaacacgcacccatctaaaaatggaaaaatgcttcaatatataaagcaatagatttgtacatacagttttttttttttttggtaaatatataatacctcttaggaaccacaagaattcttaaagttatactatggcactcctgaaaaataagtgacttaaaggaaggaattctagcttatgatggcactaggttcccttcccctcatgtaggctctcctaactaatcagtgaaataacaataaattcacagaaagaggcaaacattaataatactgaaaactaagtctgacagaacgtctgttggcaaaattcacgtgaaatttccctaaggcaggtggaactggttgaagaaaaccaatgttttcttggttttcagtggtacggcgtggtgattatagttaacaataatgtatacttgaaatttgctaagagaatagatttaagtattctcactacaggaaaaaaagggaactgtgtgaggtgctagatagttaattagtttgattgtggtaatcatttcacaatgtatgtgtgtatatttaaggtgatatcaacatcagtttgtacaacttaaatatatacaatttgtattagttaacaatacctcaataaagctggattaaaaagagaaaaaaacctattggtggcttcttttggctttcccttattaaacagagaggcctcaatgactggaaagatgacaggaagacccattgccccttccccactctctgtcaccagcttagagaccaggtcaatacatccaacttggagcacgccatttactgccggaagcatctgtaatccttctcttttcaccccatctttttaattctgttgagagatgaccactctcagaaacgagcaggacaggaaggtgggtaggtgggtggaaaggggtctatagaagatgccacttcaccattgagaagtgtactgtggtcttcataaggacagtgattttgtagttgctttgaaagtattgcaataacaaagcttactggatagtgtagtttttctggcagggtattggtgacagagaaggaggtagggggataagagatgatttcatctgaattgccctaaaaccgtggtacatggtatataataacttacaactgggaacctggcttggagctgtacacatcaactagccttgaacgcagatctgaaagtggaattgaacccatacctttatttttagctcagtccttcgcgttgtagagaggttcgagatccaggttgccttaatcagtgatcacatttgcatctctatggaagcgggaaggcaactaaatctggacaggcatctgtcacttagcaatgaacgaaaacatggctgtttctcaagaaaacgggagagtgaggaagaggggagagcatgacatttacatgggaggcttttggaaactactaacacatgtgtatttgttctcctcccccatttgtgccccctcgtgggagggtggttggtgagaacccttctggatatgaaatttgtaagttttcctggttgaatttgctaacaacttatctcccaagttgtgaaacattttcctaaaccaagaaatttgctgtttattagactatcaattggacattaaccaaaaatttctccctgaagtctttaagcagaaacgtggagatttggttctatgtcttatttttttttttctccaaaatggaataatctcatccgttgttggcaaccagaagtaggcaggtttgggaacgtggggatgcatgtacataaggcaaccgaaaatagccccaaccgagatcctggatgaaacattattcactttgtggggagaggagagaacctgttctccattctcctctggtagccaaagttggttgaggagcttgtaaagctgccttgataacaggctcaggggttagccagggtctcaaagaaatacgaaaacccaaaacatcaacaggcagttctataaagaatgaagagagaagaaacctctgaggttttctccagtagtctggatgaaaaacattaagatctgaggattcctaaaaaattgcacacatagtaaaggtttgccccttctccagtttgtttgctagtttgtttattttttgagatggagtctcattctgttgcccaggctggagtgcagtggcacaattttggctcactacaacctctgcttcccaggttcaggtgattctcctgtctcagcctcccgagtagctgggattataggtgcccaccactgtgcccagcaaagttttgtatttttagtagagatggggtttcaccatgttgaccaggctggtctcgaactcctgacctcaggtgatctgcccaccttggcctcccaaagggatggaattacatgcgtgagccactgcgcccagcctccagtttgtttttttaggagaactatatttgtattaattgtatgtaaaatctccattaatactctcatccatagttatagaaattgattcagaagactaaatatttatgttctttgccccaggttaggcaatatcatgtatacactatgtagaaattattgtaatgagttttaaaatgggaaaatacttatcagaggtgaagaattggcatacacattacctgtaatgttcttacaaccaattattataattgaggagatggcttatttttaatttcatactttctagtaatttcttaaattagcatacatttcttttataatcagaaaatcattatgtaagttcttctataagccaaacattatttcctttgtgaggtttcctttcaggattagaggttggactggtagaagttgagtctggacagcctgaatttagtttgtcatttatgtgcagaaagtactgtgtttcaaaattttaaagtagctttccttgttatatgagtttgactgcctgtgatgtcactgctgtgttcattttccagtatccacagtgaagatgtgttttcatatagctgtggggtctaagcctttgaaagggagctctaattgctcttttaatttgttgaaacagcttcagatgaattcacctaaggtaaaaattctgctctctccatgaaatgtttgcttagaagactgatgttggtgtcactgctcacttttcctttgttctataaactctgtcctgttggactatggacccagggataatttgtgcaggacagacctttcaacatagagagtcaacaatttgaagaggttttatttagcaattacagaataataggaataattgcttatttatgggtgctataaactgaatgtttgtattccttcaaaattcatatgttgaagccctaactcccaatatggatatatatggagtaaggaggttactaagattaaatgaggtcataagggtggggccctgatctgacaggatttgtgtctttataagaagagatcctggagagctcacatgctctcttcataggtagcatgagaaagggccatgtgagggtgcagcaagaaggtggcagtctgcaagccaggaagagagtcctcaccaggaactagtcctgccaaaccttgatttgggacttccatgctttagaacaccgagcctgtggtactttatatggcagcccaagcagaagggttaaagacattttagggattgtaggaagagggatataaaaaaagtagaagcaggatcctcaacctcagtgtaatcaatgtagttagtgttggctctctctgtgatttgagatctgactctgcaggcccacctctggaggcacagacttaattgagctagaattttttttttttttttttaaggcatggtctggctctgtcgctcaggctggaatgcagtggtgtgatcatggctcactgcagccttgatctctcaggctgaagtgatcctcctgcctcagccttctcagtagttgggactataggcatgcaccaccacacctggctatttttattttcattttttgtagaaacagggtctcactattttgctcaggctggtcttgaactcctgggctcaagtgatcctcctgccttagcctctcaaagtgctaggattacaagtataaacgactgcacccatttgagttagattttttgatggtagatatcgactagtaactccaggtatctgtttatttgaataatggcatttttgcaaagttgctcacattgtcttgagttgtcacatcactttgggtgccttcaaagcaaccaaaagaggtagagtcttcagatgcttcatttctttttgctacagttttttataaaaacctagggtgacaggtttaatcatataggttagcatttttaaaaagtagatggaagttttattatatgaaactttggttggggcattgggttaggagtactttgtttttgaaagtcctggctgttgaatatcaggtccctgaagagaatgaagcaatatttggaggaatttcttttctttttctactatccttaagtatgtgtttcctgagagtagctagtaccttcctctaaagatttacttgttgcatttttttttcttagtgacaagcataagggcatattttacgacatgttggtagaaaaacttctgttggatgattatttatggtatatgcctatgatgtataaggcaatatgctagcttgataagcatccaaagagatatagaactggatgactggacaagtgaaggagctagaaatgtttcatagttttatctcatttactttgaacaacatttcttcaagatagatgttaccctgattttgtttttaaatacacagtaagggagtacataaagtatcacagataaatcagtgtgaaagttaagacagatatttccccttcaagctttaaaatgaagataaggacttgggatggtgatgatattattcacttgtgcacctgaagaaacagccctgaggaggaaagagtgtctcatatcctggaagactcagaacttctacaaaagaatagaagtttcatattgagatacttcccataggagtgagtcaccggctgctaagatcgcccaagataaacagctgagtggaatcacattttaaatatctggaaaaccttcttcctcttccttttgggtaatttccacctcctccccctcccctcccccttgtcccctcttattcctgtcacctgaccgatgttaagtatcttggaaaatggtttatctttttttgtgtgtgattccttctaagactgggcagaggaagaaagatggatttaggatcgattcttctccttcaagagattttgggaaggataaatagaaactatagtatataattatatataaatgcacactatatatatacacacacacaagcacaaacactgtatatatactatatttaaattatactatgtttaagttatatactatataatatataatatttaagtatacttatatataattataatatatattatataagtatatatagtatgtaatgttatatagtatataatttaaacatatccatatttaaattacagaaaaataagagtgggcaggcagaggaaaacccagctttaggatgaatgcttaccaagggctgggcctgtgtgattggccctgtgcacatactccagccttacagcagacctagagagggccagtaatttgttgcaggggacccacctgtgaagggctgagattcaggcactcatctgtcccagcctgaagcatgtggtcccttcatggtatcacacctttgtacatacgacttagggccagaatctggaggcacagccccaggctttggggttctatgggcagtgctgaagaaattgctcactatactttattttttaaataagatactagtgttaataccagtattatgtgaaataagtccccacgttgtctttttactctagcattggtctgtggtagtgatggtcagtcagtatgctgactgctggtgggtgggggtgtggggcacagtggtgacagaggagccactaggtgcctcaggagatggggatgggtactagaggggtggggagaaatagggaaatgggagccaaggaccaaacagtgctgagtgacgtgaagggaataaatgtgtgcgtctttgagtgaggatggaccagaagcagggaggaaccctggagtgaaaataaaattcatggctggcgtgatggctcacacttgtcccagctacttgggaggcggaggcaggagggttgcttgagccctggagtttgaggctgcagtgagctgtgatcccacctgtgactagctactgcactctagcctgggcaacataatgaggccctgcctcaaacaaataaactaaacaaaacaagaaacctgcagtaacagggatgcctagaaggtagggggctagaaaaaagggaggattcccattcattggaggagcaagagaaaccctgagctctgaggcttgtggttctgatactggaagcccttgctctgctgggacctggggcttcacattctgcttcatctatgctcagagaagccctgtcctacctgtccaaggagttggtatgctccttggtgtgcttaataggtacctctttggtctgaattactgctgtagtcttctaatctttctccttttctgcattctcctttctctagtacatgctttggacttaagccacaagtgacctttttcataaagcaaatttgttgatgtagttcacttgtaaaaaacaaaatctttaattttttttttttgtttttgcagtcaggatagagttcaaagtcattttatggtacacaagttccctcctaaatcggcccctgtctgcaatctcatcccgtgctgggcaattctttctctcatacgctgtcctccatcctatggaaccactggctcctcagagatgccaggctacttgaggactgttgcctctgcaactgctgaaatgcttcctgggctgaccatccacctcctgcttctttacctggaaaacctaactgcaatgtctgttctttgagagtgtctgtctctttctactcctcctggtagagtactgctctacctctgttcctgctctgtgccctgcagctgcctctctcagggcctttgctgctgctgttttgaaactgtccgactttgctacagtgtagggaagcccttgaggccagagatgctgtgtggttcagctttgatttctctagagggtaacacagagctaacctgtagtaagttcagtaagtgttgaatcaatgaatgaatgggttccttggatgagggagaaagcccaaagctcagcgtgttgtagttatttgttacatttatatacaaggttgtccaggatgtataatccaggctttgttgagtggatgagggtatcctgactggggcctggcaaccccccgacatccacagaggaaaacaagtgtttgtgagagaagtgatagaatttgtcaaaagtatatgaaattagttacataaaatctgaaacatacattgtggttctgtttgtcctgtgactatgtaaaattgccattgaaaaaacccagaaagccgggtgtggtgactcatgcccgtaatcccagcactttgagaggctgaagcgggtggattgcttgcgcccaggagtttgagaccagtctgggcaatatagagaccctatctcaaaaaaaaaaaaaaaaaaaaacaaaacccagacagagaataaaaacaagaaggctaggctgctatgtcatgaagaaacctaccaccaaccgctgaatttcagtgaagataggactgtattatttttattgtatcctctgctcttagtataacatttgctacataataaattgtaacatatagtgaaaatgtacatgttatttgagtcagtgtgtgtaggtataaatttttaatagggtatttacacctgaagtctttacaacaccatgtgactgctagactccgtttaaatgccagaagatactcagatacatctgcttgtcatatcctctggccaccatgtaatggtcagttgtagaaaatcttcggtcagtactggatcttaggcatttttactgcttcctgcaagtttggggtgcttttccaaccttttagtgattgcattttgtaacaaaaatttcccaccacagttttttttttttccagaataagagtatcttgagatagcaaggcaagctgttatcaaaagacagaaacaaaactcctaccaaatatgcaattagccattggtgagaaacagcattttcactccacagcataaccaacacaaaatatagaaatatatggcatgctgaagaaatagactacaattgttatttatagcttcccattccaaatttttgttttcattagaataggcttattcactagaacattgtgttggcagtgatctgtcacacacttgtatggtatgctctgcatatggtggctggattttgggatgtctcagctgggaagaaggataccctctttctcatttgcagtggtgtgacatgggctaccaggaaccctcgtcattgttcttactgacttgatactgagaaaatataaattcagaaagataaaataagtttagtaggataaaatgctgcttttatatgatgagggtgtatatgagcatttatttgaacaacaacaacaccctttactgtgaaaaccaaggtttgaaaaccactgacttaaaatgaggctggagtattgcatgtaaattctgttacaacaaggtttgaagttactacctagattttcctaatgagctgacatgcttctactttaagtggtggtagggaaatcttctgggttggggggtatgaattgtcatggaattattgcgtgttccagacacgtatgccatgcagcacagtttgcaccactgatgtaataaagctcttcatatctgaaaaacatttgtttgatatcatcattctaaagtacctagttgaaagggttaactccagtttatcttatgaaagaggccaggattctaattttggttctttcacaactgtatgaactcaggcaaagcatttatcttcttagggcctcagctgtgaaaggatagtttgatgaggtgatttccaagttaccttgaaattatagaattcattgtaagttcgagagtctcttgggcactctgactagatgtcattggaactgtctgaagtattctgtatctgaaatgttttggtttgtgttcaagtaactgaaggtgaagtgtatgagatatttactgtttgtgctggtctcttctaccagacagtatactatgtttgcagcattatgtgttatcttgaagcccttgggcaattccctatagtacttggttctgttaattttggtaagtatttgataaatattgtataaaaccactctacttccctaagtctttctgtccttaacagggaattgccagagctattaagttatttaaataaattaactaaaccctatattcaatttttgagtcacatggtaccaattcaaagaaaacattggttaaaggggtcatatttggaaataacttattttttctgaaagtcttcttttctttttcagttgtgaaaaaaagggatgaaaatataatattgcacttagctgtcaaatggaaaataatcattttagatctcattctacatccaaattatagcactcactgaccatactgtgcaaaattggtcagattccatcgactggttgcatttactccactaattggaaaaaattatgactattaatcattgtgacacaaggcagaatgtcatcatggcatgacattcttattttccacctgagaagtggtggcttctgagcgcaaaagcacactcttctctcctactttcgcttgccatttcttttttgggtttggttatagttctctgtagtaaatcagacaaagacttgtaaaaagtggagcatggagaggcagagcaagaaagtgttccttcatttttattctccagaaacagctgtgaaaatgaaaatgggatagggagagaagaaaaacatcataagagaaggaaatgtggctgttgcacagacaaagacatttgaaattattcgcatgtagacaattgatggagataatgtctttttgggcataaggacttcaaagtgactggactctgaagttttattttttttccctcctagattaactcagaagagaaatgttttcagcaatttgccaggatttcctatgaggataataattttctagttatagaagtaattatggttgtaacacgtgagttattttgctattgagttttgtaatttcttagtgttttggtatacttaaaatttatttgggcgattgcatttcttgaggattgaaaataaaaaggtaactgataaatgctagtctatcatgcttggcttttgaaagtatttctggtttttatttttctctctaggtatcagtattaatggcttaaaaaaaaagagaaacaaaagtgtttaattagtggtttattcttcctccctggacaatctatttttaatagccatggcatatttgctgggtgacttttgtttgtctaataaataagcaacttcttttatatgtccctgaaattttgttaccctccaaatagagttcttatagtactctaaaggagaactgacatgttttgttttaatgtttccccataggaaaattatgtggcatacctggtgaatattaggtccaaatgcagtggtttctctgtgggtgtcttagtaaggacaatgagaagattctttaatttccatttctgcctcagtactaatgttaatttgatttcaaattgttaatgctaccatattttgtgatgatacagactactataagcagtaccttgttttataataatagtaaacctttactgaactcttactaggtgtcaggccctatgccaaggtcatacatgcatcatttcattccgtgctcatgacaactacatgatgtgagtactattcttatccacctttttactagtgagaaatttaggaacagaaatgttctagaacctgtccaggatcacaaggaaattgagttgtggaactctgatttggtttcagattctgaagcctggtttcttagtcagtatgttgtagtgtcttcccagtcatgtcttcattactctttgttttgtttggggtggtggtatgggaataaggggtgtctgttaccataaagctaagcaactgacaaaattcatagtaaatattgaagcacaggttccctgaaaccaagcaaccccactgggatgcaggggtgcaaggtggttgttggtgcagagccagggctaaagtttgggcagcctgtgatcttgaaacctctgctcggtctgcttccaatggagatcccccgaggatgtcccagtgaagttgccccctggcctagcccagcactcttgcagaactcatcagaaggtagtgtctgagactcagccaaggatggtgtgcttccagaaggcaggggcttcagccgtcagccctaagtgtgcagctgtggtggtccttccaccaaagtgactcctaccctcagctgcagccagtgatggcaggcaccttcccacctggcagtagttgccagctgatctataaaagactggattccgcttaggaaaggcagtttaagactgtgcattcattggtgtgggaaggagcaggtagtgagaatggaacacgttaagtagagacctgcctgtcctttagagatggatctgtggcagtacaagggagagctaattataacaccattgtgtcactcaaatgttgtggtcagactattgaaggtgtcttttatttcaagtgaactttttcttttctttttttttttttaactgagggtgacccatgttctgacttccttttgaagtcatcaggcctcataaacagaatcagacttgaatgcttaagtcatccctttcctgtttgtagaatactaccctattccactttttcctgtttggatgctttcttacttgtcctgtttgatccttttaactcttataaggtagacagagagagttgttcctgtattcatgatgagacagttaagacacagcaaattaagtgaccagtgctatttgtttgaagaacttagtttattcttctgtgtacttattttccacatctgcagaactgtgaccatcctccacataatttatagtccataccaagtagtggatcaaacgagctcctgccaggcagtcaccagcttctgatgagaacagcagcatgcagcctgcacttcaatgctgcactcccaagaccagctgtggcccccacactgccagtgctgtgtgtaacgggtgctctgtagttcagtattattgatttcctatagattctttattttttaaatagcccatgtcagtttctttcttttaagtgtgggaagggtcctaagctttagtttcctgttctgtaaagagggatgatactctttgccttgtttatctaccatgcaattattatgatcaagtgagattatttttgtgaagccatgtaaactataaagtgctttccaagcatgaggaattactgtggatgatcttgagtttcacatggaggtcaggagcagttaaaattgttggttgtgataccatccataatctcttctctcaacaccctctgcaagctctaagggggggggattgtaggggtcacacaggtgttattgctagaaaatgaaagagcagaaaggcttcacaagcccactgagaaggacttagctcacacttctgggaaccagtgtccaaggcgtgtgaccataggaacagagactctctgtcaggaaggagtcaccagctgactccaagggccggggtttttatgaggagagtcagtgccatcctgcttggaagcagtcaaaaggaggttagtagcttgtaccttttgctccaaaaggaaaaaaaaagaaaaatgaatgacaagttgcagaatatgcactattaaacctcagagaagttagagttagccaaaggactaaactgtaatgcccctgggtgaggccggggtggagactacagctctgcactgtgaagaagttgcccaaagcagcatctgcaagaggtgcctgcagatcatacagaggggtgcgttagggaaaacctgaccctgcccagttatattagcaagtggtgttcacctgtgtggctgtgtgtgtgcagttttcactgatgtatgagttcctcctttgtgccaggcattgtggtaggtactaggtctacgttggagtgtggaaggttttcagatctcacaaagcttagaaactcatgcatctgttaaatacaggtctgtgcattaggcacgtgcaggggctgtgggcacagagatgaagagtgaattccaaagaactcaaacctgtgtggagaagtcagagaaagggtcactgataatggtcctaggagaggcaaggtggtgtgataaaagtctgcacagaggaaggggccctcagacctgggcaggtgcgtgcatcctggagaagatgatacctgaattgagttgagaaggtactgtaggaattaactaggtgaaagaaataggagagggtattcctggataaagaaacagcaaaagcaaaggcaaggaagcctaaaggcttgcaggagtggctgggaaaccgcacatggattactcccataaatgttaccactatcgaaatactgctacctgttgctgacacatcgcctcactccaagttaaatcagtggttctcaatctgattgaactacccaaccctcacccccactcccagggtttggaaatgtgttgcttttgataaatgagtgattggacagccctcctggcatttgttggacaagactaggtatgctacatgaccatcagaaggaagaactgccctaccccacatgcccatgccatcctttttgagaaacccaggtttaaatcctggcagacataatcccgtgaggtgacaagacagtgagtgtgtttactgttttcagctaaggcatgaaagccaaggtcacatagttttcaggccatcagtaaagcctggaatgcttttctcatcaataccttttgtttgaaatttcttttgccctttcagtttccatgttttattgatgtcctgctttataaaattctagataatgccttttgttgatagtatctttgttaagagctcacagttctccccctcctattcccaaatggaggaccttccattaagaggtagttatggcctttctctgccctttctctccttcccttttctactcaattggcaattggttggtaaatttggaagatgagactgagctggccttgctcattcccttctttctatggacatcttccgtctgtagagaggctgccttctgatttgtaaggttagtggcaatgtgggaggcctacatgtttatgacctaaacttagtctaggggagtgtagctgggccctgtgtacagtgatgctgtttgtgtcctgcacgaagggagcaagtggcagctggaagccagccagaattccactgggcccagccagctgtgctggggcccaggcagttccttttgcacatttgaacaagtgcattgtccagtcctgtggccaccctgttgcacagctccagaggccaccatcgtgttctcattgtattctgtgtctcgtggtttaggtcttgatagtgaggcacatgcctgcacacctagccgtgtgctttcatgcagagtttattggccataaagctgacttcagtttgacctgcttcttctgtctgtccagtgagtgaaagggatggtatttattaatttttctggacctatagtttccttagtgacaagaggctttgctcctttgtaatctcttaattgtgtttctctctcacacacacaattaatacatgcttgtgattaaaagttcacacagtatagaaaaatgtagcatatgaaactgaggtcttcctttgcctccttctcccactcttcttcctgaaatcgatcattagccaatgcaatgctaacacccctctcagatcctttcctattccgttggtgtgtataattttaaaaatgtgatcacatcatttatgttctgtagcttgcttttttaaaaaatattacatcatggagagatcattccatataagtacattataaatctagctgtcttttaaaaattaatgtatttcaaaattgatttgaaaaattgtatatgaaaacaataataactataagactgaaatttgactccttctgcatgccgggcactattctaagtcctttacaggtgtcacaacaactctatggggtaggcagtgttaatagcatttttcagctcaagaaactgaggaataaggatcaggtaacttgtctaagttcatcctggacaagtatgtaaaactagtatctgaaggcaggtggtgtgactctagaatgcacagttttaaatgttatacttgacagcatttgctatcaaattcaaaaggtaaaaaagattagtgatatggtgattgttgaggttcctggccctgtgccccagtgcctggagttctcaccctagaggcagatccctttgggtacaggtgcccaggctgtcctgcggatttaatagcatagaatcctcaggaggttgtatatgtccactgaaaacgattttcctttattctgtgagatgcaagtgcacgtaccgttcaatccatttcaatcctgtgatcctgcttcctgttactctttcttgttaagagttgcatactattccacagtgggaacgtatcatactttatttaaatagttcctcttctggttttcagtgtcaagcttttttttttttttttttttgagacagtgtcttactctgttgctcaggctggagtgcagtggcacgattttggctcactgcagtctggaactcctgggctcaagcagtcctcctgcctcagcctacaggcacaaaccactatccctggctaatttttaaatttttttgtagagatggagtctcagtatgtttcccagtctggtcccgaactgtgctggcctcaagccatcctcctgccttagcctcccaaagtgctgggattataggtgtgagcctctggacccagccccagtatcatgctattccaaacaatgctacctcaaaatattttgcacttatatgtaaatatatacaatcatataattacacgtgggttcatatctctgtagaatatggacttcagtgtggaatttctgggtcaaatgggatgcatactaaatatttttctagatcatagcaaattatcttctcaaaaggctgtatcattttatattcccaccaacatacttgtttactctttcttgccaacattggatattatctctaatattttacaagtctgtaaagtgatgttagtataccaaatgagcaaaattaacaacatttgaagttatttttagcttatccaatcttgctcatactcacttgctcaagaagaaaagttatgtgcaagccattctgcaactactacctccccttttaattaagaaatgtcttccaaacttttgccttaaaaatgcaactatcatgagccatttttaccaacttcaggaaaatgactgccgtgtcaccaacatggggatgcttcctagaggggcaggcagttatgaattgggagtctacttacagccctttaatacctaaagcagcctgctttgccaacccctgcccctaaggtggtggagcagtgcacagccacaaagtgctgttggcactgtggggaccccagctactcaaaagaaggatgccatcatcgggacagtgcctcattcagacatatatatatctacaggcagggagctcatgctgtcgtcatggcacggacacagctccttaagtgactctcaggctgtgcttttatcatgggcacccttctctgaggtgattttctaaggagaagccagtgcctttgagtccatgcccacagattccatttctgagtactttggctgcagaggaccaactcacacttacttccaaacttgggaaaggagaattgcagcctgatctgcctggcagatggcaggttgtgctgtgtggacctgtcggggtaaaagttgtctgcagaagtgaagaggttatttttacatgtaaaggagcactgtgcttctgtttttctgaagtctttggtcctctgatgcttgttgggctctttgggagagcaaggttctccagagtcgttttgcatctgccgggggtttctgggttgaggggggctacctccttccttgtctggttctgcctctgccctaccatatgcttagtgaatgccatttctcttttatggtctgttttctgaatgaagaactatgcctacatggtactgacagctaaaccgtagttgactttgaagctattaatttttagtttttactttggaattttgttttccatttatgttctactttagacttttggacttagtatccggcagaataagaaactgatgctgtgtgtgcacccacccccactccaccccgttttaaaactagattgacaacttgtcagtttattaacaacatgtcagaagttggcataatatgaaaagtcaaaatggaaaagtgcttatgctaaagtgatacgagccccagttaaatattcatcatacctttgaggtgtgtgtttcactgtgtatttctgattttgaggggttttaaatctatactaatctcctaaatcttgacagcataactaccatttttatttccatatttctaattaagctgggtttttgtagggtgtgaaaggaagggttttgaggtgaccttatgtgtcagaaaaatcacatagtgattctagaaaaacttccttttgaagcagctgtgttctccttgaagggattctttgagcgccaggcatgtttaattcacttctgggtttttgtgtgcatgtagctgggttaaaaaaaaaaaacaaaaaaacaacaccttttgtgctgggtgctttgctgaaactcctgtaacaaataatgatatgttaacattgtatttttctgtaaggcaatgctactagagagttcacttagaagattttttcctgtggtcacttttttttttttaaggtacaggccctgtttcccaggctggagtgcagtgacatgatcaccactcactgcagcctcgacatcccaggcacaagtgatcctcccacctcagttcccagagtagctgggattacaggcatatgccaccacaccgggaaaatttttattttttgtagagacaggggtctccctatgttgcccaggctggtcccgagctcctggtctcaagagatcctcctgcctcagccttctaaagtgctgagattataggtgtgagccaaatgcgttcagcctccatttctatttctgtgaaataaataagcatctcaagtaactttttgagttcatcacaacttttgaggaattggctaagctcaaacacagttttttaaaatgttcattctgtgtcccatcataggttcattttatatctgaagttgctgtctttcaggaaacctttgtaatagatactgtcctgatttctcatggcttggttagcctatgaggatacgtacaaaaccttctgatttggcagcctccatcatgtgcacatttattctgtatctgagctcatcggtagttccgaatagaggatgaacgagaggaatgaagggaaatatgatgaatgaggcttagaaaaaatatttttattttttggatcccttttttaaaaagtgtgcaaaaccagtcatttccatgtgactagctgctatcagaaaccaaaaaatgtgcttgtcgtcacagttgaggcagcttctctgtcagattggaactcaggttatgttggtgtctgactggttttgaggaataatgtgaggaaaccatgtattttcagttcagctcttttcctagcactgttatttcatggtgggtatttcctggctaggttgtagggatgggaagccgagacaaaggtgtagtctttgacaaagcaagtctttggagcaggggctgttaccgatgatttttttggtctctcatagctccccaccctcttttagctccccactcctctttttttctccttacctctcttatggcaaaagtttattcatttaaagtacaaaatgacttgagaccattaaaaattgaataagaagaaaggcatactgtaagcctcacttcagcacttcagaagtacaaaatgagtgatacagccaaagtccttaaatcttgaagcaagaacacgacaactctcttagtgcatgcactgctgtcacaggacattgcatttcacctgtaactgtgatgaaggaaaatgagaccaggagcaaccttcagaaaggtctcagggaatgagagagtgatactgatgttagtaagcattttgggattcttccacatctggatgctgggtacttaatacaatttgtttattggattgattatggtcccacagccatggtactgtcatcaagaaagtcccaggggataggtataggtgtgtagcctgtgctaggcagatgagagctcgtggccagtcatgcccatgggatttcccatggtgtccatagagcataaagaagaacagcctttctgcaaagcaggtgtcctttcctttaagcaaacctaatgctgagttgataaagatacagatttcctgtaaaaggtgactctttttttttaccttataaaagggcttatttcaaatttctgttaaaaaaaaatcagtagtctcctatagcatttgacatatcaactatgaatttacagaaattcgtagttgtgcaaaaccagtcatttccatgtgattagctatcagaaaccaaaaaatgtgcttatcacagttgaggcagtttctctgtcggattggaactcaggctatgttggtgtgtgactggttttgaggaatgatgtgaggaaaccatgtattttcagttcagctcttttcctagcactgttatttcatggtgggttgcaaatttacattggtttgcaaatccataaagatattttaacaacagctaccattaaacgaacagttctgtttgccaggtatcaggctaagtgcttttaaatgcattattagcttcttcactcatcacaaaagccttggtaaataggtgctatcattatcatctatgtatttcggaagagctatctaagatttagaaaggttacttgcctaagatcacacaggtatagtaaggggtgacagcagactttgagcccagggctgtctgattcctgcaatttaactcttaacaaatacctcagcctaggctgctgtctgtaacagtagggacaggcaccactctgcgaggatcatatagatttctaatgtctctccccaactacttgttctagctatgattttgtgctctggagcttgatttttggaagtgatgactagaattagaagttggttggcaggagaattattttcttccttccctcattctacctcattatccttgtaacctagggaacttatgtcactaaaggacaccatggccaagatcttgaaaatggtaggtaaggcttctcacatgtcgatgatcaacatctgtgcaatgatgtcattaaaaacaagcacaaacaacaccaccaccaaacttgtttttatattatgtgcaatttcagttttatattatgtgcaatttcaacgcggaacacagtactttcagagcaaatgcagttggttgaaagaaacaggcactcaagagacagcttactgtaatgagtcagtttccatattgttactgagtaggacttggtgttagaagactctggggagtaaaaattaatgtaattaaaatatagtaattggcagatttgtgcaaactataggtttttctgttttgatcctgaagaagccaaataagggcattgtgcttgtagtttttttccaatacatttttctgtgccaagaaatgggccactaaaaattttatattgttattaataatgagaggtcacacagacaacagctgcattacagtagagggaagaacaaagctcccagttttatgttgtctttggaatcagaaccaaatagagcattgtgaagtcaagtggagacctgtagacgggttcatggacccagaggctttctaatgggtacacattgggtgagggtggtgataagagatatgggtggatttaaggaattctgtttcccgatctcaactttcatatgttctttttctttagtgcctgtactctcctttcccaatagatcttctttcactcagtaagagaaaggtcagtcttccacacacccctgttcttagtagggtgctctttggattgtggggtagaaaaacacctgctctccaaacaaaggaatgattgaaataatggtgttggttgatgaaaattaatgactctgatgacaggataacaaatacttttgcaattcaggtggcatccaattctttattttccacaaaattgagaaaggacttaattgacttgtcagttgatcattaaaaataatgttgatgatagatcaccctgagatttttttggcatatgtcccagaatgaattcaaactatagaggaaagttattatagcacacttaaatttcaatgtagttatttgtgtgaataagttttgttagcttttagattaaaaaggggatgggggcagataggaataaaattgatgcacattttagcagtattcatctgcaaatgcataacttaattggaaaaagaatctcatatgtctcattaagagataaattttaaaaacatttttattcttataatcatttataaagatgtaatacttatgtgtttatcaattgtatacaacaaataacaaatataaatcaatccagctgaaaaaaaatatgagagttttatggccacaaaaccttctaaaccttcacatttatatacatatgtcaatttctagtaagttaggcttatatattatgtatacttaatttagagatatatgataggatgattaatacaactttcaaacataaaaacattttaccttaagataaaattttgtgaggatagtgaaatggaaatacaaaggcagggcaaataagggaaaaatttctattacacaagagctttttcaggttttttaaaacatgtataatggtagagagcaaacagcttggtgttttgattcagtggatacattttagagactcatgttatagtttaattttcaaatgtcattataggacactttggaaatcctttttcactgtttaaacttcagatgaagaaatgattaagatgtcaagttaaaaatgttccaggggacggggctgggcgcggtgactcacacctgtaatcccagcactttgggaggccgaggcgggcagatcacgaggtcaggagatcaagaccatcctggctaacacggtgaaaccctgtctctattaaaaatacaaaaaattagccaggtttcagtgagccaagatcgcgccactgcactccagcctgggcaacagagtgagactctgtctcaaaaaaaaaaaaaaaaaaagttccaggggaaacacagtggctataattcttttagtaagcatgcaaaaacaaaacaaaacaaaacaaaaaaacaaaccaaaaaacccactttttaaaacattgagataaaacatcatctagtgaaaatgagagaccagtcatctgggagtagaatatggacgtgagacagagccttaaaattggatggtattacaggtttctggggccatttggggtcataatgaaggggagggttttgggaagaacatcttgcattatcctaaggtggtgattagaacttttaattaaaatagtaacaataatacttactgttattatttaaaatcctgccttttttccctgtaatcatgatttctttcatatacatatatggtgatgtgtatatgtggagtgtgtttccatgtgtgtgtttgtgtatgtgcatgtgtagttacgatgtgatgataaagagaaggtttttggtccttttactagataaaggcagaaaatcagtatgcttgtgattttgtgcaagatgactccacataccttttcgtgatagaatgtcagcagcttacccttgaattaagtgatgagttggatgagcttctgaatgaattaaagaccttgagagaaaaaagctcaagctagaaaaggcagagtgtgttttgaggattgtggcagttttttccagattgtgtgtgtgagagagaatgatttctgcttttggatgataggagctacctcaggttgtgtactaacgtctgatgggataccacagactctcacagccgaccaaagagttgaaggtccgcagctggtccaggtggaagtcagcagatggaatggttcatacctggaataggccaggacagaacaggacgcaggtggagactcaggagggaattggtgcagaggtggggaggtggggaggtggggaggtggggaaaggcaatgaggaaggaaaaccctgcatgggaaggctgaagtggtcatctctgagccctccttgtgggtcacctgcccagggctggtctgctggtccaggtcctgtcagtgccttgctgttgtcaggccgcacaggtattctgcttgctctcttatgtattttggtcactgcattgttggccatcatgctgcttaggtagcctttcttgctggctattttccacgtggaattgccaatgaaaatgtttggctgtggggttttgctgggctagcacctgcccttgggcatttccaagtttttcctcagctggcatagctgtgactacggcctcctgcaggtcttcatgctgttttcagtgtgtgtactcgtctttgggagcagatgattcctaaatattacccaactaatacctacttggaaagccacattagatcccaatggaacccttttgaactagctgctgaccgcccataaaagagcagcacaggcctcaaagccacttctgtttggctctgttattaatctctttaggaaatgattccttagggaaccagggtaagaaggcctgctgcctgtaaaacagctgcctcgccactaagtctttagaaagagacaatggaaaataatttagtacaacaagggctattgtccggaagtgacatttccctccttcccttgagttgaaacagttgtgttgaaacatggaaaagtaattataaattggggaggggttggggagtcatcccttttgctatttctttctcacacaatgcacgagggaaatcatgctttttagctgttttgttttctccctggtgtttggataaaatgtctgtaaaatctgacgctaaagtaataaggcaaatgtatagaatgtcagagggattacactggattctgggtatcattgggtggcttttgagctgttgacatgccagatgtctttggtaccagtgaaattataaatgtctgtgtgaacagactggtagtcatgaagggctcacacgacgtgattaagcttatttctggtttgttcagatctgagactgtatcctgtgggttctgctctagttacggggtctttcattacatgaggctgtcatttttacctatgcatctatatagcagaaaataagatttaacactttttggttgaaaatttggaaataacaaaaagtttaaagaaaaaatatcaaaatgtatctataacttcactgccagaaataatctactgttcttcccggctttacattttttacttatgtatttgatatatccttacagtaacaggattatataatatttaccatttggcattatggtttttccatataatgacatactgttcatgaatttatttctattgcagaagataaatacttgaagatgtgaattactgtaattttgattaattagtgttgtctggttctggagggaactattgcccgatttttacctctgtttttaatactggcagtgaatatctaaaagtcacttgttctcttgatacaaaggaagtggaaattacctggcctgtatttgacgtcagatattttctaatagttcacttcccactagaagtagagaacaagtcttctgagagatatggcccaaattcctttctcatagggaggtaaaataggaccctaaaagagaggctggtggccaccaagaagagataaagcttctggctttcttattcaagaagtattcttatttctgcaggcattccctatggccaaataattgttagccttctaggtagaggatatttccccaaattgctattaagaatcccaaaatgcacagcacaggaaacgtactggaatatttgctttaaatttcatcggggcattgttatggactgaattgtctcttcacccctaattcatataaatcctaaccaagcacttcggaatgtgactaacaggccctttaaataggtggttaagttaaaatgagggctttagggtgggccctaatctattctgactgggtctgtataagaagaggaaattggacacacaaggagacaccagggatgcgtgtgcacagagggaggaccatgtgaggacacagcaagaggacagccatctgcaagccaaggcaagaagcctcagaggaaaccagccctgccagcaccttgatcttggacttccagcctccagaactgtgagaaaataaatttcagttgcataagccacccagtctggtattttgttatggcagccctagcaaactaataaggcagctagaagaattgtttgaaatatttgggaatatactttccaactataattactgatgtggagaaaatgtcaatgtggatatgaagaaaacaccttagcaaacagagggatgcaatcggggtgcagggtacccagatttgtgcaggtttttggtaaagctttagttcccacatcatgtggttggttcaccatgttccattacattattatgctgtatagagtacacctatgtaacattatgtgatttttccatggatcaaatattatattaaagataaagtgaacttcaaatccctgacaagtagaaaaaaaaagataaaggaaaaaagttaaatataaaaaaagaaaaaacagtttttttacatggattatatttaatgaaaaaaaatatgacatggtcagaattctcattacaattcatataaatattgcttttcctttcaatagccagtctattctgtgaagcagattgtaattgtattcattagttatttctttatggaaaataggttaattatttttccatttaaaaggaaaattaatatcagaagtgagccattcagccttggcaatgagatatgaaaatgtggaagcttaagctattgaagcgtgatgctgaaatatttaagctttgaagaagggttgggactgtttgtgaaagtttttctaacatttagaattggaaatacttattgtgtcctggaaaataagttgtggatgtttggtcgaagaagtctggttcatgttcacgttagtttagccttccttttctgtgtgtgtgtgttgtgatttgagagatttttcacattgctggattatatttgaaatgtatggcaatggttataaggtctgactgggatcatcgcactaaaagtgcaattttttttatcatatatggtactacttctgagtgtatactattctctgaggcaatagctaacaatatttctgtgtacagtatctcagtatcttgataattgttcataggcagtcattttggctttaaaatttcttagattacttaagtactatgtcaagttttgtggatatgtgcaactcttcttagcatcctaattaagaatatttttaaagaaaatttttataaaatatgttaaataatcctttccttcttagagtattctgaatatagcttgaccatttgtgtaactaatgaaggtcatcattatgaatgtaattcttgttctgcttgtaacgatgtctttggagctattgagataagtatggtctgctcctatagtaagttaactctaaatatatatgctttttctggtttttttttaagacggggtattattctgtcacccagactggagtgtagtggcatgatcatagctcactgcagcctcaccctcctgatctcaagtgatccttccacctcagcctcctgagtagctgggattataggcatgtgccaccatgcctggctaatttttttttatttttaaattttttgtagagatgaggtcttaccatattgcccaggctgattttgaactcctgggctcaagcaatccttgtgtcttagcctcccaaagcgctgggattaccggtggtcactgtgcccgaccacatatgctctttcaatatttttcttgccttttatttttttctctcttctcttttgtcataagacgatcacttataattttgtttgctgctttttgcagcctctttcctctttcaaattttgcttttactctgcttgtgagaatggagataacaattgaacttacaggggttgtgtaaaaatctggaacctgtgagacccaagaaattctgttcaggaaaaagtgttggtggagtttgtagtaactagttgaagttgcacaactgttgagatgactataacttctcttgagtgcctattgtaggcaagctataccccagtggcagcactgctcagctccctgaatttggactggtgaagcacaaaggtgatttgtcgccctcctcccttatcagccatgacatttagattttgcagttgagaaagaaaaatttctgcttctctcagtcttggtttgtatgctggaatcgaggccagaattctcactaaaggctacacgagaaaggtggagtggaacaagaaggccttggatggtcgacagatgcatgattgggatttatctgcctaattctgcatcccttaactagtggcatgatgtttctcagaaatttctttgtgagtcaaagaataatttataattcccccaccctcatagaaaatgcttcctttaaaatatcaaatatttgggtcacaaaattctcaattttatccctcagataattaaatgagtctgttctaagtggcattttaatttttgtgtttaaagtttcatttttcaagctgtattgccaccagttttgcttggaaaggtatagctttggagcaatggcatattagtccattcttgtactgctgtaaaggaatacctgagactgggtaatttatgaagaaaagaggtttaatggactcacaattccacaggctgtactagaagcatggctggggagacctcaggaagctttcagtcacagcagaaggtgaaggggaagcagacatgtcttacgtggctggaacaggagagagtgaaaggaaggatggacttgaaacagccagatctcatgagagctcactatcgtgagaacagcactaaaggggcaaattcacccccatgatctaatcacctcccactagggccctcctccaacattggggattacagttccacatgagatttgggcagggacataaatcaaaccatatcaaatagtgataatacacatatatgtgtagttttctaaaaggaccacccagggtgctgatactattttttaagttggccatgcttagaatgtaatttttcatggacttctgatccaaactgggacaacagatgtgcctgattttccccttcagtgattgacaaatatagctgtaagtagaattcaaaattattctcttcatcagccatggtcagcgttcacctgacctaagtccttatgttacttaactctatgttttttgagacagagtctcactctgtcactcaggctggggtacagtgacatgatcttggcatcttgactcactgaagccttgacctcccaggttcaagcgatcttcttacctcaggttcccaggtggctgggaccccaggcatgcgccaccatgcctggctaattttttgatttgtagagatgggggtctccctatgttgctcaggctggtctcgaactcctggcttcaagcagtcctcccactttggcatcccagagtgctgagattaccactgtgcctggctcgttaactgtgtttttaaaggaactctttgtatgtgtgctgacaggttacccaaaaggagtgactttgagactttaatttacatagctccaaacagcatgtccaggtgaaagcacagatatcagaataggtatgatggatctaagagccaaagcatttcattctcattcattgtagtccaaatgaaagacatttgaatcatgcaacattttgaagaatttttaaaacatgcttttagattgttttacaacaaaattaatgatgtaaaggtagtttaaaacttgattaatacctgatttttactagttaagtaccaggcagcctttatttcaaactgggaaactattttaaatacttatgagtactagtattttttttttttgccagaaattgtgacatgtggtagattcaatgattccaaaaaatcgatacagtttcaaattttaatttagatgtaattgtgatcatcactgtatttatatatccaagtgactacattttaagttgtagacaattgttatttagaggtatgaagaaaaagagggagctggtgggaagtttgctagcataggagaaagtaaaaagaagcttcaattttataataatgaaattaaaagtcttaaaaagtcttagagattatttagtatagtactttatttttttccttaagaaacaatcaaggcatgtactgattaattgagttatttaagcttactgaggttggcttgaattagcaattaaggaaataatacaaagccccaaagcataaactccaaaggatgataataagcatgagggatgggcagttttgatgatcaattcttaaaataagttccttgaatatgtatgacaatatcctcaccaaatgtgagtatgtatctttgccatgagcattttaaagtaataggcggaattcctaatgttcttcatggcattcacagattctttaatcaagtgagtattttcatggccttttcctgtctttcacaaacatttttttttttgtaaaggtgggactgaccactatacagctgtgcattggggagtcactggtgacctcagccaagaatgaattcaggccatccggctacaggccagaagctttgccagcttagctacttgaccacctgcttctgtttttctgttccacttgcaaatggagggtgtttgttcttttcctggcatcaacatcaatttaaaaaaattccttggaggaagttggaaaggggaggcaagaagttgatcagtgttattagttttgttccccgaagaatagcatctcttaattgagatgctgggacattggtccagctataggccactggctgaatggaattttctccactaatgaattcttttgtagttgagaactgttggagatgtgtttgatggcaaccttgaaaattacaaaccatttatcttacttttccttcactatacagccccaacaaatacagtgggtttcattaaagtaatgaaaatttaagctggcacatattctcagctactctgaaggctggggcaggaggatcacttgaactcaggagttcaagtccatcctgggcaacatggcgagactctgtctcttaaaaaaaaaaagaagaatttaaaacagatatagttatcagaatttattattccatgcaactattatcacctaagagaagtgacattaaacatttaacagtttttcagtgatgccaccattatcaagtaaaaacatgttaggaatttcttacagcccaacgaggtcaggccctttttaaaaaaatactaatagttctagctgggttgttacatccaattcccttgagagaattgaggtttaaatttaaaataaatcctctatgaaatgattagatttcatagattagattagattcactgtaggctctgaaggtacctcctgtgacatgatatgggcaaagtaaatgtgtaagtcttccaaagtgattacttagaataacgtacgcacatacacacaaaatagtaatgagaataatagtggacaggaggaatcttttggaggcggtggatatgctcgtggcatagattgtagtgagggtttcatgtgtgtatacttacctccaaacttaccaagttctatacattaaagatgtacagcttttttttgtcagtcataccccaagagcatgttttttcttttggtaaaaaaagtacaaaacactcttggcagttttttctttattctttaatggcatagttctaggttatttcatacttaaaatatgccttttagtttcccaagaaacctagttcagattgtatagtggacattgatgtttaaaagctcctcactttctttgcctcttatagatatggcattaaaaagaagcagcagcagttagcagggattttcctctaagaagatgagaaaagatgtgacagaaatggttggggatgatggcctgttcagttagttactcctcagtaacagcagtggtgcttgtaggatagtgatagtgctagagatacagaaagtggcagttatttggagggggcgagggatgtcaaaggggtctcaaggcttggcataggatgggaaacgtgacgaggatgtttaagcagtagggttctttgatcaactttgtgttactgaatgattcctaggtgttctcatttaccttgatctactctaacagaatttatgttttattcagtttctcagcaaaagttaagtacttcttgatttttttccccttacattactgtaagaaatgtacttgatatttaaatatcaagataaaagaagggagtaatagttatcatcttggaatgtgtaacccagggaaataaatatgtaaaacatggattgaccctaagtgtccaaagaaatgggatacacacacacacgcacacacacacacacacacacacacacacacacacacgtatactattccaccatgaacaacaatgaaatcatatcatttgcagtaacatgaatggagctggaggtcattatcttaagtgaaataagccaggcacagaaagacagattccgcatgttctcatatgtgggagctaaaaaatctgatcacatggacgtagagcatggaaagatagatagataggagagattgggaaagatgagtggaagggagaggggaggatgcagagaagtaggttaaaggttacaaacatgcacaaatatagaagaaataaattcagtgtttgatagcagagtagggtgactgtacttcacaaaactgtactgtgctctggtgacgggcaccctaaataccctggcttcatcactacatgttatatacatgtaacaaaatttctcatataccccataaacttgtacacataaaaataatttttaaagaagttaactttgtacacatgtagtgggcaattttttccttctagccatagattgaagcccaaacttgatattctacataatattaatattaactaggcagtttctgctgatgccagttcttagaaagataacaaatttttactccttaatggatagttctatgtttcaccaggttgtaataacatgtccattaccagtaagagacattttcccagtactctgtagtggagctcaaatggagcatattctggctttgccacttactaggtatttaagccttagcttcctcatctgtgtgatgaaataacagtacccacttcaggatggtcacaaagattcaacaagtaaggcatgcaatgcatttagcatgatgtctggcatacttaatgccccagaaaggtttttaaaaataattgtaagtattgagtgtaaaacaggctctctgactaattctaagattggagagatgagagacttttccatgtgttgaattttagatagaacacaaagtcgtgtgtgtgtgtatagagtatataaatgaagcagtacatacttagtatagttcctggcacagagtaagtaatccagatagattagagaataacagctatgagtattattattaattcagttttcaaatgtttataaaatgtgtactttattaatatggttatatgcagactttaagacagttatatatgtatatatttaaagaacactaagcttgctatataaccagtaaagatgtgcagggtgatattaatatgattagaatacaaatgccttcaagacagggtcttttttctttttttagagacagggtctcactctgtcacccaggctggagtgcagtggcttgatcatagctcactacaccttcaaacttctggctcaagcaattctcccacctcagcctcctagaggcatgcgccaccacacccagctaattaaaaaaatttttttggtagtgatggtgtttctctatgttgtccaggctggtcttgaactcctggcctcaagcaattctccaccttagccttccaaagtgttggggattatacgcatgagcctctgggcctggccaagatagggtctgtgtgtgttttgtttactgctgtcttctcagggactaaaatgtgtttggtacataataaatgctcaaaacacttggatgaaaggatggatgaatatgtgctagacacatatcaatgtgtgtgcttgcttagccccttgcagttctaactgatcatgaatttttccatggcataaaggttgagagtataacttctgtcaccaggcagttcaagtctacttactggctgtgggtctggggcaatttacttaacctctctaagccttagtttcttcatttgtaaaatggggtaataattatttcattgatttattatgactattaaattaatcaatatttgtaaatcgctgagaagagtatctgccttgcctatactatgctctatgtaaatgttaaataaataattaaataaataataagtcaataaatgccacttgtgccaggaatgtgcacacaaccgaaagacaaccattcattggctgacattggcatgattttggcttaggtcataaagagctaggccaaatttctcttttaggacgttatacctgagaagttggagattaagtcagttagctatgagaaaggagatttatagcccagggaagagggtagtcattaaaggatgcaggcaacaaagatgccttgttggccagggcattgatgagagtggagcatgctgtgcacagaggaagggagaaaatggggaggggagggaggagggcaggatgctggggtatgggggttaggccacgtcagagtggttcccccaaacccattctttttatttgtttgtcttataacttgagtgaagctctgttccttgtgagacaaaggacatgatgtgattagtcattcctaataactagcttgccgtgtcttaatttattcctttttggtaaatgattaattgtttaggaaaaacccacctaaaagttgttgtaggatatggcagtagaggcagtagcagctacaaaggaggataagttgacgtctggctccccacactcaggcagtgttacgttgcatacagtataatgaacaaagaaatctgttacaaagaagtgtctgcctatttactggaaagtcaagtgtccttggataattcaatagtgcttgagaacattatatgttagggtttaagtaagtgactagataaaaaagataaaatcgtgtttactatggcttcttttttcaaggtagagaagcatgctgttcattttgaggtttcctataacatcaggtaaagtttagccagatgaactttgtacattgtgtgaaccagtattcttttagttgaaagtgataaaaaccctcctcaaagtagtccaggggcagaggttatatggagtttcttaggactccgttgcttttgctccaagtttacatggttaggattttggatagaaaaagagagaggggagtggggtgtgtgggtggcagggagaggggggagagagagagagagagagagagagaaagaaagagacagacagacactctcttcctcccaacatctatacacaaaactaagtgaaagggcacaggtcctgcttgggtcacattcctacttctggttgtaccactgtatccagggggatgatgagagcttggtccagtctgagtcatgtgtttcctctgaggcaagggggctggggtaccaagagtgacagcccagcccaggccctgcagagtggaggaggggaggctctgcaggggaggagtgctggcaggcagagacaacacttccactccaggcaaatgaatggcagagtgtttgttattcaggaaaccactcctccagagctctgctctcttgatgccagataaatgaggcttcacgctatttggaattacttactttctttgggaatacgcaaaataaaaattgtgacacatataaaaaatttacattatcattttttaaatcaattgtttgtacttatactgtcatacaaagggaaactttttcacaagcttttatacaaacacattagtaacagtacacccccatttctatcctccaaatcttaagatcttgggaagttgaaaccagtctggatggggagtagcaactgtgagttcagaattctctgtagttaggatgctcaggatgcaggcgttttgttatcctttacttacagtcactgtggaaaaaaattaccttggcataaaggttctccagttttgttatgccacattaaccaagatgtgtaaatgtcataagtgaactattgatattatttaagtgttccagagagactgtaccagagctcaagtcatccccaggagagcttaacctaccttccttccataagtaaagcatctctgacatcacataaatcagcccaacctctctagtcagtacagactgcctttttttcctaccctaaaaaatttgctgcttgacattggaatgcagaatgaatatgctgcttttgtgtttcacaggttgacacaatgataaagacagatcccagggtcaaagcaaaattctctggttaccctttctagtctaattaaaatttataggaagtgtagctttctattaggttttccatgccagacatgaaagatctatgtatctttccttcccattactatgtgtctggccagattgtttcatgctgttagcatccaggttacctggtacagtgtatgaaattttcttacgtggattttgcaatgggcatacatcctattcagtttttaaaacaagtgcagcaagttttaaaacaagtccacagactttttttttctcaaccttttcttttatattggacttatataggtagtaacaaatatgttcagtgttctagaaatatttgtatatggggtctatttgaagactgactagcggtcgccaggtagacatcataacaggaaaggaatcagtaggaaatttgccacttacaaaagtacatgtctgctttcaaggctaacttaattattaaagcctatgactcacttgagttgttaagtctttctgtccccctgcaaatattagttaaatgtctataccagagaacaagaggtacagggccacagtggtgatcttgatggggggcctcgagtcctgcttaatagagctcagagtcgatgttagcccgtgaaaatatttgctcagccttcattctcaggaaaaactgatgaaatgtaaactgatgaatgccgcgataggatctttaatagaggctatagccaagtacaagtaagttgtttcgaaagataagtgtatagaaagctaaagtttgacaaattaattgttgttccctgctgaaggaacattctgttttctttcctgcagtggccactgacctctggctggggcagtgggggtgcctgcttaaggagataacccagggctgttcagatttctgtgtaacctctgactgccatgttcagagtcttgctgatttactaaatagattaagatactttccagagattgggccagcttgataggtttcctttgtcttagttgctcctccctcagagcttgcatcaaatcattctcttcagggaaaatttgccccaagaatcccatggaacctgatgtggtttgtactgtctttggattcctgtggcattttaatactgttaagatctagatatcatactgttctctggcattgtgtgagtgtacatttgccttctcaattaaattatcccaccaattcaatttgcagagtgttttcaaaagaaacatcttatcatctcatttgatattcacaaaagccctctgagagaggtaaagcaggagcctctgtttacagatgagctgagtcacagagtcggatatacttggagcccttgctctgactgcagtgcactgagatagacagaggagaatacaggttgagtagtctttatctgaaatgcttgggaccagaagcgtttcatatttcacatttttgttttgatttttaaatatttgcattatatttactggttgagcatcccaaatctataagcctgaaatgctcattggagtgtcatgttggtactccagaaattttggatttgggagcattttggattttgggttttgggatttgggattcgggtatttgggattattatgtattatatacattatgtgtgtatatatatatgtgtatatgtatatacattatgtatatatattatgtatatatatacataatattatgtattattatacataagtataatacaaaatgcttgttttagaagcttacatcctggctacagagggaaggtatatgcagttaccccaaattgtgactattttgtggaaatgtgggaagacagaattgttattgggatagggaaagcgtctggggtaggagggtcatataagtgctagatcccaacagatggataagacttggacggaacgtgacacatccttgtcagggagacaactgttagagcaaaagaaatacggaagtacgaactgtgttttgacaggaggaagtagggccgtttgtctgtagttgaggagtgtgtttagagaagtaggaaaaacataggttagaaactcaggatggaatcaaataatggaggacttatgccagaccaggttgggctatgaatgcatttgagaatgggagtggtggtgataaaggtggtggacacgcaccagggagcgatgaggatgagaagggttgagggactgctgcagagactacgtgataggggcctgaacagggatgttgagggcgggaggaagaagagatgcagatgtgagaaagattgggaagggaagaaaggcagcgccagtcaagtaatgagatggtggtagggttttgtagagtggtagagacttgaaaagatgctagaacatcattttatgagacaataacatatttctaggagggcgtatttgcagtgatgtactggtagggaggatactgaaggcatttggttacattcacaagtataaattgtgaccaactgtttggcttctgttacatccttcatagcaaccaacacagagcaggccacttggtaaatattgctggcttcagtaatgggattcatttagttggcttgtagtaacttagatgaagctgggctgaactttacctgccgtgtaaaccttaaactgtgctagtagtaaaagagaatgggcaaggaatatttaaaatacttatggaaacaaatgatttttaagtgctgtcaggagcttgagaaacatccatttataaccaaacaattgagaagctcattaaaaatagtttttagccatttattacaaagcttctctaactacttttattgaaataccctttgaaatttgctaagtatattaaaagtgatagtttctttgaaattttcagtatttgacactgataaccttagtaaaagagagacttcttatatatgaataaagaggatttagcattttaacagcattgattgcccaagtattatttagaaaagtaaatgcaatactgtaagtatataactagtatcttgaagattattttatgaaccttatcagttcttgtatttgatcaaaattcattgtgttttggaattccaaggactattttaaaaagcacaacaaaaaccaaagaaaggtataacttttccacacagattaagtgctaaatttactgttgtgtctatattcctacttcatttgttcaaaaagtatttattggaaattcatactatgtataagcaataggtgctagggatacagagataagtaagaccatgagtagtaccaagtccatataggtttctagctagaaacttgggcatcaccctagtaaatggttcctaaatgtattattcccaagaccagaagcatcagcacaatctgagaatgtggaggtgcagctcagccatctgttcttacaggttctcctaagtgattctgatacaagtttaaaggttgaaagccagagaattttaacctgggcttccatggagataactgcatttcagtattattatagtcagtattgtattatatactgcacttcagtgtatatttagtttctatatattttatgcatttaaaaacattttgaggacaatttataggccttactagattcatcctctccactatagccaaagagaccatccttatgtgctaatcatttaaatgcttaaaatcattgtcattggtcacacgggatcaagtccaaatcctttaggatggcttgcaaggtgttttcatggcctggcccttgtctgcttttccaagaactcctcctgtgcttttcagcacatgccctgtgctttagccttagcggaagtcatgccacacttccttgattataccaggacacccaaatctgtgcattgacagctctctccgtctgaaatatccctctgtttctgctttgcctggtaaacttctattcaggctcatcagcataccagggcagagttagggtgctctaatccctgaactgtgagagttttccttacattatctccaaataattattataaaaattatttgaccacagatttcctattttaaaaatccttgatgctaaatgaagatctttcaaatggattacacaggtatgtagttgctatagagtggtgctttcttttaacccttaaaatgttcatacctctggagagtaagccaacagctggtgtagaatctggccggcagtgtaccatgtccagggcaggaaggggaaaatgacgtctcccatggccgctacaaggtgggtattggataagcactctgtaattactctcattgcttggttgccaggctgttggaggccaaaacacatatgaggttttgtggtttgagctgttgtcctcccacaatactgtgagctgctctcaaatgacgggaaagaaagatgactagggctcaaccatagtgaataattaaaaaaaaatttgagtctcacctcccaatataaaagtcatacatactcacagaaatctaggaagataggaaaaagtgtgaaggagaaaaattacatgtttccctgtctgctaatgaagataacattaaaaaaaactttttttcacgtatgttaacttttaaaatcaagctatatataattttacaatctgatttccttttcatactataaacttgtctcataaattctcaatacatattttaatagctacatgatattttattgaattaatttgtctttacttatatattctaatatgaaaggttaaggtggttgtccattttctttctttgtaaataaaactaccttgaatatatagtgaataatttgtgtgtgtgtggttttttaatagtctttatagccaagtatataattaagtatgtcagtaatttcttctgaacttcatctatttgacattaatcaaatatttattgagcactagaacaatgctgggtagcgcctccttacacaggaatgtagagagtctccaaatctgctatttgtgaatactacatcatagaaagtagcatttaaacaattttatgtgggtttgtctctattatagaatgtcatgcttggtaagataagagaacagcagactttagctttctggctcactgattaaccaaatatttaaacatgaatacaatttataattcttcaattccatacagtttttaccaaattataatgtaaccccaatgtgatatttttcttttcattacttctaagaaatgcaaacatttttatagattgttcatgaaattatatctcataattggccgctaagttctaaatatgtagttcttttagactgagaaggatgaaggaggactgaagagagaactaatttttacagtgtctgtgtgctggacacagtgtgagggaggccatcctgagagtttggtgttgagattcccattatagagatgaagaagccgaggctcagtaaagtacaatttcaaggttgtgtaggttgggtaagagactctagtgtgtcagcctccaaagcccatgctctgttacatctaggggtctcgaggtctgcgagccctgtgaaaacaaactgggctatgattcctgtgtggagtgaggtcgtaattctagaattttgctgtccacatatggctctttatttttaaatttaaacgaattaaatgtaaataaaattaaaaatttatagtttctccattgcactatatactgttcagtgctcagttgtcacatgtagccagtggctgtcacataggatcatgcagatgtagagcatctccattatcacagaaagttcttttggatgatgataggctgcctctggaaaagtccttaaatactaccgtccattaccttcattagcagaaccactgacaaactcaaatacttccctgggactctgactcacatcttttgaactctggggtccacactgtccacagtctgggactcctaactgaaggaggggaagaggacttgaataacccactgggtggtgattgcagcagaaccataatactagtttatatggaatattacccaaaaacatttctttgaatatgacaggccttgagaaaagtagtgatttctgtttctttacatgatgaatgctatgaactatgtatttccaggtgcaagttacttttttcacattttcttaatgtttcctcaacacccattcttaattcagttggggaagggtaaaccaaaatggggaggaattagtgggaatcaaaattcaggttatactctgatgcattttgaacatattaaattaatccttagtattctcctcaggaaactttaatgatacagggaatagactaaggacttcttttggggatacatgaaacaaatttttacctactgtgtatatatttggttatggcttttaaaagtagttggggaaaacaggtcattttgacggttaaacagtgtcacataaaagaaaaagcgctatgctgctgatctctaaaaagccatttaacctctctgagttttatcaatttccttgtcagtttcttcgtcaataaattggaaaaacaacatcttcctttcttgtcaaagtcaatagagactcaatgaaatcatgaatatggaagtgtttgggaaactgccagtgagtggtgtgctgtgcatatgtcaatatggtgttgtttccttgatcctctcttttctctacctgttttaaatctgaggcacagcaaggtattgtgtcaggccagagctcctgaagaatgctccccgctattgcatgcccgtagcctggctgaagttgcagtgcaggatcttgttctttctagagggatagtagtaatgagattgacatgatgaaaaataccttgagtaggagaagtcttgatgccatgggctgcatgaagtgtcttccctttgtcaaccccacgccagtgttcctgggagatgagagagtctttatctcatggaggaaaacatatcagtgtctgttttagtagatctgtagcagaggacagttgtcttgatatattgtagactgtaccctatgtatcagctgccatcctgattcaacaagggggaaggaagttgtctaatacttgttaagcgtggaaggacatttgtgacaaatgtaaaacatcactgtagaacttcacattaatctgtatttcagaaagcaagtgcaaagaaaaaggagtcaaacaatgtctaagtagcatggagttgtgctcttagttgtgaaagcagcagtctcttgttcagtggttattgtaattctcagacctatgctttcttcatgtatgttgtttaaagattacttattcttttcatctaaaaacagtattttaaaaaaccaactgggtacaggtgcttatgcctatagtcccagcactttgggaggccgaggtgggaggattgcttgagcccaggagtttgagaccagcttgggcaacatggggagaccttgtctctacaaaaaataaaaaaatgagctggacatggtggcaaatgctcgtggtcccagctactagggagactaaagtgggaggatcgcttgagtctgggaggtcaaggttgcagtgagcccacatcaagccactgtaccccagcctgggtaacagagtgagaccctgtctaacaacaacaacaaaaattgctacattattgtttctacaagaagtttgccactctgtcacagttgtccattttttattattgctagcttttaacttagaggctgatgttgctgaaatattgctactttctatcctccgaagtacctggtatgatgccttgcacacattgcttgcttattcaataactgggcttggtagaaattggagggtgatccttttgttttgctgggacaatgtgtccttcacacacatccatcattctatattggaattggcaattaattttctagttggaataatgttataaataatgggttggttcccagagtggtccaccaaattaacccataatatggcttagctcatgaagaaatatacatgatggagaaacagacaactgacttagagctaaattttacacagctgaaaacttaaattgataagctgggaattgcctatcatttttaaaatataatttcagataattattatatttgtccaattttaagttattcttacatctcagagtatgagcctcctcccttcataggaacattaaccttaaatgtaaagtgtagcagctggtggacatggaactaaatttaattttgtctacttatatgtcaaagttgtgctgactattaaaaacactgtgattttagtattttccttccacttaaatgtagtttttaaatggctattttaaaatgttcaatgtgcattttaaattaccatttacaatggtgttctttgattaatttacactggtttttctttgtcataaagagaattacttaaaaactcagcaagtcagtacatcatggtagtaacaaaggcataaatctaagaatttattgtgctacattctgcaaaggtaaatataatttattgtaaaataatattgagatataagactatgatataatattactcatttgccactccaaactttttaggctttaatttacttttgaaagtgacattggcattctgtgtgaccactgatcctatttgttacatgtgtttgaaatggttaaacacaaaaatatgtttaaatttttattacatgatagattatacatttactcttacaggctcttagtttgaagaaatgttcggttttttttcacattttactacttaaggtacgtttgttggcttagtgtgtgtaaattataaaggtactcttaataatcaagactttaggctggatgcagtggctcaagcctataatcccagtgctttgggaggctgaggcaggaggattacttgagaccaggagttgagaccagcctcagcaacatagcaagacccccgtcgctacaaaaacaaacaaacaagaactatcaagaaatcaagactttagtatgttttgaatggtggatgagtttgtttttgggatttaaaatcgatggcagggacatttttactgcatataccctttttgttcattttcagttgaatcaaggaaatagaaaccttctcagtgctgcaagctaagaattgctgtgcacattgcctgcctgttggactctgtgacttgtaccccatcacaccacagagctgtatctttaggaggcatgctgtgtggcatgtggatccaattatcatcaccatgactatttcatttgatggaaaatctgtagtaaatcaagaatattaagtctgtttgttaatattgaagtccttagcagccagctgtgctgaaactgtttgttgcttatatttatagatgagttgaatgctaatactctctgtcatggaatggtcttattgtccattttctgagctcgttacatagtaaatggaagaattattttttctttagcttctctaaaattaaagttgagcatgtgcctttatataaatattcttttatgaatagagcatttgagaaaacagcattcattattcatttgtatgtcttttaatgaatttttggttttttcctctgtctcaaatgcaactaagcatcaagttattgcatattagcttcaattagctagaattagtttttttttttttttttaataacagtttggtgctctagttaaaaatacatggttccacattctgcttttgtgtggctgctcttcctttccctcttctgaatctaaagccaggcacaggttttttgttttttgttttttgttttttggtcatcagatttctgtaggtggttgggtcatattaatcttcatgttaatgtgtacctttttttttttttccacatctctacttcttgctgaactttcctcattattgaaaagagacattcatttaaataaaacaaaaacagagctctctgaaagaaaagcattcagagacccacaatagcagaacttcatgtttgccagatttaacctcagtatcaaaatgcaatgggggaaagatgtgctactactgtgtatgactcagagatgcttactggtgacgagctctagatccagtggtgtccctctgaatttccacagtgcctgccttcacagtgaactaaaaattaaatggattttttcttaccctagctgtgtgacaactgtggtgccgtgggtatgccactgactcactctcctttttactactgctactatctaccatatttggagtatttttttgttaggtgctgtattgagtacctaacatgcatgattttattggcatcctacagacctatgaggtagatgttgttactgttgccattctacacatgaggaaactgaagccacaagaggctaatgtagctactgaaggtgggccaccagctcccgttctgatgccaaagccccaggcgttaaccactaaattgccctagctgtaggtacaaatccttctccttgtaaaactgcttcagagctgtgtattacatcatatctcctaggaactggctccagggtatgataaaagtatacagaattaagttactcctcctatcatggaaagtcacttattttatgtgtgttgtgcttagtggagataaggaaacgctgctcaccttccacttaataaccagaaaactcatccttaagagatccttgtggcttaaacaaacaaacctctgcaagccttttagcatccccagtctggctggggccaagtagtatcttgtaattaagctatggggattatgttgctgttgctgatgttcccaagaatgtgggtaggaaatggtgtctgaatatatagaagtcctaagaagggaccatggtctaacattgggactttttaagttttggggaggttgaggatggtgtttattaagtcaccttggtgcttagctgtgaggactgctggagtggagggcttggagctttattcaaaactggaagaaaaggatggcaatggatgagctgagcagatgttgaagccacctcggggaagatctgtgaatggtattaggatgctgaacagtccaaacctcaagaggtttacaaagcagaccaggattgacttgcttttgaataggtgggctttgtctcagtgtttgaaggaaataacttgacacaggactacgtgtgggggtaaagcaagacaggacgaggttatctccaagtatgaggggcatagacagaatgagcagattcaaagagcttggagcggcatgttggcagacaagtgctcattcttgacggatgtttcattgattaacttgaggctgtacccataaattacctagtcattggctaatttgtaccttgatatttctgccaaccatgataagacagtatacatttaccagtgcagttgcgttagacattttggggggatttttgattagaaaggtagagttggggtcttagaaggagaaatttctcaggcaaaaaagcatttcaaagcatgagcttggagtcagacctaagttcagattatatcctaggctcttactagtcttgttattttaggaacattacttctctaagcctatattttcttttctaaaatggtggacaataataagactttccacaaagtgcttttggaaggattcgataagacagtgtgttggaagcagctggtaccttgcctggcccacagtaaatgttcagtaaatgtcagcagctgttgcctttcccacatcctttccatcctttaagcatgtggcaattgaacctggcccataagccttttctaggggctgcctttggggcatatttcagagactgagggcttcttcagaagcctgttgataggacaagcatatcaggtgctttggcctggaagctcattgctgcttcctctgccaatatttttcatccgttttccagatgtactgaattcatagaagagacactagaaatcatatctcctggtgacagatgaattttcttttattattccttttatagcttatgtgaattgcattctcttgtccatgatgggatggttgatcttctcttctttgatagtcttcttttattttctgtaaaataaggatatgttgtatgttttttataatgttgtctgctcctccttttttttttaaacctctttataagtcatttctttctttcctacagcgattttatgaagaccttgtattctcatacacagaggggttatcagacccatgttggcgtggtaacagaaaaattatcacgtgtgctcagaatctgtactctgaaaggcccagttgctgaaaacatgattgtcctgcatttttttcttccttagagctggcttatgtcagcctatgggctgtttgcttgagcatagaaatagtggtatattcaagtgggaagctgagaaaccataatgacgaagggatggcagcgccatcctcttccagagcctgggaagggccgcgcagttgcaccatcttttatgccataggcattaatgaatcataagtctctcttgaaaaatttccatggagagtttctatgatgtacctgccaaaaagagatgtgttaacaaagcacttcttaaaatggtattttttaaaagttcaaataattaggaacagagcaagatgaagcagtagagcttgcaggagggagcagcgtgctcagtggccagagacttcacctgagttccagaaaatcagatttcagggctattggcgcattatcgtagccacaaaacgttggggttcatgttacctcttttgtccagtggtttgtgtgttcccttctcactgaattggatttgacattcaatttgaattgacagtgaacttcggggtaattcctttcagaaacctgaatcattttaggatctgggaagcattactctgtggcaggggctcttaaccaaaaagcccatcgctagaattctagggtctctgaatttggatgggaggaaaaacaaaacaaaacaaaacaaaaccctttattttcactgtgccctagctgaaatttagcatttccttcaattatgaatatagacagcaaataatggttgtatttgaaatgtgaaattgtacttgtgaaacatgctactggcccctagattttatgctagtagtcctattattcagtgttattaatggagaagcacaaaacgactctatcagaactttgctttttaagggttagataattgtatttcactttaattgtttttcattgtaattacatgatttttatgcctttaaaaacattattctgaccaggagtccataagcttcaccagctttccaaagggggttggttctatgttagtcctggctctaagccattcttctgacatctccccctgtccctctgccagcactctggagagctgagatgtggctttgaaaggcccagcatcaatcactggaatccctattataatcttgactccagcaatgaagattctgtggccatttttgtcagtgctttatatgtcttaaaggaggaggctttctttagcttttctgtctttccaggacaatgccgtctacacagacttccaatggaagatgttgattcagcgacaatttactagaaagctggatgctgtgaaagcaagacacagaaagcagagaacatcaagcagtgggagtgtggaggagagggagagagcatgtgtgcttgagcagaggggtgataggaggcctgaggggagagctggtggaggctgtgaaatgagatggggaagtagggagttgggtggaataatgaggagatggagaagtaattaaattcaagctttcaagcctcctcctggtggtggcttctctttatcaaaaaaaaaaaaaaaaaaaaaaaaaaaaaatctacgtttgctcctgggaattgttcctgtgtagttaaggatggattcttcactcgtgtcttcaattacttgaattcagtacggaggttttgtgactcagagcttacctctcagataaccgccttatttttgtgatggttgtggccaggtcttctgatgcaggatttctagattttatactgaacacaggaaagtgggcaaacttttcaattataggaaatacctttgagggtattttgaggtattgggcaaaggctgaaaacaatttcaaaataaaatatttttaggcaaaatatctgttaactgtaagaatgttgactctgttaagcccaaagggaaatgttacaggtcaggtggatccaggacagagctaaaggtggtagacatgcactgatataaatgtctgtgcttaaaatgtggttctaagagactaaaaaattgtctattctggtactagtagaacctaggtttggatctccttgaaaacgcccaaaacatattttacttgccatttagaaaagatagttttagtgactaattagacttacgtgggttgtagtctctaaaaacccaataatttactgttcacctgtgtatatttctaatgacaatgctgaattcagattgaaggtaatctaaattaggtacaatacaatatctataaacattattatataagaactgtattaccatcaaataattttaatatctggattaatataacaaagtgttccctagtatatattactaggagtcctgctttaaaaaataaatacatgatagttatatatcatttgtaggtagatgtatttataaggtgctttggggcttttaagaaagtgtcttctcttaaatatttaaaacatttttatttgcattactggtttccctagcatatcctttctttagagaaaatataatcaaattttggatactgttacactcgtctaaattattacaaattcttaatttcaaacttaatgaagaaattagatgggatgaagagatatcgaagcctcctagatctctgtaaaatgttcttcctctgccaaagtacttttttgagacaaggtcttacactgttgcccaggcaaaagtgcagtggtgccatcagggctcactgcatccttaacctccccagactcaggtgatcctcctgcctcagcctcctgagtagctgggactataggtgcacgccaccacacccagctaatttttatagtttttgtagagatgaggtttcgccacattgcctaggctggtctcaaactcctgacctcaaaggatctgcctgcctcagcctcccaaaatgctgggattacaggcatgagccactgcacctggcttcaaagttctttcagttatactggcaacaaagcagcttttggggctttgaaattcctctattttatttaacacttctgaaatcacagtgaccaggaaggaggggatcaagttttgccaacttgttaaagaaagccttggaaagcctcttctaggatgaccatgctgtggggacttctgtagcttttgcttggagactttgaaactcctcccatgccaaccttagaaaaaggctgattcgatgaagtctttctggcaaagcatttaagacccagccacttttcaaaggtgagttcctctgtaaagtcacctcaggttcttgctacaaaaaccaatctttgtgctaagtgtttgatgaatactgccatgttgtgattttagatgttggatccttggcttcgttatgtggacttctggctttgggaggtattttatcctgttagaatattatctcttccagtgtatttctctcattttctatatcacaaacaaacatataagcacattctaatatagtacgcagtttaagcgaagttagatgatattgaataatagattgttataaatatatttttacatacttgctctcacaccctccttgacccacccagtgccccatttttttttttcttccaagtaactaagttctgtgacttggatgctgtgacttggactttagaggtgaagtcagatgacaaaagatttccatgcaaatcatgtttccagaatcatccctcatgtgcatgtatgtctagtggaatgcaaggcttactagagggaggttgaaatttggtgtgcgttaaaggaaatataaaaatcctgcttaatgatcctgttaggtttgtatacagattaactgttattacacaagaaatggtatgtccgtttggaatttctcatcctctgaatagccagctttagcactgtaaactgggaagaattctgttgtatctctgaatatataatattgcattactgcgagccccgcggcccttttcccaaacaacatatgcctgcatgtgcctcagttttatgtgagccaaaccaatcttaggcctagcatatgggagtttattagtatgtgtatgttcctatgttgtttaagagagattttagggtctggagaactgagacgtggcaagttacaacaaagctttgcttagggatgtggttcatggatctcagcctaagtctgaacacttatgcctataaaatatcctcattccagttcttgaggcaaattgtctttgattcacatttgctttttctttctgtggtgcttgcctgatgcttgctaacctctctagcacctgctgcctttatacctccctaaggtgtccggtccctgccttggaaccacctgcaactttcctcctttttacaacatattaatagatatcgtttcatcatatagggagtgctcttacagaagcaccggaaaatttctgcatttatagcttaagtgtagtactttaaaaaattctaacaagcaagagtgtttcataacccagtggaacaaaaattcctaatgatgaaatccaggcatattctgggatgagattcctcttatcacacctctctgctcgctttgcgtcagtagtcctggtaggactgatgttcccaagcatcccaaggagagtgtgcataccacagtgtgctttagagatgtggtattttggtgtgcagagtgtagttacaggatacctctgatagaaagatgtttgcaaaaactactaggatattttctcagctgtgccagaaatctgggtaaatgagtgttagattattagctttggcattgaggtgctgacctgcaaagctctgttgccactgccctgggtccttgatgacctggcatcctggagataccctggtcctcctagatctgacctaggttgcagctgtgagctggatgcctagtgccatctgcctgggcaaatgtaggaaatgccaagtgggctggcaattttttgtgtggcctttggatcctcactcagccatatggtgctaaaatgtcaaactgttcccgagtatgggccatgatggagaaggctagatagagaacacacacttcagataaagaagctgctgagtctgtttattccccagccactggcttatcactttgctactttaaccaacatttactgaatagtgcttagttcatagtggactacttatattgtgagaggtgccaaaaaaagaaaataaaatactgagatggttcttactggcaaggattatgtctcttgtgtccatgtgtcttgtatgtaatactgtcactagaggaaggtgaaatgaagggattcttccagtagaatttaatgggaggaaagtatcttagaaactgaagaatgccaaggaaactgagtcccccaaaagattgtagcatccctaaattgtgattgcagagatattaccaagccccatactctttccacttcagcttctttctgctatattctggcagtcacacttgttgatggattgacataatgccttgaaaagtttacaatccgtgtaggaagagaaaatgtaacaagaacttacagatgatccgaatcaaaacatctgcaagtgctgtgattgagaccaaagggaatgtgtaagtctaaagggaaagaggaggagatgaatgatgtggttcagatgaggttagccctggcaggcttcctagaggagatggctggggttgggtttggcccatgtagctcttcttagtcccactctcaggagactttatataaacacatttttctcctggcacagggcatctgactggttggaaagaacaggaagacaaagaatagatgcttgaattccaagaggccctcccattccttatagttggagagccgcgaacttttagatgtgcccccaaatgcatagaattaaacaaatatatcagatacaatttaaacctaggtaaaagacaagtcatttcatgtatttgatagagagttgtagcttgagagactttttcactaatggagctttgttgccttttcaatttaaatgacgtctgcttgtcttggtttataaatattcaaagaattgctttggttttagttaatcatacttgaccgtatataagctcagctatttgaggcattttaaacaaccagtttcatatggcagttttgtggcatttctgggatggagggccctggagctagccttttcctgtttccactgctgtggaggtctcgtctgtgtctaggattcagcccaaggcattgtgatcctatggtgaattgcttggagtggcccagaggagatgttcttttccttttttttttaaccttttggttttgaactaattttagaattacagaaaagttgcaaaaatcatagaaagagtcccttacctaactcacccacttcccccagtgtaagcattttacataattataataaaattattttagtcacccccacttatccacccttagagaaagcctcacacttattcataaaaagacacatgtacaaagttctttgtttccaggtacaacctaatgtctagtaaaaacaaatagataaatatcctgtgctatgcaatagtaaaaataaatgtcaaatgcattaaaggaaacaagcaagttgcagaagggtatatgccttatgtttccacctacttcaggtttaaaagcatgcaaagcaatactagatactatgtatgcatgtgaagtagcagtgtaaaaacttgcacatgtatgtgaatgatatacacaaaattcaggatcctgtttagttctgtagtggtaaagaatacatgtgagctttctattgtaacatttaattttaaaaaatgagtggtaggcactctggggatcattatattattttctaaacctattcaaggactaaaatgtttaatttaaaaaatagtaaataatactaatacaaaagcccagcaaggccattcattagaaatgcattagtgatgagctttcctgagacagtgttgtacctgctgagttgaaaggcaaaggagtaaggcttcagttgaattcttggctcttctgcatgggttagacagtcaacatgtcttgagtttcctgggtcacattttctctacctgtaaaatttccatgactgccttacaagcctaacatacaatagtgaaaattcagagctaaaactcttcaataatgatcctagaaaaggtgtgcaatgttgtctgtggccctatactctgccaggtttgacatcccaccagccccactttctagctatgtgaccttgcctgagttattttttctctctatgccacagtttcttcatctgcaaaaggggcttaataatagtacctacctcacagggacattgtgaggaccacatgagttaatgcatgtagaacacatagaacctgtttctccctctcccatctggctcctagactcagtgtatttgctcttcatagagttaaattactaggtgccttaaatttgaattagttgcaagtagttaagaattgcaatgagtggggggatgttacattttaaaactgtggatttctggcctctcttgaacaaatggagcatttagtagcactggccccaattgcaatctggcaactctgctgtcccctgtaagtggaagtgtccccagttcagtgtagtttccaaaacactctcatgtcctctggaccctgaggcaggctgttcattgtcatttattgtccaacagacatttgcaccagtgacattacctgccaggcccccattaacatttgagtttgcaaccctaatttaaagaggtcgtagtgttgcaaagaggggattggattatacatcaatccatgttctccagagaaatagaacctgtaggagattttatgtatgtatctattatatcatttatatataaggaaatccttgggcaggagttgatgttggagtcttgagtcagaatctcttcttcagggaaatctcagtgtttgcttctaaggcctttcaactgattggatgaggcccactcacgttatcaagaataattttgcttttacttaaagtcagctgattgtcagtgttaatcacatctatagaataccttcacagcaataccccgattagtgtttgattgaataattgggtactgtagtctatccaagctgacacatatagtgaaccatcacagattgcaagtttttgagtggtcttctggtaactgtgtggcaactgtacacttttctgtcccttatggtagaggattgctgtgggattcgggattgaggatttttcagaggggtttaatataaaaagcttggagaacttctgagctttgcaattaaagctgctgtgtctgtgcctctgattagagaggcaggatgttggtgattgttgatgcaagatgcttcttggaatagagggtgccagagatgctgggtttggtagttccgggtgtgtcattcagggttgagaatagtcatgtgtagactctgggttttggaggaagacagggcatttagaaagaaattttatttgtttttattttaccagctgtagagcctcaagctaaccaggtgtacaggtgtgtgctctgcctgctcgaggtcaggtgtgaatgcaggttctgaaaacatctccatctttagctattaatgcaggttctgaaaacatctctgccatgtggttctgtgtgttggaaggttgccaacaaggcttaaaaggaattctcccaaagccttctttgattcttcgagatttgtgcagagctgctataaagaggctgaaaggcaaggaaaaaaaattcttccgtgtatgttttttttttctgcatttaaaaaatgcatcaggtaagattattttttcttatgtgtatttttttaacttttttttttttttgtcggggagcaggagatctgaataaagcctcaagacttcatttctgtatgtattttgagaattcactacaacttaaaatactgaaatgtggtttgtttccatgaaaaacagtagactggccagaagatccaagaatattaatcttaaggaatgacccccaaaacccaacagctcagcctcacagttttaatctcagaaagcatgtttttgtgtggaacatattcaactgctgaagaccgaatgtatcatcagctctgggtgtggtctggacattgctgcactagagtgaagaacaaggtcctgcaggtgggggttgggggctccgacatctccacgtttcagagtttcccattctaggggagagcatacagccttgtgttagttggtttgttattgtgactaatcttttacttgagtatccttggtttttcatggggtaattcccgctgtgtttttattctcggactagatcgcaaacttttgggagggaaaagccatgaatctagacctgggacctgtgttgttccatcttggttctgttggtgccttagctttgaggccttaggggatgtctctttttcctcatcttaactgtaaggggattgagctgtatggtaactaaaatgctagagataattgtattttcctttttaaactgcaccttggcaaaaatttttagcttggttggagctcctcacagtcccttgattcttctgctttttcttcaactaacatccactctttattcagtgaaggcctgtagtctgtggcatgctaatatctcaattctcttgccctcttcaaacctcctattctgctatttcccttttacaaaaaagataatgattttttctgtctctttagtacatcttcattggtccctttagttttgtcaccttgactatatgtatatgttttaggaaaactcttaattatcactgtcaatctgtaaagcacttactattttgtcacgcttggctacagaagtatcaggctgccactgaatttgttaatttgatactttccctgttccctctcattttagattagctaaaatgaaatcccatcttcacatttgataaggttattcttggatattgcccttttcctaagctcttagtcacacgttgtcctttatattttaaaaaataactatttatgaaattgctgcctaatagaccagtgggagtgccttctgttgggattagtggttactggatctagaacccatttttccttgtattaaatagcaaacagatttgctttgggaattaatgtctttgttcgaaagactcagccctttttgggggtattttttgtgattgctacttgaagtagcttttttgttgatatagtggtagccagcctccataccatttgcagttgtttcctagatctgagaggccctggttcttaatgtacacaaattggttacaggaggatttgcagcgactgttgaagctaccggtttcttatctctttcctgactcttggtaccaattactgccttagtctgctcaggctactgtcacaaaatgccacagacttgggggcttaaaaaacagacatttatttctcacagctctggaggttggaattccaagatcaatgtacctgcacagttgattcttgcctacctgcagaggggttagggttagggttaggccaacctgcagagttgaaattataatgcaggcccacttcctggcttgtagacagccaccttctcactgtggctttttcttggtgcatgtgcatggagagagatctttctctgccttccttttcttataagagcactaatctcattaacggggccccaccctcaggacctaatataaacctcattacctaccaaagaggccccatctccaaactgtcacattgggggttaggaagtcaacatatggatttttgagagacacgaacatttagctcataacaggaacagagaattgtgggggagttgggtatgggcaggtgtgttgttaatagctctgacttcctggaattgggaactgcccttgccttcttcctgtatgctattctgtcattttggtattcatacttcgtctcaacatgtgctgcctgaatatgtaaattgtaaaaatttcttctgcaaatactttcttggccattcttcttcatctgtatctgagagactgtaacctaggctctataagtagagaaagcctatcaaaagtaagggcagtaattgtcctcccataccatatgtatgccaaaccagtgagagcatattgtgtccattttccaacaaaatacttcagtagccaggtgtgacaaaatagtaagtactttacagtttaacagtgataattaagagttttcctaaaaactatagtcaaggtgacacaactaaagggaccaataaggatgtactgaaaagatagtaaaatcattgtctttagagtaaaagggaaataacagaataggaggtttgaagggagccaggagaactgacaaaacattttttaggagggtgttgacaaattggagtggacccagaagtagacaaaagttttagcaagtatgtcatatgggagatgattgtagagaagaaattatttaatctagaggtggatgatgatgatgattgattatgatcatggctaacatttactgaatgttgactgtgtgctaagcactatgcaaatactttatgtgtattatccagtgtaatgcacacacagaaagcctatgaagcaagtattattgttagccctgttttacagatgagaaaactaaaattataaagaggtgtgagtcaggtcaaggtcactgagctagtaaatggaagactgttgctgggctgaggagtgtatggctgcagaaccttggcttggtatctctacttttgaggacatttctcaaatatggaaaagagattagccattgaggaagggttaggccaaccttatgtaaaatattatcttactatgttttattgcatctgagataccactggctataaaatgagtcattattttatttgcctttcagaaaaattgctgcctattaaagttataatgcagaattgatggtaagcctccctctgattttatagttgttgaaatgggtaaaaagcatgtcttagaatagatggaaaaatgttgtcctgtgtgtgatctcggaccaaaggaccaaactacaagggagattttagctcaaagaaatgctttgcaacctctcaagctgtggagaaatgtaacctcctctgacagaggccttgacgcatagcaggagctcgctgtgaggttccctgttgtgcaggtgctgagactggctggaggaactctctgggatgatgtagagggatttattcaattgagtagaaggtgaaataaattatcttctagaatccttccaaaacttttaatgaaatatagcatacaggcatcacataagctatgataaaaaaattatttaaatgtggttggcagttatttgtaccaattatctatagcaatatgtatgactcaataccttttctttcttgctgtcttctctctctttttctcttttggcattctaaacgtggttggtagtttcccattttttcctcaggtaaagttcagattttttggctcagtattggaggcactctgccttttcacccaacccatcttccccacctttttgcctctctcccaaattccatagctgaataccattttgctttcccattgaaaataaatgagatatcataaataaaagctcctagcacagtgctggcatacatactagccttctggaaaatgtcagccctctctctctctcttttcatttttcaaattatccatcagtctctgctttcaaaatcatattcatccttcaagacccaatttaaatgtggtctgtttccaaaaagccctgcctgatcacataaactagaggtaatttctgccccttcctgaatcctagtgtgttttgtttatgccagcctgatagtagttacaacatttgaccttgaactccagttatttgtatccagtcttttgtcttccgcctaagtataaattctgagggtggacacaattctgtttgccacatcatcccccagcaaagggcttgacacataggtgttacgcatgtgtgagggagcgagtgaattatggcattttgtagcagatttatcttctcgtaattgtctggattaaggtaataaaaattattttgtgttccctaagtgcatcatacttgtctgtgggagtgggaattctggcatgatgttaggctgagtgatttacaagctactctgggattgcaaatgtgagatcaaccacagagagaaaaatctacaagataatggctttatgtgtgttgctagtccttcatagtttctatgtttcttttgatattaaaacatattagctataaaatgaaaccggtttcattctttttgtttttattgtcttcagagctttgaaattttacaagctattgatttgggttataagccacactgaggccaaaacttctgagagggtatttaattttcactgcatctttggaaattggcccaaataattcccctttcaacccatggcactggtgtatgacacaggaaaaatctgattagctcttgatggttgccaaatacttggttttctcagcttggctgaagatttagattatcatttggggcaggtggcctggaattaggaagaatgtggaaggaaatcaataagggttggtttctcttattattttctgttggcctttcagatattccaccaggaaagcaacaaaattcaattttttatcattaaacttcggggtaatttgtactggttcaattttttttttttggtgagaggactgataacaattttatggaactcttggaaaaaagaaatagaaaaagctattggttaccttttttttttcttcaaagtttctggtgtttgaatttctattctagatggtatttaattccttgcacagcagtctacaggcagcttaatcaaggcggcaggatagtcaagtggatgtaatactgaatgcttggattgatggctttctgttgattaaaggagatagattatatagctaataagaatttgctttagggaataaaatttaataaataagttagactataattgggtattggaataaatttatcatgtcttatgtagtctttccattcagaaaatatttttttttctcaagtacctacagtgtgtatggtactgcatcagggaagtataatgagaagaagtaagaatagatagatgcttagttttgacaaaaacataagactaaaaaggtaaagcgtaaatatattaatgaaaagctatttatttccatggttttaactattttaaaatgacttaaaattcaatctatatttatcaataagccttaatcatatttacttgaaaaatataccaactttcaatttagtaatataaaagaattaaagagccacaatcagataattatgtctcagttaaaacaaattatgccttaaggcaaaattaaactaaggatttagaaatagtaaattatacagaaaggactttattgattaaacaaaaaattgtggggttttttttggtgtatacatatatatacacacacacacacatatatgttttaatggtgaaataaattttatagcaatcataggtgaatactggttaaggaaattactgaagtaaatgtgttttattatgatgtattatttttattctgagaaatggaatatgcctcattgaagcatagcgttttcttattaaataggataatgcattgtggcactttgaaacccaccttgatatacttataattttagaatccacttccttatttttctggtcttagatattttattaagtttgtttgtttctttctttctttatttgagatggagtctcgctctgtcgcccaggctggagtgcagtggcgcaatctcagctcactgcaagctctgccttccgggttcacgccattctcctgcctcagcctcctgagtagctgggacttgcctgtcaccacacctagctgattttttttgtatttttagtagagacggcgttacaccatgttagcccgcatggtctcgatctcctgaccttgtgttccgcccgccttggcctcccaaagtgctgggattacaggcgtgagccaccgtgcccagccattaagtttacacttttagagttatttaaagacataagtaaaaacactttttataccttccacagtttattgggtcaacctgccatattgaaatcagatgcttgtggaagagattgagatgtatagggtttttgatggtttggcatagggtgtttacctctcgcaagctgttggtgtcactgctggctttccgagcctcagggaggaagagtgttgctattgtagtgaaagctccaccctgtttgttaatctgtcttaactctataaattatggactctgagacttagtctaattacaattgaaacgattctgaagcattgtaatgcagtgaagtattcaaagtaatatgaacattgcatttacatttttctaaatgtcaaattgacatcattctggcctcctaccatggcacaagttttaccaaataatagctaatctgacaacatgtggtacactccagtattttgttttccattctatttcattccatcccactccattccattccagtctgttaaaaaaaaattatttcacaaaccatttgaggaagccttaatgtgagataactcacagtttgagaaacactggttcacttaataaccacctacctgtatacagcactcttccaaagaagcagtctttgtcctttataaccgtacatccaaagagccattttattttttaatttttaaaattttctatttacgtattttttttgagacagggtctcactttggcacccagactagagtttagtggtgccatctcggctcactgtaaccttgacctcccaggttcaagcaatcttcctgcctcagccctcaagtagcgaggactacaggtgcacgccaccatgcccggctattttaggagagacgggtgtcaccatgtcccccaggctagtctcaaactccttagttcaagtgatacacccgcctcggcctgccaaagtgctgggattacaggcatgagctgccatacctgggccaagcagcctttttatagcatactttttttcattcaggcaaagaggtgtaaaatcaaagagcctaaataaaagattaagcaggaaagtgtgctcatttatatgaaaaagctcataataagaacatttgtggagtggaacagtaaattctctctcgatcagccctggactctattttggtttctctctggctaggaagaactatccctgcaaaatgtttctgcatttgaaggtctcagaagctcccgcaggcacccacatggcctccatcagtatagcctgtcacctctcctcaaaacactagagagatgcggtatgacctgtatccctattctgggatttgggttggaatgaagacctagaagtctcagaaggacttcaatattagagaagtagaaaattcttgtggaatttagaggcagttggtcatcctggaatttgagattctaaattttaagagccctgaataccagtctctggattcatccatttcacttctgtccattgtcagttgaaattcaggagtgacacttagaattcctgacaaagagtaaagactggcctgtaggagcttccttgcttaatgaatcctgcagcgaaagtgggtctgtcaagctgtgggccaggtgcccaagtagaagtttaaaccaggagtaaattctgtaaggccagagagtattctgcccatcctttaataacctttttgcatgtgtcccatgttccctcctactttctgtattggatactttcaatatccaataaccaaggatattgaatggaggtgaaatagcaagaccaaaggcctttccccacctccccccgccccttttttctattaaagcatttgcttaactgccttgcttgtgtgtatgcatgcctggtctctatatagcttcctgttttaaggtcctttcagggcaggcatgccatcaatctttgtgttgtttctagatatcatctctgtgtgaatgttgttgatgctatttttaacattgcatcctttgtgtgagctgccacaaggctgggatgaccaaatgtcctgtttttatcccagatttttcctggttaatttccactcttttgtttgtgatacctagacatccttttgagatggcaaaaggattcgtttctgcttcattaactgtgatgaacctaaattcaagcagaactgtgcctttgaaacagtgtgacttaaacctcttcagcaatccctgtagttaagactaagcaaccacagagaaaatgtcctccggctctaaagtagggggccagtttacatggatttatgagatcctatcaaagtgagaagtaacctttgtggcagtccactgttttcctaatggtctaagggctgccaaactcccaccccatgctcgtttcatccttgccttcaatgcagatattaataaatctgcccgaaatgagatttttgaaagcctttcaggctcacaatgatgatgcttgtatgaagggatcccttttttcttctgtctgacttagtcttctgcctccagaccctgcatattttccctgtaggacactggcgtctttctagggatagaatttaaaagcatctcctcctccccccataccaatagttcagtttgaaaccatgaagtgtgttacaaccccactttgtgcttttcccttcctccttttttgtgtcattagtgttcatgtctgtctctcctattacatctttaagggcagagactatgccatatgatttttttttctctttctcattagctgacatgatttttggttcattataggcacctgataaatatgttgtaacaaaaaaagtgaataaataatgtatgtatcacattttagctgtttcctgcattgtacaatgcatgcatacattcactctatctttgattcatttagtcaaaaaacatttattgagaggtattgtctttggggctggggatatgaggagaaataagacatgggcacccttaaggagcccatggtttattgtatgagaaaatagttggtttcctctctccttgtcctataaaaccaagggcaactaagtttcacatacgggtgaaggatctaccctggagtttttgtgttggcatccccgtatcctggctgaattgcttgcctccttttgcccttcccaggtacacagggaatcacatggctgcatatacttgacactgtagtcaccatggagtgatttattagttatgggccacagcgcttttaaaacaatctcaagtgctgaatggagagctgatctcatctagtgagcagcatgtatctcatgctgtgagttttagattatttcaaagaacagaagacccctcaaaaactacaagaagcaggatcacatttgttagttttaagacatatttatggcatacggccggccatttcctttatgtcacgtaggttttcactattatcagcctccgtatttctatgccaacttgaccattgtgagaaatgaccctatttattgtctaaaatactggaagtcaaatggatttatttttggtaacttttactgaggtaatgacttgacataaaataaagactctgttccagagactgtgaattactgcccacgcaaattcaactttgcaatgccattaatattttactgccacagtgaacaaagttgttaaatttaagtcaagaattattggttccttttggtaggacgcgtctgtatttttactcagcctctgtacattttatttttccccacatttactaacttaaaacatgacctacgtttattttgagagtgtagaccagcattgagaaggcacatactcagagcgtatttttttctgattcaacctgctcttgagattcctttataatttgtgtattatttagagtagtgattttgatatccatcatcactagcttaattttacttgctttacatagaatccctgctttgcttagacagaaaaaacaactgacaaaagcatcacattattatacttattgggagaaccatgacatcttgtttatgttaactagcaaaagacattcatgtgaggaagagaaatataatgtaggcatcttaaaatataaagagaagtgttaagagactccctgtcattggtgagcatagtgggtgtctatctttgagctttgagagttaccacctgtcagatggcaccagggactttttggacctggtacccacttcattccaggctcatattggctctccccaacgggtacctgtactgtcacacagcccccgtcctcatcctgtagtgctccaagactgggatgctgtccaggcctgcagcttcctggattgctctttccttccaggtttgccaggtgacctcttacccaacattcaaactcggctcaaatttccctgaatgcgggaagcctcccctgacctttccaggcagagttaaaagtggctccgtgtctagatgtgttcaaggccctgttcatttggatcaggaatcccaaggacttgtcactgggggaatggctttactgaaagcccaagattatggatatgttaatgcatttgcttcttcattttatcccactataaaaggtgtgacagaggattgcattttgagtttggtggcatgagatctagtctctgttctgctgctagggtgagtaacttgggggaaatgacaaccccataaaaggaggaatgttgtcctcctctgctgtttatagatttctacatatgaatgagctaaaaagctgcttgggatcttttgttttttcttttacttacatttgaaataattataattatagactcacaagagtctacttccacatgaagaaattttatgtacccttcactcagctcccttaatggtgacatcttatacagttatatcaaaaccaatttattaaaattggtacattgttgttaagttagactatatggcttgttcagttttaatcattttgtacacacactaatgtgtgtgtgtgtgtagttcattgcaatttagtctcacgtatggtatatgtaacgaccacaataatcaggatacagaattgttccatcaaacaaaagatcttcccttatgctgcccctttataggtgtacccatccctccactgttccctggccactaataaatacttgtttgttctccatctctttaattttgtcatttccagaatgttatataaatggaattatactatatataaccttttgagataatgccttgggatccattcaagttgttataaatagttcactcctttttattgctgaatagtatcccatagtatgcaccagagcttatttaaccattcacccattgaaggacatttgggttgtttgcagtttgggactgtaaaaataaagctgctaagaacattcatgtacagatttttttgtgagcacctaagtgtttacttctctgggataaacacccaagagtgtagctattaggttatgtaagtgcatgtttagttttataagcaacacccaacctgctttccgcagtgactatctattctacattttcaccagcagtatatgagagggatcagttttttttaattttttattgatcattcttgggtgtttctcgcagagggggatttggcagggtcataggacaatagtggagggaaggtcagcagataaacaagtgaacaaaggtctctggttttcccaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacagaggacatgtttcagagagcacagggttgggggtaaggtcacagataacaggatcccaaggcagaagaatttctcttagtacagaacaaaatgaagtctcccatgtctacttctttctacacagacacggcaaccatccgatttctcaatcttttccccacctttcccccctttctattccacaaagccgccattgtcatcctggcccgttctcaatgagctgttgggcacacctcccagacggggtggtggcctggcagaggggctcctcacttcccagtaggggcggccgggcagaggcgcccctcacctcccggacggggcggctggccgggcagggggctgaccccccccacctccctcccggacggggcggctggccgggcagaggggctgagagggatcagtttttaaggggagagtaatttaacactgagaaggtcatctggttacagaacttagaatcttttaggattggggaaggagagtactggaatctacccttgccagaagatattaagagactctttaaattgtgtgtttgtggtactgtttgtctaactgaatgttgttttaagtaaatgaggcataagcttaggctgccctccaccctcacccccgacagagtctcgctctgttgcccaggctggagtgcagtggcacaatcttggctcactgcaacctctgcctcccgggttcaagcaattctcctgcctcagcctcttgagtagctggaattacaggtgtgcaccaccatgcccgactaatttttgtatttttagtagagatggggttttaccctgtaggccaggctagtctcaaactcttgacctcatgatccacccaccttggcctcccaaagtgcagggattacaggtgctagccgccgcacccagccaagcttaggctttctttacaaagcacacatactcattggtgatgtagtattggtttactttgttgttgttgtttttatttttatttttatttttttgctataaaaatttaacattttattaaatgaatttaatttttaagcaaattctatgaatgttcttcaaaataaagaagtttttttttattattattatactttaagttttagggtacatgtgcacaatgtgcaggttagttacatatgtatacatgtgccatgctggtgtgctgcacccattaacttgtcatttagcattaggtatatctcctaatgctatccctcccccctccccccaccccacaacagtccccagagtgtgatgttccccttcctgtgtccatgtgttctcattgttcagttcccacctatgagtgagaacatgcggtgtttggttttttgtccttgcgatagtttactgagaatgatgatttccagtttcatccatgtccctacaaaggacatgaactcatcattttttatggccacatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggagtggccacactgacttccacaatggttgaactagtttacagtcccaccaacagtgtaaaagtgttcctatttctccacatcctctccagcacctgttgtttcctgactttttaatgattgccattctacctggtgtgagatggtatctcattgtggttttgatttgcatttctctgatggccagtgatgatgagcatttttttcatgtgtcttttggctgcataaatgtcttcctttgagaagtgtctgttcatatccttcgcccactttttgatggggttgtttgtttttttcttgtaaatttgtttgagttcattgtagattctggatattagccctttgtcagatgagtaggttgcaaaaattttctcccattttgtaggttgcctgttgactctgatggtagtttcttttgctgtgcagaagctttttagtttaattagatcccatttgtcaattttgtcttttgttgccattgcttttggtgttttgttgttgttgtttttaatgttttcattagcagacattcaatgtgagactgctggtactagacactaagcggggagctgatctaatatgaggaattggaagtcagggagatggtgtttaactcaccactcttacccattttaactgtaggtatttttgtgagctttaccttcatctctaatgtggagatgataatacccaattctctgggctgctgtgaggactaagcatgataaataaataaatagcatgattcttgattatggtatgcacccagagagcctctgtccttgaagatttcaatgttatgccattttgattaatttttatgttgattagaaatagctaatattttcactcgttttgcagaagagagaaaattccattgatgattcttcaataataagaatagtgtaggccaggcatggtggctcacacctgtaatcccagcattttgggagaccaaggaggatggatcacttgagcccaggagtttgagatcagcctaggcaatatgacgaagccccgtctctacaaaaaattagtcatgcatggtggtgcatgcctatagtcccagccacttgggaggctgaggtgagataatctcctgagacagggaggtcaaggctgcaatgagccatgatcacgccacagtatcccagtctgggtgacaagtgagaccctgtctcaaaaaaaaacaaaaaacaaaaaaatagtgatgatgagcctgccatttattgagaatatattgagtgcagtgccatgcttgttaagtatgaattacctgtctcacttaagctttatagcagatctatgactagatactcttacaatacctgtttttcagataaggaaaaccaaggcttagagagttaaataacttgatgaaggtcacatatcttgtgaaactgaaattggtaacccagtctgtctgtctctagttttaatcatgtacctgtatctattccttagtattgattgcttcttcaaaggccgttctctgcatggtataaattataactgaagtgactttatactaagcaacaccagatacactgctgcattcattgggagacagcctgtaagaagtacaattgagctttgtctacaggtcaatggaagcaaccacacaaacaaaatgaccttgcgtttcagaaagaaagactctgaataattttgatattttttaaatagctggtttggatttttgagaggcaagacaattactctaaatgacatgatagagagggtttgggatcatcctgatggggcagggggggagcattgtctctgaaaacatatgattttcccgacacactgtaatttaattcacaaagatattatagaaaatagtggatattataattacctgagagtaaactgacttatccctttattcattcatatgtaatttcaaatttggtgaagctgtgggattttaggcttgttgttttcacagtgaggccttggttaactcagtgctttagggccatgcttgagacttagggccctgaagcatccttatgaaaacatctttttgatacatagtaaaccaaactcatgtttatatgaatatctcatctaagtctgttatttagttcttagcacatgaatagattcaaatacagcctatgttttaaaagtttaagcaggttattgttaggaaggtggttaaaaaaacgaattatatatgaaatgtatcagtaaacatattgctttagtgaatgtgggttccttcaatgaaaaataagcaattagctaagtggttttcttaaaacactatgggccaggcactgcgctagacagttgataatacatgattttattttatccttaaaacggccttatgaagcagttaattatgttattcccattttataaatgaggaaatgatatttcacgtcacatggccagtgagtgggtaggcctctcttcacttattacacttctgcttctaagctgtgttctttcctgtattacactggaggaaggagaaaaagaacttgtatttggtccttgactgggtggaatatcctttaatgtggctgtaaggacatgggtagaatactctggtcaattcatttcttatttaaatagtgacaaaggtatgtccatgttaaccatttctcacttatgctttatacataaggatggcttatagggaatgttgctttattatatcacttaaaatgtttggtcaggcaatagtgactcatgcctttaatcccagtacttttgaaggacaagtcaggaggatcgcttgagaccaggaactcaggaccagcctggacgacaaaacaggatctcgtctctacaaaaaataaaatagtcgagtgtggtgatgcagtattgtagtcccagctatttgggaggctgaggtgggagtatcgcttgagaccaggagttcaaggatatagtgaatgatgatcgctccactgcattccagcctggacaacaaagcaaaaccctatttctaaaaaaaaaaaaagtttttagtttcttaatgatcagcaaaactaataccctatcctcatgatacacttctgaacttctgattaatagctcgtgccagggcagagtaatgggtgtgccatataactatagacagtccttctgttacttctagttagatcccttttatctggatagattctgtctgttaagatttaggatatattctttagtttttaaagcaggtttttcttccttatgatagctgattctggggataatggaaattaatttgcctgccttgagttatagcagaagaatgtgacagaagatagttcaaggctgtaatggttctggaatatacaagttgccatgggtattacacgggttggtagtagaaaatttattgagcaaatagttgatacattggatagactcatttagaaaattatttcctcttttatgcaggggctaagaggtttcttgacttgatagctaaaattccagaatctgttctttgcttgaatgattgaaatgactggtgtaaactgcaatcacttaactagacttttattttgactttgagtcaaagatgtgttcatggtcctttttataaaggccatgaattttcatgttacttttttgtgatatatgttaaatttcttatccccgtgttggggttcagaaacccatatccccaaatacggcactttgacatgctgaactgaagaagcctcaaggtctatgtgaccttccccctttctcctcagccaccatctctcccaaacacaggatgaagttaaagttctttatctgcctaaaatccagacccaccaaggagatcttctccatcttattagaccaagatgtaaccacacctgaatggacattttcccaagataatgtctgagttaatccctgctccctgatccattcattctccctcgcaatccctttaacagaattcctcttctctccctgctattttgccaggaaggcatagaagcttctgactctagttggggttttgtggttctccctgtgtatacattaataaagtttgtatgcctttgccctgagtaatttgccttctgagaattaatttttcagcagaccttcagaggggaagtttcccttggcgtctacacctcatatgagaaaattggaagtgatcttgttcttgactacataattagggaaatatgggcttcagtgtatatttgataacttaaagatagtcactcataagataaaaacaatgtttcaactttcaaaatactaaaattaattaaagcagacaaaaaaactagtctttataacaacatagaagataaagtatatagcacataagcatacaacaaaaggatgaaataaaaatgacaaattcaaatatatcatcctctcaataaatgcacttgggctaaacactagagggttaaaactcagattgagctttaagaaatccaactaaatactgtttataagaggcagtcttggctgggcgtggtggctaacgcttgtaatcccaggactttaggaggccaaggtgtgtggattgcttgaggccaggagttcatgaccatcctgggcaacacaagaagaccccatctgtattattaaaaataagaagaagaagaaaaaagagacaatcttaaaacataatgacccacctctaaagtagtcagattcaaagaaacagaaagtagaatggtggttcctagaggttggggggacagaggaaagaggagttaatgggtatagagtttcagttttgcaagatgaaaatgttctggagatctcttttacaacaatatgaatatacttaacactactgaactgtacacttaaaaatgactaagatggtaaattttatgttttgttttttaccacaattttataaaaatactaaccataatgacccaccaaaattaaaaataaaaagacagggtaagatctattagcaatggcaaatgagaatcaagtatgacaatgttaatatcagacaaagcagaatccaagggaaaacttaaatgtggaaaatattatctaatattgtttgcagcatttttttatagtcaggagtaaatgtaaatcaaatacttatagaagtgactggagaaattgattttaatatagaattctatactatatactctgtaattcaaaaagaagagagtatcatctgtgtttaataagagatcagatataattttgcaccaggaaggtcatgactttgataagagcagtttcagcgcatgagtggggtcaaaaccactggtctctcaaagaagaataaaaggaaaccagaaagggatttcatagaccctgaatatctgtatgttggtccatgagccttcctgcctagagttattttctttgctgtctgcaaatgaaatctaatttttaaaagttaaaagcattcaatttgttgctattctctctcacattagagtggggtgaagatttcctgaacaagggtgatgaaataatgtaggtgggaagcctagaagggaaggtttctgaaagttaaagaaaattgaacctaatgctaagaggtcagtgaccgagagaacataaagtggacaaaagagagaaggaaccttgcccctgtggatttgtctaaagctatgttaaacgttttgttgatggagatggacctttgtaagaagcactaggagcctgtgctccgcagaacacataggggaatgtggggaatctaataacaggatagcatcctgttactactccctagaaggaagaagacttcttggagatcagagtctttatccaaggatacagaaaatatcatatctggtagagaaataccatgagacgggaagggggcatgagatttggagtcaggctgaccaagttcagatcccagcacttccacatatgagatgataagagagttatttagttttgcagttttatcatgaggatataacatacaaaaatatctagcactgtgtctggcatatagtaggtactcagaaagtgacacctgctagttaataaatgtctcctttatgctaagatgactgagatcatggggtgaattcccttgatgccagtctcgtaggctgaatcctctgttctcaaagaatgaaaaatttaaaggtacttcccaatccccctacagtcaaatgactgcagtgacctaactttgataattatgtatttcaggccttggaatgtccaactgtttctccaaatgttgaattattctaaaattagcaaagacttgttgaagaagctcacaagatcatggaatcaggcctctgaggtcattaatattcagtagatatattgcttatgagcctggaaggaaagatttgcaattttatatagtataatatagtatttgctcttggtatcaacctaaattcataaacagatgtgtatatatctctatttatgtatattgaagtctgtattgtgagggtgaataattagaagttgactttatgtcaaaccaggtttatagaattcagatgtgtccccaaaatttgtcctcttctagatatgtccatttacttttagtatgactagtaggaacataggggttttagtgtctgattttgaggatataaacacaaaaaaagtattttttctcttttgtctagattactaatccagacaatgtaaacctcacccaaaatttgtgaaatttgagaccggatttctttttcatggcattacaacattattttaaaatagcgctactaaacagttttatcaaaaaattccaacaaatgacatgtggcccagtggatgaaaaaaaattctgcaattattaatagatgtttttactgttcagagttttagctgttatttgtttagtaatgttggtgtttgtatgtaggctttgaggcaaggggactaattaggaattctctgtaataatttaagtgaagcttaaattattaaaaagagcaatcttgtaatcccagcactttgggaggccgaggcgggcggatcactaggtcaggagatcgagaccatcctggctaacatggtgaaaccccgtctttactaaaaatacaaaagattagcctgttgtggtggtgggcacctgtagtcccagctacttgggaggctgaggcaggagaatggtgtgaacctgggaggcgaaggttgcagtgagccgagatcgcgccactgcactccagcctgggtgacagagtgagactccatctcggaaaaaaaaaaaaaagccatctacccatttattgagcactaaatatacgccaggcactgtgcttcctgcctttgtataatccttacggcagctgcatgagatgggttccattattatccccattttatagataagggaactgagactcagaagaatcagtgagttccccaaggccacagaagggtggagctgggatgtgaacccaggtttctgacttcagaactcagacttaataaccacccggttctgtttccttatgaaagggctgtgtctccaatgttcgtttagggcacagttgcttggatttggcacacatgttgccacagaacctatatttcaatcagtgttagacgtttgggccaatattaatgtgtcagaggtgtctgagtgccaacagcactgtagatctgaagccatcctgagatggtgttgggcttttaactttggcgggccagaactactctttcctcagtgttgtcttgccctggacatatttgccctttattgtaccccttcacctactgcctggactggtggggatctactgccacagtggggtgggggcagaggctaaaagcggcagggtggggtggaatggggcggaggcttctatctggcaaagcttctgggattctccatttattcagttctctgtcttcctctgcttccctcccaccctgctgttttcacttcttgtcttggagagtgagtccttctggatatctcttctgctgctctgggtccttgatggaatgacataatgacttggccattgtctatgggtgtttttactgccaacaatgattggaaacagcgagccaaagtgactagctctggtcccatccctgccccattttttcacatagatacacaatttcattagaaaaagatgaagatgcgtacgagctatatgtaggccactgaatattcagacttatagggaaaggcacatctacatttagggaaaaatgaagttttgagtcttctgggtggttattgaagaaactgggctctgactctgtatgtacaacagatggagagtttgggagcatggcaggggtgagctggagggctaacagtttctcctgcttcctctccccttgccaaacaggcttgtttgccaaactggcttgtttcattcatagattgaagacaggctcaggactggggttgaaggggttagaagagaagatgatcttagcatcttggtctatattactgaagggaaaaacgtaggaaggggagtttgaagtatggagagaagtcccagtggccactcaacggtgaggtacagaaggaaggcttttttggcaatggtttctatatagagtcattgagtattagttactctatatttatacgaaatgtgaattttattttggtgtagtatctttgggtagattgagaggccaaaatatttatcttgttttcaaattactctgaaatcttacttctttactttatcatcatcttgcctgtctcttttgaatgattttcatttgaagcagttcaattaaatcttgttaagtatgacaataaattacttagtgattcctataaattctctaaaatacaagaaggagaaaattgaatatagcccaagtaagcagcagggatttttacagaaatgatttcttcaatcttgtctccatggttctgttgttattcttttataaaaggtctcaagaggaggagaaaaaaatataggagacaaaatatatatatatatattataaataagaagtctgcaagaagatcagagatttttgtggaaaatggggacggttcaataagcaaaatgaatttccttacacaatagctctgtattttgtgtagaaaatcgtgcatggattttcctggctctggaggaggaggccattctttcttatggtgatatgagaagaaaggttttaaagagttgagtggagagaggcttttagaaagtgcagtgatgtctttggatgtccaggattgactcaaggtaaaggaagaggcatgtcatgaagcttggtcttagacctaagcttctatttggaaatcaaagccataagtcagttctgccataacacgaatgctgctctcctaaaaaatcaccatgccatacaataacacaacaaaaccacagtacttatgaggcaaacagacgcaacatccaaaaactttatcagcaatacattttacaaaaagaaaaggtggctgggcacagtggctcacgcctgtagtcccagcactttgggaggccaaggcaggtggatcacctgaggtcaggagttcgagaccagcctggccaacatggtgaaaccctgtctctactaaaaatacaaaaattagccaggcgtggtggctggcacgtttaatcccagctacttgggaggctgaggtaggagaatcgcttgaaccctggaggtggaggctgcagtgagctgagaccacatcactgcaccccagcctaggcaacaagagtgagtgaaactccgtctcaaaaaagaaaaagaaagaaagaaaaggtatgaagctaataaaagtggtagcatggttgtacacatgttcaatggttatgaaatacacaaatactacgataaatatgacattttgactttaaaaagacctgaagtttatttgtgaatgagggctttagagggctgcagcttgtgagttactgtgaaaaggtgggagcaaagctatgggactcccaggaaggctgttaacaccaggtatcaatgggtgtggcttacaacacaggcagtgaactgagatggttgctggatgttttaaagtgtgtgcacaggtgtgttttgtttgttgttgcatggcttggttcacctgggagtcttcagttactgtttctttcagaggaaacacactaaataaacatgaaatttgtgttatgctcaaattgttcccttttaaaatcaattgcattagaacaaatttgtattttcaaaacaagcattagagagaagtgactgtactggccgggtacagtggctcatgcctgtaatcccagcactttggagatgaggtgggaggatcacttgaggccaagatttcgagaacagcctgggcaacaacagccgactctacaaaaaagagaaaagaaaagaaaactgtacaataaattcttttgactttgtttattctctttgatatttacaaaaatataaatgcaagtcctttagttggtctaaagaacaggctcttcactcttcattgccttggttatgaatatgttataaacagaattgtggccagagctcactctttctgtagttacaaagtgatgtttgcagtcatttgctaatcttaggttttctcttctggtttccccacttgtgacacatgttctttgtggcggaaaatggggcagggatgctggggctggcagttgcttttctttgatgtatgatcgtaaggtgagcattttttagtaaaactatgtattcaagtgtccatcaagggatgaatggataaacaaagtgtttctatacaatagaatattattgagccataaaaaggaatgaagtactgatacatactacaacttgaatgaacgttgaaaacattatgccaattgaaataagccagacacaaagggtcacacattatatgatttcatatatatgaaatatccagaataggtaaatctgtagagacagaaagcaggttagtggttgctgggggctggggagaggagggtggagggtatgaggagtgactgctaatgggtatggggtttccatttggggtgttaaaaaagttttagaactagatgatggggatggttgcacaaccttgtgaatgtacttagtgtcatgagttgtacactatttaaatgattaagatggtaaattttctgtgatgagtattttaccacaattaaaaaataggccgagcatggtggctcatgcctgtaattctagcactttgggaggccaaggtgggaagatcaggaaggccaggagtttgagaccaacctggacaatatagctagactctttctctacaaaaagtaaaaaataatctgggcattttgacttgtacctgtagtcctgctactcaggaggctgaggcaggaggatcacttgagcctaggagttagaggctgcagtgacctatgatcgcaccactgcactccagcctgggcaaaaaagtgagactctgttaatagatagataaatagattacatagatgatggatggatggatggatgggtggatggatggatggatgaatgggtggattgatagatggcatatgttggatctctgtcctgggcatggcaccatgcttagcatggcagaggatacagtgaggagtgaggcaaggtgctacctccaaggagtctgaagcgtagttgaaagatgagataaacagaacaatagtcagactgcaagacagaaatgaaatgtgccatggaggaggtgagaacagtaggctgcaggtgtccaaagcaggagtgcacctgttctggaagaatctaaatggtgttctttcaggaagtagcacatcagatggactcactgcgtctgaactgagtgtcacctagatagcactgaaaaatatctattcctaggctaggccctattcaaattaagtaaaagtctctaaagggaagagctttggaatagatttttttctgtatatattttttaaagattgccaggtgattcttttacgcagccattggtgcaaaccacaggttgaaacaacagtcagatattgataggtgtattctgggcagagggaattttaggggcaaatgcccagctgggagagcccaaattctgcttgactagatattagggtaagccagaaataaaaatgtctgcagtatagatagactggagagaggcaggcctgttgggaatgggttttaatggtctttagtaggtgctctcaaggtggagtctaggggtccctgagacccttctggagagtctgtaagggcaaaattattttcatgataattgtaagatgttgtccgcctttttactttggatttgatgtttgtgtcaatggtgcaaaagcaatgctgggaaaacttctggctacttagtgtgaatcaagaccctggcaccaaactgtagtgattgtaatttttacctctttttgttcttgcagaaaaaataggagtttcacttaagaatgtccttgatgaagcaataaaaatctcagtccctcgggttcacatctttttaatattctgtgggacaagataggaagcacacataaattacttgtgctgtgtactagagaatgctggttgtcttgaggaaaaacacttccacaaatattagagtgaaaacaagtgaactagacagttttttcatggaatatcattttacttggtagactgacacacaatagttactcagactttggtgtttgacagacatttttttggaaatgaataacaagagcctgtcacttcaaggtaaacagttgacaacatttattgccaatgataaaatttgaactttcaagcaaaaatgcaaattttggaaaatgtgttatttctgccactgagaacataacagcataccaacacttttagactttttacttttatattgtataatgaaatgcatcaacatttggatgatctgtattacaggtgaaccaacattttccagtattagtggtggggaatgaccgtgtcatgaaggcttgaccaggatggggatagctcaaggaggcaggatggctcattgtttatgtcttcttcaggaacacaatgaagtaggttgagtttccaggatttggcccctgcattggggatggttggaagaaaagccaaaaaccatagcttcttcaagccagtggacttaaaaaacagtagtacttttaaagaaacaaggaattcaaggcaagagctgtttgtggggctaggggtaaagaaaaatgatggctttgccaaaatttgctaaatttatatcaggctgggtcctgatacacatttctaaaaatccaggcgaagcatggtggctcatgcctgtattcccagtactttgggaggacaaggcaggagggtcactaaggccagaagtttgagaacagcctaacaacacagcaagactgtctctacaaaaaaaaaaaaaaaaaaaaaaaaaaaaaaaaaaaaaaaaaaaatcagccaagtatggtggtgcatgcctgaagtctcagctactcaggagggatgaggattgtttgaggccaggagttggaggctgcaatgagctatgattgcacccctgtactccagcctgggcaatagagcaagaccctatctctgaaatatatacatacatattttttaatttttaaaaaattctttattgaatttttggaaaagaagctaaacatattaaagcttgtctacttgggggagacttttatggagtaagatacagagaaaccaattttccaatgtgatttttttctctccttacctgccttaataatcataatttccctttaaaaaaaatcttttgtggtactacaatttagtcctctctggcccactgaccttagtgtcagaacccctgatcttgtgcagagttgccctctcctcctcatcccagctgttttaccagggtcctagttcttctgttgttcctacacactacaaattttcttccttggtcttcaatactggcgtttgtatttgggaactcacgaacagatctctttggcttttaaactgctagaacttggccaacaccccactttgcctcaggaatttcctaataatggctcctttcaccatagcctctgacctaatttgttgttgttctttatttgcatgctcgtttttattgaatatgcagtagtataatttctctttcctattagtaatccactcctgccttctaaaaaccctagtcgggaaaaaatctgtggtttcctgagtacacagtcagctgtttcacaacaacagcctgtcacgtccttgaagacagtgctgaggtcagggatacaagaattgaggtagaaactggaatagaatatgcaatttttctgtgtgggcaattgggagagatgagaggctactgaaaggtacctgaggaggaatcaagagccaatgagattgagaggcctcttgtgtgagccactgtttctttgctataaagaaatacctgaggctgggtaatttataaagaaaagaggcttattgggctcacagttctgtagactgtataagaagcatggttccagcatcttcttttgtttttttttttgagttggagtctccctctattgcctaggctggagtgcagtggcactatctcagctcactgcaaccttcacctcctgggttccagtgattctcctgcctcagcctcctgagtaggtaggactacaggtgcccaccaccacacccggctagtttttttgtatttttagtagagatggggtttcaccatactggccaggctggtctcgaactcctgaccttgtgatctgcccgcctcggccttccaaagtgttgggattacaggcatgagccaccacacccagccagctccagcgtcttcttctggtgaaggcctcaggaagcttacaaccatggcggaaggtgaagagggagcaggcgtttcacagggtgagagagggagcaaaagagatgctatgttcctttgatcaaccagttctcatatgaactcattacaacagtgaaggcaccaagccattcatgaaggatctgccgccatgacccaagcccagcccactaagcccacctccaacattggaggtcacatttcaacatgagatttggaggggacacacatccaaatcatatcacctctcatggggaaggcaaagagagggtaagctggtggctagaaactaaaaacaaagatttgagaggagagagatgctacaggtgttggtacagttgtgtgggtgtgagcatcctggcacttccactcacttcccgtttactgtgagcagaattttctggatgggtgtggaaaagtcttcatccaagttgggtctgagcagaatcacagaggctcttggaaatggcccatgtggattttatgtagcctactcaactcttttttacatgaatgaagaagtctgtacttatttaaagtatctgacaattccaggttaggccggcaggtcctactctgcccagaacagggacctcgcccctggcccttatattaggaacttggtcctgtgcaggtcaggacactatcacatgagttctggagagcaaaagccaaagatggaactgaaggttagggagtgatacattttctgaattagagctcatgaacattaagatggttaaatatgaaaaatagaaattactgtctagaattaaaataaaaaaaatggcaagataacaaaagacttgtgaaaatgcctaacataggtgtaagttcaatataggctaaatgatgtcagtataaactggtggttttccaccaatttgtgaaattaaagtgtttttctcagcttgatatggatacacctgagacccccgcctatgtcctaaggagaagaaggcagaaataatgagaactgaggccttccctaccccctccctccacacacaaggtgggtcatacccctagcatcctcatacctacctctcagacctcaaggcttccctgccccactggagatggcttttcttccccagagtcctcacaacccctcctgggtgtcatgtgatctacttgaatgctgtcaggcactagctattgagcttgtgccaggaccagaggccccagatgtgatgaactaaaagaccactcttcctgtacctcaatgacatcacctgcggtgggtgcttttcagaaatgatcacaccctgtttctgatgtaggtcacccgcacgccttatactccactcaagggtggacatccaaggggcaatgggggtttggggattcgttagaacatgggcagggattctttttgctgaggtacaggtgcattctgaatggggaagacgctggcagggagtgagggtccgcacatttccgtggggagcggagttgcccctgtgggacagcctcctcctgcagcatgtaagccacccctccagctgaccaccagtctgacttccccaagcagtggatactgtgtctatactggaagtgtctgaaggagggtcctcagagcagcccatgatagggttgaggaatctttaatctgaaaggctacaatccagaagtcactccaggcagagatgaggtctcccctgaaagcagggccaccacctctttggctcagagattcctggatgactcccccatgcatgacacttgccagatttgtcctttaccctgcctctgcccactgatgaatgtgacctgaagatcgtgttcaccatgtggctcctccctggacaggcccaatgtcagggcactgatgcaggggtaataacatttaagtgtattctatcccatttggttttttggcatacctagtcatgtctctgaagactatggctctaagatggatggacacgtagtagatctataaatatatcaccctggactcaatccacagagtgatgaatgtgaaaggtggtttgcatgccactgcacaaacccatatgaaatactcatcttggacttttaatcaaaattgaattctgcaagtgttagcaatgtttttaagagcagtttttttagtatttaaattttttacctttattgggaagttatctgttaggataatacaatttaatgaaagaaaacaatagtaggagacttggaagctcctattcatatttggcagccctttggcttctctgagagggcatccacaaatgactttgctatggatacaatgctgtgttcaaagatgattttacggccgggcgcggtggctcacgcctgtaatcccagcactttgggaggccgaggcgggcggatcacgaggtcaggagatcgagaccatcctggctaacacagtgaaaccccgtctcctaaaaaacacaaaaaaattagccgggcgtgatggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaagatgattttactgcagcttaaaaaaaaatagtgctatatatagaaatggactctggctactcacaaatatgtagcagttgtccaataactaccttctcttcgaacttgttaaaacttgaggactttccttttctgcaggggcacactatcgctgaaaatcaatacattcttatttttagttcagtagttttaccttgagagagcaggtagcccaggagtttctatcatgaaagctagttgcatttatgtgagaggtagattgcctgctttatagagcattttcttcaaaagaacagtcctgctttttctactttaagcttcccatacattttttttcttctctgtgacttattggggggcctgtggaggaattgagttggccagtgctctatgtcctctggaaacctaactagagggagaagtgtagttagcacttgtcttgggtggtacttgggaaaggttttttgtgtgtttgtttgttttgttttgttttgcgtggggaaataatgggaagaaggcagtgctgcagtactcatgagcacccagcatgctgcttctgctgcaccagggaaaccccagcccctggccatgccaactggcttggcaccatgtggctggggagttttagtcttcccctaagggaagagaacatctcttattgagataaatccatcaagagaggcaaaggcacgttcctcttacatccatcttttgaaatggggttaggataggggaaatttttctccatggctgctctcctcctcccccagtaaaaaaaaaactgggccagatactggaagagatttgtcacctttacatcctggtccctggcagtgctcagaaataaggggtctcgccaaaatcccctacattctacttatacccctaagaagcaggattacaatattcactttcagtgtccatttgcaaggtttctttagcaattgttgggtttccattggcactgaaatgcaatcgtgtgggtattttgacatttgtctttgataaatagaaaggatgtaattaaaggtcagatcttgaaatgagtttttagtttattttggtatatgtggaaacttgctgtgtttggtcaatgttcttttaatgatctaagttttaaatacctttttaattatctaagtttcactgggttctgcaaattaaaggagtataaataaatgtcttattgccagcagggtgacccaacagtatcctcagtggtctaataagaagtagtgtaattaatggtgtaaaatattacactctcttgtttattcattgaagtagaaattttaattcagagggagagtgagtgtctccttggcttgtcctacgaagtttaaaatcagagcaggctaaaatgagggctttgtttagatcagtcactttttattcagttcctagaaggatatgtatcactctagtatagtgttttgtttgacacctaacagattatgtaaagaatataaatttagaattcaggttactatttttttttattagagagtggtatttatttttgcaagctctttagggttcaggatagcttgcagggaaataatgtcttcaacatatatctaagcatgtaatttcagaaatgtttgtattatactaatcttaggctcttataataagtttaaactcagaacttttgtgtgtgtttttcttacaaataggaaaactaagaaactttagtagctctattgctctctataaggtactgtccatattctgaaatagttattgttgttgcatgtgaagtctgggtagttgatgatttctcttttatgggcactcctgcctctgcaaaatttagtataaattcctcaggctgacatttccagcccttggcttgtggctttactaggccctgtcttccttggtcacaggcaatcagcacatcaccaaagtgagtgactggctgctttccagatgctgtatgtacttcttcctacctgaggatcttggtcatgcctagagtaactttttctgttcttccctgaccttcactcttcagaattctacgcatctctagggctcatcccaggtgcttcatccatgttgtctctcctatttccttcaattgaataaagcatcacttttctcttatagtatgcattattagttcctttacagagtggttgtgttcgtctgctggaattgccataacaaaataccacagactgggtggcttaaacaacagacatttattttctcatagttctggaggttggaagtccaagataaaggtgtccataggtttggtttcttttgagacctctcgttttgtcttgcagacagctgctttctctctgtgtccccacatggcctttgctctgtgtgccttcctccctagtgtcttttcctcttcttagaaggacaccagtcagactggattagggcatgccatccatgtgacctcgtttaaccttagttacccctttaaagaccctatctccaaatacagtcatattctaagataccaggagttaggacttcaatatatgaagtttgtgggaacacaagccagcccataatagtggttatttgtatacattacatgtcttctcctctttcctttcccccattagattgtgaggtatttgaaggcagagccttatacagatgggcttattaagtcttaatataatgcccatacataataaatagtctctgaatatctgaagttaattttgattaaatcaacacttcaaaaatttagtgtagttattagacttttatggaaatgatctatagccacacatactacttaaaaaattactttatgaatttggcaaaatgctgccaagtcatttataaaacaacacatggccagaatactaggcttctctgcttttttttccccttcagacttaagtgatactcattgttcttttgcatacacatcttctctcattcttataaactcaaggtcgaaaaaaaggtcagggtggaacttaacatgtccacctcctaaatccgcacaggaatcttcattctctgcattcaactggcaaatgttaaataaagcttggatgtaacaagccaattcattcagctctctggggtagtaacatcaaaggctacatcaggaagccatgctactcagaattggatgttccttgggaatacttatgaagtgaacattggctaggcgaggaatgcagtaactgccattttgaaaacatatgaggcttaaagcatttctgccatccaccgtggtgtagattcctggatgctctatcaaatacatgtctaaatgtcagagcagagtctttgctgcatgctaaaaagaatgccttgtttagctacagcctccttagcaccccacctctgtgtgtatatgcattgttcagaaaggtctggttaaattctcagctttactaacaaggtgctgccctgccatctggttgtctgattttccctgtgttaagagttgtcctcatccgtggtttagaataccagttgtttgaggcagattggagtataagctcaacctgtctgacaaatagcttttattagaaacctgcctaagagaaagaatttagtgtctgcctaaaggacttgtatttattcgtatctgcaggtaccaggttctcataaattccattgtcacctccccagaactgtagttagttgaatgttgtgcactcttctcttgccacaagccacaaaaggaacagccaaacagaatctgttgtggtccgttgccccttacatgccttcccattccttgatagaagataaaggctctggctgggcgcagtggctcatgcctgtgatcccagcactttaggaggctgaggaaggagcattgcttgagcccaggagttcaagaccagcctgggcaacatagtgagatcctgtctctacaaaaattttttcaaaattagccagacattgtggcttatgcctatagtcccagctacctgggaggctgaggtgggaggattgcttgagcccaggaggtcaaggctgcagtgagctgtaattgcatcactgcactccagcctaggtgacagactgagacgctgcctcgaagaaaaaaaaaaaaaaaaaggaagaggaggaagtggaatgacgaggaaggaggaagaggaagaagaaagaaaaagaagaaagaggaaaaaggaaagaagaaagaagaaaccttttataagaatttttttttttttagatttgttgtctttagttccttgcttcaaggaagcataaaccacatttgaaacgtagtttatccaagttaactcatatagttacaatgttcacatttttatttcactctcatgatgatgtaaaaacttcttatatttttaaaaaagaattaagaagttgtacaaacagcacagaggggtctcattacccattatcttgtggtggctactattttttaaaaatgtactttttatttttaaaggattttggattttcacatcgatttttaaatttctttccctaaacatattcctatgttctttattgcaattttccataacttattaagagaaagatggaaaataaaggcagataaataagagaaaatagcttaggaatctgtcctctatgagttaccctaaacatatttcagattacttttcaaggtgatggtgactgggagtttttccacttggatacaagagcagaaaaatgcactcaatatgatttctgacatgtttctgacaatggccagtatcttcctgttttttatgatcccagcagcatattaagctagtagtctttagaggataacctaaaatgatgctttaatccctttcttgagacataatagttactcttgaatgtatatcatcccccagcatgactgatctcatctttgagctcatttactgcttattattgatatatcatttagcattgggttaattatatactaccttatatttttccacctattttttattctccagagctgtgagataagtatttgttgttgaagccattcactctatagcattctccccacccagattataaacattttgaaacttcttccttacgctttttatattctttctatatttcttagcacaaatttaaaacaccataggtcatttggatatttttctcctaaaaaatggtattttatacttgtccattcaaattatgctctccaatacaggagatgaggcggggtgggaagccagttccttctgaaaactgattctcagaacttggtagcagccaaggttaattttgagttttggcgcttaccttgcaatcagagagccaagtttcataagccatggcctgcaattatgcctaaagaggctgtaaatgttctgagttgggagttttttttcccgttagagtagagggctgcactctaatgattagtttgctaatggagagagcatggctggttaatgaggcattctattgcagtgatgtacttaaaagtaattcagtaataattgctgaatggtatgattcatattccagaacacacagtagcaataacacatctgttgtgaaagtaccaaagtaccattataagattgagaatgcattaacctacctaaccctgttcactaatgaccactatggtaagaaaaaattcagaatgaatttctctgcaaaaagagatctttctgtgtggctgggcaaacactggtcctcagcagggagaatataattgagaatgggaggtgggaacttggttttactatccctgttggaataaagctctggctgctaggtggtcccccagaagttagccctgtatcttgttcctgaaaggatatgcaggaccaggttctaggtctcagagaaagggaaaaattattgaggattattcttattaaagaacactcattagtttatggattttttttcttcttttattgagacagagtttctctctgtcgcccaggctggagtgcaatggtatgatctcagctcactgcaaccttcgcctcccaggctcaagcaattctcgtgcctcagcctcccaagtagctgcgattacaggcatgcgccaccatgcctggctaatttttgtatttttagtaaagacggggtttcgccctgtttgccaggctggtcttgaactcctagcctcaagtgattcgtctgcttcggcctcccaaagtgctgggattacaggcatgagccactgcgcccagactgtttatgatttttaaaattctatatagatcatctttcaccaatctatgctttcccaagacagaacctttgattttaagggccaggatcaaatatactgcagccctaatttgcctaagtaaataaagctgcttcctgaggcccaggagatcacactttgtgggtttccccctggctctcaggaacatggggttgggcctagaaaggaggaaggaggtgctgtggatttgtggttaggacttctccgggctccagttctcattcatttttcagtacttccatggctactgtcttgttagaaaaattatacccttttcttgctttgcatttgctctccaagtttggggattttgatctgagaattgaaaaaaaaacataaaagtgaattatgtgctattttcctataacttgatgagaaaatgataaacagtgattcataagtttaagaaatggaactgtttcatgtgacttgagtttatttgtagatatttgaagtgatttctgtagtatcaggtaaattcagacatgtcagacatgtggacaagtcaatataaccagagacagaggtctaggcatctgtggggttcaataagaaaactcttaaacattttttaaacttcttattttactcataactttaaaagtttattggtataaacagaatttttaaagggctaacctattgtgtaaatggtaatttttgacacaaagtgtttagaatacttaaaggcatttaaaaaaagtgtttggcatatattaactcagttatttcttatgacactcagtaaagtaggtacctgctgtagttcatttgggctgctataacaaaaatatcatagactgggcagctgaaagaacaaatattttctcactgttctggaggctgagaagttcaagattaaggcaccagtagattcagtgtctggtgagggcctgttccccagttcatagatggcaccttctcactgtgtcctcacatgttggaaagggcaagggagctctctggggtcagttttatggggtctgtttttaaagagcattcatctcattcctgacgactctactcttacagcctaatcgcctcccaaaggccccacctcataatactatctgattggaggttaggattttaacatattaattttgaggcaacataaacattcagttcatcgtggtacctttcccaaggccacacaactagaaaatggcagggctgagatttgaaccctggcatttggctccagagtttttcctcttaatgactattttcttggtgtgcctactttaagcattcacagtgtttcttagtcacttactcattaatctttcatttcttgagacctgctattaattagatgttgttaacggatatgttttctgtcctcagaaacatcagcctggaagtgggagacagatagatccataaacaatcccagagtggtacagaaggagcgttatagcaagaaccgagggaggtcggccggagaggggagacatccattctgccggggaaagggggaatgtgaatcttagaaaaggtctcagaaccgaccatccttgctaacatggtgaaaccccatctctactaaaattagctgggcgtggtggcgggtgcctgtagtcccagctactccggaggctgaggcgggagaatggcgtgaacccgcgaggcggagcttgcagtaagccgagatcgcgccactgcactccagcctgggcaacagagcaagactcttgtctcaaaaaaaaaaaaaagaaaaagaaaaagaaaaggtctcagaaccttagcatttaaatgatgggtggaggataagggccgagcaaaaaaagactataagaaaagttggtcagcaggtattgaaagcagaaagttcaagaacgaactacagatctatttaagagcaaaaggaaaaatgagtctatgtgccagcttgagagagataaaacagttatggttggaaagtgaggtaatggagtttaaaaataccgagggggagggttctgaggggcttcactgtgtggaaaatcataacaacagttaacatcaaatccagctgagggaattgcttcaggaagctggcactgggtcatgacttttctaggtctgattggtagcctttgtaataagcttttttattggtcccatttgtcttttgccataaaagtacttgatgctaagcaacggtgtatacaaatcaagcctttcttctttatagcatatattttacccctccggggacgagagctatgaagtagacagggtgaccatcgtctagattcaaaagacattttgagtgatgtattgtagatgactttcttaactagcatgtgaaatatatagtaaatcagcatgaccttacactgggataatggagctgaatttataccaaggatccgtctgcctgtgataaaattgcttgttaattctgggtagatgacattttttctgacgggttgttgaccattataattcccatctttagaagtggtttccaaagtggaaatctcactctatgtgtcccccctgtaccccttccttccataacacacccccagattctgtttctaggagactcttacaatagatgaatggctatttcctataaacttctcagtgttggctgttcacttggttatttaagtctgaattcaaagctcagagtttggaatataacccattctttaagggtggagcttattttaaatgcttcccttatatccctgatatcttttgggtgatgtgtgtgtgtgtgtatctgtatctctatctctatgtagatatataactttcattattcataatttctgacctcatctttgcctttggtaaatacttgaatgtctagtatgttccaggcctgaggaatatgggagtgaatgtggtttggttcttgaattcactgagctctgagtctaatcagggagatagaagtgtacagcatgtctgatgcactttgatatatgcaatcttggatgttgagtggaagctactcaaagtacgtcgccatcttttgttttgtggaaagtcaggaaaagctttctcgtagatgtggtgctaagaatggggcccttgggccgaatcttaagaaaggaacaggtctctagcaggctcagagggaaggacggggtcttttcaggcttgggtaaaaaactggagcatctgtgtccacttgcctctgctgggtaatgaattggctttctatagctgtttcatcttcttcccaaagggaatggtaaattttattaactcagcatccaaatgcgtatctattccacagtgaatctcatgggagtgccagagatctcaaaacagtaacctcaactaatttatctttgaggagaattatgcatagttattttttagagttacctaatttcatgaatggctttacgtagtttctaataatacctcaactgtatcaaaatgttacatgaaatgcttcatgcgtaatataatattcctatgcacagtaggaaggaggtatgatagttagcatacgtaggtttgaaacacagctcatttttattgtcagaatttatttttgttaaaatatttcatggggtctaaaaataaaggtatgattgtaaaattataataacctagaacattaagaggataaaatactatttgtgagttcttgttttgcaaatatttatcagtgtttaatttgtgtaataaatctacaaaaaacacaacctgttcattattttttattggcttttaatttattatagtctacttacagttatgtcattagtaatgtgttataatggcttcaaataccatcaaatatatttataaatatgagggagggggtagttttatcttctatgtcatctgtttagctagctatctaattacatctgttttcttatatgcacatattatgaggttcctggaccaacttcatacttggcttttctgaatgatgtgtgtataaggtcagtgaacctatacaaaaatgtttattcatgaattcagtcaatcaacttatcaattttaatgaatactgaccatgtgctatgatagttgctgagttgtcagcagaactgttacccttcctgacctcatgggacttacagtgaagtactggggacaggcattgaatgagtaaacacaagtaaatacataattatcagctgtgttagggaatgcggtaaacttttttctgttaaagagaataaggaactactgtcaaagagacgcatgtgtgtggtgggtcgcattatagatatggttatcaggtttggccattgccaatacagggtttctttggactactttttttttttttttttttttaaatccgagacagggtcttgctctatcacccaggcggaaatgcaatggcacgaactcagctcactgccacctctgcctcctgggctccagcgattctcccatctcagcctcccaagtagttgggactacaggcatgtgccaccaagcccggataaatttttgtatttttttgtagagacgaggtttcactatgttgcccaggctgctctcaaactcctgggctcaagccatccgcccacctaggcctcccaaagtgctgagattacagggctgacctaccacacctggccttcttgaactactattgattgacctttctgggctgcaaatgggataattaagtattcagaatttaaacttcttttcctttgctttttaggtgttgtaaaatgtttcttagattatataaaaatcagtatatgttcatttgggtctagtatttaaattatgctcatgagatataatttagataaaatatatagatatatgctcatgagatataatttagatataaattatgctcatgagcctgttaaatactagacccaaattaacatatactgaattttacataatctatataattatgtaaaattacacataattttacataatctatataattacataaaattacacataattttacataatctatataattacataagtatttacatgtaatattacttaattacttaatttacataatcttacataatctataaaattatctatctatatattatataaaatagtacctattcactgctaaaggaaattatatatatataatttaactataagatatataatttataggctggacgctgtggcttgcacctgtaatcccaatactttgggaggctgaggtggggggctcatgaggtcaggagtttgagaccagcctgaccaacatggtgaaaccccatctctactaaaaatacaaaagttactcgggtgtggtggtgcacgcctgtaatcccagctactcaggaggtagaggcaggagaattgcttgaactcaggaggcggaggttgcagtgaaccaagatcgcaccactgcactccagcctgggcaacagagtgagactctgtctaaaaaaaagaagataaataatttataaaaaattgatataatttctttagcagtgaatagtttatttttagagaatttgagcagaggtatatggattatccttgcatttttagtgcatatgacttttcatttcagtgtttactcacatttctgctgttgctgataattgtgtagcatggaaacatttgagacgtggagtgagagagaaggaaggcatttcttgaaagactgtactatttgtatataccactgtaaagctctggttatataacagattgttgatgctgaaacacacagtggaatccctttaattctaccaatgaatttagctttctaggaaaaaactctggtgtcctaaactctgttaggattgggatttactttgacattctggcattcagcattatctcctgcatctcagggtagtaataggaaattcattactgagctattttcataggcccaggaatgaccaagttctgttcatacacacacctgtgtggtcattacaaacaatactgatcagaataacaaaagtatgtgtgactaagcacgttactataaaaatattagtcaaacatatgtttattctacagaaggccagtatcagaggcccatggaacaacctgagtctttttttgtttttggatcaggatcttgctctgtcactcaggctggagtacagccttgacctctcaggctcaagcgaccctcctgcctctcagcctcttgagtagctggtagcacaggtgcacaccatcacacccagctaacttaaaaaaaaaaacgtagagatgagatctcactacattgctcagtctggtttcaaactcctgggctcaagtggtcttcccaccacggcctcccaaggtgctgggattacaggcatgagccatgacgccctgccaacagcctgaatctttttcatccttctcctagaaagttttaaactttcatatgttcagaccttccctgggatttggaaccaatccttttcttagccaaggaagtttaaaaatccttaatttggtggcttgaggctgggtaccagtactcctctatcacttcctctcttctgggtgggtatttgggttccattaacttagtttcttctcttttcctgtgaactgatagttggctttttgcggtaaccaggtcctgtgttccattttcaagctctgctttaaggtcctccatctgatacgcattccatttattctgtattaaggctctgctttctagagacagaagttctgcccctgagccttgctgctcggccccttttatgcagacagcctacttctctgctacctttctgttctgtgttccccagtactgtgtcctgtaacccactgtcagaatgtccagttgcccttctccatactggcttggcttgtgacattccttatcgtctcactgggacctttactaaccagctacattttggtctttgggtctgggcagcaccaaatctcactcattctagaatgcctcatttacatttaacactgtcctagctcctgggtagaattcaaaggcgttagattcttcttgtctgatgaaatatttattgagtactagctgtgaataaggcaatactttgtgttgtgacaaagaaataagtgaaacttgatcgttacttccagaaccacacacttaaaagaccaaaataaaattagtacatgttacataatgggttaaagaatggcctaaaaaggcctggcacagtggctcatgcctgtaatcccagcactttgggaggctaaggtgggagaattgcttgagcctaggagttggagaccagcctgtgcaacaaagtgaaaccccacatctaccaaaaagtaaaaaataaaaaaataaaaaaattagacgagcatggtggcatgtgcatgtcattccagatacacaggtgggagtatcgtttgagcccaggaggtcaaggttacagtgaaccatgttcccaccactgcatttcagcctgaagaacagaataagactttgtctaaaaaaaaagaatgccctaaaaatatcacacacacacacaaattttatatagttgaagaactttcttcaaaagaccctatttaattatttatttatttattacgagacaaagtttctcgcttttgttgcccaggctggagtgcaatggtgcaatctcagcacaccgcagcctctgcttcccgggttcaagtgattctctgcctcagcctcctgagtagctgggattacaggcatgtgccaccatgcctggctaatttttagtagaggctattttcagtagagacagggtttctccttgttggtcaggctagtctcaaactctggacctcaggagatctgcctgcctcagcctcccaaaatgctgggattgcaggtgtgagccaccacacctggcctaaaagacattatacccatttattttttatttttattttattacaaagcacacttaaattcatgaaaattgcttattcaattttcttaaggggatttactgaaatgctttcatttcatggttgtgttttaaaatttcttgcttttattttgtccttctctacatcaatgaactttatacaagtatatcaagttagtatgcatggattagaaaagataccattttttgatagagttatcaccacaacaattatgagaaagaagacttctgtgaaatgtttgctgaattctctattcataggaatcatagtcaaataactttaagaaatgtcatgggtcacttagttacatattctttctcttaatagattaaaattttgaggtttgactcctttttgtgtcctgttcaccatttctcttgatttaaaactaaatctaaactaaatatttcttatagcaattaaaatcccttaccctccccaacttcttccctcttaaggcttttattttcctttatgtaacttcaagtctttatgtgttcctcagtgatttaacattgccctctcaactcaatttcattgtctttctttgactcctccttgctcataatccatataaaataaagaagccaaatgtcagccctataccattgaaagactgatcaatggtaagtaaagtagaaggaatttttcaggattgcaaattatccttttgctgtacaaaagttcacaataaaagtcctgtattaggctgttcttacattgctataaagaaatacctgagactgggtaatttataaagaaaggaggtttaatcagctcatgattctgcaggcagtacaggaagcatggtgctggcatctgcttctggggaggcctcatggagcttccaatcatggcaaaagacgaatggaggagcaagcacatcgcatggtgaaagcaggagcaaggggtcagggaggtaccatacatttttaaacgaccatatctatcatgagaacagcaccaagccatgagggatccatccccatgacccatacaactaccaccaggccccacctccaacactggggagttacaattcaacttgagatttgggccaggacaaatatcccaactctattaactccctagtttggtcattgcaatatactgttaagctatggtcaattttcagtttcaaaactttctttgttgttggttttgtaattttcaatcacatataattaaattttcttatccctgagtatgcatcatattttaataggcagttgtcatttttgaatttcaagtttgctacaactaagttggtgtaatttgaaaagtattcttttccaatttgcagtactgatagccactagagattccctggatgtaaactcaaaatttttggaagatgttttgacctaaaaactatgtcgatttgatataactatcatttgggaaggaatgggcttgctgaaatacagctctatttctcatagtccacttttttctgtgtagcttatcactgtgtcacaaaagaaaattcactgttgctcatccctgagccctgacctgataccattgtagttttttttttccttgtgatgactgttaattcaaccaatgacagaccagtgttattgaagtaaggagtgttttattttagtgggattaaatgaatgctaaatttgtttttcagacaaagatagcatgatgtgctttggaaaaaaacctattgatatatattttaatataaatatttgccaatcagctgccattattttagtgtatttttatgcttaccctgggtaagtcaaatggtctcataatatctaagctcaatatgcttttctaagatgaagcctagattttctgtgtttaaatttcaaaaataaccatttgagacagttttggtgctttttctgttttttttttttttccttatatgtcagagagccattaattttttataagggcctaaagttatggtggatcaattttttatctcaatatttctatagaatttttaaaaggcaagctttataaagctaactttatattagatgggtgtaagacgttctcttccttaaaaactagaatcaaaattgctggatttttttgcagtagttttcgaggtgatatatcacagtaataagagtttctttacagaaaggtcgctttgcttatgcagcatttctcatttaaaaggaacaatacttttgccgactatgagctttactttgggagtgttttaaaacagggaaagcagccttgcttcttagaattgttggtccacatgaagccaccagtggggtgttcatgactggactccagtgtggtgatatattaatataattgtttccccccccctttaaatgtatgatgactttaaatgtcgtcacaatattaggtagtggattattttcgtgaagagtatattaatgatgatttgtagactagcttaaataataatttaaaaccgttaattgcccagaaagaattacttaacagtgttaacaggaacagagatttatggggaatgggaggtgggaatgtgggcattgagaaggagcacatgtgctaagagccacttcatgtttatttgtgatcaggtgatcatgaagcaattctggggtaacattgtgcctacttgtattcttccaagcaacagcgtgactatctgcctatttaaggatgcagcagcataccttaacaatgtttggagtcctttcttttctgcattctgatataattatctccacatgcccccaaatcttccataatgatgcccatatgagagagacaaaaaggataaatctattgataaactgaagtttgatttcccatgacactttcagttactaggcaggtaaagatttcagtattctgttcccacttctcccaaacgcccactgagagaacaaaacctttctgacatcctgaggtgtgggagggtgtaatttactggtgcccagagcctgctgtctgtgcttttcatttcatcttcttagggaagaaggacagtgcagtttcaaaactggaatagtgattatggccttctgatctattgctgcctgtcgggcatgttaaaaaagaaaaggaagagaagtttaatgcaaatcacaatctctttgtggcagggtcatctttggctgtttcgcactgtaatagcctttggagaaactgtttttcacttgagttcttttagatgttgctttgaagagacttgatgcttcaggcccagagttctcatgtgaggtcaagcaggaacccagattctttccgttcaggtagagagcctgtcgcgccgttaggtcgttagcaagagttttctaatacttgagatcaaaagtgtgcacacgtcagctctgtagggagctgttttgcagacacataattgagttctaacatcttcatctattaggaagtattggtaaaaatatttcacaggattgttgaggggattaaaaaataaaatgtgaaaacccctaaaatgtgcttaatgcgtggtaggaacttgataagtgtttatttatttagtggcagatgaaagaccagtgtggcaaacatactgcgtggtggataaacaagagggaagatgtgaatattaacagtgtgatagtcagacaaggaatggttcatgatagtcccttgtatcttcatttgccaaacaaagttattacacagccagcctgggtgggggtgtgggatattgagaacagggctcaatattgagaaagtggtcctgggtttgttaacgctgacacacaaaagcctctgtggttgcttacgaagtgctcacctgcacatgtgtggttatctggttagatagtgagagcatcacacctggtacagggagcagtgcaactgacatggtcaaatggggataaagagaaggctgatttggttggcttctgatactcagaaacaaacaccaggcttatgaaataggctgtatgggtttgacacttttcagttcttgatgccttcagaaagtgcaggaaggattatgggtgtaagttgtggattctcgttcatttcaaatctcaggaggacacagtattaactaggggcatcagtgggtacagccttcctctctaggtgaggaaaaatctgagaaatacccttgtgagttgcctctgctcttttcagggctggtatcttgaattcttttcggattgggctctgcgtccgtttctgcatccaggtatagtgctgagtctgtgggaaattataaccattcatcaatgtgatatggtctctattggaaatgtcccagcaccaggagtacctattctagcagatagccttgaatattctaaaagcctgttttcagttcaagagtaaaggtgtattgtacatctttctagaattcagagagaccttaggtgtgcaggtagggcaacgctggcagtctcccagagtgaagacggcctaggaatgcccagacatctctcctcctctctgcctgacctacccccaatccaagctaatctttgctgggcctaatgttcaaatctcatgtataccctttaattctcattttacctctctttcttcttaaggggagaagctgggatatttgctgatagttgtatcttaattatgtctgcgaattagttggtaggaacactggagtcaatactaagtctgtgaagcaatgtgagtggggccctagtacacaatccctggtgggtctttcccttattttataacaaagatgagagaccttcctttaccttggagggctctatttgaacagtacctcttcagtctaatgtttgtgccaccactgatgattcgtaaacagacctttgtgggtgtgcctgagggttaaggtgtttggtgaatgtgagcccggtagagtcagggggtccctgcctaggaatctggagacagaaaatctggtgctccccctgccacttctagctctttgagccaaataacgttattaccctgaactgcaattgatttacccataaaatgaagagttaaattaaaagatctccagttctgaaattctgtctcaatggtcacagtttgcccatccattcagtgcatgtttattgtgattctttgctccaggcactatgtttatagcttacccagaatatagtttatagaatcaaaatatgttgtttgcttctttccatgaaaaataatctgtctaatctttcaaaaatgagcttgtatatttaaccttttcaaaacctaaccaatttgcccttactgcaatgtagttttcaactttaaaaagatcatagagtctcctgtttttccaggttataaaatatggttacttacatatgcagatgactagattatttcagaaatagataagaatggtttgtctaaacagatatttttgcaatgttagaggtgaattgactttttctgtttagctttcatatagtttttacttgtgaaaatatgtttatatctcaaaattattacaggatcttaatccataactctatattgtacagaatgtctaaatgcataatttcttccccccaatctcaaaatataattagaatcaatttagctgacagagttcagattttgatatcttattttataatttatttatctttttagaacctctaatgataccatataattttcctttatagcacatatcacccatgataattatgcatttatttgtgtgattgattcatgctatctttaccttgagactaaaagctaaaatagaagttccaggggcttatccttgaaagactaacttagaatctccagaaagagggtcttaagaatattttgtgattcttcagttgacaccataaaccttgatttggaaatctcagttagcaaaaactgatgccagctttcaagatttggattagttcaatgaatgcatttaacactgtattagtcaattctcacactgctataaagaaacacctgaaactgggtaatttatttaaaaaaagaagtttaattggcccatgattctgcaggctgtacaggaagtgtggctggggagtcctcaggaaactttcatcatggcggaaggggaagcaggcacgacttacattgctggagcaggaggaagagcgagaagggggaggtgctacatgcctttaaacaaccagatctcatgagaactcactcactatcatcagaacaataaggaggaaatccatccccatgatccagtcatctcccactaggagattacagttcaacatgagatatgggcagggacacaaatccaaaccatatcaaacaccaaaccgtaatttagtatttgattcatatgtcctttggaaggacttctggatataagttaaagtcattggttttaagttgtatatccttgaaaggtcattaagtgaaaaactgtaactaagatatttataaaaattgaataatggatgggtgatttgttggtgatgggtttgattatttcttctggtggagaatgggaggtcagtgtcaacagggcaaagtacaataagtgggtaaagttttttgtattgattatatatagcaaaggtgttcttaaattaaaacctaatttgaagccctagaaaggaggaaaggtaatggatctctagtttcaggcatcaaccttctggagcatccctggccaataaaaatgaaatgcaagtcacacatataattttaaattttataacagccacagtaaaaagaactttaacaagtaaaaaaagggaaaaataggcaaaattaattttgacattatatttaacacagtatatctaaaatattgtcatttcataacaattattaattaggtattttatattcttttttggacccaagtcttcgaaatccagtgtgtcttttacgttgacaacatataaaaacaagcattgacaacgtattgagcacttactgcctgccagctgttactgtaagctctttaaatgcattacttaattaatcctttcagtcacactatgaggtggtagatactagtgttatccccattttatagatgaggaaactgagggacaaaggggttaaggaaccttcctaagggcacagagcaactaagtggcagagctaggatacattctcagcagtgcaactctagaatgtttgatgttcaccataaggctctcctgccccagttaacacaatcctgcccgataggaaactaaatgagtggaaacttgccaaggggactcaaagctaataagtgacttagcacatgtttaagctctgtgctctttcccatagtactaatagaaaaaaaacaagaggtcatactggctgctttaatcatgattttatcactactgaatatgaagacttggatatgtacagaaattttcacttaggagtttgggtgtttctatgtgtatgtatatatgtgtgcaaataagtattgtcttacatgttttccaaaagaggataagaaaatccattaattatataggagatacatttttttatctataaacatctaacctttcaaagaattaaaaggggatatttcagttgccaaaagaacacatttaaaaaggctttgtaattctgtttattatctggtggtttatctagccatggactgagtgtttaaacttgaagaagaatgaccatgtattaaaacttcactctaaaactgatcctccagccaacagtgtgacctgcctgaagatgtgattttatgcttctatgcttttgcctgaaaactcacctagttgtgctccctgtctgcatgcgaggtctcatacgggaccttgtcccacgatcccactggtttcctgcttgtctactgcctttccagcctatttatttaaaaatctactccccttcaccactgttgggtatgtacctcttgctagggacaccactgtatttttgactatttctatcatattttttaacaccttgtgttggagtagtaattacaaatctcccacctgcatgccactccatggatctgttagagatgtctaaacagggctgtatttcattcacgatgtgtctcctttgtcccataattgacaaatggtcccaatacaatgttaatatgatggtctaggtctcaggagttagatacccatttctgagtgggactggagagaaaggcttagggaaaagtgagactctatttaggagataacccaaaatgaagctgtctgacagttttgtctcagggtacatagtattttagataacgatatctttttttcttttcttcaaggaaaaaattcaaagcttaaatctctcatttttttcctagacattttattatttgtttttgacactttatactttaagggtacattccagagctgcaggatattttgctttgtcattattgaatctgaagactatcatgtttatataggcgtcttcagtgaatttgggcagttttatgaggatgtctatttgtgtgcaaataagcatttccatacgtgtctttcaaaacagaacaaatctaaatctaaagataattttcaagtttggccagggaatccttatgttatattgattccataaaaacaggggtatgtattacctagcagctgaagaagagatggcctacattaggcacctgagtgtcagaaggggttgtcaagaaagtgtacagttaatacataagtctgtcctgattgaattaattaatcaagaactacaggtgttgaaaagagaaatgggtacctggagaaggacatcatctatattggcatcttggaatgttaaaaaaggaaatagctcaccacagccctagcctggtgagctgccctgtctgcaccacaaaatatagaactctgagactcctgagggttatctcagtttttctgtcttttcttccttcttacccagggttcagcatgcaaggttattcattaaaatcctgtctttttctgatttgttttttcaggggtggtgggggtgctggtagtgacagaattttccaattctcctaggtgcctttgcttttctatcctggtgctactgactgtgtaaactgtgacaaaattcccttccaatccttggttactgtttaattcccctacatgtgcttcagagtcaacatttagtgtgcttgggcaggatggccttggctcagcgtaaaactctgtcagaatcggttagatgtgacttcagagttgggttttattgacattttacatgcccgagttgattttggaaattgcctctgttaccacatccttacttctgatcctaatgggaaaccaacatttgctagatttttggcaaccactgttttaacaggaggaacctgtgtctcatacactgctgtattgccacagctttgagttttgacagtaaggagaaggtaggtacttaataagtatttattgagttaatgaattttggtgctctcggttctgattttaaaacgttttctgtttcattgactctcctgttaagaaaacaaaacctttcccaaacttagctatttaatatagaaactataattctaaagaataaagagaagaaagagagaacagacagacacagacgttaactggtgcacgacttatggtccctatatttaaatgggcatgaactgtggtgagctagtttttctggatttccctttctgccttatttattgtggaaatttgtacacaaaggtgtacaaagataacgtactatatattcatgtattttttgaacttcaaaaattatccacattttgccaatcttatccatgtctgatctttctttttcctgtagtacatttaagcaaatcctaaatatggtgttatattacctcaaaatactccagtatacatttccgaggatttttttaaccaaattgtcatgacatgtaacataaggagtaatcatttcaagaattaatatcctatacagccagcccatattacaatgtttcaaggatgtacttgttagctccagagacttgattagactctggtctgtttatttgctttttttggcaaaaatgtctcatagctggggctgtgtctttttttctgcaagagagacttgttgtctgcctgtgcctcttccagggacactgctgaagatacctagatcagcaagttcaaatgctgtcagcccgatcccatttgaaagttctctatcaagctttccctgatggatttagcatccattgatgatcactgtcaagatccattatttatcttaggaattaggaaaatcttagttttctcattgtgattctgtcatttcttgtacatttattgggtgaattcttccataaagaacttctacccatctgctacttgattaccttgaaatacactttttacaggaaaggtaagataaatgcttgatactttctccttatttataactttttggaatcataaatttgtaccctggcaaccggcagtaatgaatcattgaaattttctcattagtatcattatgaactcatgagtttttatatattagatgtctttcaatctagtgcatttttttcctcttaaattgccctatcttaggtcactttgacctctgtttctttttgacacagccaaatcagtttttgatgggctatggatttaaaatctctaatcttgtttactggtttatgaaagataatttgaaattgctctcttgagcatcctgaccctttgattcaagcaaatattgtgggactgaggggaagctatgaagttctttgccaaatgttaccatgttaaatctcttcattttgaggagaaaagattagaagatggctttgtgatatgatctgtgtggcagtttctgatgttgaagtgaatatactagaacaattttctcatagaatgggatatagtaagagcactgttctgaagtcagacagccctcgctccaaattcctgcttgaccacttccaagccatacaacttggccaagtaacttatgttctgtatgttttagttttttcattttctaaagtacacatacatggtaataataccttccttttggaatagttgtgtggttaacttgaagtgataatggtgaaaacacccagcagaaagccggtcacacgggaagtgccttgtaatggtagcataacaatggtaacaagtcatgtcactgtgatttggcattaaatctggatatctgttacttcactctgtacaaacatgaagggagattttctaagaaaacaaggattttctttcgttttcattatgcatgtcttgaaatttcctgcattgctctatttgtgggaactgaaacattttctcagcccaagcatcatgtgactgtttcttattgctagtcagcagcatgaaacctcagatgaaagtatattaactgagggtctggtagaactgttcagcaaagctaagcagactttatttaaagaaaatgctcattcccttttgctggacacacaacttctaagatccatgtatcatgctgctaagtagtggctttgggatgctctctgtataaatgaaattttctagtcagctgaaattcaaacactaaacattcaaatattttagtagctgctgatataaattgtactgaaatgtaatggttttaagcggaagcaatttaaacatcttttcactttttctttatgattgcatcagtcagctgttgctccataaaaatcaattccacaactcagtggcttaaactaattttcattcattctcactctctgtgatagagattggctgggcatgttctgggccaggcctgacggcatgactctacttcatgctgcaggcctgtctgggtttaggtcctcactgtggattaagcttaggtctgttccagaaatgtttattttgagggcccagtctgaaggaagcaaaccagcgaagctattcctatggtcgtggtaggagtacaagagtgttagcccaactgtgcaagcgcacttcagctgtcaactggaatcacatctgattccattccgttggtcaaagtaagtcaatcactaagcctaacagcagagcagggaagtatacttattccatgaggtggttagggaaaagtgattatttgccaaataccaatctaatttaccgtactaaactaagcctttggtatgatcctctaacaaggttccatactatatgtagttattattcatatctttaatatccctgccatcagttctgacttttcatcttgttcattctgtgccacggaaaaccatgtcttttaaaaattgtgttcaggtaaagataaattctacatgaagattttaaggccttctggggagtgaagctttgttttcatagctattttggatgtttggtggccttttattttattttattttatttaccttaatcattttgttccaaaaagaattagagatgttgccagaaatttgacttctgggtatgaggggttaagctcaacatgtaaagataaaaacttctaggaaacagaggttaattcattatgttatagtaactgggtcatacgttatactattaattctatattttatattctaatcttatatctataaccaactcacagaacaactaggggaaaattacctaatctctaggtacttttatgtaaaaccaatggagatgatagatgtgagagcctgaggcaattgtgatggtattcacatatcaaataaaattattttcaactatgttaagatcatattaataaaaaattctactgattcctaattcataattaatctgcctaaactacattgaaatttactttaccttagtgcaatttatggataaagggattatttataaaatttatgttgtgaaccctctgaaaagaagtacattattaaaattagaatatttatttggggctacaattaatgctaattataattagtgctaatttcaagtgtgcttaatctattcaaaaagtagacccagtggactttaaattgaccatctccataatacattaaaagtaataaagtggtttttatttaaatacattctagaataaatgatactttaatttaaaatttatttctagctaagtcatatgggtaggattttaccaagtttaaaaaattatatatttttcagatacatgaatagcactaccaatctcagttgtttctgatataaaatgtctcagcaagtactgtggtgattagtatttctctctcctttctctttttctatatagtaaactataagccttaaatcgttaagtgtaatgtaatctgaggagagagagtgagttgactactatccataaatacctctacatctcctttagtcgagggtttaatattaacaatacattctctgtaggcttttccggtttcttacaggaagagaaaaataattttgtagcgaacaacaattacgaaatttatttgatttgctgggaaatcccagcgtgcctatgggttgccaatcctattatcccccagtaaaggagtagggaaggtagattttgtaccacagcaaccacccccgctatttctagccattcttcctttttttctctggctttcctgtgaaattaccaacttcctacctggcttgctgctaattgttcagacccacaaatgggggcatggtgatggctgttgtttcctctactgacattacaataatgtatgagactctcagggttaactgtgtatttgagatttcactaagcatgattgcattaacatagatttcctctccagtcatgacacaaatttttaaaaagtttttcaggttcaatatttcattactactgttccctctgcatctacccttcctaccatttactatgtgtctattccatgacaggtgcggagctaagaactctacatgtataatgtcatgtaattccccacgcctctccagcgtaggtactctgatgacatccatttgtcacatgagtattctgaggctgggagaaccttcagtgacttgcccaatttgtcacagagctggtaagaggcagagcagggccccaacccaagtctgtctctggactcatgagcactaggagatcttgcgcattactctgtgatcttcctcttttggtcttcacattttatactgtgataccttagatagttttccctctttttattcttgagccccagatccaatttaccatctttctttttgaccccttcaagagaacagctacaaataaattatttaatttaatcagcatttattaaacatcagctgtgtgtggagtattgacgggcactggaactaccaagatttgtttatttttctgtctacaaaacatttgagataactgacaaagtacgtaaaataagaaagggataaaaataagttgcaagacctttaagacatagtgactttcctcctgggatctttctagaagaatcccacttgagagtggttcttcatgttcttgttttgtctccttgacctgctctgtgggacataatgagtgttcatctgcacttttcgtgtcaggcttccctcaaggactctgtcctcaccctgagtctgggatgaaagccaccctgatttgtgactgtaataaccagcttctcctaaaaagttggtggtgttagggatatcttcacatggattgtcttgtttccatgtgaaatagtgtcttagagccctgagaagtagctgtcatgtggaaacggagtcatgcttgcctgcattctgtgtgtctcctccaaacctcactacttccttgaattgcccacaggattcgcattcctgtctgactgcgggttccttcttcctgtttcgattcttttttcatgggctttttgcaccactacccgccttcctgtctcagtatttttgttgctggctcatccttcttgtcttctcagatgtcagcctcctatccgtggcctgtgggctacttggcggaccctctagaaatgtacctcgacagttgttcatgtcttttaacaatttcttttatattgttgagcagatggaacaattatttaagtctattttcattcctcataccccacaaatctacacaagtgtttagtgacataagtgtaaatattattgaaacatcaaaatatcttgctgtctgcatccagttgctagttcacagcattcaggtgacagtggctgtatttgtagagcctgaggaaaatgacataagatgttttctttgacagtggttgtcttacgtatttggatatacccattgtgtaaatatgcgttgaacgaaggagctgtgtcatccacatctaacagaggtgaaaacaaaagtctaccataaggtctgtctgcctttagccaaatgggaagtgatgtttctgcacattgtcacaagtgcgtagccaaccataacctcttcttgagcaacttaagctggcacaggaaatctgagacatgactaaatgacgtgtcaggaaagaagaatttctgaaatgttgtttaaacaaaaactggcagatatgtaacatttctctatcaatgcaagaaatcatcctacatgaaaaaggaagctcaaaattttgtttatgtaaaaacttttttaaattacttgagttttgttaacatttatccttttacatagggttgctaaagttagcgaataaattataggatacccagttaaaatttaatttcaggtaaacaacaaatagatttttagtataagtaggtcccatgaaatgtttatgacatatatatactaaaaactcattcattatttaatctaaaatttatatttagcttggcatcctatattttgtctggcaaccctccttttaagaaaatctaataatccatatttacctgataggtaaattagaatactgattcttttttgaatgaaaataatgtatttttttaaatttttctaactttagttcctctaatagaaattaatttagataactaaggaaccataggaatttaaaagctgacctatcagaaataacttcagctatattacattaaaaatgaagagatggaatctgaaataggaaagtaagatttatacccattattcagccaaaatctgtttttctttaacttctacccattgttcctaagtctgccctctgggggctgtagaaaataatgaagatgatgttattaatgataaccagtgcttgctgtaaccagttatgtgcattattttattggatttaatttgtttactctttataacagcatgtgagggaggtgcttttctgatttccattctacaaaataagaaactaaagcacagagtagttgattagcttaaccataaccacatctctttgtcaactcttaaagtaccagagctttcatagttttaaagttcccaattccttctaccatttcttttagtacagggtctctagaccctttcctgtcctcattcaactctcagcttgttgtggcttgtcagtgccctgaaatatgttatggccaaaatttaaaagtatacttcatagatcatataatttacaagtagagtacagcaggatttttaatggccttggtactaaagttatattgccaatagtgacccatggattagctgagttttgtttcgttctagtttttgaatggggaatgtacttttacataatacagttggctcaggttgaccttttagtcaggtgaaacttccaggttcttatctgtactaaatgcaggtaagcaaagtctccctcaatttccacatgcacagtttgcttttttaaacagatgtgcaggaattcacttgtatttgtataacttttagaaattgtctcattttaccttattcttcctgcctgctatcattcttacatatttatttttgtttgtttgtgtgagacagagtctcgctctgttgcccaggctgaagtgcagtggcacaatctcagctcactgcaatctttgccccctaggttaaaacgattctcttgcctcagtttcccgagtagctgggattacaggcgcatgccaccatacccggctaattttttgtatttttagtagagacggagttttgccatgttacccagactggtctcgaactcctggcctcatgtgatccacctgcctcgacctcccaaattgctaggattacaggtgtgagccaccgcacccggccgtattttatatttctttataatatatcaaaaaggcagtactggtctatgtttggagcagagacccagactctgcaggagatacgtgtataagtgagtgagctccctcctgtttctcatctccagacgttcctatgcctctgctttcttcccagttggcttgagtagatgtccaagggattgacatcagcatgtctatattgtttgaccatttcagctttggggaagaaggttggagctgtgttacaacatttctctcccttaaactcgacaaactcttaaatcaccttcctttgatattccacagtgatcctgcctagttaaatattttttttcctaaatcgtctctctatgtgccatgcctgtagctgtagctttggtaaagtttgtttccaaaataataagacttataataccttgttcttggtaatcaagagagttaataataggaaaaagtatttacctgggggaattgtaaaccatttgtatttcatataaaaaatgacagctctagttgtcttggacgtagctgggagcagaatgtattgagagaaatggggtagagtgtagtgagacaaaagaggcttctttgtgtttgttttcaaggaaagctcagatttagatgtaaactaattaagcatcttctaacatttaaaaaaacatgagagataaaatcttattcatgcacctgatagttctaaaattttatgagaaatttgatgaatttatgtatattgaattgattcatgtatcagtataccatttagtagagaacaattttctgtattttcatcattatcaataattagtgtaattaatatctatgccaatacatttaataaatataatagaattttactcacttaggcttgtatttctaataaatacaaaacacaaagtgatcaacacttattattctctttctgggaccgctttgatgtgtcttagctaccttttatacattaaatttattatatttttagcaaacctattaactgataagtttactgattataatttttattagaatgaataacattttataaaaatttgagagcattattcagaaaattacaagtgctgtattatccagtgctttctagcatcaacattcagcctagaatattgccatgatactgtatttaaataactggcatgttaaaaaacacacacacgcacatattaataaatcataggtgctctgtgaaggtaatctattacacactatggtttaaaacatgattttataatgcatgataccacaactcactttggaatgcgtatgaatgatgtattagtgactttttctaaatacgtattccatcactcttaagcacactgtagaaatgatgcgtaattttgttttataaataatatatctttaaaagacgttagtttctataaatatttaaaatatttttgtagtataaaaagtataaaatgaaaaatgttctaaattgggtttcattttatatgatgtctttcccatagtagttaatgtaaatactattctatttttgtctttaatgttcagaaggagcccagctatgttgtgttttttgctagtatgatgttgggctaacttttatagcatttttcctttttggataacttaatttaccacgtaattgtccatgctggggtggagcaaagatttatccaaaaggttacttttattagaaaagtgtactgctttagggttttgaatttctgactactggctgacagtaaccttatttgctgagtatcagttgtcgttcagttactctttccctgtctcattggcttttctctccctgtttcccattttgactttatactgaataaaatcaaacgtctaagtactctacttactatatacaccttgccatttatatgtaacaagtctcttgcaggaaagtgttcaaatgatgcgatctttgttttatgctattggaaaatatacttgtcaaccttaagaaatagtatattcagtcaacgcttcattaaatgtagtattctttcctgaaaaataaaacccagtgctctgtttagttcttacctacattatagtctgcaaataagacatatgacaaattggttgtaagctgaatttcaattttaaatgaaaaatgatttctaaaaagaatctcattttgtttcataaaaccctgaacacactttatatggaatttaggactcatttgtaaccataaagaaatgataatcaaacttcccaacaagatgaggttttggggaaatatgaattaaactggctacctggagaatgtccaaatattgcaaaacatattttgaaaatatcaagtgggccttagggtggaattccataaataatcaaaaaagccagatgtctttgatcatgaaataatttgtggaagtgtgccaaggtgttctaagctttcctcatctgtttttaaaataatccatttaatatgaaaatgggttccaaaaaatttaacattttttgccaaattcagtttgtctttattaactgattccccagattctaaattaatgaatatgattttaaatattttaagaacccccccaattctttttcttagttaactcaaaccagcaaacatttattgtgtgtttactgtaaacacggtgttatacctgtttcaagggcatataaaagtaaaaaaacaaaacatactgtttaccttcaaattactgcaaatgattccaacaaaatagtttcctgtagtattttataaagaaagttctttaaatggctacctgaaaatatttttagcattaaagtcaacaaatattttaggtctttttcttcactgtaacaaattctaggagaatatagaaaaagtgtcaaatgtagcacttctttttgacaaactaattttttataatctagcctaaaagataagataaaatatcagatagtgtaaggacatgagtaaatggtaattgtactacaattttaagtgttgtaaaagctcacagaaaatgaaaattagaagtcactgtattatgtcaacacttcttttgggctggaagagctaattcccataatagtatttatttctgtaagttttttttttttaaataaggacaaagtttagccctacttatgtttgcactatcaaaagtttcattgtgactatgcatgtgaatggcatagtgtgtttacatccaggttgaagtactttgtaatgaaaatctttggttcagaaattaatgttgtcgtatcagtttttgagatatgctcaaattctgttgtttgttgccaatgagtatggcccaaaatttgggagatagttgtatttagctatacagtattcagtgagttgtatctgaatttcctgctaagttatgtaacttttcagaggaaagactttgtcatagtgttacggtttctaacttatttccaagtcctccctctaggtgatgattcctctatgaactgtcctcttcattaccatcagtgtggcaccatccaaagcagggaattgcatgtgaggctcccaatagctctctgttgcctgcagaaaacatttcttagcaccagcaaaaagtccctcctccagtcttgcctctctttccctgcaaaaattattttcatgagcaggctctgcattttatatgttgttggtactttctcctgggtgaataccttcttttaagtgcctggctcaactattaggtcttcagtgtctttccctgaccccactgttatatttttccacaatcagtgtttccacatttattatagcatagtacagatagtgtatcagtggagtccaatcagggacagaaaccacaacagttacttgaacagagatacatcaatataaagaattgttagctaggtagaaaggtgatacttaggcaactgacaaggcaggaagaggaccctaagggatcaaatgtgtttcaactgcaggaaagagattgggttatttgaacatagaaacttagaggaggagccctgtagagctgaaatagatctctgagaagagaatactgctctactagtgctgctgtagctgacttcagaagatgatccctgtgggcctgggatccaggtctttaaggagggttggccagccagctgttggtgagatctctgggtagaggctggggtcaggatgaggctggttttgcaagtgagaaaattggccaactggattgaaatgctgctagagagaactgcttctgcccagatgaagtgttgcctgggtaacacaggaaccacagacagacaagaggcaaaatggaaacatccatagacaggaaggagtatgtcccttcttccttctcagccttgcagtcccccactagtatccccatggcagatctaggagccagcaactggcaaagcagaaatgaggtttgcagaattgttagcccagcatcacagaggaggatgaatttgtagttggtagacaaaggtttaataaccgacacagaagaataaatgccttcttcctgtttggctatgagccccttgatataggagttgtgtgttatttatttccagttcccaaatatctaaaatctaaatcattttataactcatttgacagtaaaaaatctaacctgtggatgtaatatttgctcatgttgctgcaaaaatattaatcctgcctggatactcacccacatctgcctgggagggtttataatacatgatatttaacccaaattattttgtaaaacctggagaaattattttttatttttaacgtgaaagtcatttatgtgaaagtaaccaaaaaggcttattacacagtagtcaaaaggcatgctaaaactcattttagatacaactattttttctcttttatttttactggacatgtaatcattgtacaaatttatgggatacagagtgatattttgattcgtgtatagattcaattcatgtatagagtgtataatgataaatcggggtaattagcatacctcaaacatttaaaatcttctagttttctgaaaatatataataaattataattaaccaccttcaccctacagtgctacagaatactagagctcatttctcctatctagttataattttgtatctgttaaccaacttctcccagtaccctcctcccccatctcctccccagcctctgatactcacagtcctactctctacttccatgtgttcaaaattatttttagctcccatagataagtgagatcatgtggtgtttatctttctgtgcttgacatattttgcttaacataatatcttccaggcttatccatgttgctgtgaattacaggatttcatacttttttatggctgaataatatttccttgtatacatacacaatgaaatattattcagccataaagattgaaatccttttttacattacattttattatctgtaataatacatgtaatacatgtattattttacattacattattgtaaagaaaatacattttctttatccattcatgtgttgagggacattaaggtttattctatatcatagctattgtggataatgcgacagtaaacatggggatgcaggtattcctttgatatactgatttcctttccattgggtaaatacccagtagtgggattattactggcagggaatctatacaggtctgcagcaacctcaattcttggctcctcagaagaaaaaacttgatagagggacatagacaaaatgagagacctaggcaggttttaggacatgagtggaagttcattaaaaagcttttgagtaggaatggaaggaagtaaataattcttggaagagggccaagcagacgacctagagatcaagggcactgtttgacctttgaccttgggttttagatgttcccatgcttctgggggtgttgtgatcccttctcccctgattcttcccttggggtgggctgtctgcatgcgcagtggcctgccagcacgtgggaggggctgcatgagcagtgtgattactggagttgtactcatgctcacttgaggcattcttcccttaccagtataaagttcccagaggaaggttgtataccagtaaagctccgccattttacctcttagtgtgcatttgtgagaccacttgctcagcttctgagatcttatcaggaagctgctgatcaccagtttcaggtgttgctatctgttgggagatggccacttcctggtgctggctgcaacaaatactattttagggagacagtttaacaacctcctgaccatcacctgatggttgcctgacattcctggtggcaggggccaggtgaggggctcttctggcctgctcatgtctgcctcactgcctactgtaacaggattgctgggtcatatgatagctccagttttagttttttggagaaatctctgtactgtttttgctagtggctgtactactttacattcctaccaacaaaatataaggattcccttttgtctgcatccccaaacctggagaaattctaaattacacaacacatctgaccctagcgttatcagataagggattaaggatcacaaggtctaacaaaatgtcttgtgtagtttagtaaagattccatgaattgataatagattgtttactaacttcttgttgtcatgttattttgcaagctgatactctggttatagatagattttttttccacatgtgagaatttttaaagaggtaataaatctgtgagctctttgtagttactgagtacatggaaatatcatggtttattggagctttggaaaaggatatggaagctcttttgatagagcctcagagaaagaaaagagaagatgttttgaattcccaatagctatggtgttcaaacaggttatgactcagaaaataattttcacattggtttgcaggaagatgagttcagcaaggtgagggatattctacttcaatctatgatagtcaagaaatttcactaaaattgtaaacatatagaggaggaatctggagtttcattggtttgatctttttaactagaaatatgagataattctttacccttcctttgacaagattttgatggtaacttcctaatagatttatttctgtcaatattacatattgctgttggtacatttttctaaagctactgtacttttagtttttcctctgctaaggcaaggacatccaaataagaagattttggcaggtaattgtgaataaaaatacattgaaaggttagaaaatattttaaaggattatacttgtatttctttcagaagattgaagactgctctgaatacgtaaatacttttacaatttgtatggcattcctattggaatagaatcattcaatttcgagtaataataggactttttaacttttaattttttatatgtttgcattctcgtggcagaataacaatttacggtttaaatcaggtagggtctgttaaacttcagactattaatattaatcttaatgatgctgaggaattccctttgtttctcctcggtcagtattgattgggtcttccaacatgtttaatacactctgccaggtgctgtggaatatacatgagggaaaagtctgaaagataaaaatgaaggagaaatgaagtaataattaagaatagtagaaaaaaatctgtgtccgagtttttacattcattgccagcatcagatatcaacaaaggtacaagatatcaggaggagagctctgttgtgggctgtggcaaagataaaatcatattataagcaatgctattattttaaaaacaaaatgattttgtagaacaaattggttttttcctactatcaggtaacccaaaggcactattgatctggtggcaaggaattctgggtagtcaactgtcttctgccaactgctttacttacagcatttgcctgaaggctttttgttttgttatgttttgttttttgctttttaggtagaaagaggtcgtagctgaatggctcacatctctttggtcactgtcactgcttacctcgtgccccttcaacccagccatgtacacgacaccagctgattcttaaacggtcacctgagcaaactcatgaagctccagggaataggaggaggaggagaaaggcagggccagtgtgcctaagacttttccttttcccttagatttaggcgatttctttttttgttcacttcctaatatgagctgtgtctcatgacctcagtttatttttatttttaattttatagtttttttttagtggttcattttaataaaactttatcaccaaaacaacccatggcttcaaatacagttttcaaatctccgtctctgggcaggcctttttcctgggcttcaggaacctaaatattcaactactccttaaatactgtcagcttgttattccacaggttctaaaattcagcctgaataaaacttaaatcctatttccctgagaaatattaggttggtgcagaagtaattggtgcaaaagtaagtgtgatttttggcatttttttttaatggcaaaaaccacagttacttttgcactaacctaatatatcaattcccatagttactctcagtgaatggcattatcattcatgtgcttgcttaagcccgaagtgctgaaatcataatatcccttccttcttcctcccacccctgtatctaaagggttcccatctacttctaagtccacatcctaaatagtcttttaattagtcatctcctatttaactctgttgtcattatattcatttggcctgaagatttcctgcctgctactatagctgctttctacctagccctattgttctttcacctcatctaatccatcttccacactgccattaaaatgaacttgttgagttgtgattctcatccttgactgctccaaatccttcaatggatcaccattgttttctggctaagatcggaactcctgtcaaaaactgaccagcttttctttccaccctaatgttccactatgactcagtttgtgtactgtgtaactctcttcccatggctgcacgtgcccttttgtttccatcctttgctcttccctcttccttgcctgtttgacaatttctagcttggtactttctgttttaggaggcattttctattttcctttatttttcttatttcttttttaatgcagtggatctgtttcaatggagagacattttctattttctaccgctgagttgggtactcttgatctttgctctgataccagtccatgctcttgtcaccgtatatccaccaccaccactaattgtaacagcaacaagaacaaggaagccaagttttaaagagaaagctcttgtgtgaggctctttgtactgtatatgtgttatttcattaagtcctcagaacgaccctgtgagacaggtgggtaccattgtctttgtcttagaggtaaggaaactgagaacgacagttttagccagttttctctaagtcttccaataagaggtagaattgagattcaagtaagttattcttaatgtagagtcctatctagtaacaatgacatgatgctacttacctcattaggctgagagccccttaaaggcaagaattatgtctttcattaatagttggttgagtgagtgcctgaatgagaagatgagcaaaggcatgcgtgttataaaaacatttagcctgcagtgccaacaataactcaatcttctcaggagaaaagtactgagctgttatccacccaatgacaaaagtttgctcggtgtacaaacttggtgttacgtagacggcttggtgtacaagccatcactgtctggcagtactaatgtcaggcaacagataatcatttgggcactcagaatagccagtctgttattcaagatatgcaagagtgcattttaaatgtcaagcacatttacttctttgagggaggcacattttatacaggagtgaagaattagagatagaagttggaaattcttcctaatgatatcattcattaatatttctcttttttgttgtttttaaatgtttcagctggttattttcatgttaactcattaaaaaagttattctctggtgaggcacttggggacaatcagaagagatagagatcctacatctcagggctctctgaatcctcaagaagtaccttgggacattatttcaatcagagtgtgaatacccactaactacagagcctacaagaggtgcttggggatgcaggatgaatgagacaccatgtctgtctctagaaagatgagtctcgctgcagccgatgggaatatcagagaagatattttgctctttaggttgccttataggcttctcattgcctaaggcagagtcataattataataatttatatgcatttgcaatgtgtcaggaactgtgctaagcactcaatgtgggttcttttgtctaattctcaccataagtttatgaggtagatattgttacctctgtcttacagatgaggaaactgaggtttagagagggtaaataacttgtccacattcacatacgtagaagggatggagctggaattcacacccaaagccagtgtgctcttaatcatagtactatgctacctccctatctgacccaaagcaatctgggtaaatataactgtcaagatcattacagggtgctctaacattgttttatcttttcaaggaaccaacaagggatgcaggtactctcaccactttacagttgaagaaactgacccagaaggatttttcctggaccaaagtcatactgctgttatactagattatgagtacaatagtgcagtcttctttgcaaactccccagtagcaagtaaacaaacaagaacagcagattatgtgtgaacaaagagatctggtgcttattatatatttcttcaattcatttttcttttcccttgttgtgtgagacatgcataattttcttggctctgtatataattacatacctgctttgagatgaacattcttaagtgtagtgattaatggtctgggattggacgtagtcgccctgcagtctaagttattcaatatctttcaccaaaaatgctaataattaaactgccagtggcaacaaacagccagggtttgtgctgatagatgtctgctgtagttttccatggcagtaatgtggtaagcattgaaacgtttcctggggatttcaagtggtagcctttgaaggtgtgttttgtacatctctcctgccctggggagctttcctgttccccacaggtactgactggaaagaagtcaaagccgtaagttctagaagagttggcaggaaactcatctctgcccattttctacaagtaatgctgcttccaagcaggcagcagccccagtactttactgtgacatttacattatccttttttttcttttttagccctccagttatcacccaatgagaatgtaaaatacttcatcttctctctagtatattttttactcctttaaaacttagctgaagtcgtaccttcttagagttcaccaccctggctgaatcatacctatcctcctctctcttccctatctcagattgcttttaattgccctggccagccatccagaaagaagcactgtcttaatggcctttctgaccaggacctcgatgtcaggatgttgatgggttggtttgtctggtatcatggcagtagccagttcaaatctaggagtaggaaccatcttttttttttttttttaagtaaaggtgttttttttttctgattataaatataataatgtttattgtgtaacttttttgggtgttttttgagacagagtcttgctctgtctggagtgcagtggcacgatcttggctcactgcaacctccacctccctgggtgaagcaatcctctcactatagccttctgagtagctgagaccacaggtgcctatcactatgcccagtgggttttgggttttgtttggtttggtttggtttttttgtgtgtgtgtgtgtgtggagacggggttttgccatattgcccaggctggtcccaaactcctgggctcaagcagtcctcctgcttcagcttcccaaagtgctgggattacaggcatgagccactgtgcccagcccattgtataacagttttaaatgagataaaaagaagagacatgaagtcatctttgaactcgccacttgcaggtgaccaatatgttaatttgggttctccagagacacagagccaataggagatatatatatatatatatatatatatatatatatatatatatatatatatatgtatatgtatatatgtatatgtatatgtataatatgtgtatatatgtatatgtgtgtatatatacacgtatatatgtatacacgtgtatatatgtatatgtgtatatatacatatacacacgtgtatatatacgtatatatgtgtgtatgtatatatatgtgtgtgtgtatatatatagagagagagagagagggagagagagaaagcatgctatatgagaggggatttattagggcaattggcttatgcaataatgaagactgagttgtcccatgataggccatctgcaagctggaaaaccaggtaagccagtagagtggcttagtccaagtctaaaggcctcagaaccaggaaggctcaggctgaaggcctgagaacctggacttatgtccaaggacagtaaaagaagagtgtccctgctccaaaagagagagtgagcaaaatagtctttcttctgccttttgttctgtttggacccttagccagttggatagtgcccacccacagtgggtgagggtgcagcccactgattcaaatgctgttctcttcctgaaacaccctcacagacatgcccccaaataatggcttaccagctatctgggtgtcccttaatccagtcaagttgatacctaaaattagccatcacgaccagagttaacatttttgggcatttgggtatgagtcagtgtatgttggttgtgtccttggacagaagctccactctggacacttgatgtgatatcatgtggtaatgccatggccctcccttatgttttttgatccttggacagaagctccattttggatgtctggcattacatcaaatggtgattgatgtctgtaactcctccttaataattccatcaacagtgtttgtcttattgcataacttgtaacttgaggaaaagaaactgtcatgacacaaaagtgtcatggaaatgaactagtgttgaagtggaacttggaagtcatctacccttatggctccaaatctagctgtgcatgagaatatctgggggacttgttaaactgctaccatcctaggccaattgaaccagaatcttacggctggaacctgagaataataagtgccctcaggaattcctgtactcagctgagcaccatctagtaggctggaattggagagccagttcactgatttttaaaacgtagacatggtaccttccctcatgcagttgaagttctaccaggtaagataatggaataacaagtaaataaaaataataattaaaattgtggtaagtggtttgaaggcaaggcactgagggagaataactttcgctacggtggtcagggagagcttcccagagagggaagcagtctcaggactaggaggctgagaaagagccagttgaaggaagtgtggaaaagaggcttccagctgagaaatggcactccaagccatgctggtgtgagaaaagcttggcttgtgtcagggattgaggtagcagtgagtctggaatgtggttagagaggggagaatgcacagagatgttcgaagttgttttaattagttactcaacaaccccagctggtaactggcagaatgcaggctagaacctgcttcgctgattgcatgtccagtgaatgtcctgtatgctgctgtattagtctgctcaggctaccataacaaaataccgaagactgggaggctgaaacaacagaaacttattttttacagttctagaagctagaagtccaagatcaaagtgccagcaggtttggtttctccagaggcctctctgatgcgcttaccaatggctgtcttctctctgtgtctgacatggttctccctctgtgtacatatgcccctgatgtctgtttgtgtgtccaaatttcctcttacaagaacaccagtcaggttgcatcatggcccaccttaatgccctcattttaacttaatcacctgtttaaaggccccatctccaaatatagtcacattctgaggtattgaggttaggatttcaacttctgagtcttgaagggggggcacagttcagcccataatagctgctgtcttgtagttggcaaaatcccccatttgtcctaggatctagtctaacaaggcaaatccctgtttcccacttgctactgagaccaagagggaaatctgtattactttcttggattgaaataaccctaaacaaaacagagacttagtgtccctgcaaactctaatacagatggaggaattgtaagtgatatggagctggcttataaattttttgctcccctggctgggaactttagctgtttcagaaactttcctttccagagagtcctgtgtctgccaaggtcctttgatgcagacagtagaacccatcctaggtggcttaagtgggatttactatgggatattggttggtttatagactctttgaaaggatgcagaaacatgctctgggctaaatttccatgaacatttcctagaaccacccccacaggattagtctgacaagagagctgctgctgccgccaaccctagaaccacattgcttctgctgtgatccacaaagctgctgccatgtctcactccaaaaccccatacctctgccagcacctgtgccagctaaatgggtgccttgaacctggcttggttccttacatagttaatttccaaatcaaaactcacgtctgatggatggaacctagtctcaccaggctgtactctagctgtaagggagacttgggaaggaaaaacacacaatatggagaggtctcaaagatagccccttccctttaaaaaagaaatagaaagaaaaggacttggggtacccaaaaatgtcatatgacagatgtcctctgcaacccaccttttcaagatgtgctcacattttacatgtcccgatcctaccctgacaacactgtaaaacataagtaggctctatattcattgtcttttacatctttgaggggtacaaataagatacaaagaccctaaattggaagatgagcatgaaaaaatcttgagtcccatcagtaaattccttttttcttatgattgtacagagtcccgacttaacaatttttcgactttatgatgctacaaaagcgaatatgcattcagtagaaactgtacttagattttggaattttgatcttttcctgggttagtgatatgtggtacaatactcttacatgacatattccacactctattataaaacaggttttgtggtagatgattttgcccaattgtgggcttactgtaagtgttctgagcacatttaaggtaggctaagctatgatgttcagtaggttaagtgtattaaatgcatttgggcttacagtattttcagtttacaatgggtttatcaggactgaaccccatcataaaatgaggagcatctgtattatatgtggtggaaggatgatagaaggccacgaattacagactggtgtatagcaagtaccgacatggcatttttgattccctgtgcttctgtctcttgaacagtagctttaatcttcaggatggtcttttgcagtttggtcaaagagaaagcaagatattggagatgccttcacctagtgtggtttattttaaactgggagattctgtgtgctttgtatctttcaggaggactctacctgaattttctgcttataacttctctctctttttgggaggcaactgtgtgtagatacacagccacaactgagtattcacatgatgtaaaagtaatgaaagtgaccgggcatggtggctcaggcctgtaatcccagcactttgggaggctgaggcaggcggatcacgaggtcaggagatagagatcttcctggctaacatggtgaaaccccatctctactaaaaatacaaaaaattagccaggcgtggtgacacacgcctgtaataccagctactcgaggctgaggcaggagaatcgcttgaacccgggaggtggaggttgcagtgagccgagatcgtgccattgcactccagcctgggtgacagagcgagactctgtctaaacaacaacaaaaaagtaatgaaagctattgtactatctagaaggacacagcagaaatcatagaatatgtgcttctattgatgcagacaggattgttttaagtcggcccttggctatcactcatcactgtttttggtactggagatacagcagagataaagatatattagcacatcttgatggtcactacaatatgttcatcaagagatgctatataagtcactagttaaatataaaaacattgacagctgccttcactttggaatataagatttaagaaattagctttatttttactggagaatgaaccgtcccttagaattgtcttattaatgttcggagtactttttcccactccatgacttatattctcctgtttttaaacctactttgctttacacaaagtgaaaatcgctgtgcttttcttgaagctgtttaggtctaaaatttttaaaaatattgaggttggtgggaggaaaagtggtggtcataattatcagtattattattaggacatcctatatcttaggagtgtcctacacatggtaagtattaactagctcaccaaatgaataaatgaaggaatgaatgaaaaaacatactttggagtcagatctggatttccttttctgctctgccacttactagctgggttatcgtcatctctgtaagcctcagtttctcatctgtgtaccacataattgtacctactgcacaggtctgttttgagaattaaataatgtttataaaaaaagtgagataatgcttgtctgacttcagtttaagcagtcaataaaacatttccattaccactgctattatcactttattcccagtgaagattcctataacaaagacactgggaattcctccagcaaaggaacctgttgacatttttaaaaccatgtacatcgtgtgtgtgtgtgtgtgtgtgtgtgtgtgtgtgtgtgtgtgtgtgacattgttaatatcttcccagaatatttttccacaaaatagaatttggcaagtgctgctatgaatcagttacgtttataattctttttaaaggaaaaattgggtgtgtttaagagtttttttttataatgtggccatagagagcttatgaagcatttgctgtgtgtgccgactcttgttccatattaaatgtaaggatggagtgttagaaagcgggtgacagaaagacatgtgtagcaggcccaaggtcggtgaaggaaggcctggtttgtatcttgctcctgggcatctgtcttgagctaccttgtgaaccaaagcctcacactctaggacagtcttcttaatgtggctgtcattctcttgctggcagtgaatgtctgtgtggtttaattctgtgactacctggtcgtgtgacccacctttgcaatcctcaagggtgtggggcagggcagccgggacaggatgaggctatttgcagtggggggcaatagtcacttctgtgtgtggggctgtaaccatgaattcatccaatgtggtaattactggaaatgctgatttacacatctgtggtcctcatcgctttatgggaaagatctccatagatggagagaagagggggagtagtttttaacaccatcatttcccttttatatttgcaaatattcatgtgggaaaaaaaggaatataaaagtaaaacagtaggacatgagggattataagttatctcaaatacatctctttttctaattttttactgtggtaaaatacacgtaaaatttaccatctgaacctcttaagtatacatttcagaggtattaagtacattcatagtgttgtgcaaacatcagtcccattcatcttcgtaactcttttcatcatgcaaaactgaaactttgtacccattaaaaataactccctattctccctagccccagcccctggcaacctccattgtattttctgtgtttttgactactctgattaccacatgtgagtggaattatacagtatttgtctttttgtgcctggcttatttcagttagcagaatgttctcaaggttcatccatgttgtagcatatgtcagaatttccttcctttttaagcctgattattatttggtgtgtgttatgtaccatattttgcttatccagccatctgttgatggacacttgggttgcatctccatttgagccattgtgaaaaatgctgccatgaacatgggtgtgccagtatttctttgagacccgattttcaattattgttggtatatacccagaatagaattgctggatcatatggcaattccatttttaattttttgaggaaccattatactatttttagagaactttataccattttacattcctaccgacagtgcataagggttccaatttctccatatcctcaccaacatttgttagtttctggggtttttttgatagaagccattctaatgggtatgaggtggagtctcattgtagttttgatttgcatttccctaaattgatgaactcaagctgttcttttcctgttagattttgcttttgacctttaaatgtcttaaaaaatcaaagatgaaagcttatctattctttttctcttcaaggtgctagaaatgaaattagctggctctaggagctggcagccctaagtataaagtgtgtcctatgaacttggtgtcaagctcttggagttccaaaaatgaatatcatgatccttctagctgccaccttggacatgcttctaatcgttttccattataccagtgttttctaaggttttttcatataaactactttaaaatatttttattggctcttaaatgtatcatctttcttcttgttctgagtttgtatagactttgagagcagtaattttgagtgatggtatttgtacaattagatatgctatctgaaaaggaatgtctctaagttttagacaaagctattggaaaatgtctctataactgcttatcagtctccacattccatgactttttcccccctcttttgacatgtccatgttttcctaaaatcttgaatcaattattgcattagttaactatctctgttaaattcactggagagagttctttgaggaaacaatgttggatatctaaaattctctgattttatcatgtcatgagttggtgaaatatcacttttactgttaaatgaaaatggagggaaatataggatgaatattatcataccttgatttgacaggtgaaagagtacgtttctaaattctgccatgatgattttatattcattgcatttaaaaaatttggaaacgcgggtggggtggtggctcgcgcctgtaatcccagcactttgggaggccgaggaggatggatcacgaagacaggagttcaaggccagcttggccagcatggtgaaactctgtctctactaaaaatacaaaaaattgtccaggcatggtggtgtgcacctgtaatcccagctactcgggaagctgaggcaggagaattacttgaacttgggaggtggaagttgtagtgagctgagatcgtgccactgcactctggcctgggcgacaagagtgagactctgtctcaaaaaaaaaaaaaaaaaaaaaaaaaggaaatgctgcagtataattttatgaatgtgaaattattacatgtgcttaaaagcattattgtagcttcatttgcctctgaatttcccgagtggttgtaacaaggttgtcttcctgaatctctgcaaatttaagtcagcttgcactaggaagccacagatgtccttagagttgagtttaatcttgactcaaatcagcttctcctccagagctttgacatatgacttagcaagagcttttccttcttctttctgccttcacttcccagttcccaaaagaccagttttcaggacagtgtgatcctagagatatgggaagagagggaggaagcaggctttgatctttgccattgtgtacccatagaactcactcccagattctttttcctttttctttctctctccctttcttctgtctagctgacttcattgtcttcctgctcatattctgtctatgacccttataagacagcaaacaaacccacaatcaaggctcttgcttcattgaagccctgagaattggctacatgaggcctttgctcaagggacttaatatttaatgtgttcatgattgggttaataaaacagggagcaggtgacaaatttagtctatggaagccccattcagaagagtgagcatttgagagggctggaaagacatatcagagattctcatcaaacagcgtggtttagatgaaaggtcacaaattaaatttaatgtgaactatgctaatatagttcatattaagaatataatttaagcatattacatcatgtcatcacttcatattgcttttggagccatcttggagtagaggggcaatgtttgctgttccttataacagaggctttaatgatttattaaaaacaaataattactaggttatgtacattgtaaaagtacatttcccatggtgtggataaagagaaacgaataaaaatagggcagaatagaaaagccaagataaggtgcttgtcactgctactagaattccctctctccaaaaaattttctaaatattttccaaacattttgactttacaccattcatacagtttcttctatattagtgaaactctactagtaaaaaaaaaaaaaaaaaaaaaaaaaattgaacctgtacttccaaaatgtgtatttttatttacaatttatatccatgtactataaattcttattaagcgtaaaataaagcacttacaaaaacagacattttaataggatgagataaagttaaaaataaactatcatttaattttttttagttttataaaaccttttaaatatgattatgtacttttagtgagagcagtgtgattaaatgtgcttcattattattatttttatatatttattttataaagacagggtcttgctctgttgcccaggttggagtgcagtgatgtgatcatagctcactgcagccttgaactcctgggttcaagcgatcttcccaactcagcttcctgagtaactaggactacaggcacataccaccaagcccagctagtttttaaattttttttgcaaggataaggtcttgctatattccaaggcttattcattttttttttttttattttttgggacagggtcttgttttgtcacccaagctggagtgcagtggtgccatcatggtccactacagccttgaacccttgtgctcaggtgatcctcctacctcaacctccagagcagctgggactacaggcacctgccaaatgcctcgctaattttttgtatttttggtggagatggggtttcgctgtgttgcttaggctggtctcaaactcctgagctcagttgattcacctgcctcagcatcccaaagtcccaaagtgttgggattccagactaagccactgtgcctggctttttctttttttaagagatggggccttgttctgttgcccaagctggtctcgaactcctgggctcaagtgatcctcctgcctctgccttctgagctgctgggattacaagagtgagctaccttgcccagcaaatatgctccattatttttaaccttagcttaattctttgtgatacagggattttaagtttccaagtaagttattatcttttgtctcattgttataatttatatacaataaattgcaaccattttaaagtatacagtttgaagaattttcacctaagtagcttattttgatattttaatagctgatgtctaatatacaatatatagttatgtttaataaaatattaaaactatatattaaaaagttttcctgattatttcaaccttgtatataaaatttgtttttgtcagctctttttaagatccgattagatcttcagtttttacttatatggctgactaaagtaaaaccacagaagtgtccattttactagtttttgtttgcacatgcttatattattagtgctgttttaatccacgttttctttccagggatctttttaagccatttgtccattttgtaaatgagttcagttaaaccaagataatcttgtttgtaaatccacttagctgggcccaggtgcactccagtctttcacaatatgctgaaagtgaagaactgagtgtgaacacttcccttgggaggaattcccctcttctttctgaatgcgtcatggttccattaccctgtgatgcaggaaaggcagccatgagaattcatataataaacattaggagagcttacacatttttaatatagtttagtagttttaacatatatattattatatacttaatatctgttatctattttgtatagtacatttagcatatttaaaagcatacacttattttttacagagaaattttaatatgttctcctgtgcctcagtggctcttcttgtggacctaactctatcaaccattgtcagtttgttgtttacaataaagccacataaccccttttccaaataacatcttacagaggggctaattatgtaaaaataagctgagctgctcttcttgaaagggggttgtagagctgaagtctacctggtctcatcacctgccgtatccctttcccacctgctgctctcctgccttcctatcaaggcttgcaaagcacagttggattcaagatagaaggaaaagtttcctctgatcatagtattaggtatcattgtgcttctcctttgctagccctttgtttttatcttatggacacagattcttgtcagtgattacatttcttccctttctttaggaaaggttttttttttttttagacagaatctccttctgtcactcaggctggagacgtgcagtggcataatcttggctcactgcagcctctgcctcccaggttcaagcaattctcctgccttggccttctgagtagctgggtttacaggcgcccaccaccacacctggctaatttgtgtatttttagtagagacggggtttcaccacattggccaggctggtttcgaactcctggtctcaagtgatctgcccacctcagcctcccagagtgctgggattataggcgtgagctaccgcgccctgccctagggaagtttaaagccaattctatctcgtcttttgcagtacaacaggtcctcaaataacgtttcattcattgttgtctgcttatgatgatggggaagaaaaaaaagtcgattctcagctgtggccactctttgtgtggagtttgcacattccccacatctgcatgggttttctccaggtattcccctttctttccatatctcagtgatgtgcatgataggttcattggcgtatctacagggtctccatctgagtgagtgtgggggtatgcgagtgcaccctgtgatgggatgactgtcctggccaagggtttccctgtggaataagtggataaataatgatcttccttgtttttattaatctaccttaaatgtatgtatagctcacatttatttcagtgttgaatattagaagtattttaggtcattatttagaagtttggtgatgtttttgtgaccagaaaatatgctgcaggaacttaacctttgtttatgtcaattagtctttggtaaaattggtttcattatatattgtttgactgactgaaagtcgcagtttctaagaccttattgatgatggtaaggactgactgtatgtagaaatacatggactgtacaaatactgtttgtagaaattgaataaatttagaatacaaggcctacttttggcttcaccttgctttcttacctttatttactttgcttcctgtttcttcaatttatagtttctttttaaatgaaacaagtttattttaactttctatattaagtgtgtcttaaattactttaatccttcttggaataagtacaaagggctttgaaaataccgcctattgtattgttgctcataaacgaaccttaagatttttggaataaaacttctaaataaatgtaaaataagttaattccaaattaagtgaacaactttcacttaattaaaaggatttgggagcataggtgaataaatccaacattgcatgaaacatctttttttctccctacaagaactgaaaaatacattgttgtatttcattattttgtagttttgtttttttttgtcagtaattcctagttcagagcttggtttagaaaagaagaacattagggctttctaagttggaagtcatttaatatagtcatgatttttgtggtgtctttggctacaaggtcagtattttaatgctaagatttcttggagagtgaaagttcttttccctagaaattggggtcagttgtggtaaagatacatggagagttagaaaggtatataatgataggtctcatcattttgaaattgtagagcagtattaaataacttttatccaaggaatataaagttttgtcatcccaaactcaatgctgagcaagtcattattttgtgacccagttctgaggtggaggtactcatttcctgtacctcacagttccaaatatgttactttggtttttattttatttttatattttatagagttagggtctcactatgttgcccaggctggtcttgaactcctgggttgaagtgatcctctcgccttggcctctcaaagtgctgtgattaccagcgtgagccactgcatgtagtcccaaatcccattcctttgttatttcgtccctgctcttctcagaggagtgcttcataagaaatgcccagagactttacacagtgggagttcgagaagctcaggggagacctcctggacatttgttgtttgcctcctcagcaacctgttgcccccttccaggaacagctcctatcttcatttgccactttgcactctctactcctcacctgtgtgcttaggtaaggtcccagcgcatatgattagctgacggtgtaattatgacaacattgctgatgatgccttcccttggacatttcttccacaagttctgatagacatagctggttttgaaaggtctggtaatccatgcagccattgagtgggaaagcaagcaaaatgttaaatacactgtagaaataaagcctcatgttttataagttgagtattgtcaagtgtttggaaagagcccttttaaaactatgactatgctttgcaacactttgtaattaagctggatgatgccttgttggggttttacaagttagtggtattcatcttcatgtgaatggacagagttacttcttggacttctgagaagtagggatcaaagtggggaagaagtgagtggaataatttttttcttacagaaaaacccttttaaagatatttgtatgcactgagtcacaaaaatgagacaggcaagactgtttttcctttgccttgtgtttggtcttgcagcatgatctactccagtgaagtctgattgtggcaccttgcttgtccttaccttgaacttcaaatccttgaacctgatctgaggagtaggatataaacagcaccccaaggtcttgcatgtggccaaatattgtactataattagtaagagttatggcctgtcattgcctttcctgaatgatggctggacagtaagaattagcgcttttttagctccaggttttcaatggttaagagaacagaatcatattatgtgtttgttctttgaaagaatgattggaatgaataaacactgggtaagggaaaatttagcatttaactggttttccacttggcttttttaactccggggagtttggtgaattagaaaccagaactacaaactggaatcatattggtgtgttctgtcaattgctttgaaaacagactgactttatatttgatatatattatttcaactttccttgggccttagtttgtaaagctgtaaaataagaatgttgagaggagaattaagagtttaataatgatattggagaggagtgtgaaataaatgcagagacatatcaaagggggatggtgggagggagtggatgtacaagcccagctgcttttatatgaggaaacagcattattgcgggtgggtgagtgggaggcagcaaatctttttgtataatagttcagggatgggtctggggcattacaacataatgtaaagatacagatggtaaattggtatgttggaaacaagtctgacccaacatgggcctggggatccttcactgaaataacataactttgtaatgaatttcaaagaaatatagaatagaaatctgtaatacattatatgcccgaagtgagggggggaagaaggggaaacaggaaagaatattcaatgaaactccaaaattctaccaaatgcaacattacttatatctatagagttttctataagaagagttttgggacttggaggttaaacggtggatttaaaatatataggtatatgtgtgtgtgtctagctacatatatatgtatatacacacacacatacagtcaacattctatatccattggttccacattcatggattcaatcacagatcaaaaatattttataaaaattgcatcagtactgaacatgtacagtcttttttcttctcattattccctaaacaatgtagcacaataattatttacatagcgtttacattgtgttaggtatcataagtaatctagagatgatttaaagtatatggggggatgttcataggtcatatgcaaatactataccattttatataaggaactgtttgagcatttgtggattttggtatctgcagaaggtcctggaaccaatcccccacagataccgagggatgactgtatataaatatgtatagacataaatctataaatatcgatagatatctgtctagctatttagctagacttctttaaggttttaattaaaattaagtcttctgagaaataaattggaatagtctttggaagatttaagagtatcttttcatgcctttttaaaatgcctgaatattttctacagcaacatgaaatcatctcatataataatataatatcatttgagcagctccaaaggttcttcccttcatgcttccaagtttttattgaaaatatatttgcagccaagagaaaattaatttttttattattagaaaatgtcattcttttttctgatctcctgacctattaatgtcttctccaaaaatgattgcaatcatttttagatatcttacttcagaaatcagcatcaaaagttgttgagcctactaattcttcccctaactccatttttctccctggctcttcttttcgataaaagaagtcatttaaaagtaatctgtaatttagtatcattataattttccacctaaaaagtataactaatgtatatgcagaaattttaaggccttttgtaatctggtgccaccaaacctaccctccatcatattagtaaatcctgctgttgaagtgtcctacctcatcctcatcctctgagagagtttttaaccctccaccccagagtcttgatacatttctaattaatgcatgaaacttttcttgacaatgcctagccaccaagattgtgccattccatttccctttacgttgtaaactttaaaagtaacacagtattttttagtgttccactcatttgttctaggtgtaagcacagtattgtatagtacagtggtattatatagtattaacatatatgtgtgcctaatactctcttctttgtttatttttaactgtgagcaatggccatattttactcttagaactgtgcacccaatggaccatactgccaggtcacaagacatttttgcaattcatgaatttatctgtataatgccattatcagaaattattaactttgaaatactaagctaaacaaaaacaatacatagatgttctagcttcagaatttggattttagtaatacttggcaatttcaatttgtcttgacaacatgaaaacttatgcagactttcaaatcagtaaaaaaatcgggattgaaatgagcaattctcctaatataaaagttgattttgaaagagttaagtatacactggaagctggaagctggaagctagagctttctctcttgcacgcttgctatctctctctctctctctgtcagactcttcaatgaaatccaacatttgaattttgtctaaaaacgtattattggggctactgttattagtcatttatatcaatgactacctttaatctttctatctaaatgattgtttaccaatgtggaagactaattgaaattcaatacctaaaagtatttctgggctagtataatgttatgtaatctatgtggattactacagcatactaaaaaggttgttgggcaagtaaataccatgtttaggattgtgctgatttgtgtatagttcatttaaagtcagggaatcaatccagtgaccttaacattggatagcaaaagagcctcctccatagtccagggaaacgtttatctcagttggagacctcccttaaaacttaaatacaaacaagactggttcaaagatgaccagtattttaaagtgttttaagagaggcctctttaaattctgggggaaagtgccagattttatttgtgctgctgaatgtctccttttagaaggaaagctaaaacagacacagtgacaaataaaaggagaggaaaataaccagttttgagtgtctgctctgtatcagacatcatgctaggtgttgagacagatcctcttaaattcttaaaatagctacctagtttgagtacacttatcatatagaaaaagaaatgaaactccaaaggattatatccatgtgccctgggtcacaaaatcagtagtggtgaagctaatattcagatttaagtcaccaagtctccaaataccaaacctttccagcacatctgacttgatagagacgttattagatgtatttttcagctctgtttttaggtacataaatatttaggattggtaggtccccttgatgattttatcattgtgcaataatctttgtgctactatcttatgccctgaaatctactttgtctgatgttaatataactactccagctttcttttggctaatgttagcatgttaacttgtgcctttatatgtgaagtgctttccttgtagacagcatatagtttagtcttgcttttttaatccaatatgacaatctctgccttttaattgtggtatttacaccgattggcatttaatgtgatcattgatgtcctgagattttaatctgtcctcttgctatatgtattctatttgtcttatttgttttttgtaccttttcttctttttctgtcttctttagtacaattttattttaatgattataatttatttcctctcttcgcttatcaactgtaagtctcttttatttaatgattacttaaaggttttaacatacatctttaacttgtcacagtttaccttcaagtgatattacaccatttcacatgtagcataacaagattacaataatatacttccatttctctccttcaagcctttgtggtactgtcgtacactgtatttatataagttataagctccagaatatattattatttttgttagaacagtcaattgacttttaaggtgatttaaataatagcaaattcaaaaaaaaatatttacccatgtaattacgacttctggtgctctttattgctttgtgtacatccacatttccatctgcctgaagggcttccttcactatgtcttgtaatgctgttctgctggtagtgaattctttcagcctttgtatgtctgaataagtttttatctaacattcgtttctgaaagatattttgggggaggtagggggagggagatcatcaggataaatagctaatgcgtgtggggcttaatacctaggtgatgggttgataggtgcagcaaaccaccatggcacatgtttacctacataacaaacctacatgtcctgcacgtgtatcctggaacttaaaataaaaaaaaaagaaagatatttctactggatgtagaattctaggttgatgttttttttttctttttcttccagtgtttagagacgtttctctactttcttgcagaaattgattcttgattgtattatttatgagaaaaataatgtcattcttacctttcttcctctgtacttaatgtgcatttttctctttttgtttgtttgttttgtttttttttgtttttttgagatggggtctcactccgtcgcccatgctggagtgcaatggcttgatcttggcttattgcaacctctgcctcctggggtcaagcgattctcctgtctcagcctcctgagtagctgggattacaggaatctaccaccacacctggttaattttttttttttttttttttttttgtatttttagtagagatggggttttaccatgttgcccaggctggtctcgaactcctgagctcaggtagtccacccgcctcagcctcccaaagtgctaggcgtgagccaccacgtccagcctttctcttttatatttttaagaattttttccttagcattggctctaagtcgtttaattatgatgtatagttttcttcatgtttcttatgcatgtgcttcattaagcttcttggatctgtagatttatgttcttatcgaatttggaaaaattttagccattatttattcaaatgctttctttgtccctgcccctcatttggagactacagttactcacataataggccacgagacattgtcctcacagatcactgatgttgtgtttaaaatttttttctcggccaggcatagtagctcacacctgtaatcccagtgctttgggaggtgaaggtgggaggatcccttgaggccaggcgttatagatgagcctctgaaacatagcgagaccccatttctacaaaaataaaaacctagccaggcatggtggcatgcacctgcagtcctagctactcagatggctgagacaggaggatccctcgagcccaggggctccaggctgtggtgagctataatcatgccattgccctccagcctgggcaactgagcgagcaagactccatctccaataaataaataaataaactaattaattttctctgtgtttcatttaggatagttgctaattttatgttttcaacttcattaatcttttgttcttcagtgtctaatgttaatcccattagtagttttgtttgctttttccatatcacatgatagtttttacaaaatctctaaaaatttgattttggtctttctaatgtcttttaatgtctccattaaatttttgaatatatggaatacagttataatactattccaatgtctttgtgtgctaattctaacatctgtattagttctgagtcattttagattggttgatttttcttcatacaaaggactatattttcctgcttatttgcacttttgtagaatttttattgtgtatctgtggattttaccagtttaggtagcgaatattttgaatatctgtaaatactcttaaccttccttctggggtgcagttaagttaacttgattctcttgggtcttgcttttaggttttgttagttggggcagagtatcatttagtctagggttacttttgccttaaaactgaggcaaacttttctctccaaagtgtcccacgaattaggaggttttctagtctgactaatgggaacaggccccatgtgaatttcaggtactgttccttctaatccttcagagtggttctttccccagagtcatgtcgtttcctcacattttgcactggttaatgttttctgggatacttaaagtagaacctttgcagatttctgtgattctttctctttgtagctttttcctcgctgctgctgtaaactctaagctgccttggtcccctcagactcccaactctttttctctcagctcagggagttggatgggctctattttggttcctccagtgctccatggcctggaccctctatcaagggagtaagctggggcaatcatagggctcacatcatatgtagcccctctctcaaggaacatgttcttcaatgcctgaaatctgctgtcttgaaaaaccattgtttcatatattatccagtttgttgtcattgttttgagacagggtctcactctgtcacccaggctggagtgcagtaatgagatcatggctcaagtgatcctcccacctcagcctcccaagtagcttttttgttgtttcaggcagtgggttaaatccagtttcttttgttccatcttggttggaagcagaagtattaggtagacatgtccattgaagggttttcttttcttctccaatttggcagcatttttaggaaagtatttctttttatcttggtttttacttttttattactgacctgtatcttttatcataagaatacagttgtcctaaatctattttttcaattgtctgaattttcttaaatgattcaaggcagaacaaatgaagaatgctttcttttgagaattccaaagttgtatagatggtgggtatacttgtataaatttggttgattattaccttttatgttatattgtgtagattataaggtagaatgggctaggattgctttttttccctgccagtaaaagttcacagaatccagtaaatgccaagtatatccaataaagaaacaaacacaaatgataaggatgttttgagttgacaagcttttctgtacagttgttatttaagggatagggtattgaacaatgatttctctaagcagcagttccatatgccatgactgtataaacttatacattatagctaaagggaacttgcattctttccactccattaaaaatgtactgtcattttcttaacttcacgttatgaggcgtggatttaacaaacttttttggagggtttggcaaacggcatttgacctatattccctcattttttaaatggtagtatttgctatggctttgcttttgatgactgttagtcaactgtttctctcttgaacaaaatggtgtgctctcaccagcctatcacacatcagacttagagccatgacatttgaatttattcattcctaacttgttattttaagaatatcctcagatattattgggcaattactatctttcaggcaagtgctaagtttcaagcatgtatggtgaaaagacttgatctttgttctcagccaaggagcatttagtgacaaataatcattataacacattgtgataaattatttgctgagttgttcatgtgttttacaaatatttactgagaatctgctatgtgccagatattaatacaggctgtgggtttatagcagtgaataattccctagtctcatagagctaacattttaatgaggagaaaaatgatgatgtggagggagtgggagagtggagaaatgctaggaagataaattagagtaagaaaatggagcttgtcagtggaagggtgttgcctttttacagtggtcaaactcttgttgtaaggtgacatttgagccaagaccttaaagaaattgagaggataagtcactcaaatatctgggggaaagtgttctaaacagaggcagatataaaaataagaaaggatgagtgtgcctgctgtgactgaagagccagaaagggtccagaatagccagtagaatgaggaaggggaaaatggcaggaggtgagctcagcaaggcagaggtgaggagaagctgtagctggactgaggaaccagatcacctggggctttattagctgtgaaaaggatgtgagttttcattctgagtgagaatctgagtagaggagagacatgaagggttttggggttaggaggatccttctaggcattgccccatgaagcaagggaagaggctcatggtctgagggctgggaagagttagaaactgtagcaatagacaaaatgagagatggtgagagcttgggccaggataattgtagttgtggtggtgtgagatggttcaactcaggatttatgttaaagaacctatccagtgagtttgctcaacgattggatgtaaggtatgatgagaaaaaaaaaggtttggggcctgaacaactagtgcaagagagttgtatttcacgaggtgagtaagaacgtggtgggatcaggggatttgggtaggttaatacccaaaggtaggtagaggaaggaagaacttgattttagacctgctatgtttgaaggacatgttagacaccaatggagatgtcaagtagacacttggatttatgagtttagagtaagagatgaattttgggctaaagataaaaatttactaagacataatttaagtagaaaaacttacataccttgatgagtgctagataaaaatatctaagatcatccaatacagatcatttttatggaaatggagaacctaaagctcagaaaagtagaatgaggtgcccaaggacacaggtttttggcagaattcgtgtcatttgattccttgtcttctactatttccagtccagcacgcagtgttttattcatgctgatatagttcagaaatggggggaaccttactagtacaaaagccaggatagtaagcaatggtataaggcagggtttaagagcacagactctggaacaaacttcctaggtttattcctcattctcccacatacctactgtatgaccttggttaaattatatagcttctctgtgcttcagtttccttatctgcaaactgcaattgataataatagtatgtacctcacagagtacttgggaacttaattgacaggacataagtaaagcatttaagtcactatgttaagtgctatccaagagaagctgcagctatgatttattattgttattaataattattattctaagtcactcattgggaaatcttcagaaagtcttttctttaaacttagttttcctacctcagatgcaaaataataaagtcttccaattgcttcctctttaagattcttatttcagagtggaagccatgagctttcattacaacttcttgggacccagaattagcttatctagggggtatttagatactatggagaagtcatattgaggtcaaatattctcaaatcccctctatccagggttgcctgttcattccctgacattcgcatctactggtgcttgtaattggttggtagcatgctctgctctattggaacagtgtgttcttttaattgattgctttctgtgagaatggcttatctgcctttttcattaacattcatgattctgtgacacttcattctctccattaatagctttatggatgtctttttaatagagatttaatcttgcctttaacattttaggcaatgtcttggttatctacactgtaacatctcattgttgtgtgtttatgttattaattcatcattgtgtactaatcaaaacaagtaagctcctgtttttaacaccccattctttgtggataacagttgatttgtggcaggttctagatgaattgaatattataatttatgagtaacattggttaattttctagagagaataatgagattattgattaagttttttttttttataaaggagatttagtaacagtgtcagtgaagaagtgtgaaagtctctctttatttcactggttagtgtgtgattattttcctttctctgcctgtcttagttcattgtctgttgctataacagaatacctgagactggataatttataaaagaaagaagtttatttagcttgcaattctggaggctgggaagtccaagatggagtggccacatcaggtgagggcctcatgctgcgttataacatgatggaaaacaccacatggtgggagaacttgcgggcggggcggtgcaaaagaaacaagcacgagaggctgagcttgctttgtaacaacccgctttcatggtaactaacttactcccatgagattaacacactctcatgagaaagacataaataactcttcatgatcaaattaccccttgaaggccccaccacctcccaaccgtgccatgatggcaatcacatttcaacatgagtttcagaggagacaaaccatattcaaaccatagcactgcccgacatgctaagtgtcaaccttgaagtaaatcaagtgtgttaacagaagcaagttatcccaagatgattggtcatgcagatggtaagcagttggacagcaaagatttaattttgtatcgattatgcatatcaactaaataccatttttttcccgacttatttgctctgtttttttgtcattcgtggtggcattcatggaacttctactcagcatgtgttagtcttctagcctctcctcagacttttattaacctttgctgtcttggatgtgaattttgttcaatattgtttggtaggttcttgatccttcctcaatgtctgcaagacactcagaatatcctcgttcacactttcaagatgatcttcctatccttaggcagataagacatgagcttggagcacaatgtcttcgtctcctggtcactgattcctctggactacaatgatgtctgttctagtaagtagaatagggttcactaaatgaggaataagcatcctcagatattataactctgtcgccttgcagatgactattattttcgttccatcaaaggactggataatcttttttcttttttttttatttaagaaatgatttgctgtgttgcccaggctggagcgcagtggctgttcacaagagtggtagtagtacactgtagccttgaactccttgcctccagcagtcctcttgcctcagcctcctgagtagctaggactacacgcgtgtgccaccttgcttgcctatcaactggagcatcttcacattggcagctgtattcccctatacgcccataggctgacactctcattccagtggggtacagcttgactgtccagaagtacgctatctgatgcaaaaggggcaggctgggtccaagcaaatatcttctctttgccatagaatcacagaattttagggttgtggggggatggggtcatggaaataatgtatgtttggtccttcattttattgatgagaaaaggaaactcataagtgggaagtatcttttccaaaatgtaagttaataacagaacaggaaccacttactaaaaagtctttttcaatcctgtgttacccccatggtgaaatggaacaagaaacagatgggtagagtagaaatggtattgggtttggaatctgaagatgtggattttatgcccaggtttattgttacacagtaattatatgatttggcataattaacttccagcatttttgaaattgttttttatccatggaatggtgagtttgtcaaagaccccaccaaccttcatctgaaatttgttgtgtattcatatacattgaattacagcatattgttatgcttaaaaatctgttaaaggttgtgatttgattaaaacgttggctaatatggaaatataccatgaccccattttcttctctcccgtattccttcaggtcagaggaaatacatttttaacttcataattgcatattcttatctactctgacagctacacctcagggtctcacctcttctgaaaagaattataataattgggcattctgtgaccttcctgtcacaatagatgggtattggagactccagaaggatttttattagtagtgttcaacagtatttccctgttaaacccaagaaaaatagttcatcagacatctcaactcagagctgcatctgagcctgagctggtatatgttatcattgtcttaccaaaaaattatatttgatcatttgtcaaaaacgtaaaaaaaaaattacctctaaatccgtcatccagagataactactttagacactgcatatacttagactttttaaagtcttttcagacattgcatgtattttgacattttaaatgcatgttcataaacatatacatatgcacaaatttaatgcacaatgtaattacatacactttttttaatggagtaatactgcatgaactattttagaatctgctcctttcatttaatgatactttttttttggttcactctgccttagcatctacctatttattgaaatgtgtattgggtcactgtgcctaataatgtatctatttattgaaatgtatttgtgggttcactgtgcctcggcatcttctgtacttactgaaatgtgtgtgttggtttaccgtggctcatcatctacctattttttgagctgtgtgtgttggttcaccatacctcagcatctgtgttatttattgaaatgtctgttctggttcactgtgcctccacaactatctattgaaatgtctatagtggttcactgtgccttggcaaatgatacttcttgatcagtttttcatgcagttaaattttctcctacaacatccttgttaatgctgtctagtatttcttctgtttggggcagaatgatttatttaattaagccattattattgtacattttgaaaccaaagtacagtgtctacatgtggtagaatttcccctgtatcacttaaataagaaggtgtttctctttagaattctgatgagttagaagctaagatttcatagtacagaaactagaaatgtaatctctactgcttgagaatcttgttgaagaatttccattcaattgctttttgttgtttaatatcagtttcattaagctttctctaaagcattttgacctcacttaaaattgggtcagtatacatatagagagagtctattttcccaggtagtgggttacatgcaaggtaagttataagtctgggccccaaaccacttacattttattagtaaaaatagcagtatgaataaggcaattacaatagaataaatgtgttgtatggtagggtctgaaaacttaaatgctaactgaggccaagcacgagtatagaggtctaggtgaaagttataggaataatttgagactgtgttctccaggtaaagggatcaggtgttattatttaactcaaactcagttattaacatgggaaataaagacgtggagtaactaggttctctgattttttaggaaaagctgaaattaaattttttttttgagaaaaactcctaattcttaaatgttggcagtagttataattgtttttaaacatagttctgtccaaacaggagatgtctgcgactctactctagcccatatacctaggtaaagctggctcggggggcaagtggtcagcaatttgagagtcagaaaatccttcagaaagataaggctttcctacattcatcattccgaggttagtttaaggataagtataatgtataaaaacaacaacaacagcaacaacaaaaaaacagaagacttcaagtaggcaattacttaagggaaaaagtggaagaatgacagtttataactagatttctgcatctttaagcccccccccccatatgaaatcctctttaaaaccttcagttttctacatatcacagtaagtgcttggtaattcaatgttatcagcaggaattgtggcagggttccttccactgtaggtaatcagtaaacatattttcattgaaataataatgtaaaagttggagacaattccgacatcacttatacttaagagtggaatgcatctgaagtgtgtgttgaaatatggatgatgattctgggggatcttggagattcactgagccggaaacaatataatatatcatggtaagagaatgttaacactcttggcttctctgttctgcctcctccatctaagtccctttcctgttattcactttgtactgtgaaaaaactagactacctcttcagaagcaaaggagcagcataaaatgaacatgaacactgccatggataaatttgctggtatgcaccatttcctaggcctagaagatagcgacattggtctaatatgttgcctttttaaaagagttcctgtcgagttggaatagcttgtagtcacaaaacattacagttggtgactgaagaacaaggatttaaatcagctctagctggctccaaaggttatgttctttccttagaaccaaacagagtttgacttctttgagaattatctagcttcttctcctagcattttactttttttgttactttggtcacttggaggagaaatgtgacccgctggtgttggttgtcaagacacacacttaatgacactgagtgggtagcctgtcctgggtgcagttgaagctccacagccagtggtggcacaagagtgacagtactgtcacctccaggctgttcttgacctcacttggcatattgatcttcagccctgatccaattatgtagcagggtgacattagtatttgtcaccactcagctgctttcattgctcctccctaaaaagattttgaggactcaaaagtctccaaaatagagatgacctattgatatgcctgctaattaattcttcaaaagcactttgacctcaactccatattttttcctctgtgcacatttatgtggctttatggcttcccagtcccccaaacaacaaataatggctttacatatttttaaaaaatgagatgtactcattttataaaatccaagtaacatcgaaaaataaaaagaagacagttacaaagcacctccaaatcttacttgacagatataaaatgttatgatctgggaaatatcagcctcttcaaatatacggatagaaggatgaatgaatggataggtagacaggcatgaataattttataacaatgctaacatgctgtccatgctattttaaagtttaaacctttacatttaataaaatgaaactggataaccttttgacttctgattaattttatcataaaaaattaggaggttggagccataatgttattataaccattagaatggctgaaattaaaactactaaaactataaggtttatatgaggatatggagcaactggaactttcatacagtcctggtggaaatgtaaaatgatatagaccctatgaaagaatatctcctataaaattaaatttacccctatctaatgatcttgtaattctgctggtatttattcaaaagaaatgaaaacctatgtccacaaaaaagtgcaagagtgttcagatttgttcctaatcataaatacttagaaattatataaagaaactgtatagtcatgtaatggaataataaattttaaaaggactattaatatacacaatgacatggatatatttcacattatattgagcaaaagaaggcaggcataatagagtatctcttgtatgagtccgtttatataatgatcaagaacagccaaaacttttctgtggtcatagaaatcagaacagtggttgcctatgagatgaatgggaggaagattacctggaaaggtgcaaaaaggaagtttctgggatgatggtaacattctatatcctagttggggcattggttaaacagctacagtttgcagatgcttctcgactgacaatggagttacaggctgacaaacccatcgtacagtaaaaatatcttaagttgaaaatgtatttaatacacctaacttactgaacatcttatcttagcctagcctgccttaaacgtgctcagaaaacttacattgacctacagctggacaaaatcatctaacacaaagcctattttgtaataaagtgttgaatatctcatgtaatttattgaatactgtgctgaaagtgaaaaacagaatggcttgcctccactgcccagcatcacaggagaacattataccatatatcactagcttgggaaaagttcaaaattcaaaatttgaagtgtggtttctactgtcagtgtgtattgctttcacatcatgtaaagttaaatcctgtcaggcagggcacggtggctcacgcttgtaatcccagcactatgggaggcaaaggcgggtggatcacctgaggtcaggagtatgagaccagcttggccaacatagtgaaaccccttctttactaaaaatacaaaaattagctgggtgtggtggtgggcgcctgtaattccagtgacttgggaggctgaggcaggagaatcgtttgaacccgggtggtggaggttgcagtgggtagagatcatgccactgcactccagcctgggcgatggagcgagactccgtctccggaaaaaaaaaaaaaaaaaaagaaatcctctaagaccactgtaagttgggaattgtctgtatatatatttgtcagaacccatcacactgtgcaccctaagatccgtaccctttgttatatatatctcaacataaaaatataaaagcaaatgaaatttagacattttagttattacatattgtctccctgttatgaaaccagagattaacacacttgtgctttctcccacctccctttatgttgcttgtgttattttttctttttttcaggtttcacaacattcattctctgatctgcaatcataatgccccagttgtttagtcttagttctatatttaaatggattctgtgctcaccattaatcctttcgccacagtttttccatgtctgattatttatttttattcatttcttgtttatccaaattttcatcgtcaagtcctttttttttggtttgtttattctaaggaaagactcatggatgtgctatttcctgagtttttacatgtttacagatgcctgccttttgtttttatgcttgaattgcagattagctggatttaatattcttgggtcatacctgtttccttttttaaagacatgggtcttctgacactgaatattattgtgaagatatctgtggtcagcctatttttcttgtctttctccctctagtagataacttcctttttatatttgatacttgaagtttttttattcttttaagatcccagatcaaagaacaattttttctttcttttgttcaaaaacttattcaagttatagctcgattttttaaaaattatgtttaaatttttgctggtgtaggaatgcccttttggtctgcacattgacttcttcctttattctggagagctttttttaaatgagtgttgtaattttctgtagtgactggttttgttttgttttttaatatgaacacttctgtgtgcagaacaacaatcatctttatgtttgtttatctgaattcttcatgtattacattctctctccttcctttaatttctttgtctttcctgctgcactcagtgtgattctctctctactccatgccattaattagattttcacttcctctgccccttgctatttctaatttgtttattaactgcataatactattgttctgttttccatgcatttcctgatttctacagtcttcccttttggtcttttgttctatcttctagtctttggtccttgttttatagaattcatagttttatgaagtttttatagaatgtgacacattcaccgaaagtcttcttatgtttctggggttatatttcttacagtcttagtttacatatgtctttgcatgctagattttttttctttttgtagtatatttttataattgtcctcatttcatctcactcatacatagtggaggccactctccacatcatctgtgtgctctgaccacgcagaagtgagttcacttgatcttatttctactttatctgggactaatttgtcttccaaatccccacctactatttaagggctggctgttagcttcaatgcagtgcttttaatccaagggtgtgagggtagggagaactcagctggaatggagtacagttaggggtcctgggtctgggttgaccatctccgtgtgtccaggactttcctagatgaagcatgcaaagtcccacatcatgagaaacttcctcagttcagagcataaaaagatggctggttaccccatctttctcctttaagttgttttttttgtttgtttgtttgttttgagactgagtcattttttctgtctcccaggctggagtgcaatggcaggatcttggcccactgcaacctccgcctcccgggttcaagcagttctcctgcctcagcctcctgagtagccgggattacaggtgcacgccaccacaccaaacactaatttttgtgtttttagtagggatggggtttcaccatgatgcccaggctggtctcaaactcctggcctcaagcaatccacccgccttggccttccaaagtgtgggattacaggcgtgagccaccgcatctggccaaaattttttgaataccctaggcccctgcccactccatgcagccatgcgtggttcaacttgactccaactctgcttagtatcttggaatgtggtcagggtgccttcgtacatacaagagtctagtctcaagggttgtttctttctttataactttcaattccaattcaacttctccagtttagagaatttaagtgaggatgttcagggtttagtcagctgatcctttttcctcattaccatgtgtggggcagaggacacgggccagattcagagccatgctagagttttattcctttcctccacctgccacttttcaaaaaatagcgtatagtgtcattttcttgcttagttcctttaaaaagatatttaaaaattttttattagccatttgaagaaggagattcaggaatcgtgtttgattccactatggttacctggttcattgtaaaactgtggttatctcagtcagtcagatgatttagccttgtatatcatctctttctccttccatcctgccctcaaaatgcacacatgaacagctctctctgtatttcccatatgagtatgcaagtgaaaatattaggtttgagagagctgagagccaaaacgcaatcaaaagcacaatggattagcccatgaattgaaaatgtgctcctttcttgcaggatttgtaagtttatatgctatcatttgagaactcttatttctaggtattgcttcagattgagcactatatttcacacggaaacattaatgatgatgtggtttttatgttgagcttactagttctcttaagacttattttttcaagaataaagaagattatgattcttcaacaggaatgtagtggctcagatttccaaggactgtgttatttggggcaatgagtgtgaatgttggaaaactagtgctggctctctccatccatttccttagcggaactgttttaataattttgtgaccatgaaagctggtcaagcagtcataacccatgaagtcaagaaaggtaagtacagtcctaactgaaaaggtcaggaaaacagtgatacagcctaaaagagggtaaggtttgagttttgaatgaaagtgagaaattattgcaaataaaattcagaaagtaatttagggtacaccttgaaaagtactgctgaattcattagcaggatgtagcatgtgctgttagaataaaaggcatttactgctactctccctgaagagggatttttgcttggttttattttgctttttgtggtggggttgggagtattcaaaaatccacataaatttgaagttttgtgctttttcacctttctcttctttaagcctcaagcagtaggtaatgggccataaaaatgattatttttgtatttgtttttgttagcccattttttttctactctagaacaatgaagaagcttggcctatttttagattatgatgtatctgtctgcatattgtatttcacttggaattatttgctttatattgagcttttcagaaatatgtgcagtataaaaattggaaattttaaaatatactgtgtctcttactagattgtttgcttactcagattattgctaaaataaacagacatatttagtgattgaagtcagaagttattacaatgagctttattttatttacatttgttagctaaattaattagcactttaatgcctcttttcccctttaggaatgttgtaaaaagatacttttttctttcctcagagattaggatgtctttttttttcatggaaagtaaaatatattagagaaaattattcagtggatgcttaaatgctaattccaagctagaataaaaggtagtacatttattttcacctctttcctatccctccacctttttaaggcaagtgtggggctttggggaaaatgagccaataaagataaacaacataaaatcacaatgatatggctggaaataaaatctggcctacttttcagcaatttcttgctgttctatatggtgttcacatcatgcataggaatctaactgcaacacattgttgtgtagggaggaattcacaataagacagatccttcattggttccttacaacaaataccaaaatacaaaaaggccctttttaaaaataaagcaagcaacctcagaaatggaagccaaggagagcatttatgtgaaacatcattatagtgatatgtgaaaggttttcctaaaaatctaatccatttatttgtataaataacttcttaatttgtagttgatagccatgcacttcggattgccaatttaaaataagcagcaccttatacttaattagttatcaaacattttagttgaagatggcacagaacttttttagtttctgtgtttgactagatatttttgtttattctcttcctaaatatttcataatgttaacgcagttgaggttgggtcagaataacaaaatacttttcctccaagatgatgtacacattgtcacccatcacattttttttgctatcaaaattttctaagcttgctatgacctacttaagggtcttacaacaagattaaaaattctagggaattttgttccacagacagcagtggattcagcgcttgtacttgtattttccagctttgttcctatggagataatgaccagtcttatcttgcaaacccactgccttcttttttggtagacatgctttttgttttgatttccaggaagcaataccgtttgaattgtttgttggactttgtaaggtaccgtgcatgtatctttcagtatttcatcaggagacacttttttgacatgttcacctcactgtaattctggtttgtcagcatctctcttataaacctgtatgtttcagcggttcatttaatagttttaagaatgttctggagtaaagcaagcactcttcccgtggcaataagattaatttgaagaggcttgaagtgatgaaatacacatagcaaattctctttcaaaaaagccagttgatgaattgcagctcaggagagagaaaagaaagagtggtggggagtgagggaagaggctggaacttgattaaaggttaggaatcagtgcacacaatggaaggttataagaattgggcctggttttctttctgagaagtttgtaggaagatgtgatcagtctttaacactataaagcttatatgaggaaggacagagaagagggagggaggggaggaaggaaaaaaggaaaagaaaactgtgaagataagaaagtggaattaaggtttcctaaagaaacaacaacaaaagcctttggtgtctcactttcaccaggtgaggagtgatgctcaactccactgaaacccagcagacaagacagggagtggaacgactatgtgaaggatgtctcagttgggtaggcaatgcactgggctgaaggccatccttatttgctaggtgtctgaaccaacccctctttccacatccttggatccagtgtcatcctttcttgcttttttgtgattgctagtgtctgattctttgatctagttgttaatagatagtggtagtatgatgctcctctatttgtataatcttcctgctgtttttccctctgccctgttctggttggcagtactacatgaagaggacagataggcatagcttcactatgttacactgcaaatcacgagagaacatggaccagtgacttctgccttaaaaggcatcatccttgtcctacattgcacctcttcctgagtatttgccatagattgtggccagtgcttttacaaatgacaatcgcccaaaattcaaacttgcttttaaaaagttcatgaactgagaaatctgaggagctgacttagcctattgctgcagcacctgttgggtccacgagttcattgtatcatcagagctctctccatccctctgtgaagacttcttctagcaagctttgtccatgtggctctaggctttcgtctgtctcagagctcaaagtcccaaaagatgaaagatctttctcaccaactctggttaaagtttgaaggaagagtctgttaagacttttctcattgcccaaatgagagggtgtagaatgtgtggggcctgtaaccctcaaactacaggaaataaatataattattagaaaagatgaaaggcaagctgcaccaacaatgtgtgttcactacagccaccttgctcctgtttcatgatttttgtagtttcattgtggtttagaaatacttgaaggatgttaatccattatttagctgcattaattgaggcggcactaacacagccaagtgggttattcatagttgactttgagcaggaattttgtttgtacagttgaatgtatgtctcagatttgagcatttgctgttcaaatccaacatgaatgctcatcccagcccttttctcagtcttgaggtgtgttctccttagaaaacagattcctgtatgcttgctgttacactcccaaatgctagtttaggcttaaaaggtcatcttttctgcattctgcaaaatgaagatcctgatcctctatattgttcagtaggaatctgaagccagcatttgaattggagatgtgacatgccagtagcagggttcttgataccatgaagttttcatgcagatgtaatggttctcctatggagctgctttgcttctattaagaaagcaaattcaagtcattttgaatcagaaagttacatttggaatgatttagatattcagatcttttttgagatattatagctatttaattgtcatgaatattcagaaaaacaatgaatcatgatactgtttcattttagccatattttgcacaaataatttctttctgtgatgcatcagtagtttatacttctaagaattaagtgggcttagattggttcgaattagtatctccttctgtggacacatgcaaacaaaccacccagtgagtgcaattaccgtctccattaacactgctgtctgttggaactaatgaatttccatgtaagttcaagagtgactgctggctgacattttagattattcaaccagagtgacaagttctatcctttaaattagcatggaggttcaagggttactaacagttctcatccaacctcagtttgactttgcaaaagatgttgcaaacaccaattgctggtctcgtactgcaaatgaatggtaacattttatgaattatttttcccccattttattttcctccctttgaggctgtttaggattttcatttttatacaacagtttcatatccagaacctgcctgaaagaagcaattctatgctgcataatttgagaggttaaaaacattctttcttctctagggttgccaggagactcagatatgctggggtgtgaagagtggatgtgcattcttcacacggaaggtttaattgagattttgttttctgggagtggccatccagcctttctgtacttgcacattcacaatgattaacttatcaggatgtgttggatccagtggacgccagtgatggagcacagaaccaaggaatgagcaggcacatttcagagctgggtgccaccaactaagtgatggatttttcaggcgcagctggaaggggtcagatgctgagaaacagaagaagaaaaactcaaaattgtaccttacttgcaaaataacattgcaagataagcactactgggtatctgatttatatttgaggtagacaataggaaagttctagccacagcattaattattatgtttaaataattagcggtctaaaaaataatcaggaccatgtgagcaggtttgagcagtaggatgattcggtgtgaaatgcttgttgtctaacgctgagagagaaatggacaaagggaacccagtgaggcaattagagactttttgtagcaagactgagacatcagcaacctgtgctcagttttcagtgcagctgactgtgtcagagagcagagcactgctgtcttgctgtgtagatgatgatcagaagtgttcattcatctctgagtttccattttgcttgatccaagttgttgagaaagctttcctttggagttaaagtttcacctacttgctaattcttaaagagactagaaagattgttttaagttattattcgacaattacaattcagccatttcattgggctgataaacctttagtgctgagattatgctagtgagatgatgtagttctgtgtttgcaatagtggagtagctgttttcaaacaagcattgataggtccttttgatgcaaggtctgatctccattctgccaacaaaatactttccctttaggaataagaatatgtattctcagagtaatatgtaaggaagatataagaaaccatttcttatctttgcttttaccgattagattctcagccctcagagggcttggattttgaacatattaacatattcctttgttggagccttcttcaggttaatctttttaaaaagtcgatttaccacttcccattgccttctcatccctctgggacctgtacttcatgctctagtgatacttagctaccagttgctccctagatggcttgctgttcctttcctttctctcttgctatccttttcgtcatttaaaactcaagttcagggctatctttgtcatggaggctttattgtctctctcccagatgtatcggtaatcctcttctatgtactgccctgtactcacctttagttctgtctttctcaaatggaatggtaactctttggtttcatggctctctccttcactagactgtgagttcggaaaaaagactgtgatttactcaccttgtctcagcttcttttcttggtactcaaatcagtgcttaagaaatgatgttgaaggaaattgtgtttggagaaggatgtcaaataaacatttgaaaaataaacccagtccctttcttttttctattttctgagcctgtgccttgatggctccatacaatcaaagctctttgatgcagcccagtttcttagcacgtgagtcttccacttaattaagttcattaaatctgctttgaccaaaataacaaaagccaaatgagctgatatgtatcatttgcctattagtttggtgcagacgattttttatttagttaattgaaattaactaaaaacataagtaaaggactgggcatggtggttcatgcctgtaatcccagcactttgggaggccgaggcaggtggatcacctgaggtcaggagttcaagaccagcctggccaacatggtgaaaccctgtctctactaaaaatacaaaaattaaccgggtgtggtggtgcacacctgtaatcccagctgcttgggaggctgaggcgggagaatctcttgaacccgggaggcggaggttgcagtgagccgagattgcaccactgcactccaccctgggcaacaaagcgagactctctctcaaaaacaaacaaggaaacaaaacaaaacaaaaaaaggagtaaagaaaggtagcctgtctctacacacagttcctttttctggtcctagaggcttgggactttagaattctgtaagagtctcagatttctccaatgtatttgtgaggttgaattatgttattatttatcctttttaatagttgtcccaaatgataaagtaccattgagtagcaaatgagttcatccaagctcattatgtccttacctggcccagccgagcaacattttctgtttacagctgaagatcgacctcccacctcgagtcactttcagtcatttccactctctttaatttgaacttttgttgcatttccagtggaagttcaaagtgcccttgaagtgagatgaccgggagagtaataggcaagggaatggaagttggagagcaggagtggaaaactctttctgtaaatggttcgatagtatatatcataggctttgggggccatataatctctgttccgaccacaggactctgtcattatagtgcaaaagcaggcataaacagtaggtcaatgcatgaatgtagttatctttccataaaactttgtggacactgaaatttgaattttatataatttttacatgtcacaaaatattactcttttaaaattttgtggaagaatttacaaatataaaagcctttcttggcccacaggccttacaaaaataggtggcagactggatgtagctggtaggctgttatttgttggccctcttttagggcagcggtccccaacatttttggcaccggggaccagttcatggaagacaatttttccacagacaagggtgagtgggggggatgtttcaggatgaactgttccacctcagatcatcagccattagggcattcaattctcataaggagcgtgcaacctagatccctcacatgtgcagttcatagtagggttcacgctcctatgaatccaatgccgctgctaatctgacaggaggcggagctcaggcagtaatgctgacccgcttgccactcaccttctgctgtgcggttgggttcctaacaggccaaggaatggtactggtccatggcctgggggctggggacccctgttgtagggcacaggtgtgcaagtggtaatgaggcctttattaagctcctcctatgtgtttgataatatactagtgttaagagttgtgggaactcaaagtttagtggaagagtctgttgcttgtgcagatagagaggcaagtgcaatgagaggggcttgcattgggtatcatgggagttccaaggtgaagccccagggttgggggagttggctgtatgcttgtgtaggagtagccagggaaggctttatggtggaggggacactctctcagttgagtctaaaatgatcaaacagtgaatggggctgttctcagcagaaggaaacacatgagcaacctggagttaggaagcagcattgtgagtgataggaactacaaggatctggtgttgctgataaagaaaataaaagatagtgagagaagagaccccaagtgaggcaggcagtgggccaggccacagagggttagcactttatttcattggtcttgaggatccattgaagggttttatgtgagagggatatgattgacttcgtttggataggtcataccggcacctgaatggaggaggaatcagaggggctgagaggcaggagctatcattagggtggctgaaaaaggaacttatcacactgatagagttggctatcctctccttggccagtcagcactttaaactaagaccagaagggcaagaagtctcataggtctcactgctaaaatagctcagatgcacagtgagtagctactccaacccacggtataaatcggaagctgggtctgttgtattccttgtcctcatccagggaatcttggagcttgtggtgatttcccttgcatagagcctaattggaagctcagtgagagcttagagaactcaatgagaatgaggtagaaaaggcagctttttattattattattattcatcactgaatccctagcacccagcatggtgccggcgtatggtagatgctgagtgaatattgaggatttggcttatgtcagcatttggaagacatctgtactatcatcaatgtcactaaatactttaggttggtcttcaacatttctgttgattagtgctttctcaatgacccagctgtgttatgcaaactaactttcttaacttgggaatttggttattttgtgagtgtatttagtagcatgaaataatgagaaagaagttgtcctttcctgtgaagttctgtagcttagaatataaaaggtaagacatttagttcagaaagatttgtatcactttgctaattatacattatgcacaaccaagaacaggccttggtagcattgttcattagagccccaaatttaaaaataacgaatgtctgtcagtatacaataaagaaagaaatagtgttattttgagcagaggtatgacttgatctaccttaagttttagaagaaccactctggctgtcagtggagaattgactgaggtcaaggtttctgaagcaggaagagctttagaaggctgttaattatccaggctacccatgatggtaatttgactaggttggctttggtgcaaggggcaagaaatagccagatatatactttacaagtagaggacagtatttgttgatgggttgggtagaggatgtaagagaaaggaggcaagaaaggaggtaaaggacttttggcctgagcagccgggaatgcattggccatttactgggatggaaggctaacagtagagcagattttggattgtgggttgagtagggtgggaaagagagttcaggagttcggtttcatagaggtattaaataagaagttgaatatactaagtatactaatctggtgttcaagggaaaagctccaactagaaatatcaatttgggagtctcagcgtttagatgatatttaaagccaggaggctgagacaggccccgtgtgatgcttgaattatccagtataatcattacatttttaaggcacattgattatttttatgaagtcattttatgtgaaaattgaaagcattgcatccttgtatctcctcaaagatacatatataaatagtctttcttgaaaaacaagtcgagatgaaaaacagaattcacgtatacatgataaacattttcttgccacggaaagccgtgaacaaagcagtttaggaaggacacgcattgaacagcatttatgactgataaggaaaagagacatgtttctgtactgcgtcacttagtctgctggctggcagtaatgtgaaatatcaaagttttattttatttttttaatgacatgaaaagagctagaatatagattaaagagtaagtctgtttttgagagtaatttttgttaatttcttaaagacatacaattaattgataagttgaggattttctttatggattttcaagttgcagaaataatgctgcacaaggtatgcaccccctttcagggatggagcacaaaatgcctgtctgcctatttctctttcattagtattctagtggttggattccaaggacagagtttttaaaaacaaacaaaagcccttcaatattactgatttaaaaaatagtagaaaggctaataacctaaaatctctggtctctgatccggaaggcatgatgtcatctaatgttgtgctttcttcctgagcttttgctccgtgagaagcaaaggatgtgtttttataatgggaagtgtaactgtgctctgtcaccctgtctggctgccttggatgctctttacaacttgaataggagtaaacaccaaatcttaagggggaaacagaggcttttgccaaagctctctgcattaactcagcaccaaactcaggtacatctcacagcttcaatgcttctccctacacatgcttccctcagctttgtagagcaactctggaaatcattcatgaaggatacgtagaaaaggcttctcagctggacacggtgcctcacacttgtaatcccagcactttaggaggccaaggtgggcaaatcatgtgggtcaggagttcaagaccagcctggccagcatggtgaaacgccattgtctactaaaaatacaaaaattagctgggcgtggtggcgggcacctgtaatcccagctactcgggaggcaaaggcaggagaatcgctgaaaaaccgcttgaaccttggaggtggaagttgcagtgagccgagaccacgccactgcactccagcatgggcaacagagtgagactccatctcaaaaacaaaaaaagaagaaaaggctcctctttgattgaagtggtacttgaattctgggggcaatttacaggcctttcacttccttagcaggaaattgcagcccgggaaccagagtttggatattaagaaaataagcatttcatcagggaaacatttactgatgctaactacttgccaggtgattataggagtagtcaaagaaatggtcaacattgacagctcacatgcctttgctgcccaggtgtgctcatcactgtgctgaacaccatccatgttctccatgggactcattccattcccacagaaccctgtgaggcaaatactgttattacccaaattttacagtctgaggaaactgaagcacagcacggttaatagctggctgggctcacgtcgttaataagtagcaggaatgggatttgaacccacctatgcagaagcctgagccatgctcctcaccgctactctgtgcctgcttccctctcaaggagcagtaattacagctgggacagccatcagctggtcaggggcggaaccctctcctgtaccaccaccgagctttgtgacctttggcaaattgcttctcttgtctggccccagctttcctcatctataaaatacagataagaatacctactgcagagagttgctgtgaggagtacttgtactatatttgtggatacttctggctcagtacatagagtggtatccagtctgcggtagatgtttagtaaacattgagtgagtgattataccgcgctaaacacataccacagcatttcctagggggaactgaatagagacagaggagattgcatgtgaaggggaaaaggtaaacctttctgttctaggtgtttttcacactgtcatgacatagaatatagtaccaagttaatgtccctgctcatggttagtggtcttttgcagtttacaattttgacattaatcggaagcataaataatcatatgcatattttttcaacatagcatttagtatgcccttcacatgatactgagctttctggggtttgtactgggcctactctgtagtctgttagtggtggagatcagctggctcatgtaaactagggaagcgcagggcgaagaaactctggaagaacccgtagacagggccttgatcctttttgtgtatagttgtgtttgacagctgtgaatggtttgggaaccctctgaggaaatattagactagaactccccttgcaataaataaattaaaatacataaacttgaaggaagctgttgaaagatggggaaaattagcttcagaggagacatgggagaattcatggaaatgatgggatcctttttggatgaaatactgtgcttcggctggtggccagattcatggagcggacccatctgacttgcccatgggaaggcgttagacttcctcctgcactgtaagtggcctcaggaatttttattccactttatgtgtagagctatggatgaaattcaagtagcacttcttttctgagctagtcaaaggataaataggtattgttttctatttactttcagttgtatctaccccttttcttcacctaggtgtaggccctttgagaacagatacctagtctcctatatagatgaaacatttcatatctctggtatttacctcatctatataaaacatagctaagaaccaacaagtaagtttctgaactaccaaaacagatttgccgaagtgtgctaaagctcctcatattcattggtagcattttattgattcttttttattcttaaatataaaaggctgatttctggagcaaaatagtttagaagagaaaaatcataatggctttgggcgtcagcttttgtcctctgtgtaccctctagtgttcgtcccccagcatggctggacatgataatgggccatctcccatcctcacttggcctccaccttcgttccagctgttgttgttgacccttcagaactctggggagaaatgggcaggaaaacgaagtacaaatagttggataagtatagagaaaatttaaggagttatgctgagaaatcccaaatgaaatttggattagatcatgtgttaggattagatcatgttttaccagagttctgatggtgacataacatgaaagaaacatctaaagccaggccattgtgattggcagtgaccacaccttttcattatattcttgctccctgaaaagcccagctttagttcacttattaaatttccttaatttttttttttttttttttttttacttttagggtaccagtgactctttggcatagaaagccaagtcagttttggcctatcttctgtgccacatggtcttacggtgctctcaggtttgagtttctgaaggtatgatcgtttaagtcggagactacaacacatgattgacatttcccctttctccaaaacaaatgtaaattctaaaatattggtttttcacgagaccagtcgggataagctacagactgcatgaagggcattaagtgttcagactgatacttgttttgtttagttttgttttatgctttaacaagcaaaaggacctgccacagctggggaatagtgtgaaggtgaacttttttacctggggggttcaggattgatgcacagtgagtagctttatatgagttacttctagcaggacccaactagattttggaaaactgacagggtgatctattatttctacacatgtatgaggataaaaaaggttcagtcttgtggcaaagaaaggaaaatattagctcttaactcatctgttttgaggagatcttggttaccctgtcctgtttgcttattgtgtcagaactcaggtgggtgcggagcaggtggtgattgagaaacactcagtacttgtatatatctgtcacacagcttcaaacacaatgtaggaaagtttttctgtataatgctgggtatttttaactctgcagctccaattgtaaattgggattttctgccatagtatgacttagttctaggcttaactcctaggtaagcaaacaaacaaattgactttcctggttgcctgtgtttttaggaagaactcacagcaaaatgcagaattttttttaaagacttcatcccctagtaggcaaatctgctattctggatttattaaaaagtttaaagattgaacaaacatttagtatactaaaaagaccttaaaactcagtgattaaaaaattctcaaaaagtatcttaatttttaaattgtatttcctttagctataagaggtaaagataggaaagacagcagggaaatttatttatttatgtttccattttaccagaagctgataaactcagaatttttaagcatataactttggggtcttgatggcctatggtcagtgttttgatccatttacttagattgagaaatagctgaattattcatttatatagattgctttttaacttccagaattcattaaaactatattcacattaacacgtattattaatagtgaaactattagtaaattgtcaatatagttataactatttgttagtaataacaaatgactgttagcagaggctataaaataagatagtttttaattacagtcattaataaaaggagaaaaagtcatatcttatatgtactttcatgcaggtacaccttattctagccatgcttagtcatttgagctcttgattcttctttttgttaatgggaattatctgtaaattcttgcacacctaaggaacaatatgtctcatcctcaatttaatttttgaacgttgaatatatttttggaactttttaaattgtcttccaaaaaatgaaatactttgaattgtttaacatttttcttttgaatcttattatctttgggcacttgttatttcactttgcattagctggatcgcaatgttatgggtacccactttgtatatgagcaccaagggcatgcacattgtcagatttagttcatggacagaccaagtcacctctgttgatggtcagaaaaataaaaacaaatgcaaaattatcatttgaaccaaagaactgcaatagatggattgttcctaattaacctattgtgaaatcagtgactgcttttggccctaacaccagacctattgtttgtttttgaagatattttggaaaatttatctcatttgtttggcaagtttcatagtagaggggaaaggagaaatatttctaaagattttaaccctagctaagcatagggattttgatttccatgaaaaaatgggtggggtgggggagggggatgtagggagtatttttttcaagtttcttttaaataatgtagcttttggcaaacaaagacaacccagatttcaattattgtagacaacatctggaatcaatagtttctgaaatttacagtgagaagaaagttatggaaagctaatttcattagcttataaaattggaagagcagaagaagagagggcatgattcccaggggaacctggtgccctctaaaaaccctgaggaggaatttaaaagttcatttataattgataagtgctgagttggtaatgttcatttttatcctgatttggctattacagtttcatgaattttgccttaacttgttattaaaatctctatgataaacaagcagcatttttttccttaatatcttttcattttaaaaatagtcattgagaggaagcagaaaggcttcatagagaatttatacagtggaaataacagagttttattagtttcctagataacataagccacatgaatactggttgcctgtgtttttttttttttttttttttttttttttttttttttgagctggagtcttgctgtgttgcccaggctgggttcacaccattctcctgcctcagcctcctgagtagctgggactacaggtgcccgccaccatgcccggctaattttttgtattttttttagtagagacggggtttcaccgtgttagccaggatggtctcgctctcctgacctcgtgatccacctgcctcttttaggaagaaccatgaatgccaggtttacaagtaccatatgtagaatgatgtgagtgttcctataaggcctttctagtcccagtactgtgcaagtctgaagaatggctgacctgggcttgacccagatcccagaagacatgagtcttcattccctcaactcccattggtgaggtagctactatattttccacaggggttgggatagggtgtggttgagagattggtgttctcagtgcagctatgttcccttggggaaaagggaaatgatggaagaaagcaaggtgtgttcataattatccagtctctcctgagggctgtgaacagtatggatggatcgccaggttgtggcaaagttagggtgaggcttttcaggaatcaaggttttctaggtcaggtggagaaacacagtactgaggaagagtcagctcatgttcattgtgtctccacatttgccaagacctctctacctctcccatactatattgcctctgctatgtataaatccctcccatcacccagttttcattacatgtgtaattattatttcagttgtttaatcgattaagtaggctattatgaggtagcttcagaatttagttactgattccaactagccaactttataacatttccaaaatgtaaatcctttgtaagatgctcactgtagtttgaagccagtgtcttattttaagtaagattttaatagttaaaatcagttaagccatacatacagtatgccacagaattaataacttgtgatagcttctgtgaatatcagtaagtcctaagaccttagttaaaaataagtgttattatacaaaataattaggaagtctagattcctgccagaaaatgaaacaaatatatataattttatctagattcctttataagtcagtgataattgcagtgaagctagagagtttgattcaaacctgaagatgattacagttaatcgtaggacccatcgaattttccttgaaaatgttggctgaaatcgctcaaaagcaatcttttaaccaaacacccatatacaaattatttggttaaggaagtaatatctaaagagatcatgccgtgtatgaaaattggacaaaaacgttaatttgtttccattttctgaaataaatgaaatgtttttcattttctgaaacacttgaaatttcacctgatatactgagtagtcgtttcaaggatgcctatggtagtagtattaattttgtactttatgttaaagaaatcaagactaaactaagtatattgtatccacttcaaaaagaacccattacaggttttgattgcaattgaaataatccagctgtgtctgaataaccctgtgacaaacatcatgattagaaatggctaaggttgcaaggcaaaaattatcaatggatgttatgagatatgatgaaaaacagtatatttgcatagtctgaaagtatcttcccttaagatacttgttacttacaaaggcaaaaatagtaactgtacagtggagaaacctgggacacttaaccaagtgatcaaagttaatatcaccagtaataaaacctatcaccatcatgtacctcctgatgagatacaccaagcagggcacaccatcacttctgtgatattcatgccaaaaatgcatattctacatttaattgtgaggaaacaacccaaaatttagagatactctgcaaaataaatggccaatatccttaaaagtagccaaagtcatgaaagacaaatactgagaaacagtccaatatgggaagagactaagaaaatgtaacaactaaatgtgcaatcctggacaggacaaagatgacattagttggacaagtggtgaaatttgcatatgaactggagaatagttaatagtataagttatggtttaaatgtttttgtcccctccaaaacttatgttgaaatgtaatccttttaaaaactcaggtgttgccaaaaagacagtattaagaggtgggaccttaagaaatgattggaccatggggactcctcccttgttaatgggattaaggccctattcaaagaggcttcaggctgtgtttgggtagtttacactcatgttcttcgtccttccaccatgtgaagacaaagcagaaaggctcttagcacaatgccagtaccttgatcttggacttgctagcttccagaactgtgagaattaaatttctttataaattacccagcctgtgatattctgttacagcagcacaaaatggactaagacagtatattttttcaacattaacttcctggttttggtaaatgtactatatttatttaagagcttcacatttgctgaagcttatttaagaatatatctttatactatttgtgttactttcttcttttctttccttctgttaccagaaaggggtcctgatccagaccccaagagagggttcttggatctcaagcaagaaagaattcagggcaagtccaccgagcaaagtgaaagcaagtttattggagaagtagagataaaagaatggctactccatagacagagcagccctgagggctgctagctggctatttttatggttatttcttgattatatgctaaaccaagagtggattattcttggagttaccaaggaaagggatgggcaattcccagaactgagggttcttcccctttagaccatgtagggtaacttccagatgttgccataacatgtgtaaattgtcctggtgctggtgggagtgtgttttagcatgctaatgcattataactagcgtataatgaagtgaggaccaccagaggtcagtttcgttgccatcttggttttggtgggtttcagttctttaccacatcttattttatcagcaatgtcctaatgacctgtattttagccctgccaacatcctaattcatcctatgactaagaatgcccaacctcctgggaatgccacccagtaggtctcagtcttatttttcccagcctctgttcaatatggagtcactctggtttgaatacctctgacaattcttctttcttcctttcttttcttccttttctctttcttcctttcgagacaggatctcactctgtttctcaggccggagtgcagtggtgtgatcatagctcactgcagcctggaacacctgggctcaagcaatccttctacctcaacctcttgaatagccaggaccacaggcacacaccaccacgcctggcttatttttgtaactttcttataaatctgaaattaattcaaaattaaaagttaaaaaaaggcagtgggcttaatttttttccacataagaataatagaactaactataagtgtatctgtttgctgtgtacatttaaaaatctctggcaatataaaacacagaggtgtagaactctgtgaggtgtagaaggagaactagcctgaaagcagacctcagcacatgtgagtcatggttttgagaatgctttttggtaggagagtacatcagcactttaagatggtgtgtgttggggctgggtccctatcttccagttcgcttttgtggtatttgctgaacaattaagagatcctcatttctaggtgctctgctggttggaatactagtcccttccttaaagatgtgtttagtcttattgaggtaacaaaattcctaccgatggtagaaattgataaatttgataaaaactaataaaatggattaaatgcgcataaaagaagtgctaattgaatgaccaagtgacaaaatccaagcacctgaagagttgtccatctacacattctgaactgtgttttgtagcaaacagaaaacgtaggaaacttctttctcatgacttaataactcaacaccagtgcaaagtgttatcttcaccattgtattcccagtgcctagcacaatactggcacatggagagtaaccattaaatattaatttaataaataagtcaactgcacaccttggtgatttcatcccattatatatttaactgacacttgttgagtacccactaggtgtcatgcattgtgccgggtattgggaacataaaggagccgcagaagtagaggtggtgagtgagtataatcagtgttggagggacgtaaatgggattggtgtggtggagttagggtacaggctaagccttccttgaggatggagggacttaaaggggattggtgcagtggagttagggtacagactaagccttccttgaggatgtcaggcctctgagccgaagctcagcagttgtaacccctgtgacttgcaaaagctttattgctcatacaaaacctgtttgctggtctcttcacatggacacgtgtgaccgaggaggatgcttgcgttgttttgaagaagacctgttaaggggacaggagtaagaggcccacatgtcaagtggagggaaaagcaatgggaaaggcatagataagagaggttcagtgggactgttgagtggggagttgtaaagggtgagattggaaaactatgcaggagctagattttgaaagaactttggactttgttcctctatttctccgttgaactgttcactggctcccctatctccttgagaaatagtttttgactaggtgtcaatggccagagccggtaaaaattggtatttgttcaaaattggaaattggcttagtcatcagagcaaaagggggagtaattgtaagaatttagactttgacttcttctgactgtaaggcaatttgtaggtaataatctagcagacctcttaagaagtcagcactgggaatgggagtcaaaatccacattggaaaaaagaatacctaagaagaaaaaatcagaaaaataaatgcttagttgtatgaggaagatgagtgattggagctgatacaggaccgaatattatgctggagagaacgttatagaagaggctgcaaaaataagctgggcattttaaagtggtgtgtgtggaggctgggtctctgtcttccaattcacttttgtgatatttgctaactttttttcgtgactttcatgatactgggctggcctgctgagtccctccggttgcgaggtggaggtggcagtgatatttgcatgtcccacttcaattctactgtgttatatgttttgtgactttgagtatttagtattcaaagagagaaatcagaaaaaaaaaggaacagagggatataacatttcttttctcttataaaaaaaaactaaaagtaacaaaaagtcagcaaacttaatcctgtatcttaaataatcttagttcttaatcttaaataatattatttgaatattaaccatctctcattggaaaaaggaggttttttttcatttattttttccaaatattggtggtggattaagtacaattggttggaaaatgatattttattaaaacagtttttcatttggattgtgggaaaagcagttgccttctgtaacttcattctccactgggacatgaagactgtattgtaattttttcctgcctcgtgctgtctatcgtcccttgcacaaataatactgttgtgcagaatgaatggtaaaagttgcatctgcctcccttcctaactctgccttagcatttttggaaaatccctcttaaccccgttactttccttatcagtctcattgccaaagattttttttttttttgctgccttatcagaaaaagcagtattatcagctttttttcctcttgaggttcttaagcctgcgtctgtctaagtttaacttaataacgatttccaagaaactgtaataacagaatagagaaagggttttttatttactattataaatggaaggcttattttggcttttgaatctatagcagattcagatctagcttccaaatttccagttaacaattatgatgaaaaaattctattatttcatatttacttacacatcaaattctcatatatttgtttgatccttgtgacatcctgtgaggtaggccaggcagggggtgtcatcgtgggctagcaaatgaaaggaccaaggaccacatggttcataattggtggagctaaatcccaagcctccatctaattcacattgttaccctttcctaagtgctaggaggcttttgaaataattgggctttctctcatctcatctaggatgctccttttgactggctgttgccaaaatcttaaccttttaatcatattacattgtttttagaagtatggataggtggatgcaataatcagcttaaacttaaaggttttttttttgttttttttttgaccttcagttcttcttgtagccacttaggaaaggaccttagcatttgtgacatgaaatccaaggtgaagagcctgtttatgaccctttggagaataaaacgggttcatttattgccaccgtgacaatgtcttcaaatctgaatgtggaaaaattccctcctgatgttgttaattctcttccttgtttgcctctttttttttctgtttctctatctctaaaatgagtattgaaatgtctgtgtcatagaaggttagaactaacacatgaaaaacttagcaaaatccttaagataaaatagtaatgcaatcatgttattttttcttctcccttagaaagaggactttaaacaaattgggccagaagtaaattctgaatggggagtgcttgaaagcttgtaagaggctgagcccctcaggaagcagaccctgagatggagattggcttgcagggtatttagcaggaagtcctctcgggattcaccccagtgcagtgacgaggaaggaagcagaacttgccagagggcgaagttgatctgtgatgcaggcctagtgacaatcttggtcagttaagtgggaatggccctgcagagttataccaagttgtagtgccaaggcccagccttcactggatgtaagccaccctgggaagcagccccagccttgagcaaagcagctctcttcagctgaagccatcccagaagggtgctagggttcgaggactatctaccccagcactcccagccacagggagagtcattgatttccaaagaaggatctgggaggggcatcacagtacctaccaccatgctttgccttggccttgtggttcaaggaggatgacattctgcaatccctgggagagctatcctcttaacagtcaaaggcagcaatatattttcaggtggtaccttttaatacgtcagaaacaattacgtacctttcattcaatatgcttctgatttttcaaagtcacataggccagaagagagttgcgtgacatgtctcaaaggctgaccgtgataactggcataagaatgcagtcctgcttttgagtgtgcatatatttgtgcctcttaggtgagcctgcaaggtgtgtgaggcctgtgggcacagcctattaccagatgaaggcagatcccaaacatgtggcaggtctgaggatcagaagatggaacacagcatttctctattcttcccagtgagttcatttgaaccatagagcagtatccaggagataccacttcatctccacgtagtcctactgtgacacacatagccacctgggagttcccagcggtaaggaataaccagcttgctcctaacttcatcttttggagggaaaaaactgaagggaataaagaagaaaaacagttctatgctatactttcaaaatgacagtaccaaaagaaatctccaaatgacttctgtctttcctccagccctgtcccagacagctagaaaacagggaagtaccttgaaatagactactgatgtgtttttttccaccatattttatctttccctacagtggggttttgtacatatgtagaagaggtgaccccttttccttttccatcatagttctccatttcatgaactaaagtacctgagaaaaatttagttctccttggccaggcatggtggctcacacctgtaatcccagcactttgggaggccaaggccagcaagttgcttgagctcaggagtttgagaccagcctgagcaatatggcgaaaccccatctctacaaaatatacaaacattagccaggtgtggtggcgaacgctttcagtccgagctactgaggaggctgaggtgggaggatggcttgagcctgggaagtggaggtttcagtgagctgagttcatgccactgcactccagcctgggcgacggtgagacgctgtctcaaagaaatgaaaacaattttaaaaaaaagaatttagttctccttaatccctttcctttttctctgttttttccaaatcttatcgaggttcttcagaaattctacccctttatctcttttccatttgtgatccccccaaataatcctcataaatgttgataaaccttaatggatacttccatgacacgccagagccgaatgtgaaatgaacatggatgtaggaaggaaccagtctgaagacctcagaggtctaagaattcctttagaatgtctacaacaccgatgcctgctccatcactgccttctgatggacactgctatgttttcagaccagtgttcaatattttacaagcactgatataaaattttatatttaattctggtgcagtcagcttatttttgctgtgaaaaacaacagtttccttttgccatgaaataggattctgtgggctagcctcagaacttgagaagagtagctttgtgtgttctgtgttgtaagcagttgactcataagtgaccttttaaaccacaacctgttcatgagttggagatccttttagcagaaagatgaagccaaaatctggcctgaagagagaagttttccttcctttgtatcacaaaagacaaagcattttaatgatttctttcctgcattatgttccattcctcttagatggtcagcctgtaaagggcaagggcagcatgtgctgggctggaattgacctgtgccaagtagaatcattttgaatattattttgacaatgatgaggaagaatatgttattgtctgtggcttacagctatgtgattgacttataataattctttgtttgtttgtttgttttggagatggagcctcactctgttgcccaggctggagtgcagtggcacgatctcagctcactgcaacctccgcctcccgggttcaagcgattctcctgctcagcctcccaagtagctgggattacaggcacccgccaccacgcccagctactttttgtatttttagtagagacggggtttcgccatgttagcaaggctgatctcgaactcctgacctcaagtgatctgcctgcctcggccccgcaaagtgctgggattacaggcataagccagtgtgcctggccaataattcttaatactttgttttgatttaaaattttaaaagtcatggactgttgtgattgagtttctttgtattcagtttaaaagttttaaaatgtccattggttcttggcatgagcaaatagcatcattgaaaccaaggaatgagtccccatttcactgcatcatttaccttctttttatcttcctcatagaaaattaggagttgtgtttgagactgtttctcacggctatttaattcttaataaactgtcaatacgtactaaactgatatcattatataaaggaatgatactgttagtaataacaggcagttggttaggacatctttttcaaaatggttatgctatgaatttagtgttttcagctgacagatattttttaaggactttcctgtaaactgggtttatatacatataaactgggtttattaatccaagtaaatttttccatagtagcaaatgggcagagatgaacacatcaccacagcagtagtttttatacgcagtttaaaattgtgctctcagggcccgtatgactaaaataatagaaccgaatatttatattcccagctttaccaaaggttcattttctgtgattgtttcctgtagctactaaggatcaatttataagaaactgttcaatttataagaaaaacaagaaaaggaaatggagggatcaaaacactgtataggcatctttggtaaaccgtgatattatttgggggaaaatgcccctgggaagtgtacatgaataaacttttgtataaagagatagctactttataataactggtgacaatgcattttcaattatagatgtatttcatgcagaaacacttggagaaatttaaagggatttagttgaaaagttgtttccaaatagaatttgaaaataacagatactttaagtgcatttgacagaattgcatattgaagcttcattaatgcatacgtggtgtatgggtatctgctttgctaaactggttttccttagtttatgatacattatatgctaccactgagaaacatgagccaaccatattttcaaattcttcgctctttacctagaactgcctttctctttcataacctgaagcctaaacatttttcctgagtatagtatccatccatctattcattagtacacagcaaggtggagttacttgtctaactcagtgattgagagtgacttgccattttagaagataaagatcaaagtcattccttgaactatagcctgaaaaatattcctctccaatatgatccgcagtttaaaacttattccttagatacttttagttacgagaagagtccctgaggttgtccgaatccattaaaacctagacaccattcctcagtggcttcattcattcattcattcattcattcattccatgtatttgtactccattcttatactcagatgttcatgctggctcttgaaagatgaatgagaaatagtttctcttcccaagtagaaagacacagatagacgaagtgctgtaatattatgtgatgccttactatatttgaggtgtggtcggagtgtcctgagaacacagatgagggagtaattgtattccacatggacccacggatgacaaaaaggaaggagtaacatcaggaaatcttctaatgtcctaaccttggagcaaagccttaaattaaagctgctttgcatttcccagtgtaggagtgaagaaggcaaccccctaaatagagaataatagatgtaaaagcactgaggtctgcaagaaaaagcttaatgagaatttgtgtgtggctgagcatagggcagtgtgtggagagttgggttgggtgtgagcctagaaaagtcggagagcagttgataagggcctcatgagatgctgagagcaggctgtctcttctgcattatcagatggctgttgcaggtggagacaagtgtccacttgatcacaggcagtgattacacagacaaggctggtttggaggcagagttctttggtaagtactatgccatgtcactgctgagctgaaagtcctcttgcagactcagaatttgcgactggcaggggaatttcagttcatttgtctagctcctttgttttatagaggaaccatctgaaggccaatgagattagggaacttctttgcttacctttaatgtttattacatattacgtagctgaatagtcaaatcagaattcacccacatagaccgtttggataagaaatgagataatacatggttatggctcagacaagctgtcatcccagttttaaacaactcctatgaaagaatgagttttcccatgtaatgcagtttttggttcttagatttttaagcacactcttaaaatagtattctcaataataaaagaacccgactgttgaagaccagagcatttaatggtgatggccacacccttaaaccataccctcattcactcacccagtgattatttacacccagccacacccttgttcactcacccagtgatgatttacagtgaggatgtggagattctgagaggttgatatcctgaccgaggtcacacaggtaataagtgatgagattggggttcaaatccatgtgtcaaaatgccaggcttgatgctattttcctacacttgagtgtctggagaatgaaacttggatcacaccaacctttaagaggagggctaagaaagaaggtgtggagaaggctggcgagtgtgacagaagcagtagaagattcaagaaagggaagattcctggaaggcaaaatgagtgtggccacattgaggggactggagatcttagtaaagcagtttcaaaacacagcaaaggctggattgcaggggctgaggaaagtgaagaaatgaagtctattagtagtactgctgtgttcaagaaggtgatgaggaaaaagagaggagagccagaagtgcgggaggcagccctgggtgtacaagggtgttcctgagtggtaggagctgtgtacaaaactgtgttgggaagtccatgcaccaagacttctaagagaaacatcagtagtgcagagtttggaaaggcaattctgagtataagtttggcttgaagtcttttaaattgcagtcaatctactgtcagttcagttgctgatcccttgtaagaagaggtctctgaaagttaaatgaagtaatctgtcaagatatatagacccttgattgttttgccagcaaaatgcttcttgcacgtcattatgaggctaatggtattcatggttatagttagaaaatgatatcataaattagtgcttggctaaatgttctgaattggtttctatccatatagttagtttgttctgtctcatggactttggcttgtgttttctgtcctgtgttttgacctctactgttaattttgttttgagatcataaaagggcatgagacttctctaaaagctcattacttattggcatgttttcatttttgacagattggtgtgttcctttaggtttttaaaatatacattcccaacagtagcaataacttattttggggattggagttatatctaaatctcactctgaagcaaaattataagtttccctcctaaaattttggccttttaagaatcattttcttttgatgtgaattgttagttgatttcagtgtgcatagtatttcataggagctgtcttctttctttttgtgtgttgaaatgcattttcttcatttctccatatttgcctcctttctgactcaagctttacttactattcagggaagaatcactgagctttattctctctataattcctggagttgccagaaaaggactaatctgtgcgtactttctccgtatggatacaccatcctagtcctgtcctgccctgcaaaatgtttcagaaaccaattaatctaaaccattaatctataattaattgtgatccccctccccattccaagtggtattgtgcaagtgggaattgtggtggctgtgtgtttagacctgcgggagggcccagtcattactaaataaagtgtctccgttgattactgcagaagaagactgcttttatgcaccacatactatgctaggctctgggcacgtaatggtaagcaaatggatgcagtcccttctcttgagaaacttacagtttatggaaaagaaatctgctccaaacaatatagcagaaaggtaaaccaagcctaataacaagcaggaaatatattcctcgtttattattgaacacatatttattaactactatgggcccggcatttggatgagggagtgaagaaagcagtgaaacaaaagggtcacagtcctttaaggagctctcaggcaatacctttgtttatatctattattgagtgatagcattgatatattgtgtattattttaataaatttcatatatgtgaaatgcatatttataataatctaagaagttggcaaagtatgtgaacttagtgattttcttagaaagatataaaattaaaatatgacagagggttccagctatcaaattatacttcctatttatattcatttttcctagtcaataacatgtaataataagctgtaatggacatgattgtcttcatatattctttatcattttttacagttattgccagtttccgaggaaccgttccatatggcctgtcattggaaattggagatacagttcagatcctggagaagtgtgatggtgagtagccttatgaacaacctcctcaacatacggctgttcataaagtctacaaattctgtccataccgctattaatctctggaacttttccagtagtcaccacaagtcatttttgacaaaattgtttcctgcattttcagtgtttggctaatggaaaggcatcatttcctatttttaagctgattataatattatttccttataatcattagatgcaaacagagaaagcagttgaagttaccatatctgtgggagttcttgactcagtgccaaactagaaggtttttctcagaatcctcaggatctagtagatcccacaggacaggaagaagcagaggcccagagcagacatggcttacctgaggttgagtagccagatgcctctggagggctcctgcccaggccaactctgctccaggcctatagtttcttcccctcaaacttggaataaaattattcaatgcacttgaataatattagtagaatatattgtctgactttgtatgatgattattaatttatgtagtaggcaactcatttaagatagctaatggttctcaaatgtttccattcctgttccatgaaacatccttaaatgctagtccttaaaaagatttctgatcaaatgactactttgttttgttttttgtttttctttgagacagggtcttcctttgtcacccaggtaggagtgcagtggcatgatcatggctcactgcagcctcgatctcctgggctcaagggatcctcctgtctcagtctcccaagtagctaggaccaccgggatacttcattatgcttggctgatttttttattttttattttttgtagagacagagtctcaccatattgcccatgctcgtctcaaactcttggcctcaagtgatccttccaccttgaccttccagagtgctcagattacaggcataagccactgcacccagctttcctttttctttttttctttttttctgtttcctttttttttttttttgagatggagtcttgctctgtcacccatgctggagttcagtggcgggatcttggctcactgcaacctctgcctcctggtttcaagtgattctcctgcctcagcctcccgaatagctgggattacaggcacatgccaccacactcagctaattttttgtatttttagtagagatgggatttcaccatgttggccaggctgtcctcgaactcctgacctcaggtgatccacccaccttggcctcccaaagtgctgcgattagaggtgtgagccaccatgcccggccacccagcttttcttgttaacaaaatgactacattttagagccccgttagtatatccgaaaatactcatgtttttcctcttttaaggttttccttactaggaatttatattatgatgatatttttatcatatcaaggtttattatagatgaaactgtattcccccaaacagaactacgacatttagttagaccctagcattagatgctggtgatatcggaatgtttattctgtccactgtgattgataccttaaaaaatataataagatttcctgtgttattgccagatatattttgtctgttactactttgtatacagataaatataaaatttattgtgaattggtgcatgaaactggactgcatatctaataggaggtgttttgtaatctaagactttttctgtatagtataattggacagagacctctctatgacatttttgcaattctcaagaagttttgttttttgttagaataattatttacaaatggatgtatttcttggatctgtctttatggcaactgataaaccctgagatatagagattctgattttcagttcattctgctctcctcagactgattttaaaactgttagggacgatattttacaatatatccttttaagaaaatgtattatgaggaggaaaaatgtttaaatacaaagctcaaatatttgttttgtattaaaattttgcctaaaatttaatcattgaaaaaattctattaggcataatatttactacatagtataataatttttttgccaatgagcaaaatggtctttacacttgaaaaaatacaatatatatcctgatttgttttaaactataaaaagacatgtaaggatagtgctgcaaaattgattcagaattgctgggagcttaaatccagcagtccttgagcctgcttattggcaagggatgcgacctaagacccccaggatacctgcaaccttggatggtactgaaccttatacatcctacattttttcctttacatgtgataaagtttaattcataaactagccacagttgacaagaactaatgatgaaatagaataattataacaatattctgttcacagtttcatgaatagaagattcatttttacctagattttagcaacctcagcatatgatttttttttctttccttattaaattcaagaactttcaccttttcacttaaagcactttatggcttctctttggcacttcccagttgccaacatcactactcttgtgccttggagccatgattaagtaaaataagggtgacttgaacacaaggactttaaaactgtgatcctcaatctggtaaccgagagggctagtaaataactaatgggtgggtagcactgacagtgtggatatgctgaacaaaaggatgattcatgtcctgggtggaactgagcgggcaggcacgggatttcatcatgctacttagaatggcatgcagtttaaaccttatgaattatttctggaattttccatgtagtatttttgcacccaggttgaccatgagtaactgaaaccgtggaaagtgaaaccgcagataagaagggcctactataatagtcattctacagaataaaaattacgctgagctcttggtcagccattgtgctgatgaaaatgtgccagttaattctggcagtgaatgatggctttactctttgtatgatatgagactgatcttaacccaagaccgtaggcttaaggatgtgcaattcacgtcatgactgttggccaggtactattatttggtggcagagtctggcgtttgtagtcaggcaagtagaatttggaaatgtatgaaatcttgtgcagattcttgactttccctgtgacataatgtggcctttcataaaatgggaagaagtggtactcagagatgtcaagtaacctggccaagattaaacagacaataagaagcaaagccagaattgaagcccaatgctctgattttaaagcctttattcacattatgtatttttctgttgtttataaaaatttttgatacagttttttaaaaatggttttattaatagaattcttatgtttggtcactcgagctattttgtagcctaaggccaatacctaccatatttatccatagaatcttttcatgtatggtaaaattccatcggcaaagaacagattgatttgttattatctttaaaatattacaatggtttatcaaaatatgaccatgattatttttccacaggctggtacagaggatttgccttaaaaaacccaaatatcaaggtaaaaattgttatttctaactataattatgaaatttattaagaaagatagttatttaaattatttctttatacaattgaaattacagttgggactcagttgaaatgccaaatgatattgcaaatttttataattttggaaattcctttgaacttggattatagttaagatatgctactcaaatgataatcctatttagctcttgaaaattgtactgagaagaccttaataagctcattatatataaacaaaatctttttgaagtggtagtttctcagagagctaaattaaaattcaggcaggggaaatacatatgccaaaagaaatattaaatagcagtatttaatctttatgttttccatggtatcatttgtaaaatatcggtatggagaaacaagtatacttagcggcatgttaagagtccctttggatttggggggctgaagccaggaaaacaatattattaaaaaacccatctttcttaccatttcaggcagaaattaagattcattatccttgatacatttctataaatcctcaggaattagagcaagaagtaatgtcatttttgttttatcttttatttgtatagtttgcaattttgacagtaatccttactaatatctgtgtttttctatcttactctaatctcctcagtcttcacctgtatttcctacattctctaatattttcatatatgtcatttttttttttggtttaattctagctttgggattgtagataagaaatttgtattttcattctcaaaatacacttttgcctttttccttaaatatgccattttctggatcattcaactgtgtttaattacttcatgtattttaggtcatcctaaaggggaacggtaagggacaaaagagtatataaatttaattttttaaatactttactcctcatttaacattgtttttatatatctatgaggcacatgcaaatatagcttcagtatttaatgaattcatttagaccatatttgagaaggaaacttagtatgatttctctgttatttctgtcacttctaataaacctcaagtctgacttttcctgattagttagaattactctatttgttgatcctaccatattgaagaaaacaagtgcgttttaaaaatctacatatatatatttactactattgaatggaaagaatttgcctattaaattttattttatacttggatccacaatggtgatatatatattcaaatgacatttattttcttaaatatttaattgagtttgtcatttaattatacattagaaattcttcagaggataattgccatttaatgaacaatcaaattgatgctcatttttttgttgttgtttctttcaatttcccatttagaacaaagaaacaatttccttgccttgtcatttcctacaataaaaagcttcaagctaacatggcttcttttgtttgatttctgttccatcagaatggcagcatggtgattaactgttgctgagttgtcatcaaaaatcttccataacacagaatacacatattatctctaaatttgcagtgatattttttgtatgtatattttcaagagaaatatgaatgttttggggagaaaaaaaggaactaccatcaaaacgaagaacctttcaaaactatgcaatacatattttgtaaactcttattcagtataacatggtttttatatagaattcctgaaattttcttattttctgtttaataaacattatgttttctgagtaagatttaatttttttgatcatatttgtttagaatgtctctaaatttttaaagtagttaatggtagaaaatgaaaggatggatcttaagccacagtagatttcatccaagagaatgtggtagagatgttgcttttccctattcctgatgttgtcatggttgtatggctgtgttttatacaaatgacttgtgaaaccaaccctgccttaacagccggcatcgtaaccttcatgttttcttttccagggtatatttccttccagctacgttcacttgaaaaatgcctgtgtaaagaacaaagggtaagaaatgagttttattagtagttggaggattttcacagagcctttgcttcttttggaatttgaaaggcatagtaattgtcttgaaaaatgaactgtagaagatcataccattgtctgtgttctttgttaaagatatattgcattaagaccgttggtggagaaaattaaagaaccccatctgtgtgtgctggacaagaggatctgagagactggaggtctctcagtgtccacaaatcagggaatcagcctatgcttgagcagaaggagttggttctttttggtttcttgctacttagggaagcatgtcagtcagacccattaaatgctgtcatattatctcaaaccccaggaatttcctaggttcaccactgattctaagatgcatagtgtgtctttctctaaatgggcataataacatattcttgtgtgaccacttcacaaagccattattctattttagagaatgtcatttatatgatactttgtttgattgagctcattgatcacctagtatttctaatacattaaaaaaatttctagtcttatttccaaaaggatttgaagtggcagtcactttaacataattccaataaggtacagcaggataaaacagaagaacttgcctgtgtaaatagttagcataagcagatcattcatcataaggggccatggatttagacacaaacatttggtgtcagtgtcacaaggactattcacatgatcattgcataattttcatcttaggacaacagaatacagattcagccatagaaattatattttttctcaaatagtgataaatagcaatttattatttgaattcttaaagcatagtaatggcattttccaacttgagtcttaagataaaagttccaacgaggctattcaaataatttcctcctcaataaagatatgatattaaatttcagttcagggaaacagcctatgcatgtggctaagagtctatggtataaatactttgagagttccctatatgggtaaaacttaaagaatctcagagaccattactctacatgtcttatatatgtgagctgctttaagcatgttagtagtagcactcagtaatagtaattattgaataatagattaaaagcataattctaattctaataattaccactactactactgatcttttaagaaatgtgtgtcctttggaagtgtgcagctataatccaccagaagcatcaagccaagttgttggtccttttgaaactttcctacccagctagatgtgataccattcagcctccctccagtaaaccagaggatacttcagaatacactccagccatatgcttactctttgttctgatccttctgtgctagtgatctgggcttggcaatgtgaaaacaccatgggctacccctgtttcttaaagtgtccttttgagcaagcctgtgcaaccagtcctctttgctgcctttgtcccaagcccaaccctgacctccctcaactctgcagtgcaaagggcatcatatgctctgaccaaggaagagaaaagagagaatgctgtgctagcaaagatgatgtcaagcatctctccacttaatcaaagtctatccctcaaagtgagttggggtaggatatggtttttaaataagtacgtcctttttttaaatcctggttagtaactggtgtatatctgatccccttccatgagccccaggaagtttaaatgtgggtaaagtacctaaaaatttggtcatgtaagtttaagactttcttatggggtctccacctgacactaggtatgatggacattgtgcagcagaagaacagaaaagcccaacattagtttctgtaaaagacttattggaattgactcagaccctaggtctagggctgttactggaagaaaaactttggcctgaaaacatttgagagcatgtattgccaggtaattgctttcccagagaggaacatctttggggttttggtattacctgtcttattttaagtggatttatggcccactaggatgaaataatggaaaagtccatcctagaataattgaacaaaatataatttcagaggtaactacttacgacagactatttgaacactgattttgggtttggaataattaatagaaaacagtcaccttgcctaaaatggcaattttatgcttaaaaatttaaattttgcttggacaacccccaatcaacttctcacagactgaattgcgtgtatgttctttcttgtgtcttcagatcaatgtaggactgttggaggtcaattaaattatagtttatggacagggaggccacttctgtattgtttaattcctactgaggtcatgtcactttttaaatgttaagtagtatgtcaggtttccctggaaattcagtgtttcctccttgaccttgtataggatcattttataatctccatctccaaatattcatcatttaaattgcaaacgctgcttcaaaagcaaaataaatgtaccaccatttaaaaatgtcatatacagacttaataaaaggttctgtgtctgtcacagtttatatattactgtttacttttatttctagtttaaaatcccagttttacattttcagctgtgtttaagctctagaaagaaggaaaatattcatagggcaagtattttagcagcactgcgaaatgaggagatgaaactctgttgggaaaaaaatcaaggcaagattttagtttccatatgtctgacaagaagattttacaaaagacaattatatacactttggacataacatgaaaaaggaatcacagaacagttattagtctcatgctaagaagtaatttccccttgatcattagacaacatggttctgtgtctaatatgtcattactttctatgtattagacgttttcttgagaaaaatatactgaaataaagaaaatagtctcaatcaatatatcagtagcattctttgggaagcagtggtagtaatagccactaaaccactttcacctgcacatacacacacacacacacacacacacacacacacacacacacacacaaagaaagaatttgaaaaaagaaactggagatgaagattattatatgccaaaggtaggatacagaggacaaattaaatcttctcagccaggcgcggtggctcacactggtaatcccagcactttgggaggctgaggcaggcagatcacaaggtcaggatattgagaccatcctggctaacacggtaaaaccctgtctctactaaaaatacaaaaaattagccgggcgtggttgcaggcacctgtagtcccagctactcgggaggccaaggcaggagaatggcatgaacctgggaggtggagcttgcagtgagccgagatcgcgccactgcactccagcctgggcgacagagcaagactctgttctcaaaaaaaaaaaacacaaaacttctcttttatttcccccatctcctcatgcatattctcaacttcaggaccaccatacacaccctactagatattgatataaatattttccaaggatagtttctgacttttagagaagaaatgagaagactacgttactctaatcagaaagaggaacattttggaacgaatattcaaatatcggtgatgtcataagccataagttctatgctgtatgataacattacttagaatactaatcatttctcatggtcctagtttgcaaataataaaaattaagtgttaccgagatcaagagagtgttcaattagtatctcagtgtctagttacttataacactgagttagtttggatgcccacagccatcatgtcctggtgattgaatggtgttccttttactctctttgagtcctatagtcatagcccttggaaggcaaaagtcacctcagagtttatgtagcccagtgacctcatgttacagatgaaggcttttggccttaggttaaatgagttgctgcctagtcgtgaactggtactggagtgcaacccttctgatgctgttccttcttcaccacgctgctcaaacttgatctggttgaagtggctggttgttctggtattgtcctaccacaacccatgtagcattcctcacattaacttataaccagatcctggttactgtctgtagaacgaacaatagctaggcagctttcttttctagttatcttttagagtatttaaaacaaaattgttgtctatggtatttacatatatactttttcttttttaatttcacagacaatttgaaatggttattcccactgaagactctgttatcacagaaatgacatcaacattaagagactggggaaccatgtggaaacaactctatgtggttaagtagctttttaatgacacgatttttcgggtaaagaattgttttaagaaatacatgaacatgagtaagcattaactaatatagcaccttctgcaagtctccaggactccttggggatatagatattaacaagacagtcttgttacaatctctgtgtccactgagcatgggttttgtaagttatttttcaataccacaggaatataaaagattatttttctggcatctaaccaaataggatggtttacatggacctattgttgaacctcctgaatatttttaatttccagggaaaaataaaattcaagacaattttggtggctttggtattttatcaaattcaaattctgtaagtaattcaagtatactgtaaatgacagacttcttagctagtatcaatgagaatattctaaatatactagagaaaagaatgtttcttgaggggaaaaaggatctgtgttttgcagatacgtagtatatatttatttacttactataagtaatcacattgggaacttatgtggcaaatcccatggtaagtactctttgatgcagtatcttctttaatccttattactactcaaagaaataataatgatgatcacatccagcttacagatgagaaaaataaggcacagagagtgaagtactcaccccacatcaagtaatgggaaaatggctgagctggggttctggtatgaatatggtgctgtcactctgaaccccactgtaactgtggaagtctgggggtggtgaaatattagggaagaccccatgctatttcttcttttatttttaaagaaatttgtagaacagcttaatcatttgaagggattaattcaaaatacaaacgtgtgcttatcctgacaaaacgatttaaaacagcctgtcgaggaaaaaatccaaattagtgagggacactggcagaatgatagtgtttattgtctgttacatctgaaatgcaataggatatttcactgaggcaagaaaatctgacaaagtcactagtgaaaaccctttgatgttggacttctctgattaaaccctcctgtagctggtagctttagaactcactatgaaaatccacaagaaaccttaggtgaattggcggagcataggttttgtaaataacaaagtcaagataaccgacctcgagggctctgtgctagggaagtgcaaagaaatgcagatctcctttttaaattttcttttttttttgtaaatgttggaaagaattcaaaatccaagtattatttcacttaaagtaacattgggcatggcactaacatggaaaaagaaactatttgaaatgctcaaaccactgcattccaaatacccgatataagagttataaaaataatgacagtgtgagtgttgtccattagctgaactagaacacaaacacttttccttttatatagctactagtggggaacaaagttgaatttcctctggattctgccttatctagctatttttacctgtgttcgaggtttcaaatgtctgttttggggacagactttgttggtttgaaaatctgtgtgttgtaaactctataagtaaactcctttcctcctagtgttctgagtaactgggaaagagaaaattatctaaatgtttccctggacactggaatggtagtcagtgccattagaaacaaatattaagtttaactcagaggtattagatttttgatactaggagtgaagctaccttggccatgtcagacctttggtttctcttttcctaatgtaaatgttttgtgccaaatgttttggttcaagttcctcatgctcaagtgtgtttaggttattgtccatcgtcttttccaacagttttaaggcacctagcttctctactggaagatgtttgatgggggccataatattttataaattgttagcaatttatatgacaatgcttagcataaaagcacatggtgaatgcttgaaaagtgctagttgctctttaaataacgttgccaaggacctaaataatggtctctaaaaataccacttaataatcagtaatgtaaccacaaaaagtttaggagaaatatagcagccatcttttactgagtacttttgtcctgtccctgagctggacattttacatctctttttcctggggctctgccaggcactttttttttttttttttttttttttttggagacagagtctctctctgttgcccaggctggagtgcagtggcgcaatcttggctcactgcaagctccgccttctgggttcacgccattctcctgcctcagcctcccgagtagctgggactacagctaccaccatcacgcctggctaatttttttgtatttttagtagagacggggtttcactgtgttagccaggatggtctcgatctcctgacctcatgatccgcccacttcggcctcccaaagtgctgggattacaggcatgagccacctcgcccagcgccaggcactttttattcttgaatcttatcaatgataatttacctagggtctcatgctgaagcctgaatctaaatctaagtctgctgctgccaaaacctgtactgttttcattttaaggcaaataaaagctcatcgctttctaaaacactaaaatactctcaattaacttttgctgtttttttatgtttccagaatctcttgatattgttttattccaagtgtttaatattgtaccctaactgttttcatttagcattaaatcaaaagcatttttcatatatctgaatagccttcataactatccagtgtttaaagaatcatgattttatgaccagatgttcagttttagaactttttcttacactagtagagtaggtttgctggccaggcctgcagtatgtcagcattcttgccacacctgggttttcttcccttaatggagagctgaccaactgattttcagctttataagggatcctgcaaccttttcttattagtgttctcttaaacttaagtactagagatgacatcacagaaaatcaagtccatcctactaaacaactacagaacgcctttcccaagagcaggcaggtgactttctccctgtgacaatcagttcaaaaaggcgctgtgtctcttctttgctacatgagatttgacttgtttaataacttgcttatataattttattgacttgggtggacttttccttcctacactgacttcctcaagtgtttgtatcgcctgtacagaatctacctcttgagatccacaaaaattaacatgtgtaaatcaagctattcattcatgcattctccggctgttagggatacacaggcagacagccatgtgattgggcacttacagccacagggaggacatggacattgagcagttaattacaagagtattgtgttacagtggccttgtaatggcttgtatgggagtgtataacatgagttaagagtgagaagcaatagaagaatgggctcaatagagtgccttcggagttgagagagaagcaagatgatttatattgaggaggatcagggatggcatcctggagaatgctttttgttcctctggcaaatttgtctgacctgcacatcatgtgaaaaattcaagacaccaagtaccgaaaaagcagataacacgtcactactttttaaaataaaaaatacgtgatgacagaatgtctttacccatcacccagaatttgatatttctggcagcttacagctgtagaagactttagatggatgataacctcagtactttcatatcactactcatgaggtccactcataatttttgtagaaagtaaaagcatagctgctggttaagaaagacaaagggtaaagacttagataagatttactctattgtctctggggtaagggatatatattttggttttggggaagaaacagtatttgtagagggctcattctggaccaagcccaaagcaataacagtactctagtactaataacagctaatacttacatattttttctgggccaggcatcattctcagagttttaataactcattaatcctcacaacaaccctgagaagtaggtactataatacccgttttacagatgaaaaaaacaagcacaaaaatgttaatgaattgtcaaagctttttcagccagtaaatggcaaaactgaaattcagattgaagttgtttggctctaaataagttggtattctctgccactgtgctgtagtgctctctgcacagttgctaccactaatccataaaacagccttgcagaaagaatgtgctgcccatgtacagatgacaaaattggtacttaaagtctgtaccactagtaagtgacaaaaccaggattttaacttgtcttctttccagtaaaccacagagcttaaatgaattccacaggagattatcttgaatctccatgattgttttaaaagtaaggaagaaagcattacctttttaaaagtctaaatactggcccgataatagcagtgcatatccatcaatgaatgaattttgtgcccaacttctgataggggatccaataaagtattgagaccaatgtgcaagaaatataattggaaagcaatgtcttccatttcatcagctttagttgcatgcagccatggcacagagaagggagaaaagaatgtgagcaaaagtgatcagggaagatttcctgatggaggtggaagtcaagccgagtcttcttggatagtagcatttgagtagtgtttaaaaaataaataaataaaaggagcacgtgagaagtaaagttgcatttctggacatgagagcagtgttgtgaaacttagatgaagcatatagagaaggcagcgagtgtgtttgaggatagtgagcgaacagtttgtctgttcacggacatctgtccagagtggcaagcacatagtgggtaaccagaatgggcctcttccctttcctttttggttaccccacaactcagtataggtactgactgccaaatctccacatttgtatatttcttagcgtaatgaaggcgatctcttccaccggctgtggcacatcatgaatgaaatcctggacctgaggcggcaggtgctggtgggccacctcacccacgaccggatgaaggacgtgaagcgccacattactgcccggcttgactggggcaatgagtgagtattgagcatcacagggcggcctctagtaggtgaacacaatggaagtgacataggcctgagccagaacgtggtaatgtcactggaagcaatcctatgggctttttcatgtttcctgtttttggaggcttagtgcgaactggcattgatagagccgagaaccatttcttctcaagctggtgtaggcactgaaatgtcgtttgttgtctagtatcgtatgtggcttgatggtgtggacatgctcatggaaaatgaaatgttcacagcaatgaactagatgtggcgtctgactaaaatggatcttgttctcaaataggctttaggtttggcatgtggatttgcttttaaaatatatcttttccatgtcatggtaataggtcaccagtgtaatccggagggagacactaatgttaacagcttctgtgaaaagtcttatgacaggtgcactggtggggccttttattattgctgtgattagtcctgtacatacacattagctactttgaggagctgcttgagagaactcagtaaaaagctgttcttgaccgagatttatttttaaacaaaaccataagtgactaatttaaaataccagccaggtactaaaatggtaaatctaatcactgaaagctctgaccgaggctgatattttactaaacgtgaatattaacatagaagtgagaaattagaataagccacctttgactgagaccctagggttgcgtgaggtttaggtttaaagcagtgacatggttccttaataacccacatggccctatcctcccttcctttcctttctccaaatccccatttgctatttggaccttcagaggatcttagggcaacagaaaaaaaaggaaagcagacagaaatgaagaaaatgacaggaagtgaaccgtgggtaaatttgcctcttactgaatgtggaaaaaccaatttgaagcagaatgccacttcccattaccataggaaatcactttgtcagaagccaggtttgattcttcccaagatgttgcacactctgaatgtgaatacccagacctactaacagatttttaaacctccatctcactcagaggacttccggtattttgttgaataggatgtgccattcatctttttacagacaatgaatagaagagcccaattcatttatctctagaagattcattcctgtgagaaataaaacaggtacaaatgtggaggggcagcaagagcacaggactgggagctctgctttcttaggacctgaagcaaattccttaaccctcttcatgtcagttcctcatctgttgaaggaggaagttgaactagaaaaagcacaagggcgctttcagctccaggatgacatttaaaacacacagcacctcctaacagattagacttgccagccatttacagggaacttcctatcctgccgtgggaatgaatttcacaggagattatctcgaatctccattattgtggagtgggaggggtccgttggagcgaaacctatgctgcctaatatttatttctttattgttttgaaaaacctttgaggactctgaattattttgggtcttagtcattatgctggtcctcatttaaaggactagtttgtaaataggaagaaagttggaggaagttagcttatccaaaataacacaggaatgtagatcaggcaagaaaatgatacttcttcagttttatgaaagaaaatgatggcagaatgaaaaggggaaggaaggaaaaacattaattatgactgaatcatgactcagtttttgacttacgtaagttctggcttgtactttgggcagttctgtggctaatttatgataagttggtaaaacattgatgcatgaaaatgagcagtataatttatttagatcatcttcaacttcatgaattttctgagctatgattccgttttctttgaaattctttgactgtttattttaaaataacttacagtacagagattatgaatttaccttattcctttaagtatacatttgttttcttattgaatagtgctcatggaaagcaaattaagataatctcttgcctattaaaccagatgaaattgtcctgcaaaataagctgccagcacataaatctctggatgaacataaattaagaatgtgttccatctcacgttgtatatcaaactgttgaagagtagtgaagagaagccctcttgatgtgggaagcttaggaagaagagatcattaatctcatttcctaacagggccagcaaaagaattgttcttgcctgggaacctcagacagcactaaaataatggtacatgtttctgttgcccatacagtcctacaacacgatgttctttgacttttctgctaatactatgtgggaggaggcaatcagttaatcctttcttcttggtgtcacagagtagtttagtgactgagttgatagaaaacatgacgctctccctgtgtgatctcctctcatcctctctcttccctacttgcctcatttctccttattctttgtaaggcacttccttgattctactctgtgggctaggaaacctcaaaccatgggaagatgtacctaggaattaacaaaaccaaatagaaataaataagactcttcacataaccaggacgccaggaagctaacagaagctgaacaatcaagactatgggagaaaaaggcttgtagattacaggtttctgaggctgcagaatttctgcactcattctgcagccatgtaggtcacctgtcttcacgtatcttatcttcctcctgcatgtgactgatgtctgaatttccaagttcagattctcaaggaaggaatcttattgacagccaatgtctaatattcctgtttgggctgagcattttataccagcctctcataagctgctggccagtctttgggttatttgtccttaggtcaggtgcttacccatggtacaatcaggtgtggctcaggaaggggagatggtcagatgactaccttgtctgccaccaccactcccagcagagaaagtggatagagcagcttctcatagaaggagctatgagtaagacaagtatcacagtggttatatgccctctttcatttgctaaatgatcttcatcagcaatattgacccagtgtcagatgctgacttacactgtagtacggtggttctctttcagaagggaatggagaatggaaaacagaccctatcagaatccctggtgagatgtagcaagggggaacatggacattttgaaaacaaatcacagtgtttattgtgagttaaaaattcaactaacattaaataatgggtgtgtgaatttttttctaggtttcccaaagagaaacatcatttaggaaaattgagaaactgttttactatctgaaagacagctcctactgtcaaggaggtgacagctttctaatcttcttaagaacaaatagccctcagggtggctggggcagtgcctggcttgaagtaggtgctgaattaataaattttacttatgaaaccttaatgagattttgggggagggcatggaagaatttcagatttttttaaaatacgaaagtaagaaagctgtggttctataattggaagtgtgatgccagaagccttctgtgttagaaagagtggtgatgtgaaaaggatttagaacaagtgatcctcagagaactgagcattcggccttggatgtggtggttgagggggctctgctagagaagagggtatcatctcggccttgatcgatagggcattacacaggcgttgtgtagcctttgagatgatcatggagggttaaggagatgaacagaactgtgtggcattggtgtcagcattgtaccgtgggtgccctggaggggatcatgctaggaaggtcgctagagggaagctaaccagaatagagttagactcgtgttcctctgttgatgggaagacatcacaagtcagttaccatacttgatacctctgaggctggatataaccttagaatacttctcagcacagcaagccacatgtcagccacaatgaaatctgacataaagggttaaactattctgccagcccaggcccaaaactcttcccccatttccatttcctgcctttactgagtttctcctaacgactgacctcagaatttgctgtaaataaggaccatgcacaagttgccagagattcatataagaaacatgttgactctgggcacagctaggtatactggtgctaggtcaaattctaaagaccaaatttccttcccctcaactccaatttctagaaccaaatgatgtctagctctagtttccattcactccagtgtggaaggccttctcgtgataatttgaagggcgctgaaggctccacaccatgtggtgctaaggcccccagtggcaggagcactccactgagagtgccaacccatccctcctggatttgcttgtctttctcaccttctatgttttaagttttgcccagtgtccagcggagttatattgtctaccccaactgtggtaacaagtcatacaaggtgagagaagcatggtgggtgatatacctaatttccaagtgatatagtaaaaaaccaattgtttttaacatatttcatggaggtaacttttcccccaaacttttgcaatttgttttctagacaactgggactggacctggtgcctaggaaagagtacgcaatggtggatccggaagacatcagcattactgagctctaccgattggtaggtacaggaaatcttggcttccagtcttcctgctaattttctggtttccatggcactcctcatacttgcttgattttgtaagaacaggatgttccaggattaatttagagagagtaaaaagacttgagagctgaggtgaccatgccctcagtacagtactgagacactacctgtctaagaataacatgatactctccagtgggccctcaacgcccaggcaccaggaagtcaatacaaagatgttttcagttcttttgcaaatctttctactttttgtctagtgtagtgaaatgcttacaagtcacgcatacttatctgttgtgtttgaggaccatgctgtaactaatgggtgtttcgtcttggctcagcagcatgttaaccctcctcctgcccccattagctctatatacatatagtgtgtgtgtgtgtgtgtgtgtgtgcgcgcgcgcgcgcgcgcgtgtgtgtgtacatacataatagcactatatacaccaactactgaaacggtctcctccttagtcttcaactgctggacttacacccacccttcccagaccccaatccattcctaagtactgaagcccgtgaatcatcctaaaatatttgatcatattgcccctcatggtctcacttatgacttgagttttttttctagttacatggtaagttaaagtccagtttttttgcttggcatccaggttccccaagtctggtccaatctgccttctgtttagccttgtattcttaaaattgtatgaaatgtacctaatatcttgatattaactaagttctgaaaatccaaaatcagagaagagggtggttgggatgggctttcaaagaccatcaccctaagcataattgaactttgatctcattactgctgcttcttaccataaagttccaagaaggactgcctattggaaatagtagactcctttttggatgatcctgcctcttttggcatatcttttcaagcttatttttctgagaataatgagatattcttaacctgaagattatccatatctgaaaaatgtggaggaaaatttcagtaagtccactggggatgtatctgatttgagaaggcagttcttaatattgcttccagatttttccatgatcatcaaattgatgttcagattatctacacttcattgtgtcagttggaatcaattccattttttaggggatattcttaattgtatattgaatttcttcagagtggtgttgtgtgctgcttgccttcatgacatcagtactaaacagagtatctggcatgtagggagaacatagaggtcagttagtgggaggcgaagaaagaaaaataagagcattccaagttaaagtcatcactgcctcttagcttacataacaaatataatccgtatagtttgtctgtcatatcctctgatgtggcatctttacttttgttcatttatttaacttattgaacatcatattctttcacttttaagaacatctctcacttaatttttaagttcctttagggaacacactgtgtatacctctatatgttcaagatagtcttgtacagtgcttttgcacttagtaagcacccagtcaatgctttggagatcattatggtatcatgaaaagactggattattggctccaaacaactacatttataatctatctctttcttttaccagttatttgggtcttggatttattatttaatctgtcaaagcctcagtttattcatctactaaatagggaaataattattttcatgtttattatgaagattagataagaaatatatgtaaaatgcctttccttgacagataatatttgcacaacatgtaagcatttagtcagttttcattcctttcttatctttattcatctacgttggagagccaacagggtaaaaataattgatgcctcatattaggcttagatttggctgtgtcatgaaataaataaaaagcagaagataaaacatgatagaaatttatttcttaaagtatgcaagtttagaaacaggaatttctgggtttggttgtggttttatggtatgaaaagatccttatctttctgctacattgaacatggcttccatcaccaagaacacctttaagtgcagtatagctgcaagagttctagccatcatatttgcattccaggcagtaggaaggagacagctttctctcagttgattcaaatactttaatgaaccttcctggaagttccgcacaacacttgcacttacatctcattggcagagcttaggcacacccctgtatttagttgagtatgtcaggtatcagataaataactgatgtgacacaaatatattttattttcctgagtttggttttgtgcgtatgtaattttgtctctgttcttttcatgtaacattatatatgggatggcaaattgatttcacctctttcagcattccagtttattggtgggtggctgcctagagttcagtgttgctaagattccagggtctcatctagggtctcattgattagcaatgttggccgttggtgggaaagacagcaggggatattttagtatgttacagctcagatcctagtccaaagtcttcattttacagatgaagaaaagaaaatgtgatttgacatgaaaacttattttctcctcagtgctggttgcacttgactatttccaaaacaaagactatagcccaaaaacaactcaaatagttataagcttcagaagagcatgtgcttttctttaaggcagtttctttttcttttttactttgtttttctcttcaacttctattttaagttccggggtacatgtgcaggttgtgcaggtttgttacataggtaaatgtgtgccatggtagtttgctgcacagatcatcccatcacccaggtattaagcccagcttccataaggcagtttctttttcaagtttctgtttgtatcctggcctagcaataataagattctctgtagccctggtgtttttctcattcaacatgaaagtgactgactgttgatttcaccagggagagctgggaggcaccatcaccaatcccttgttgttgtttggcaatttattgtcactttgggtcaaggacctcagcatggaggttaaatggcccaacacagaggacatttgattaattgttgctgcttttctttttttacttcttcctagtcagtgtcatgtttgaaacacaagtgtttgcatcttactaaattcatattgcatcattagaaaaaaagtctcactttagtttcttgatagccctgttagcagatctttctcacctaattgtgttcatttaagcagtaaaagtgctaaaccgcacagtgttagcatatgtccacttagatattttggtttagtgccaaaggcaagatttcaatccttctataaataaagggagccttattagccagcttctctcctatttgtgcctgcaggtttctatctttttagaatttgtaagatcatgcatctgcttactctgcaattcttagaaggttagactagcagatctcagagggaacacagtggttctcacatgcaatttcaacccaaggggatatttggcattgtctggagacatttttcgttgtcacaacaggagatgggaaggagaggtactattggcatctggtaggtagaggctaggaaaagctgctagatgtcctacaaagcccaggacagcccccacaacaaggaaatattcagcctagttgtcaatagcattgaggttggtaaaccctggtgtagacagttcattcaataattaatgcattatttgaagattaaaaatttgagtcagttaaataaatctttgggatgaatctctttcttctcctaatcaaagagctagttcaactgttaagcacagttagagtaactgataggtgcatttgtagccacaaattatctcaagcccttgaagtgtgaacttgactttttaatttgattgtaataatactttcacagaaattttttagcagtttgcggaagtactgaattaccaagagaaaagaaagtaatcataacctactaagtccaaatgggtcctagacctgaaagaatagtggggatgggaagaggggtattttcagtgccagagtgtgccagatgtgaaggcccatgttaaatgtgcaaagggtagagtcaggcaggcttattactagcatgtattcaaagaacaaaagttcaagcccataattactcgaaagatgcaacaatacattgtttagtttgctgtgatttgcatctgtctgcacatgatcctgatcagtgattctcaaccctcattgcctattagaatcacctggggagcttttaaaactaccagtctctggacccccagcccctagaaattctaatttaattgttctgagataagacctgggcataagtattttttaaaagctctcttggggactctaaactgcagccaaggttgagaaccactgatctagatatattggattcattgcatcggtaaaggagctaattttttctcctcaattcttgtgaatgtcatgattggtgcagggaactttgcactatttgaggttaagagaggatatctccttaaggcctattcttttcatgaggtttttacatctatttctgtagctctggcctttagtagtcattcggttcttcatagtagcttgtgctctgttacccttttaagtaagcatatgtttttcttttaagtaaatcagtaaataagttagcagttctggcggggtggaggggggatggtgaagccttgttagttagaggtgtatttttatgaacataatgatgccacttttgccacagtaaaaaaaaaaaaaaattgttaaagcacaaagtagagcaacctttatagaaaacaaggcaaaatcattcttttttcctacagttagaatatttttcttcaggaacctgtgtttagtaattatagcccacacatgcctcaatgcttaggtctgcttttaaaaacaacttacttactctccacttttacgaagagattcccagtgtacctgttgagtatacagtgattgtagatgaatttagctaaattttttccaccctttgcttctcaagtagttcggaataaaagttttaacttctaagcacgaaaaaattctagtgattctatgttgtgttaacacttgtaaatttacatgacattttggcttcatttggtcattcggcagtttttcaactcaaaggcgtaaaaagatggctaatgtagacgtagggtcatttaccttatccctcaacacaggctatggctctgttacaatgaaattgaaatccctgaactatttttttaattgtcaaagtgatccaaaagaggtagttttgttattagtctgtgctatgaaagtgataatcttccacatttttagcacccgttctattaatacacaagcctagccatgtgtttttcctgtactcttatcctgaatcagtgttacttgaagtgtggtccaagaaatggctggaccgtgaactgttggtccaactatacaaatgacaagtaaatgattagaaacctttagggcattttgacattgccatggcatttttattgtatttcatgaaagaatcagtctgcagggaattatggggagaaacaacctggtccctcactgcaagcagtgtgagccctaacctagataggtaagtcctgcaccctccttacctctcagctaaagtgccattttcccaggatgcctgcccagtctcatgtcaaatccccacttttatactctcatcataatctggatctttaggctgggctcagtagcccacacctgtaatcccagcacttgggcagactgaggcaggaggatcacttgagtccaggagttcaagaccagcctgggcgacatggtgaaaccttgtctctacaaaaagtatgaaaattagctgggtgtggtaacacgtgcctgtagtcccaagtactctggaggccaaggcaggaggatcgcttgagcctgggaggtagaggctgcagtgagctgagatcgtgccactgcagtccagcctaggcagtagagcaagatactgcctcaaaaataataataacagtaatctgggtctttgcttccattcatcacagttgcagttttacatgtgtatgtgtgacaattttgttcatgtctgcttcccctagtagatagatgctctgtgaaggtgtgaactgtttctgattttactcatcattgtgttcccagggcttggtacataggagatacttgaatgtatgttggatgaatgatcatccccatgttatcctccttcctggactcgtgaatgattctttttctccctcaacctgtgggaactcacatcttgtcttgttgcccaagttgagcctggactggctgtattgaggaagggattgaaggtggacatagatgctattcttagctttagacaccttgctggctttcctaggtttctccctatagcgccacagcaagttagaaactattatttgccacagcctgtctcagacaactaccacaactttacaatttagtataacctaaaagaacttttaattatgagtaatgagaagttataacttagatataatttagtctgctttttaaaaagatgactaataatttgttctcatcttgggagttgataagggagcaaaagaatcctttgaacttcctgcttcctgaatctactcagtgagttgttattttaacattaatgattttaaaaattcttcaagcaaggttccttgataatctataaacttcacagtttcttattttagaagttggaagaaaatttggaacttaacatccaaagttaaattggatatcttccagactatttctatgtccacagtctgaaagacatagaatgtatattttgctgtggatttagataccaaatccacagcaaaataaaaagttatggcgtaggacatcacagtcacctcatagctaactagtttgttgggtcctgttatttccttcagtccatgctgatcatgtttttgttggggggtgtcattcagatggaacatcgacatcggaagaaagacaccccggtgcaggccagcagtcaccacctctttgtccagatgaagagcctcatgtgttccaacctgggagaggagctggaggtcatcttctcactctttgacagtaaagagaaccggccaatcaggtacctgcacgtggagatagggtttcaatgtcttaatgttagaatggtggatatttgtgattggcaagctgtaagatatatatcttgtatattttttactccgtcagcttcaattttctcaccagtagaactctgagtttctaagctgcctgttctttggatgtttctgtgagggatgatgaatgcagcattctttgaaaaattcataagggctatagaatcagaataattgatattaaatggaagtatggcatggatatcaaatctgttatttgttttaattattttgtattggtaacataaagaagatacagattctctggagaagtttgcttatcacagtcagcatgctgtatctttcagattttcagtaaaccattctgttattcttatcctatctggatcatatggtttaaagagacaactaaatacttagaaaccttcccattaaagtctcagagctttgagatgataactaattttcacatatttctttttctttcgcagttctctgagtcttacctattacaattctcttttggttctctttttcagtatttagaaaagatatatggtgtatgttttggtttttattcgaaagtctcaactcctattaaaacttttttgtctaaaatttttaatatttgttttaaagttaaacacaaaacttgccgtctttcaaattaaaaatttcacagataaattgagaatttgaattgaatcacacaaatcacacacaatgacccaactgtaccatgctttaaaaaaatacttttcaataaacactaacaattttaggcaataccgagtctcatatatatatatatatatatatatatatatatatatatatatatatataatagacacacatacacatatatatacacatatatatacacacacacgcacacacacacacacatatgtgcgtgtgtgcgtgtgtgtgtgtgtatatatatatatatattttttttttttttttttttttgagatggagtcttgctctgtcacccaggctggagtgcagtggtgtggtcttggctcactgtaacctccacctcctgggttcaagtgattctccttcctcagcttcctgagtagcttgcccagctaatttttgtatttttagtagagatgcggtttcaccatgttggccaggctggtctcgaactcctgacctcagatgatccgcctgccttggcctcccaaaatgctgggattacaggcgtgagtcactgcgcctggcctattattttataaacagaaaataatcttggagtaattcttttctggtaaaatagttttctttttctagggaatatgtgtgaagtttatttttaatgcagttacaggcataaaatctttgttgaattaacttatatcttagtcgttatctactagtaagtgtactttttatttcttgacagtggactatgtccatagaatttagaaggtggtgtttttgtgcaccagggacaaaatttatgaggtgtggaaataacagtggtaatacagttttagaatctactttctacactgttagaggaattgaatcagtgtgttaaaagaactttgcctctttacaaatcagcactactaaaaagggaagtaaaaggcgtgaaaaactgatccaagttagactttagaaatgtgaaagattatttagagataatatttgtttatatgtcggagtgtgtctggtttacgggtagtttagattacaaaatctttataacattgtctgtataatatgtgatctctttaatatgctttataaactatatggaatgtaaaaggaagaactgaagttattcttttgctcatttctgttaaactaaagttttttttgttcgtttttgtttgagacagagtcttgctctgtcacccaggctggaactcagtggcacattctcggcccactgcaacctccaccttctgggttcaagtgattcttgtgcctcagcctcccaattagctgggattacagacacccgccaccacgcccagctaatttttgtatttttagtagagacggggtttcgccatgttggccgggctggtcttgaactcctggcctcaagtgatccccccgccttggcctcccaaagtgctggggattataggcatgagccactgtgcctggtcgcctgttaagctaaagtttttgtggaatacaaactcccctttgccacttcgcattatcataggattgtactaatttgggattaatattaggttgtctctaaatatcatctcattataaacattttcaaattttctcaaacattctaaataggtattgatcttcagagtgctccttattttattcctatatccttagcaaaagtaagataataacccgggtacagggtctgccaaaatgttgtgtttgtgttccccaagttcaagccaggagctgtgtagttttcctggtctgtaatgtggctgggctgccatgcctgcctacttccccctggtctctccctccacttttccctctcacttctgccttcaccctccccttttgtcaccctcctccccatcccttttccttcctcctcctctctctgcaacccccatcatacacacacacacacacacacacacacacacacacacacacacacacacacacatccctcttcaatatgccacctgatctgtaatgatcctcggagaaatcaagtcagtcccttcccactgcttctcctcaatgcatttggttatctgtggctctcacctctcaaactcacaatcaccataaaggtgattggcaaaaaaatgaataagtatcacaatatatgcttactagatgtttggaacagcctcagatttatcttcttggtgtttctgaggccttaggccacacagtgattgttttcttttaggaagtgttcaaaaccttgtaatgagtcagtttggttcaaactgccgggaacacagggcagttcaccgtccctgcatgaagaggccttaggatgcacagatctgaagactgggcttggctcttgtctctgcagttgatggtgactctgcagccctgacccctttacttccttctatttttttctttcatcttggaactcctaacagttcttgctgccttcatcccacctggtgtaggtaatgagtatcaaatgtccgcatcttctcagaaaaaagtactgtgaatgtgaggtgtgattttaaggcattgttatatttcttcttatttgtgagtgttttaaaattttgtatttcttttaaactttttattttagaaaaatttccaacatatatagaagtagactattgtaaggaacccttatgtaccctccaccagcttcaacaactatcaacaaaagtttgatcttgttttaaccacattcctttccaatttttgtgtttacccccagattattttgaagcaaattcctgacctcataacattttcaaatgtaaaaaaaaaaaaaggaactctaaaggaattatcatctaaaaaattaatattcctttaacatcatcaaatattcatttgccattggattcagattcccccattgactcataaacattgttttacaaattgttcaaattgagatccaaataaagtccatatgttgcagataagtcttataagtaaatttcagctctagcttccctcttcctcttaaattcctgcaacttatgtgtcatttggtttatttcttcttgagagttcaaagtctaattgcaaacgtttaaaatcagtggacaaaagatggtatagttaagtgaatgcttgtgttattaaataggagggttagtgctataatttacaaaaagtaaaatgccagaggaaaagaagtcagtatacgaaaaagatacttgcacactcatgtttttaacagcacaatttgcaattgcaataatatggatccagcccaaatgcccatcaatcaatgagtggataaagaaaatattatatatatatatatatatatatatatatatgccatggaatactagtcagccatataaaggaatgaaataatggcttttgcagcaacctggatgaaattagagaccattattctaagtgaagaaactcaggaatggaaaaccaaacattgtatgttctcactcataagttggagctaagctataaggatgtaaaggcataggaatgatacgatagactttatgaactccagggaaagggtgggagggtgattagagataaaagactacacattgggtacagtgtacactgctcaggtgatgggtgcaccaaaatctcagaaatcactactaaagaacttcttcatgtaaaaaattaaaaaaaaaattaaagatagaaggacagagaactagagatgtgataaaacatatgataagtgttaatgatagaatctaggtagtatgtatatatatgttcactggaaattttgtttatatttaaaaacttccataataaatgctaaaaaacgtaaaaaagggtagaatgtagtctacataatctttatggcttcagtctggccattgatcacagaacgttaccttgtccaggtacaggtggagggaccaacatgtgcaaaacctgtagaggacggattaggaaacagggtgtttattcctcacataagacagataagtggttagtactttaaaaaaaaaattcctcctttaagaagcaaacagccagtatttattgagcactaaccatctgccatactctgttctaagtgctttaaatatattattagcaccaattttacagatgaggaagccaagacaccgagaggctagagaaggtgaccaagcttctctaagtggcaaaaggcagagtagagctgcagaccccgtgctctggcccaaggcctgccctctgaaccacaccaccagcagtcgcatcagaatcactgcctaagcacttcagtatttgtctgaaagtttccatagttaaacaggattttattggccagaattggagctttagagactgaaagtcttaataataaattgttatgaattcttgataatggtaatactgaaactgatatagggcctcagaaattgtctatgctatagaagttgggttttaaattgagtccttctcaaaatacttcaagaatagcaaagtggctcctccagctacccgtgaaatggaaaggaaagaaggccaagaggaagaaggtggccctcacccctgctgtcttgaaaaagcaggaggccaagaaagtgataaatcccgtttgagaaaaggcctaagaatgttggcattagacagtacatccagcccaaaagggacctccctggctttgtgaaatggccccgctatatcaggttgctgtggcaaagagccatcccccgtaagtggctgaaagtgcctcctgcgattgacccgttcattcaggccttggaccaccaaacagctactcagctgcataagctggcccacaagtacagaccagagacaaagcaagagaagaggctgttggcccaggctgagaagaaagctgtggcaaaggggatgtgtccactaagagactacctgttctttgagcaggattaacactatcaccaccttggtggagaataagaaggctcaactgatggtaactgcacatgacatggatcccattgaactaatcgtcttcctgcctgccctgcgtcataaaatgaggatccctcactgcattatcaaggggaaggcaagactagaatgtctagtccacaggaagacctgcaccactgtcgctttcacacaggttagcttggaagacaaaagagctttggttaagccagtggaagctatcaggaccaattacaacaatagatacgatgacatctaacatcactgaggaggcaatttcctgagtctaaaatctttggctcacattcccaagctggaaaaggcaaaggctaaagaacccaccactagactgggttaaatgtgccctgttagtttttttgtacataaaaataatctcctcaaaaaacaaaatagcaaagtggcatcaattcttactttatgctagtgatcaaaatcttagattaagtacttagatgtgtccaatacagaaggagccagcatgtaaaagtactccctttctcgttcactcagtagaattatgaagcatgtagtatctccttagtaccaggaagagtacatttcctgataagaacttgtcattgaagctggaccatatttagaaagcccattacttttgtttctaaacaattactgaatatccctgaaggtggcccagtatgttaagcctgcaaagtgtgttttgggcacctctcacagtgactaaagattgaggcccattcccacggcatcctgcttaaacacacctactccaggcctcttttccagtttaccttcctcacttgtttatgtcacatcaccagcccagcgtctcctgaaggcacagccacattggagaggcaaaaatcacatacttttatttgaggtgtatacagtcttgacacaatttctctctataaaagataattattagttttataaaacgagttttccaggtttttacatgagccaattgttcttagagcatatttatctggttgaaagtttatggcttctccagccctcaagggtattactgggaaagggagggaatcatttctctgcaaatcatctgtaattttattacattcatttaacacttatgtaatgcttattatattccaggcaccattctaagctctttaagaaatattaatttaatcagcccttgtaacactctatacagtggatactactaatatccacatttttatagatggggaaactgaggcacggagagtttttttttctttttttttaataacttgcccaaggtcatacagctcacatgtggtggagctggtattctaacatggcagtttatgtaggaatctgtattctaaatcactgctctacactcatactcatcatgtacagtatctataagattctatattcttcatcaacctatttttactcaccagtgtgtcataaggggtctgtcgagggtttgtagttttaggaaactagagtgggagggacttgacctccttaagaattgacaggaaagatccagtaatgagggagaggggaaatcactgatcgtccaaggtcccttaggaggcatcaggaaacagatttgagtttgctggtgaggagattagccatgggccagagaaaggaagagacagaagaatgtggacatgcataaactgaggtgtaggattgggcatatgagtttttgttacatacaagcaaactacttagcattatttgctactgtgtctcctttagcttgcatttaaaattggcttctgtactacatggtgatagagtcatggtatttgtttatgctttccataggttgtgcagctacggatgtgtatattaattcttacctctcctgttttggcatatgtcaattaatctacaatagacagtaaatttttttttttttttctggttcaactaatggtttttatttcacatttggcatctttttcttctacaaactaatagactctccagaacctattcacctgagatttctttttctaccatgcctgtcctttgcaggattgtttgaattttcaagagaatttgaaacacttagtctctagacagtttctttcaatgtagccctttgctcttcagacatatgtgacaggagtcaaatcactgtttttttgtttttttgtttttttaatagaaaaaatgagtttattttttagtaaattttgtagatgcaaaggagatatctggtggcaactggaatcacagaatgagcattcagaagccacaacagaaaatgtagatttagaaatctttcatacagaattggaagctggagccataagaatagaaaacattctttttttttttcagtcattatttgtttgtacagctgtgtgaattttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgcgatggctgggtcaaatggcatttctagttctagatccctgaggaatcgccacactgacttccacaatggttgaactagtttacagtcccaccaacagtgtaaaagtgttcctatttctccacatcctctccagcacctgttgtttcctgactttttaatgattgcctttctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttgttgtaaatttgtttgagttcattgtagattctggatattagccctttgtcagatgagtaggttacgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagtttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaaatttgtcaaaggttttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttgagttctgctctgattttagttatttcttgccttctgctagcttttgaatgtgtttgctcttgcttttctagttcttttaattgtgatgttagggtgtcaattttggatctttcctgctttctcttgtggtcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtcttgttgatctgtctaatgttgacagtggggtgttaaagtctcccattattaatgtgtgggagtctaagtctctttgtaggtcactgaagacttgctttatgaatctgggtgctcctgtattgggtgcataaatatttaggatagttagctcctcttgttgaattgatccctttaccattatgtaatggccttctttgtctcttttgatctttgttggtttaaagtctgttttatccgagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtcttgatggtctttacagtttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaacgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctccttgataatatcctgcagagtgttttccaacttggttccattctccccatcactttcaggtacaccaatcagatgtagatttggtcttttcacatagtcccatatttcttggaggctttgctcatttctttttattcttttttctctaaacttcccttctcacttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttctctcagctcgtcaaaatcattctccatccagctttgttctgttgctggtgaggaactgctttcctttggaggaggagaggcgctctgcgttttagagtttccagtttttctgttctgtttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgccggttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggtgcccctcccccagcctcgttgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcgtcagtcacccctttctttgactcagaaagggaactccctgaccccttgcgcttcccaggtgaggcaatgcctcgccctgcttaggctcgcgcacggtgcgcacacacactggcctgcgcccactgtctggcactccctagtgagatgaacccggtacctcagatggaaatgcagaaatcacctgtcttctgcgtcgctcacgctgggagctgtagtccggagctgttcctattcggccatcttggctcctcctcctagacagtaaatttttatggaccagtgaaaacaaagctgtttactggttgactacctcccttataacttttcattactttgtttactgatgtactctagggcttcatcggttaaagttgtaaatttgtcttgggactaatctattaacgtattgcattctcatcagagaatatatttcatatgacctgagtaccaccagttggtactcagctggcatagggctgctcatgcatgtgagctgctggcgtgggcctttatttgagaaaatagcaccagggtagtacttctggaaaaagtgttatcccgatgattaaatacaaaaagtcttaattaagtacagatgaggtttcctgtctgcttgtaacttattcacatacttttctaggtatttttcctaacatcacttcattaaactccatttttcttgaaatacttcatttccatataaattttgtattgcctacaattaccttctatttgatatatcattccattctatcatttaagaaaaagaaagtaatgaatgcaattggtgaggtaaagatttttttaaatatggaaatatggattcatactgaattccgaaatacatctggatatctcttcacccccaagacacatacctttgtgtgtcttgtgtaccgcacggtaatcgaagtggccagattctggagtcagctggcaagagttcaagtcctggctttgtcatttagtagctacatcagttttgggaagttaattcatgtctctcaaggctgttaacttgtctgataagtagagataataatagtactttccccatggggttattggaggattaaatttagtgtaatactttctacctgataattggtcagtaaatcttagttattagaatgattatttttaaaaaccagtacaggaaatacacctaacctaaccagaaataatatgtgttgattgctcttgaagccttaaagaaatatgttccaagcaactgtttatttttttaggtatatggtattatagttatgtaatatttagagagacctactagtaaaaggtaaaatggaatcagaggtgtgatttgctttaaaatacttccgcaatggaagaacaaagagaaagaaaaagcaaaaaggagaaaatatgacaaaatatgtgaagaaaatatgacaaaatttcttggttatgaattccctgtgataggtatatgagctcttggttgaacttctagcatatagtatatatagttaatgaattacctgcttaaaatttattaatgttttcatactgtatgtaggccataaagcaatgagaaaagacatttttttccaatgtctttaaagaacattggattggtttagtcactagccccatagatgatggtctgaattccattctgcctagaataaaaatactcgttacatgaactgacagttacgtttttcataatgtacttgacaaaacttaagaggaatgttttcttaatggtctaggacattgagtgttatatcacacatacgttataataatattccccttgaagcacgagccttgattcagacttaaaataggcagcttttagaagattaataaagattctgtgagagaaaataccttgtatgcttaaatccttaaaggatttttgccttacaggcaaaatcagtgccaccttcctggaaattctaaataagtataggtttatcctcccaaaggtgagggaattccagttgtaagaatgcacatcacctctacccattcactagttcattcactcactatgaaagcatggtaagagtaagtgaagtgttgtgtgccagctgtccgagaccctttgagtgtttgtagaggtttaaagttgaatcctgaagcaacggcagaagggatccagacacaagtgaaggaatctactttgaaaaagaggaaggacacttcttttattaatgcggaagatgaaggaagtgaaatgggtgtaaaatgctgagatggaatcaagagactttgggtttgtggccttgatcttttttaagtaaagggggaaacaagatcagctgccattggagagcaaaagagaggacagagggagctgaggactgaaagtgagttgtaggaggaaggcaagcagacgtggagcaaacgtgtgatagggatccagcaatccaacccccgtgcatgcatctaaagaaatgaaaccagtgtgtgcaagagatatctgcacttccatgttgactgcagcactattgacaatagctaagatatggagtcaacataagtgtccatcaacagatgaatggataaagaaaatgtggtatatatacactttggaatactattcagccttaaaaagaaggaaactctgtcattttggacaacatggatgtacctggaggacattatgttaagtgaaataagccaggcacagagagacaaagagtgcatgatctcactgcatgtggagtgtaaaaaagttgaactcatagtggagagaagaagggggattactagggattaggggagggaattttggaaaagaaggatacaaaatttcagttaggaggaataagtccaagacagctattgtacaacatggtggttatggttaatagcaatgtattatatacttgcacattgctaagagagtagattttaagtgttttcatcaccaaaaaaaaaaaaaaaaaaaaaaaagcacatgaggtaaagcacgtgttttacctcatggtaggttagcttgatttatccattccacaatgtatacgtatttcaaaacaacatgttttatttagaattgataaatatatacaatttttatttataaattcttttttcttttcttttttttttttttaagacagagcctcgctctgttgcccaggctggagtgcagtggcgcgatctcggctcactgcaacctctgcctcccgggttcaagcgattctcctgcctcagcctccaagtagctgggactaccggcatatgccaccacgccctgctaattttttgtatttttagtagagacggggtttcactgtgttagccaggattgtctccatctcctgacctcgtgatcctcccacctcagcctccgaaagtgctaggataacaggcgtgagccactgcacccaggccatttatttatcaattctaaataaataaataagtaaaatgttaaaaatatataaataattaagtgtaaaaaagaaaagtgtaatagggagtgagtgagggctcatagaattgctgagtgcagtgatggccgcaccaatgggagacgtctgaaattgctagtgcatccagactcccaggttagcttttgctggatgtgcttagcaaatagggatcagaagcaggtggtaagtttggagactgaaacatcataggtggaaaagaatgagaaaattgagaattctgtgtcacaaggaaaatctaagaagttaccatcatagcttccaatgggtgaggctgatacaatctaatagccttttcaattttaaaaggaaatgaaagaattatgcttcttttgaaaagactgagttgttaggaaaatttttcaagagcttacagaaagaactgttagggagaattgttatttggcccagactagtaaaaaatgctaatatttttgtgtatgtatgctagtgcataacatagttaagagagcagatatggctttttcactccctgcactgtgctagtatttctcgtctcatacatcatttaaaatgtatagcatgatcgcagaagttcagcatctatattgttatataaattaggagcatatattgttttgaacatcaatcatgggcatagatccctttttgtagcttcatgttataaaatcagctcaaaaatgtgacgtctccaaagcagagcagtaatgtagggaaaatgtctgaccggccagacgtgcagggagtacaactttgtttgagaacaaaaatagatggagacggcattcagacaccctccttggattgtggcaatatcatctattccatatggcccagagcatttcctgccatgtctagacatgctggcacagatttctctgtgggtgtctgcctgcctgtcagtgacccacagcgaccttccctcgggcctcctgttgaaaggcactcctgctttctgccctccctcttctccatcatttgattgttccagcaggtgcatgaaatgtgggagtgttgtcacttcagagttaatcagatttgcggtttactccccctttggtcacaattctgtgtcacataaaaaagaaaatcacaaataattgctttagagatgttgttatgtcaataatgggagagttttaaatatgaaatgagcaaggaggaggatctaaattaatacacaacaagcaaagaaatgctttattcatactgagagcacccagggtagaactgattcacttttttctctgtagctttttaagagccatacaattctagttgttttcgaagttgtaaattactgcatcattataatgtgttattataataataggtggcccgaaattccaagttgcagaaaaccaaaaactcatagagtcagtgtgaactcagaactgactttctctttccctttcactctaagctgtgattattcaagctacttgtctctttttacttaaatagtgcaggattttagaaagtgaccagaaggtcctcttacacctatgcctgtgttttaaaagataaccagattgatgttcttttcactaggattcgggtcatctctgtcttttttcctttgccctatgtctgctacccataaggtattcagaattatttagttttcctaagttccctacaggataagctatggtcacacttagcaacccacctcacaaggacttctttggtattcaacgccatttgtgttgtaagatggttcaacattaacaaaggaattgttaatgatgagttcttcttagttccttttccaaagataagactttgcccactcatcatctagatgttttcagcaccttgtagtgcgcctgacacagggttgggattgatgcagttagaggaagcttacaagtcttagattgttgttgaggcaaagcattaagagatcatgctattattatcttaatttttgctatcatctttccactgcagtggggatgtgcttattaagaagagagagtactcaaagtgttgagtgcatcaaaaatgtttatagagttgtttcatgttacactgtgctaataagaactgtgctctcagccctgtctctggggaaacatcatttgcaaacactgtcatgctaaaaaaagtacataaaaattgtcagataaatgtgtagcatctttccctaagtatttccatgtagagatttttggactacaaattaaatagagactgcatcttctttttatttcagttgagctttatgaagttcacactgttcttgtggaattgctgatgttcattcgttcattcatttatttattcagcaaacaattcttactgtccttctcagggccatacactcatttggacactgggaacacatcattgaataaaacaggaacaaaaaattcctgccttcatgccatttattaatatgttgtaagacgattcgagattaacaaagcaattatcattgatgcagtccttgttagttccttttccaaagataaaactttgctagtagacacagcttgtagtctactgatgttcaaaatactcaagcaagtattttttccaggttgtttagttatatagtatacctctaaggattttacttgaaatgaactttgggatttctaaagtcttctgaacttggagtcatggctatctttcttaaatcaacagtcagtcagaatcatttccttaattcaccagtttctttatcatccttttgtatggtgcccaatatgcaatttttattttacaaaagtatttcacatttcttaacaataaatcaaaatcatttccttatttcaccagtttctgtatcagccctttgtatggtatccaatatgcgatttttatttcacatgtctaaagcaatggttcctaactttttcagtaccaaagatttctttttagaagtatataaactatagacttcaacagaaaataatatacctgttctcataagcattaacattttcctatcagttaagctttgtagctcccaggttaaaaaagcacctgatcttcaaaaaatacagttgaatgagtcatctaattaataaatagtatttaatgatgctttagatcattttcatttttaaaagttataatgaatataaagaatctatcagtaagatgttgtgtccatcagtaaaagctattggaatggaaatttgattttggcttgtaaagcaaaatgtatctgaaacagatctcagtcaatttagtttattttgccaaggttaagggcatgcacctaggagacaggtctgtgcctttctctgaagatgagaatattgagacttcatatttaaagggaaaaggcaggctggaggggaaagaagaaggtggtcacattactgaatccacatgttgcaagagaaaagaaatagataggggaatagtcaattatgtattcatctcacgctcagtaaatgaacactttacagacaataaggtgaacatagagtaactacctgtggagatatttaacctcttatctgtagctctctgcttaggagcaaaaggaaaggcagcttcttgcgtgactcagctttcagcttaatcttcttccctttggcagagtgaattgggggtcccaagtttttattttcctttcacagacataatttcatgaaaaaaagaaaatctctctaagatagtaaatgcatgaacgatttattatacttactgtttttgcagggcttgaatgacatggatttttatacttattctgtgtttatttatggcttttctgcctttttaagaaactgcatgcttcaactcagagtacttataaagagctcaggtttactttactttaactttccttattatagacattcctaatgaaaagatgttagaaaggtcagaataatttctgaatatagatcagagtgattcttttctcacgaaatgtcaaagatacagtgtttacaatgatcaaatgatataaattcccagaatgataagcagaacgcattctgcctacatagaggctttctcatttcatggtccctgtttgtgttgaccagatcctctctgtgcctacttttggttacttctctaaggaactcattttttagtgaaattcttaatgagttctccagagagagactcaagcaagtatttttctcagtttagttatacagcaggcctttttctaaggattttacttgaaacgaacttcaagatttctaaggtctcaagtcttctgaacttaaagtcacagctgtttttcttaaatcaacagtcagtcaaaatcatttctttaattcaccaattgcttaatctggtaacagcacagaagatgtgaaacagcagctgatctgaacattatttataattttaaagagtattatattccttttttattgaattttaccttcctaaaaactctttcctaaaattttacctttcctaaaaacagagatatttgtttcagatatctttatttttctgcaaagacaaatagcgtgacggagaatattgtacacaataatcatcctgactagtaagaaagaattggcttgttattcaaaattggcaatggaattggctatagtttaaaaatatgtctcctgttgtgtcattcaactaaacccaaattctttatgtgccaacaaagccatcacatcatttggctgcatagtcctcaacactcaattatttgtaaggtgaatatgggcttgagcattaatatttttaaaagaaaacatcatctatctcctctttaagtaaactctggaaacagttgtatcagagatcttcctctttccatttccctttaatcagaagagctcatgactctaactttgctttagttttaaaattagaaagcacattaataatcttatctaggaagacttgcttgagaagttgctttcatttattgccaaggaaaaactctgtcatttgtgttctcatgtggttgggaggaagaggggaaaagtcttcgaccctaagataccaggcgtacattgcctgttttctggtatacatgactatcataaaacagtcagcaattctgattaattaagactagggcttttgggtaaaaacagtggtcctttaacatggctgggctttaaacaaacaggaagcttttaggtccatcctgacccagtcaatcaggatctccagggtggggcctgggctttatacagctcaccaggagaatattgtacacaatcaggttggtgcgaggctctttgtatcggttcgaaccctgagagcacgccaacaaacaacacaaggcagtgtggagcagtaccctgttttaatgagcgcctgggtgcagacaggccgaggcctaaaatggcatcagccccatgtgaggacggggcaggggttttatagccctctgtaaacaggaagtgtcccagtctgacatgacagctacgtagtacccggacagtctccctctccatcttcagggggtatgtgtcttccggccacctctcttcctgcttctgctatcttgctgacgcacgctgctgggtcttgcgccttgggactgggcctgaggagggaggagttattcattcccttaagctttcaggccctggggagaatctttcagttgggaaccactgaattagaaggcccttgggtctcttctgtttaccactgatcattccctgtacatagggcatctattcgaatgtccttcatctctgccatcataagcaccaaagccccgtagtccagcggccactgcagaactgccagcacaccttccagctgcttcccaaagtatcttgcctggacagaggtagcactggtttcttgggggcataaatagagcaatttatagtgcggcctgagcttttctgaattgtcctttgttattctaggcgagaccacagtaacagctctcttcacagttttgggaaggaaaataattttttctttaacactcatacattcttagttggaatggtcctctttatcaaaagacaaattaaaaagagaaaaacagaagtttactaacatgtatatttcatacataaatgagatatattaatacatagggaatgagaaattctcaaagaggtggctttgaattccagcttatatagtgtcttcaagaaagaacagtacattttggagaaatgacaagaccaaacaggacttgaagtctctagggaggcaacttctaggaaggcaaataactggcagacaaaggctagttgataaagagtgttggtagggatacctctggtgccatctccaggcctgtaacgtttaaaattgtcatctgtggttaacctttgttctccctggtagaagaaggggcaggcccatgaccatgccaccctgaatgtgcctgatcttgtttgatctcagaaactaagcaaggccaggcctgttagtacttacatggtctaagagaggcaagattctttttgtttttgtaaatctatgcattgcctttaggcaattagagggaaggcagagagctttacagcacctacttcttaattgcctttagctcaacaattcttatgccaaagaagtatattttggggtgccgtattctggtctcccacagcagattattggacatatcttacactgttaggcaatcagaaaacatttgacagaatgcaggagaagcagtgaaatagaaacaattcagatcaccttacgtttgtattctattgccttttagggagaggctctagggtcagcactgcaccctggaaccatcctcttagctcttctcattattccttcgtccatcttaccaccccttagcttctggtgtgtctcccttcacacctactcagtgtagaatgggtattaattgttatcctcacactcttcaaacagcgtagttaattttttttttttttaagacaaggtctcattctgttatcccagatatcagctcattgcaacctctgcctcctgggctcaagtgatcctcccacctgtgtctcctgagtacttgggatcacaggcatgcaccaccccaccgggctaattttttaaattttttgtagagacaaggtttcaccctgttgcccaggctgatcttgaactccgaggctcaagtgatctgcctgtttctgcctcccaaagtgctgggatttcaggcgtgagtcactgtgcccagattagcatagttcaatttaagacaaatgactgctttttcagatatgctacatgggatttttgtttttgtttttgtttttgtaaaattggtttgagtataaaaaaaatgacagttgtttttccaattagtttaatagaacatgaccgtctaaatgtgttctctgttgttattgttcttcttggagaccataaatctatttcaatgatatttaactgttgaaaattattttacaagcgttctttgtaattttttgtggattgattagcttgctaatctttctcacaacatgtttcaaccgaagatattacccagtcatatatttttggataaaagtacatgttgtgtaactttcatgctcattgaatcactagacagttttacttcttatgtgaggtgaactataaaagtgataaatataaatccatgcagaaagatagaacaatttttatgtgaaatataaaaatatatttcatgtaaaatgtcaaaatttttgatattggccttcccaactgaagggttacttctactgagtggtttacaaggaggcacagaggacagaagcatcctactgagaaacagaagagaagccatcaggaccttcagatccctactgtgcctcctatattatttgcatgaccaggaagaacatttctaccacactatgctgtgaaacacacttgtcatcattagaggtctttttgagtacatcagaatatcagtagttcaactgagcagttggtcacaggtgtaatttccataaacacagatatgttgtggctttttgtttttttcatttggcttcatgcagttttgtttgtttattcatttatttggttgattttttttttttttcgcagacagggactttgctatcttgcccagactgaacttgacctctaggctcaagtaatcctcctgcctcaacctcctgagtagctgggacaacaggagtgtgacactgtgcttggccatttgtaattattatgttttaattttattaagaatattcacacaaaaactcttggtttgtgtgacatagttagttttgctcttctttgtccatttctttcttttttttgagacaaggtcttacccctggagtacaccccactggagtacagtggtgcgatcatggctcactgcagccttgacctcccaggctcaagcagtcttcccacctcagccttctgtgtagctgggactactcagctactgagtgcctgggattataggaatgtgccaccatgcttggctaatttttttctttctttctttcttcttcttttttttttttttttggtagcgatggggtttccaatatgttgacccaagttggttttgaactcttgggctcaagtgatcctcccacttcagcctcccaaagtgctgagattaccagtagtgagctaccataccatgccttctttggtgctctgaggtgccctgttctttcaaagagagggttgcattttggttaaaaggtgagactctcaaatcagactctggaatttaatatcctggccccatccttgactgaccacacaactttggccaacttatctaatatctcctagcttctgctttctcactgggatgacaaatgggcacaacagtggtttccacctcctactgtggtgaggagaattaaatgagaagagctatgtaaggcataagtcatagggtctggcacagggtacacatttgcctttatgattttttccaggaatgcttatttatgttcttatttcattatcctgatttcatcaaatcattgttggaagaagaaaggttataaataataaataattgtggtttgtttttctttatttccaaagaaatagtcatttttgatttatagtatcatgatttataatgactcatacatggaattcaggtggacactaaatttctcctgcggagagattgcctctggaagaacatggcagtatatggggaagtcaaataatgagttttctctgctgttaataataccaactctcatttctcagtgtttctagaaatgttctatttgcttattcattctgtaagaagaggaagacagtattctcatttgaaaacatatcagtatagttttttattactgtatgttgaatataataaagatataaaatgttcatgaggacagcattaaatggaataatctggaatctggggtgccacgaagttaatatgagaatctcgagtcaggtcgtgaggcatcatggattgaaatatctttttgcagagtttcatacatttccctaccataaagtaaaggacataatgggaaagtttggagagaattaaaactttccagttatttgagtgttattctattttgtcctaaaagattgtatttggttagtcttatcaaacatctaagaataccaaatcattcactaggagttgaagatacaaaaaggttaatactcatgggcctgtattctagttgctcaccatgtaataggaaagaaacatataaacttctcttccacttaggaaaaaagtctaaatgatgtatgtaatggaggtatgcatatcttggaaggacattttttaagtttacaaaaactaattttgtcatctgatcatacttaccacagagttgcgatagaacagacttagaatagactgtcaaaaacatatttctgtgtggccacaaaagtttgcacaaaatatttggagaatttcagaagatgtgccagaatgcaatattattggccaggcacggtggcttatgcctgtaatcccagcattttgggagggtgaggcaggcagatcacctgaggtcaggagttggagaccagcctggccaacatggtgaaaccctgtcactacaaaaaatctaaaaattagctgagtggggtggcatgcgtctgtagtcccagctactctggaggctgaggcaggagaatcacttgaacctgggaggcggaggttgcagtgagctgagatcgcgctgctgtactccagcctgggtgatagaacgagactccgtctcaaaagaaagaaaggaaaaaaaagaatgcagtattattgacttgttcagtttttttctgggcgttgaaggcataccttctgatattctccaaacatttcagtgtgggtgagtaataataatccaaagattccaaaatacgttaatataggtctttttttgtccaaaaccatttgctgagtgattagtggctgtatcactaaagcagaagataaattgatttgagttggcataacaatagcatgtcatcaaatgaataaaaagaattttttttattggccatagatgttttccttttttttttcttttttcttttaaaagaagtctggcttttaaaagaactgtacatgacttatttctccatagtacccattttcagtctgtttgtatcttccccttaaggcatgcttaagctaaggtatatgtcattggcttaggacatattgatattctttctgaaacaggatatgatatagtataatacttgcataatcaggattctgtgtaaactagtgaaattaaaatagtgacagagcaaaaaggatctgtttctgcaatagaatactttaggaaacattgttttccagaattttgatgaaatgtacagatatggaattggattttatgtcagtgttaaagttaaggttttaatattgaaaatgccctattgacttctgtattttaatcttattggtgtccatctttttagactgaccaagataatgtgaaatttgctttgaatgtttctgtagaggtaatgaggagcttcaaacctcattacatctcaaaaaatataaagtagaacatgctgtccatgatataggagaagggaaaatgctcacattgcttatgttttgtgctaaaatgtaatcaataaatacattagtaggtaactgattactaagaaacagactaaatatcatccttaaaccttagcagtttcgactaagtaaagctgagttcttaaatctttttggagttttgtgttttgtgtttgtttaataaaataatttgtttctcaagtctttttttttttttctaagcatgtttcgttaaagaaaactactggctgggcgcagtggctcacacttgtaatcccagcactttgggaggccacctgaggtcaggagttcgagaccagcctgactaacatggtgaaaccctgtctctactaaaaatgcaaaaattagccaggcgtggtggtgcacacctgtaatcccagctactcaggaagctgaggcaggagaatcgcctgaatccgggaggtagaggttgcaatgagccgagatcgcgccattgcactctaccctgggcaacaagagtgaaactccgtctcgggaaaaaaaaaaagaagaagaaaagaaaactaccaaagaacaatttcaaaccaaagacctctttgaaacctgctaaatcaggattctcacctctttcattcctcttaacccaggaagggtatggagaaagttaccttgaactcttgggatcaggcttgactgctgagtgggtcaggcaaatgatggcttttcctttatctcagtattctggaaatatttactcgatatttctatagagaagaagagaaagttaccttatagcattctaatggagtgctagggttttgaattaatacatggaatagaatccttgctcagccacacatcatctctgtgaccttgagtaaaactatttactatttcgcagttttcccatatgtaaaatggtcattataatagtacctatttcctaaaggcatagtgaggataaaatgagataatttatgtaaagtccttggcagagtacctgtcaaatggtaaattcccaaaaatgtattacctaataatatggttaaagtataattcctttgtcccaagatgaattcttgcacatttccttttcattgtttttaaatttgaaatagtccaggcctggtagcccacgcctgtaatcccagcactttgggaggccaagacgggagaatcacctgaggtcaggagtttgaaaccagcctggccaacatagtgaaaccccatctctactaaaaaaaattacaaaaattagccgagtgtggtggcacacagctgtagtcccagctactctggaagctgaggcaggagaatcgcttgaacccgggaggcagaggttgcagtgagccgagattgtgccactgtactctagcctgggtgaaagagtgagacctccccccgacccaaaaaaaattaaaatgataaatttgaaataataatgaattttattttcttttactgtgaagagagcttatagtcattttccttgaattatagtaaatgacaattggataacattaatttatctctgcaccctcagtataggtgtcattcccagcctccagtttggaataatatcacatgtgaactttagcttcaattgaggatacttacagcaatttttattctcttcatgcatgccttattggccatctgttttctgggaaaaaatataggtaataagagtgaaaatgaccccatagaaatatgtattggctgccctttctcatatgagaagtcagcaatagacataagtaaaagatgagataagccaggtagttgattctgttaaacgtatctatctagacttagatcaccaaagagaataagtgttccaaaacagccataaattcaaattcatgtgcttccttagagatctgtttatggttctcatatctcctcttatatgtatttgaatgacagaaccattatttaaggcaaggatcgggtgataacatagaggcttccttggttctaagccttttattaatgtcctgctctccatttccctgcttgttccctagactgaagctacactgaccaaagctacagcattttacattctgtagatgttggttgtgtgctcattgcctgagacagccaactatttaattctgtcattgataccaggatattgaaattcagttaaaatttgaagctcacagtagctggtagattaattttttgtgggtttatatttgttttattttgctgaacataaatagtgtcacacattaccttggatctaaatggcatccatggcttggtgcaatgactcatgcctgtaatcccagcatatcgggaggccgaagcaggcagatcacttgaggccaggagttcgagaccagcctggccaacatggtgaaatgctgtctctacttaaagtgcagaaattagccaggcgtggtggtgtgcacctgtaatcccagctactgaggagactgaggtatgagaatctcttgaatccaggaggcagaaattgcagtgagctgagatcataccactgtactccagcctgggtgatagagcaagactctgtctcaaaataataataataaataaataaatggcatgcataagtatttattgctatgaattagtggctgatcaacagcattatttgtgttttcattaaatctaggtggcactgtattttctttttggttatataggtgagaggtttctatgttgcccaggctggcctcaaacgcctagcctcgcctccttatgtgcaaggacaacagttctgagccaccgcagctcccggtggcactgtattttcaaatgcaagtttagtgggggtagtttgagatcttctgttcgtttgttgaccaaagaaaatttaagtttcatttttgaaatctctacttgtgttacagattggagacttataagaccataaaatatgaagccttctaatagatagttagcactcaaaatatctttaatgttaattaagtaatgtgacataaaacatgaaaaagaaatcttagttacagacacatgaaacatgttatgtcatatttttctcttttagtgcatttatttctacctcttggaataatgatattactgatataaaattgtattcaagtctttcaaaagttaatgtctgtttgtatataggtgctttctgcttttgtagttgctgctttgccagttttaacagaagtgaagcaaatatttgttgtcttcggagctctcctaatttatataagcaatgttgatgttaaatgaacaacctaatatttagcttacctgttgtgatgaagagtagttacagagggataaatctttaactattaaataattttcaaattgttaaacattttttctcttgtagtgagagatttttcttgaggctgaatagaaacgggcttcccaaagcccctgataaaccggaacgacattgctccctctttgtggtgagtggatcttgtttcattcataaggcagattcatccagttatgattcatactatttaggagaaataaattactgtgagagaacatagtgaatttgcttttaaactttatgtaaataacacacaaattacattagtgcccagaattctgaatatcacctcccaggattactttcattcctttagtgtattactgcttctgttatactattaccaaagtataacagtgattgcggggcacggtggctcatgcctataatcccagtactttgggaggccgaggcgggtggatcacctgaggtcaggaattcaagaccagcctggccaacatggtgaaaccccgtctctactaaaaatacaaaaattagccaggcgtggtggcaggcacctataatcccagttactcgggaggctgaggcaggagaattgcttgaacctgggaggcagaggttgcagtgagctgagatcgcaccactgcactcctgcctgggcaacaagagcgaaactccatctccaaaaacaaaaaacaaaaaacaaaaccagtgattgcactcagcaagacacctggtatttagtatgtgcttaataaatgtttaaagaatgaatgagtgagagattgaatcaacagtgctctcttctttaaagtattacttggtatcaattgacctaaggttgattgtaatgatatttttagaacaggatttaaatcatgtacttctgctacaaacattccattaagaatgtctgtgtccatctctttcttcttttatttgtgaaaataaagtgctatgccctttaagtgccgctcatgtcttccaaaataaccaaactttctttgtttgtaggatttgggcagcagtgagctaagaaaggacatttatatcaccgtgcacattatccgaatcggtaggtataacacttgtcagtgcagtaggggcaaggaacagagaggagaaatgccaagaggtttctatgttgttgtgatttattgctgtctgaatcagaaagatatcaaagccagatttgaatccaagaatcacagaagttgtgaattgtccccagaccttcccaaccccacatatgacctcctcacctaccataaacagattctggtctcttttaatataagtaattaagaagtttgttgtgtttcattttgttctgctagccttcctaaacatatttgattcaaaaattctgtgtttgtctcttaaaattctaatttctgttagcataaatgaatttttcagagctgagtttcctataagttaatgaaggctctgtataaattggcattttccaaagtgcagaatgcttcagagcgttattccagaaggtgctacaaaaaaaaagcctgtgaaatactgaatactgaatttttttaacttatataatgtcatcagcttattaaagggtctgagaagtcctaaagggaaaaataaatatgcctgtctaactttgttgaccctagttttcctcaaatttgatctgactatgaaaacacttatataatgtagcacttattaacatcttgcagaacccactttaatgttctgtgatgaacttgctcagtgaagccagaatgtgttccctcatttttacacataaaatgcctctaaaaacaggcattttatggcagaggaattaggtgaaatgaggactggtgtaacctacacagtttttccgttaagtctaatcagtcattattgggaattcattcccacttcttcactaactgtactccattacttgcctaggaatacttctgtgagatagtaatatcttgccatgtagtcctgcaaggtgatttatttttataggctttggttttatgtacacgataactgcattgtgcattgagtgagactataaaaaacatacttttattcccgcatagattttctgtatgttttttctcataaaaatctattctgaaaacctgttttcattttatgctatttttgtatttgaaggacagtagaaataaaaaatagacagtttttggttttgttttcatttttctttttataaatgagtctatgaaaaaaattggaaagaatctttgaaaaggttggaatagttagaacccatgctgctgttttcttatgagataaagcctgtctgttctcaggatggcagaggtagtttgtcatttagtctgtgtttctttaaattcaaatgtaataccaatggttaaagtaaaatgtggttttatatatcttcatgtaaacattgctaaaattttaatataatctctgacagcagtaagagaaaaagtaaaccacttttgctttcagaactttctccaagatatctatggatttggggtggtaaaaaaacatgcagcaaagtgagtatgtgccttctggcccatggacttcactcacagtgttattgccaaggaagccgcctcagtagtactgcccatcacagggcagcctttcaaatgcttggtgtttgatttgtaattgcactttttattaacattgttatggtcattaagtcattaaaatgaatgttgagtcagaaattacctccctatctttgtcttcagttttgggcaaatgaatacttctctaggattattgcaaaaaacatttaccagttcaacattttgagaccgaaggagaagtgagattaaggtaaaatacactaagataggttaagatttagtctgccagctcccttgatggagtgaaattggtggcagatcattgtctttcagggtgttagaaatgcaaaatgcttgttcctcagtgccacaaagaaatagcactcaaacattaattttctcagcaaggcaatttttaccttctgcagaaagggtgcctctcacaggtggaacaatggtaagagcacacctggacaggggaggggaaggagttcttattcctgacgcaggtagcccctactgctctgttgttcccctatttgctagggttggacgcacagtctaagctaattctgattgactatgttgaaaagagcaggagtataagccagagtggcggggtgagtagtttggcaggaaggatggttagaaacaggtaactaaaggtaacttaggtcagagcaggtgaccagggtgactcaggtcaaagcaggtgaccgggatgagtcaggacagagcaggtgaccaggggaacagatgtaaactactgatcagaactggcaggaaagttttttattgaaactagaggcaaggcggtgaagagaaccaggaagttaaactttaaaatggagaatcaaagaataagagagctgaacatgctgacatactgattatttgaagagaaacttggcgttcactatatttaacaagggacacatacttcttacagaatgtctcttgtacctatttagtaggaaaagggcatgttggccatcactggctgcagaaagcaggagcaacagtacctcacttctgggaatttaagtccagctctttagaaagatggagaggaaaaaaaaagagaaattaatagttttatatcttcctgctcatgccaggaagtttcttcaacctctatgcctcccttttgacttttggttgattgctcagtacttttcccttcccccactcccactaccttccttcctacttagagaatgtgctagaaatctgatcgggtttcccaaagcccagtcagaactgtgaattcttattaactctagggttggtgccactgatctggcaccaaaacatctttccagtatagtaattagaatggtgtctaaagccgtggcttaacgttaaacttgcatgtttgaagacatgagtcaggtggaggtttgggagataagcttcccaggggtcacaagtgacaaaatccttgttggagagtgttaagtggttgtgagagctacacttctcccatcaaccttattcccttattttgccattccttctgtcccctacagttttttttctttagtgcagctttagatgaaggggttgtttaaaaacaaacaaacaaaaaaggattgaaatgtgtgcatgcccttgtgtaaactgtaggagctagcagagtcattaggaataatcttgtttgcagtttctagtttttttttttaataaggagcttctttctgatgttaaataactttgaagtgctccactcagaaatcttatccttttgtcatcttgtatttgcaaggaaatgattaagaaaaaagcatgttttaaaccacgatattgataaagactgccatacatattaatatttcatcctaatacattctgtaatattattcaaaatagacataaattgagaccttttttttcatttaaaaaagtgaccaaagttttaaatttgtttaaatcagttgtgtaagtaaaagtaggattggttgataattaaattcaagtatgacataaagtgttcggttttcagacagaatttatattaaaattatgtagagtgaaatttggccatacatatggcatcaggtcatgacaacctgatattttaaattcttacattttgcacatctgaaaagcagctggcttatttgggccattttttagtttgattctaactgataaaataagaggttttcgggctgtgtttccctgaaagtgacatcttgcagaggtagttttcctttactactgatgaatgaaagccaaattggatattgtcatcccattttttcctgcttaacattggattttggaattgctggagatatcttgatgtgctataggagaattttgctcagatagaaacaatttatggttgtgttgaaaagcacctagagacaaatttgcagatttttaaaatcattttttcccacattaacttgttatatttcaacttcagtgtactttttgctttttgtcttcaaaataatccactgataattaaataccaacaatacattaaaacaatgtattaataacatatttttaaacatgtaacaatttaaacaagttaaaactttacaacagttaaaaccattttggtgacaactgagttctgaacagcctgagagctgaggcaggagcatgcacatttgatcacctgtgcttacttgctgtacttcagacaacctcaaactactctagtcacaggtgaaatttttgaaatagtttttttgaatatggaatttgtttaaaaatagaaaatggaagagtcaccattactgcctttagtgacgtgaacttcctgggatgccttcatgaatctcaggggccaggggatggttcccaaacatgggatctgttccagtctttgtattttacagatggcaactgacgcccagaatttaagctgcttacccaaggtcacacagctaggtgactggagaggagaatccagaactgaagcaatatcttctgttacgcccaacctgggtgctctttattgcccaattacatttcaatggcctatcttatagctgtatgtttcgctacctaagatgcatctaatcaaatggctccatgggttaatgattgctctttaattgaacaggtcgaatgggagcaggagaaaaaaagaatgcctgtagtgtccagtaccgacgaccctttggctgtgcagttcttagcatcgctgacctgctaacaggagagacaaaggatgacctcattctgaaagtatacatgtaagaaacatgcacgtggtgatggctggggtaggcacaggggtacatgtgggtcctacttgggcgaatgctactttaggtgggtagagaagaacaatgggtggtttatgagccattcctcaaaaacccagtaatctgtagacttgttgcaagtgagcctacaagccacaatttgccagtcagaggaattactgaattaagaaccaatgagtacagacagtttaccagttaggtagaccgtctactatgtgggataccacctttgaatttataaacctagcacgtctttaccttcagacagtcaatgtgttcttggaaagtgaaagtactttttgaagtaaatttattagaattggggaagggaagcccagatgacttccatcctactctaggtgttagtttgctgggcctgccctaaccaagtaccacaaactgcatggcttaacccatttatgcctgaggttgcaattttttgaaatttttgcaatcctatctcggcgatgaccttgagcagtaggatataaataactccacatgcttagcattccaataatggaacactaggcataagtaaattttttttttttttttttttgagaaggagtctcgctctgttgcccaggctggagtgcagtggtgtgatctcagctcactgcaagctccgcctcccgggttcacgccattctcctgccccagcctcctgagtagctgggactacaggcgcccgccaccacacccagctaattttttgtatttttagtagagacggggtttcaccgtgttagccaggctggtctcaatctcctgaccttgtgatccacctgcctcagcctcccaaagtgctgggattacaggcgtgagccaccacccccagcccataaatagattttaaacaatagaaatgtgttgtctcacatttcccagatgaagatattagtatagttggctccttctgagggctgtgagggcaatctgctccgtgcctctctcctggcctccggtgctttgctggcagtcactgggggatccatggcttgtagacgcgtcactctgatctctgccttcatcttcacatggtgttcatggctttctctgggtccaatcccccacccccccaactttttttttttttttttgagacagagtctcgctctgtcacccaggctggagtgtagtggagcaatctcggctcactgcaacctccgcctcccaggttcaagagattttctgcctcagcctcctgagtagctgggattacaggcgcatgccaccatgcctggctacaaatttctcctttttataaagatacagtcatattagagtgtggttcaccctaataaccttcttatatgattatctctgtaaagacgctctttcaaataaggtcttattctgaggtactgggggttaggacttcaacgttacctttgttgggggatacagtttaacccatggttctctactaagacagttacttgatatattccaaatcctaagttaaatgatttttttaaatgcacatgggtttggcccacaccaccgtgccacctccccacaggcttggacgttgaggcctaatatacagcaacatcttcagagcagacttattagggtttccacactcctggtttgaggaccacaccattggctacctccatgagtgaactggctttcgtattccattctggaggttgtgttaatatacctaatatgtgccagtagatttttcataggtgatggtaacacaagtggcccactgcctatgggacatatacttaaaattgcctttttgacctctgctgcagggtttcatggatttttctactctccatccaatgggacctatgtaacacattcaataattcattgacaaagatttatctatagtctgtggtttaggaccggtaactctcttcatccctcttaaaaaggaaaacacctgtgatgttgatgttaaacttgaaaacttttggtgaaattagtgggtggtaaaagttgctactctttttatcacatagcaaccctcaatttcagtggttaagcttaaatccatgatacccttctttccatacttaactggtggtcataaaacgtagtttatttgaaatgctaatgactgataataaccaccctttactgtgtgcttactatgtgtgaggaactgtgttaagcactttgcatgtgtcgtatccttttgtcctcacaacaaacccatgaagcagacagacgctcctactcagttttactcataggggaacgagagttaaataacttgccccatgttgcctagctaataagaaaaggaagcagatttgaggtcaggactgtcttgctccagcatctgagctctccagttaataatttgtatttttccaggtgttatttcacaccatagtctagtaaggtgatgatgctgctgttatgtggctttttaagcaaactgaaattcctcacaaacacactctcatcatttcttaaagtagtctttccaggtgtgagtagcaagtattgtatttatcctgtcagtgggaaaacagagggacagacagtcccatcatcaccctttatgaggcagccagcggaataagacctatgcattccagccctgccaatgggagacagtcacactcatgaagacaaattgttctgctctttgtgtttttttttattgtctgcttttccataagcatcaaataaggttttgggtaattcttaatagaagataaattcctgaaaaatgcccattcagcaaatagtgatgctgtttcaagagtaatactaaccagtcaaaacagtcactgtagattaggaaggaactgtgaatttagtcaaacatgggaaagtgcctgttagaaaaaattggggagaaatttctatttgataaggtgactgaacccccagcccttctgggactcaaagaacagtagcaaatgcctgcctgagcctggaagatactttagtcacatactttaggagcttttgtttgtttgtttgtttgttttgagttttgagttttgtaggttaaaagcatgaattctggaatcacttaactatctaataggaagcaagccatctttctttcttccccactgggctgaaataagaaaactggaggcagaatgtgctaaatggcagtttggtgtcttacaactagacaggtgggatggtttcattccatcttaattttccagccctcttaagattcggcgctcatttagatatcccactgttaattggctcaaaaatcacctccatcatgttcatcctgcaaaatcctgtggcaataaaataaataaaaatgtgagcaaacaattatgaattatctgcctcagacttgatcactaggaaacagaacctgcgctgtgggagattttgattgatagtgtacagaatcttgatgttcaggcctcttgggaggatgcattcatggctaataaagtagtgaatttacacatatgttcagatgaaggaacttttccccagccaatctgggagagtagtggcagtaaggatggataacagaaccacatgcttacaaatcattatgagttaccaggcagagggacatccatccatccgtccatccatccatccatccatccatccatccatccatccatccattcataccactgacagtttttaagcatccacagcattcaaagtactaaaggaaactcaaatatcagccagtcctagatccagtcctcaagaaccttaacagtctcccaggtgaactacaccacgtaaacaaagataacatgacctaatgagtgataaaagctaagagaaagaggtacagattgctgtgaaaagacggagagatgccccatgtggaagatctgaaagagtaattttattattctttggtaaatcctgccagtcttttgccagtacaagctgtgttaatgtcaatttcattttgcttaatttgctgcattttgattctggacaaacctggtcatgttacagtaggcagagacttgctaatgagaactaatttactgagcatttattatatgccaggaattaccctaagcccatgttagtttaaagttctagtatattatctgtgtttcataggtggggaaattaagacaagagtaaataaactcacctaaagaacatagcttggttaatagtgagaatttgaatctggggagttgaactcagttggggctgccttcccctgtatacattgttctctgagatttctgtctgttttggggccacttgtaatctgcgaagtgttatcccagctgcttctgtcatgaggtaggtggtcaggcattaccagatacggacattcttgctcatcctgggacaaccatgctaaaactgacagtcagttgcagcaggttgatggggacctcaaggaggtacattatagtggttataacgaaaagggcagatgtactatgaggatcactgcttgactgcatgcatcattaaagcttaacagagtgttaatgttttcataggtgtaacacagagagtgagtggtaccaaatccatgagaacatcatcaaaaagctgaatgcacgttataacttgactggctccaatgcaggtgagtgtatgggctggctgactttccctacacttttcgttccaagcccttttttttgtttgtctgtttgggaaggaaattatcagccctttgtttttctgtctattcactccctaactttaaaaatgctcaatgaacattctggtatgtcttcctatgctatgatagggttgtacttataactccctataaaaaatgtattctattcttgttgaaacgaaaaagataatctgaatttgttctttggtaccaagtcttcatactcctaagttgttattgaaaactaaaaatcagccaggcacggtggctcacgcctgtaatcccagcactttgggaggccgagattagtggatcacctgaagtcaggagttcgagaccaacctggccaacacagtgaaaccccgtctctactaaaaatacaaaatattagctgggcatggtggcaggtgcctgtaatcccagctactcgggaggttgagaaaggagaattgcttgaacctgggaggcggatgttgcagtgagctgagattgtgccattgcactccagcctgcgtgacacagtaagactctgtctcaaagaaaaaaaaaaaagcaagctaaaaatcacatgacaaatatgatgcttggatttgtgactgttctgtggaaataagtttgataaatagcaatttttagtgaggtccaataaaaacatgcttcgcggccgggcgcagtggctcacgcctgtaatcccagcactttgggaggccgaggcgggcggatcacgaggtcaggagatcgagaccatcctggctaacacggtgaaacctcatctctactaaaaaaaaaaaaaaaatacaaaaattagccgggcatggtggcaggcacctgtagtcccagctactccggaggctgaggcaggagaatggcgtgaacctggaaggcggagcttgcaatgagccaaggtcgcgccactgcactgcagcccgggtgacagagcaagacactgtctaaaaaaaaaaaaaaaaaaaaaaaaacaaaaacaaaacaaaacatgcttcgctgcctatggctggctttgagcagcaacattattgacaaacatacaggttcacacattgaagttggctaaaaaagaaagtgatgctgattgcagtggcatgtgaagaaaaatgtgtgtgtgcttgttcagagaggaactgaaatatataccactataagtcgtatgaggtacatagtattgtactagtaacatatagtatatactacattatatagcatatatagattgcatagcataaataatgacatctttaggtttggtcagtagacaaaaacttggtgaatattgtttgttcttatccaccattcagacccacattgaagcaaaacaaagtatgcagtcatgtgctttaatcgatataaagaaacttcaaataaagtaagctgtttcttgaactgaatgtgttgttttttaagactgatttttaaaaacaccttgaatatagatatttttgttgcagtccagatcacctggcaattaggagaaccagaatttaaattcaaaccgcctttcttttttcagagccttgcacatcttgctagaccaaactgaccgcaaagagaaaaccactgtagacagagctttgtcattcagttcagtgagagccataagtacctccaactcacacatgtggcaacgcttcagactataatgagtggtgaggtcagtttcctcctccctctccttagagttggagagataacttgggttttatttgatgcagatggccctttgctttggacaaagtcctgcatctaccactaaacaaacaagacacttggagcacttactattgagggcagaatctctaaaagactcacacgagacaggagaaatgaaatacaacatggaactactatgtatgcttgtcttctcttttcccacaaaacaattacaattctcggctgggtgcggtggctcacgtctgtaatcacagcactttgggaggccaaggcgggtggatcacaaggtcaggagattgagaccatcctggcaaacatggtgaaacacccgtctctactaaaaatacaaaaaattagctgggcctggtggcgcgtgcctgtaatcccagctactccggagtctgaggcaggagaatcgcttaaaccagggagtcggaggttgcagtgagccaagatcgcaccactgcactccagcctggcgacagagagagactccatctcaaaaaaaaaaaaaaatatatatatatatatatatgtatatatgtatatatatataagtatatatgtatatatacgtatatatgtgtatatacgtatatatgtgtatatacgtatatatgtgtatatacgtatatatgtgtatatacgtatatatgtgtatatacgtatatatatgtgtatatacgtatatatatgtgtatatacgtatatatatgtgtatatacgtatatatatgtgtatatatatgtatatatatacacacttctcctgattgtccatggataaaatggtttaatttcaataccccctcagtaagatagtagagctgctatttgttagagaacacatcttgtggaattcattggtagacttccagccaaatccagttctactctaaacctttcggtgtttcttgataccagtgaccatcattttgtcattaaatttaccctagacctgtgctgtccaattcaggaggcagcagccatatgttgctgttgacaattagacatgaacctagtataccactagaattgagatgtgctgtaattgtaaagaacataccgtattttgaagacttggcccaataagaagaatgtaaaatacccatcaataattttcatattgattacatgttgaaatgataacattttggatatattgggataaataatgtatgctattaaatttttttttttacttttttgacatggttactagggaaatttaaatttcattcatgattcacattatacttctgagtcagtgctactccaggctctgtttaaaggctagcatttttttaagttcttatggatcacaaacaaatccattatgccctgctcctttctttctgcctattaactgtgaatagaagagttggtaaccatggtgtatcttgttctttctccctatgcgtcctgttaccttaatttgcttgcatttgccctcagtatggataaacaaataccaaactaatcctgaccttctgacttttcacatgtagtccctgaccttcctaccatcatagatgtggtcttgactcaccatgatatgctgaactgttggctacatgtctttcccaactccttttcatctcccagtcctttcccacttcaaatatgcctcatgcaggacaacattcatctgttattaggttgtttgaatatataattgtccaaactctgaggtcatacccaattgcctctggaatgttggtgaagttctcaatggtaggctttgatttatatctctagatagactctaacataagtgatcctgtatccttaaggcctgcgttaaaggtcaggattccagttaaaccaaaccacacatttccctctgcttacagacaggagtcatctcttagagagtatagtgtagtatttaagagctttttctctgcaagcaggatgtcctaggtttgaatcctctaagggatattgggaagattaaaagaaaaaatgtatgcaaagcacttaccacaggacatcatacatggtgtgtgtttaatgttagctattattattgtttacccactttaaagccactagctgaaatattctatccttacctcttaagttgtctgttttcattgtctcgaaatggatcctgatttaatctccttaatgaagacttttagaataacacaattggattattgatatgttggatcattgaaccgaccccttctatactttgtttccttcatctcctctccattgatttgattgctaatatctcttcctggtttcttttaacttaattgttggccttctgattaacttcaggaaggaagggaagcacattctgtttccttgggcagttcctcccatgtttagatgtgtccacatgttccatgtgctttgtcaattttactagctccttattcttactggaatcctgagtgaaaccctaccagatagtgagatccaaaccacccttttccatgagtcataccttttctgtttacagcctttgtactgaaatgaaaagctacgtgttgtagcctttgcaaagaatgaaagaaaccattgtaccataaagccttgtaaaaaggtttccccttcctctggcaggatccattcccattttgcagcctgctgtgatgctcagattcctaggcaaccaaatgtatgcactttatacctggcttctgctacaaagccctgtctgctccgctgtccttgtgacctcagcccttctctacccttctctcttaaccctgaggcccagccaggcccacgcagcctgcatctatctgccttctgtttctctggtctctctctctgatcctttctagcctctctcaagctgaggcaaacccagccctaagcctcttcactctaatattctgctctagagagtggaagctcaggaagaagcctaaaaactaatttaaagaaaagcaaaacttatactcttcccaccaaagcttccacccttcagtctacgtagatcattgttctgtatccccttgatctatatccttggttgaggaatggaagttctgtggccagcagatagggattccagagctgttcagcttcattattgaaagggaggcacattcatggcttacctcaagatagtgggggaagcaagagcacaagaaattgaagagggaaattagggtgcctaatgtttaaactgtcacaacagttagataatgttgacttccgctgttttctctctggaccacagaattgtttgttaaatggaagcagtgcagtcaaacgttttcaaaagaattgagttcactctaaaaagtactgtttttccccactttctcctgctattcctcagtcactggcactaaaaaaagagaaaaaaacgcaactttgaaattggtttcggaaacaaattctaccagctaatttccaggccctttatgcttcattgatgtcctcctagctattggagttgtaatcttgtctggttaatagataaagggattcaccaattaactgggcttttttcccctctaacctaagacttatgttgcaaaggtacattaaccactatcttagttgagtttagaaactgggagaaaattgcaagcaatccatttaactttttaagatgttttaaaaattgaattactatatcttcacagttagatatagttaggttgagtagtttgaaatctccaaagttgtgctgttttatgaattttaaatccaaaggcaatgttgtgagaatttgaaattctaaaagtattcattaatgtgagcctggtttaggtttgttgagcaaatggttattataaatttcacctctgatagacagcagttgaattataggaatgtgacattagactgagccaatatgatttactgaggcaaattaagttctacgtcttgaaacggtgtgtaaaaatcattggctatggttcagtatgtcccaagagaaacttcaaagtcttttcatattatctgtgtatttatgaaatattttctatggtttgcacatgtagcttacacctagaagaaatcatatttgctattcaggtaagtttctagagtctttgttgtatcttagatgagtgtacatggttgtattcctgccagctatactttttaactccataaggagaccacaatatatagcgagagcagtttaactctattcaggaaatatatggtgttttttatttggctgaggtgaaaggaggctttttgagagtgttaggttgcatttttgggtccacacataccaatgtagtcattttattcagtgttaccaagttggtataattcataagaatttgatcagtgcacctgatttttgaacattgtatttgctttctagtatcattgaaataaaagtagtacttattggcaccacctattggttagacatttaatatgtgacctttttgctgacttttggagtttcctaaatattttaccatgatctctctttaaagtttttttttcaactaatttgtagaaaacagtacaaagaatttgtaatttcccaaaggttaacattatactacatttcatttgcataatctccctccatttatatatgtatgtgtgtgcatatagtcatataacgcaacattaatgaatttgatatgatccttaaggattatatcagagccttgattgtatatgtttgtgtgtgtatatatgtacatatacacttatatatgcatgtatacacacatatgtacatatatacacatatacacatctatacacatcatacatatatacatttcttttcctgagctgcctgagaacaaattgcagacatgatccctctctacccctgcttacttcagaacatagcaacagaaccacagtacagttatctaaatcagaatgttaacattgatataatactgttatctaatctgcaaaccttgttcagattttgacaattttctctacgtcttttataacaaaagaaaatcctagccaggtttggtggctcccacctgtaatcccagtactttgggaggccgaggtccgtggatcacttgaggtcaggagttcgagaccagcctgaccaacgtggtgaaaacccatctctactaaaaatacaaaaattagctgggtgtggtggcacgtgcctgttaattccagctactcaggaggctgaggcaggagaatcaattgaatctgggaagcagaggttacagtgagccaagattgtgccactgtactccagcctaggtgacagagcgagactccatcttaaaaaaaaaaaaaaaaaaagaaaaagaaaatccaggctattttgcatgcagttgtcatatctcttgtttccttcgatctaaatcatgctaatgacagcaaagaaaaaatatagttcaaaatatgttactacattacaccgtaagatattttttaaagttcatgcagtatttaaaaaaaataaaactaaatccaaatgatgtgaatggaagtagtgattagagcttgatttcattttctaaatgagctatgtatggctaatttagatataatcactagcaatactgtttgcaagatttgctgcataggaaaaatatggaagtatttcagtaaattaaaataatcagatattaaactacaatcatagatactattgtagaggaggaaaaatatttcctcatgtatcctaggttcatggattaagccccaacaacaaaagacagagtaacaaaagaaaagtatacaaacaaacatatttaagttctttgtgacatgagagccttcattaggaaatgaacacctgaagaaacagtttaatcttagtttttttatagtaggtctgatgaagaacagggagttgtagagaaatactagggggtgaaaaaggtatcgtctaatggcaataaactgggagaaacttaggaaggcctgtttattcaggttcttctctgcaacactttgttttcagagataaggatgtacttttcatccaatatacggagggcacttcttatgacctgctcaggggagaatggcagggaaggtccgagagaccttcctgcacatggtgtctctccaaatagtcagtatgccaaggaaccatgttttagggtaatgtgtcctgaaccccatcactatgctctatacacattttttaaatggtttgcagcccatggattcctttgtattggtattgtggaaataaaatacaaataggtaataatagttacagtaaaaacaaacaaagcctgtttaaaaaacctagacatagtcctcagtatatgctattgaaatgttgatacactaaatcagaataagaatggaaactttaaagtgaaaaattccccttagttaaaaaggaaatgttgaaatcccttcgaatgctctcatcactcctaccaaatgtggagaagcccctctccagctttcattgctggtcagcagatttcttttgtagttaagactcaatgaaagtaaataatttcacatgtctttaatgccttttcatttgacattctgtgacattatgtattgcttcaatcttatgttctttataactcttagccatgagctaaccacttctctagagaaaacataaaagcctttcccaaagctttgaaatttagaactagcagatctgcaaaccagcagttataatcacaagattatttgttcacgcttatcataccttttgcatattagaaggtagtcatcccaatggacagagttacccacttcgaagatctcaggaagatgatcttcagacagtgagcctatggtcagaccctttgggttatcctcagtgatgtcaaaattatattctttaagacttaacttagtttaaagaagcaatcagcaataagcatattcacaaattgaacaatactggctaaaactcagaaaccaaggtatgactattaagaaataaaagtgttttctttcttcctgtcttccttcctccgttctttttctttttttctttcttccttctttccttccttccttccttccttcctttctctctctctctctttttctctttctctttctttcttttttctttgcctcacgctgtcgccaggctggagtgcagtggcatgatctcggctcactgcaacctctgcctcccgggttcaagtgattcccctgcctcagcctcctgaatagctggaactacaggtggcacaccaccacgcttggcttatttatttatttatttattgtattttagtagagatgtgtttttaccatgttggccaggatagtctcgatctcctgacctcgtgatctgcccaccttgcccgccttgcccgcccgccctgcttccttccttcctttctttctctttctctttctctttttctttctttttttcttccttctttttttctttgtttctttctttttctttctttctttctttttctctttctctctctctctctctctgtctttcttttttctttgtctcgctgtgtcgccaggctggagtgcagtggcgtgatctcggctcactgcaacctccgcctcccgggttcaagtgatttccctgcctcagcctcctgaatagctggaactacaggcggcgcgccaccatgctcggcttatttatttatttattcattgtattttagtagagatggggttttaccatgttggccaggatagtctcgatctcctgacctcgtgatctgcccaccttgcccgccttccttccttctttttctttctttttctctttttctttctttctttctttctttctttttctctttctctctctctctctttcttttttctttgtctcgctctgtcgccaggctggagtgcagtggcacgatctcggctcactacaacctccgcctcccgggttcaagtgattcccctgcctcagcctcctgaatagctggaactacaggcgacacgccaccatgcaaggcttatttatttatttattgtattttagtagagatggggttttaccatgttggccaggatagtctcgatctcctgacctcgtgatctgcccaccttgccctcccaaagtcctgggattacaggcatgagccactgtgcccggccctcttttttctttcttttcattttaaattggttttgaaagtatatctaaaagaggagatacatcccaaatttaagcagtggcaacattaatagcgtaagtatctagctctgcaagatgacaatgttaaaggacagctgtaatttgggtactttggtcctactgggtagaggctttgagtaactaggctcctttcatcatgtaattaacacattgttaagcaggcctctggtaatgttcacagctcccattttcccatctgcatcttgatttctccatctaacctggctcatttgtacacaccagtctcttcctaatattctggcttttgctccattgactcattttccgatagtattgtctcacttaatacctcacactttctagaaatttgactttctttctttcctctgcttcagagactttcagagcctgtctctgacctcccagtgtaaatacctcattttaatcagccaggattttactgcttggtgtagctaggatgtgcctctggaaaagttttcactggctttgagttgaactccagataggatatatagcttctaatgtatttactgtgaaattcaattatcttttcttatagatataacacataacattctaatgcacaaagcaaagcttagatgattaattttgtaaatcaagcacataggaaggaatagatgtaaaatttgtgctctgataagattgaggccctacgtatttcagaaatgaacaggttttactgaaggtgatttttgaaaaaatctactaatatcatctataggaagttttgctaatacctcataatgttagtaattttttgtagtacaagtttagaaattccaccaattgtgttttactctcagcccccacctcccaaacatacaaagtatgcaagtactgtcaagaaatagtgttttgagagtttactacagaatggcagtgtgaagagctgcaccatcctcctccaatggaacaaccattattgatgaaaatcgtattttcttttagattttaaattaaattatttttcatatttatttatttttaaaaatgaaatggggactcactacattggccaggttggtcttgaactggccttaagcaatcctcccacctttgcctcccaaaggattataggtgtgagccactgtgcctggtcacaaattgtattttaaaacaggactaatgtctagaaatcttcctaagtgtagacagcaaataaagagtaactgccaactcctggtaagaatcaagagagttggtgaaacttatatcacatctcattttctccttcctgcctgcaccagctcagcgtgatgaaaattccactacatatacatgtagccaagaagatggggttccctctcccatcagcttccagtcaaggtatatggtatctcaccaggagagggtaggctactagcatatcacatttcccctggtcccagttgtatagcctaaaaaaagtaaatgtgtaacccactccatatcgtcgcttccacacctatgatgcatgggatccctgtgaaaaaaacaacacccactaaagatgaattgtgataaaatgataacaattagcaatcaatgaggcagagtaagcaaatgcaacaaatgagaatcatgatcttttggaattttaggtaataaactatcaggaaaagaggtagcaaaagagatttctaatgaaaaagaaaacatcataaaaaaatggaacgagatttttaaacccatacatcaaaagaatattgagtatatatatttcagcgttactcaaggcactggtatacagtttttgacaatgaaaaatctttgttttctttgtgtataaattctagtggttaaagagaagtaaatagaacttctaaaattcttttaaaaaatgttattaaaataagaaatcagtggactacttaaatagcaaacgagcatagttggaaaacgaattagtaaaataacttaaaatattagccagaatgctacccaaggggtaaatgcaatggaataacctgaataaacatttaagagcagtgaaggattgaatgaaaagaccagcatacatctagtaggaattccagaaggaacaaataaagtacatgggtaagctgcaatatttgaaaaggttgagaatttgtagagcttttgcagaggataaaatgtgcagataaaagaagaaaatgttattaagtaggataaagttatatctggataaattaaataacttttgcagaggataaaatgcccagataaaagaagtgaaagttataagcaggataaataaaagtcatatctagataaattatggtgaaactgcagaacaccaaagacaaaaccagaaaccagagagaaaatactgattacctaaaaagaaataatagtcttagcagcagttacagaggtcagaatattatggaataataaatatcttaaaactgctgggagcaaatggccaactttgaattctttacttgccaaactgttacagtcattgcttggtatccgtgggaaactggttccaggacctctcaggacaccaaaatttgcaaatgctgaagtcccttacataaaatagcatatactatttacatataacctatgcacatcccctcatatactttaaattatttctagcttatgtataatacctaatacaatgtaaatggtatctaaatgattgttattactgtattgttttttgtggttactgttgttgtgttgttattttttatggattttatttttccaaatatttttgacacccagctggttgaatccacagatgcagagccccacagaacaaagggcctgccatatttaaaagggggaataaaataaaatttcagatgaagacttggagattttacattcacattcactgaaacaactagtcagagttcatcatcaggagtaaagaactgaacccaggctgggtgtggtggctcacacctataatcccagcaatatgggaggctgaggcgggtggataccgaggtcaggagatcgagaccatactggctaacacggtgaaaccccgtctctactaaaagtataaaaaattagctgggtgtggtggcgcacgcctgtagtcccaactgctaaggaggctgaagcaggagaatcacttgaacctgggaggtggaggttgcagtgagccaagatcgcaccactgcactccagcctgggcgacagagtaagactccatctgaaaaaaaagaactgaacccagaaggaaagaaatgtaagaagcaagtgtgtacgaagagaatagtaaatgtcagggtaaatctatttaagcactgactgcaaacagcaacaatttaaaaatatatcatcatcagagtttaaaagatccaagttcccagaattgttccagaagagaatagagctattgattaaatttagtatttaagtcaattacttatgttacacatttaaagaatagaaatagtatgtataatttccagaactatagagagataaataagcaaataagaaaacttaatccatttagagggtagaaatgaaaaagaaggggaaaaaagagaagcaaacaaaaatcatgatatttgaaaaacaaaataagatagcaatataacctctcctcctgactaaattacatgctaagtgtcttctaaaggatatttcagaatttgtcacttgttcagagcgttgacttactagtatctgaggacagcactgtaatctccatgtcattaggaatttcaccgccttcgcatatgtctaattgtacttatcgtctatttgtatttctcagttatgtctttgtcaagtctcctatgttagaggattgttctcaatatacagacatatttgcctttgaaacctttatagaacctaatcacaatatttggatttatctggtggtaagtgggcacaactattaaaagaaatattttatttctatatgacactaaggagactttggccattttttgatggaagctaatttgttgatactcatggtagggaggaatgagaacagaaacaatgatagatataatgatagtagtggcagtggcaattgtaggagtagcagctgacacttcctttgagctaagcattacctaaagtattttatggaattggtgcctttatctttattttacagatgtggaaaccaaagcacagagaggttaacattgaggcagtcacttgcaaccatatgatatgattcttaaactgcacacttagtaacaacatgtatttatccaatatatttatcacagttttccatttttgcatcgctgtgcattcgtagctacatgttatgtggtttattagtggcaaaatggctgatgtattctaaaatttcagctgctacttataaatcatgctatgctttccatttttaatgtaaaattgcagaatttcatgaatttaaaaggagccaacttatagaataaatgagcttcaattctcatgaaattagaacttccaagtaatcagccacatttggcttaaaagataccaagcctttctttcgtgtactaccactccgtaagctgaacttaatcatgaatcatatgttgttttatggcagactccagattaatgactatgccttttgtttaaaattaaatgttaagtatttatcattgggcttgaacatctaggctgatgtgaaagttcactttaatgattacgtttcttccaagaaagggaacatttctcccacagcaatttcattttgggcacttatattaaggtctaagaaaagtgacttaaaatattatttacataaacaaaattaggttaaattttatgaaattaaaattttatgaaattaaattgtaaattaaattttatgaaattttaattttatgaaattttaattttatgaaattcagatttaatctaattttacaggttgtcataaattccaataaaaaatttcctaagctttccaattctttccgtggtaattttttcttattttaatattcctatcatacctataatccattctgttttatattctctctctttctgtctctctctgtataagtttcttattttaattgttagattatcagtttcttgggtgtaggaaaactgtaatatacatccttaaatcccactttccaccctcctctcaagccataagttactgctgctcagagtgtgcattttgaactgtggcaggaataaggtaaaatgtacagataaaatttaagaagttgccccaaccccagagatagcaggtgaggccaggaaagtgaagtaggatgataagaaagaaaacggaaagaaaaataccattctccaaacatgccctgtgtcataaccctgaaaagacagggctaatctcaggtaattggaatgtgtaaatatttgtcttttttgccccagctttaataaggtataattgacaattaaaaattgtacatatttatggcatacaatgtgatgttttgatatatgcatacactgctaaatgattaaatcaagctaattagcatatgaccctcatattttatagcagtgagaacattttaaaatccactctcttagcgatttttaagtatgcagtatattattattaaccacctcactatgctatacaatagctctctagaacgtcttcatcttgtccaactgaaacttcgtctcctgtgaccaaaatctcccggtttactctccctaacccccatatcccccaccctctccaatccctggtaaccatcattccactctctgcttctatgagttcaacgtttttagaaggaatgtgtaaatatttgctacgtctttcctttatagtgatgagtagtttcttagtcttcattatgttgtttcttactgttctggtggctcgtttatccagcctcttggttgtggtcatgacaattaaggaccactgtaaaaataggatctggagtttctttgattggaaaataaatggaattgcaatggctctttgtggtctggtccctgtggactcactctcagaatcatgttttttctttgtgcacccactctttgatgtttcttagtcatatgttgtggtttctttgtggaaagatttgatgatttgggcaaagccagatacactgtggtcaaacactgtgtcctgttaacctttgtcattcttgatgtctgtgaattcttcattctggagaaattagggaacctccaaatggcagtaactgccctccccctcaacccccattatcatcacttggctagtcaaatgacataattacactgagggctttaatctatattgctctaaaccttcaggttgaaaactactgtatctatcaaacttttagtatgcatccaactctgaaatgccagcttttccttttccccacactattttgtctatttgtcctgtcattttcccattcccttcccttctccactgaccgactcctctctgtcgactgtctcctaaatgggtcctctctgtccttttgcactctctcccctctgtggcccttgctctctagagaacactgatgtatttctgtttattattactccccctccatctgtctttttctaaagcattttttctccttttcctatcttctttaattttcttcaggattcacctctctgacccaatggttttcttttatccttgtcttatcctctgtaaagtacagtattcagcttatgtttttttgtttgtttgcttttgtttttgttttttgttttgtttttgttttttttaaagtcgctgctggttaaatgaatgctggctcctatagggcaaaacaagaatcttgatcagtttttctctctccaacttctattgtgaatagcatgatctctttgttttttcattactcttgagtccttttctcttcttcctttatgtataccacatgatgttgctagtgtctctgatcagatcattcattgagaagccccagtaaaatgatcttcacttgcaaaaattacaggatcttaagaattttgttaaattcgtcttattctgtactggaaagcattgctcatatagtacgtcaggatttgaacagtgttttccccagcaggaagaactgttatcatgtactagatctggcaaacactagtattccacaaataccagatcctggtgatgctaatgatgatggtaatgatgtgggtgagtattttgaaggcaaaaggacagaagtgggaggagaacagagacacccatgattaggtgggggtagagagtgtgagttagggagaaatagctgctgggacagatggatcataacacatgttcgcttgtcttcattcttccgcctccaggttttaaaaggttctactagtatcacataaagtgtccaaaagcttcactgatgatagttgtctccatcaaatcatccagatggcttattccccccttcttcatttcccgtgaccatggaaagacagacactctccattttattgtcatcggtcacctaactcagagtgaatggggtggggctggagagggagataaggggtagttaggttaaactaggacgcagatttgaagttctgaggatgtgccagacttaatgtaattctcgcgacagctcttggagacattctgttggtacacaaaccggaaagtgtgaggacacgatcatgtcgtcatgtccctgtcctccttttctttgtttattgcccctcatctagctccgatttggacctcaggagaggctccagtttctctctgagcctaaagccttttcttttttctttccttctattttattttggtttacaaattttcctgatattttaaccactctattgaaaaacaagcaaaccaaccaaaaaacgctactttcattgttattgtttgtttgctctattattgaaagagagtaaaagggaagaccttcctctacacatgtgacaaataaactttgcatttttttcatcacagcatgatgtcattctcacacctttgttcttatacagcattatcatactgtaagtcatttttgggagttatgacttgcacatgatctgtgcattattgagagaaatgtgataagtaataatgtagatagaggttctaaatctgacgatgtagatttatcatcttcttgactgtactaagcaaattcatctttttttttttttttattatggggtctcgctctgtcacccaggctgcagtgcagctgtgcgatctcggctcactgcaagctccacctcccgggcccacgccattctcctacctcagcctccagagtagctgggactacaggcacctgccaccacgctgggctaatttttttggtagaggtggggtttcaccttgttagccaggatggtcttgatctcctgacctcatgatccgcctgcctcgacctcccaaagtgctgatattacaagtgtgagccaccgcacccggccagcaaattcatctttaaattgacttcaggttaatgatgactgaatgtttttaaaaataagtcacctttgactggtttcattttctatcactaatatagtaaatatagatgggagatatttttgtccttcttattttaaagcatagaggccaggcgcggtggctcacacctataatcccagcagtttgggaggccgaggagggcagatcacaaggtcaagagctcgagaccatcctggccaacttggtgaaaccccatctctacgaaaaacacaaaaattagctgggtgtgatggcggacgcctgtagtcccagctactcaggaggctgaggcaggagaattgcttgaacccgggaggcggaggttgcagtgagccaagatcgcgccactgtactccagcctgggaacagagcgtgactccgtctcaaaaaaaaaaaaaaaaaaaaaaaaaacatgggggaaagggtgggaggtgggtgagggataaaagactacaaattgggttcagggtttactactcaggtgatgggtgcaccaaaatctcacaaatcaccactagagaacttactcatgtaaccaaataccacctattccacaataacccatggaaataaaaaaattaaaaatataataatttggctatcttaaaaattaaaacataagaagataaacaaagaaggaatgaaaaagctgaaagagaagtgctatctttggagtatgcatacagacatattcacaatgatatgacattaaagttttctgtacttcttgcctggaaattgagaaaataatatatgataaaaagtgttttgcatcttctgtatatccagctaaggtaatgtccttataattggggtaaaaataataatttttcctactttactgactaaattctcttttctttgtcaaggtgtcctgtattctgctaaattctcctcactagaaaatcatgtcatcatgagtttctactgtatatattattaatataatcctggtttcattataatcggctttgttacttatgtttcaagaaaatctctatcaatatcctttaaatccttaaattaatatgtcttcagatttgtgttcatgcttttgatatttgataagcaactattcataggccttttgttttgttttgttttgttttaaacctcccattttgatgtcagtattttttagggcaaggtgaccttcatctacttctggaataagtgttggcgcaggaacgtgctccaccagactagggttggaggagagatttgggggttggaagccaggctgcctcttagagttctgctcattttctccacttgctatgaacctccttatgaatgggaaactcagatgttgaagttggaaaagtgttattcagatatgattcatatagattctgtcgatttcgtcggaatattaacccttagtttaaaaccatgatattctaaatttgggcttgttgcaacacatcagtttctctttattctatttctattctgtttttaactcgggtatctctcatctgttttaggtttagcagtttccttacagctattgcacggagacattgaacaaatcagaagggaatattcatcagtattttctcatggagtatccataacaaggaagctgggattttcaaatattattatgcctggtaggtgacttgggacgtaccgatatgatgaaatatgggtatactatctgtttttgatgtttgagaaatttttcaaattgccagctttgaagcattcacatgggccatgctgaagaatgaaatgaggtatgtgactgtaagtaagcacatttttttctaaaatatccttttcagtttaattttaaaatatttccttttgtataaactttcttgtcagtgatttgaagctcaaaaatgtctttacattctgattattctaaagttgttaacttgtgggggccatggctacatttcattatgaccaggagaaggaggaaaactgagttactgtccagaaaatattgtactccttgatggaaaatgttggtgaagatgcttagaggatatcctaagttttgataaaaacgtactgaacactagttagccatatgtaaataagcagccatatgcaaatattatatgtacttctataccttttctagatctatttgtgtgtatgatttagatctatattagtgcccccaaaattccccaaaagtagaaaagatgtgggttaagcagttttacagtgtgacatgaatgccagattcattgaagctgatgcatttgggagtgggtcagtcgtaatctctccacgaaaataaatgtttaaaagcacacccctttatgtgcttatggaaatttagggttttctgagtgtgttcatctacaacttatgaattggataagaatagtacgtttgctgatgaggaaggatgtgtgtttagcaaaaattgatttagtcagtcagcaggcattgattgagcatcaatcaaaactttgtgccaggagccaaaagttaaaaagatgagttcattcattctacaaataaatatttagcactttctatgtacaaaggcattcttccaaatactggggctataaaactgaacacaacagaagaaacccataggacttactttgtaataaggaaaattataataaatatgtaagtaaaacatgtatgttcaaagatgatgaatgctcaggtgaaaaccagtgtaggtaaagggctagggaatgtcttagagggtagtgggtggagagatggagatttgtggtaggtaagaaatttaggtgagaaggcagtagagtagagacctaaaagacatgaggaagccgtgcagataagaggattccaggcatagcaacaataagggcagtggtcctgcagccatagaatcgtggcttgtttgaggaactgcaagaaggctaacttggtcaaaatacagtactggggatgggaatggagattcgaagagggaagtcatgtggaccttgtaggtcacactcagcactttgggtcttattcagaatgagaaaggaaacagctagagggtttggaacagaggtgtgacactgctttacattgccacaggatcactgtggttgctgtatagagattatacctggagggaatatgggagggcagcagagaaacagggagaccggtttggaggctgtttgaactaatccaggtaagtggtgatcatggtgttgagcaaggtgttagcagtggagatggcgagagtaagacctgtttatactttgagggggattacagtccacaggcagagacacgctgtaacccgaaaggagttggagaatgcagcatggagagcacagaggagttgtagaatcttattgaaggagtctcgttaaaatttcctgaggaggtaacacctgagcagggtcttcaatgctaatgattctaggcccacatcccccgagtctttgttctccactgcactaatagcaagtacctgctttaatagtgaaagactgtgtagtcatagccaacatggctgtacctctgatgtttcttttgtttctttgtttgtttgtgttttcttttttagagatggggtctcactctgttgtccaggttggtgtgcagtggcacagtcattgctcactgcagtctcaaactcctgggctcaagtgatcctcccacctcagcctcctgagtagctaggactacaagcatataccaccacacctggctaattaaaaaaaaaaaaaaaaaattgtggccgggcgcggtggctcatgcctgtaatcccagcactttgggaggccgaggtgggcggatcacgaggtcagaagatcgagaccatcctggctaacatggtgaaaccccatctctactaaaaatacaaaaaattagccgggcgtggtggcgggcgcctgtagtcccagctactcgggaggctgaggcaggagaatggcgtgaacccgggaggtggagcttgcagtgagcggagatcgcgccactgcactccagcctgggcgacagagcgagactctgtctcaaaaaaaaaaaaaaaaaaattgtaaagatgggatctccctatgttgcccaggctggtctctaatccctgggctcaagttatccttctgctttggcctcccaaaatgcttggatgataggcttgagccacagtgcctggcccacctccaatgttaaaaggagatttctggcctgacgcagtggctcatgcctgtaatcccagcactgaggctgaggcgggtagatcacctgaggtcaggagttcaagaccagcctggacaacatggtgaaaccccgtctctactaaaaatacaaaaaattagccgggcatggtggcatgtgactgtaattccagctacttaggaggctgaggcaagagaatcgcttgaacccgggaggcggaggttgcagtgagccaagatcctgtcactacactccagcctgggcaacaagaacgaaactccatctaaaaaaaaaaaaaaggaaatttctatgctctaaaaaattttaatttctaaaattctgtgaaagtcataattttgtgagagaatagccttttaaaaacttttgaagtttaaaagcaaaaaaaaaagaaaaagtctaattgttatttagtaatgaaccactagagttctagaaatttcacactgtccctaggaacacagggctatgaccagctggggttatcttcaacaagccttggttctgtctatacctatctatttctttgtgtgtgtctggacctcttattttctttctcttttcctttctgtcttgatcttaatctttctttttcttcttatctttcctccctcctccatcttctttccttctcctcctcctcttcctccccctcttctgcttcctccctcctcagaataggactaagctacacaggttattgtggcttacatttaaaatttttttgacatatcctcttgtttttacaaatcaagaaatgagtttttttaagtcatgaattttattataaaaggacctcacttgtgtttgatcttccatagaaacaaagagcttctgcccttttgtctacagatagaagatgacgaatagcatactaagtagtagtatttctgggtgctccataccccaccctccacaaccaagaaaagggaaaaacaatagaccaaataaaatactcttaaattgttgacagtatttgttttaaatgaggtcttctaaaccactgtttaaatcccatgtgtaagtgcaagcaaaggaagttgtatctgacaaggcacctggcatagctatgagacccaataatgagattgctatgaataaagacctaaaatgaccagtatcgcccattgcaccattttgtaattgcccgactgaaattccttcatgcaaggaaggctgagagaacatcctgtaagttttcctcagatgacctgacctagcttagggacccagtcagcctgagcatctcatggtactgttgtcgaaaatgactgtttatagaactgtttacttggtggcatgctattctgtggcccttgcaactgtccattatttccttcagttgctataaataactggtatttcctcttcaacaacaaaaaaaattcatcccactgggaagcaaattgatgggcaaatctaatatattaaaaaaaaaaacattttagagcagaatgcagccagctgctggaagaattcctcagcttggtctctgggcagtatcatggagaaattgaaaaatataaagcaagatgacacttcactggctgattaattgtctgggatctgctgtgctcacgcagcttttgtgtggctttaatgatgggcatgaacttctgtggaataaggctcgtttctgtccctttccggtaccaccttgtaatgcgaagtctacactgtccaggaaaattgttctttcagacatgtgtctgtagttcaggggagtacaaaagaggtttttttaaaagcacttccttctcttttttttttccctttcttcctctggctttttaatcttccataatagaaaagggagagatgtgtgtatttccttaaacaactgaaagcaactttaaaactcagtggaattttttacactaggaaacatgcaatcattgttttgttttcctttgttactttcagacttgtcaattcattctcaccagtggctctaatgaaaacttgagctgaattcttccatgagaaagtgtgtgtgaacaatatttctgatcccaatgttacactgaccgtctgcaagcataatttttttttcattgtctagatgtgtccttcagagttaatttgcatctttagcattctgatagggtcaaaacaggtgaggcacatgattataccaacaggacccagtttatgcacacagtcaccgcctctctgcagaatgaattatctgtgatcctgacaaggacaagaacatacacaaaactcttttcgatcacagaatgtaatcaatgccagactctttttgaaatgggaaaaacgtaggcgcagaaattctccacttgtctcactattgtacagacaggtctcctggtgtgaggaggtacctgtccatatgcttctgagtcatcatgaagtcctctggactcttccttggttaagggtctgtcacacagcactttatttcttagagtgtcagacttccaactgagaaaaaacattttctgtgaagctctgtcactgccacctccaagccaaataactgattgaaggcgttccacggtctgggctatgagagggagggagagcagcaaattattttaatcagtgctttccagtaggaacatcatttgagcgacaaagctaattttaaatgttttggtagccactttaaaaaagtgagaataaaagagatgaaattagttttaaccatatatgttacttaacttaaaacatccaaaatattagcgttttaataggagatccatatgaaaaactactgatgagttattttacactctgttttcaacctcagtctttgaaagctggcaagtatcgtacatgtacagcatgtctcttttcagcgagtcacattttaagggctccattccacatgtggcagtggtcaccctgttggacagcccaactctaaacatcttaacagaccctaggcaaagcaggcctggcctattgctaagcatcagggagatccaagtttccatccatcagacattctggagcaaagctggctgatgtatcaggaatggcatggaagatctgactgtcttccctgctccccaaatgtccattttttactctgtgattctttccaggcaaaattttctttgcctccatcatgatttcactatttaagctttcatgcctgtaccctatttctttagagacttgttcccacatatccattggttaaactgtcattctttgttagggaacccatcatttatacatttcagtgcattcacttttagtaggtctttgaagctcttagccctaaaacgtttttttttttttcttttttctttttttttaaacagggtctccatctgttactcaggctggagtgtagtagtacaatcatggctcactacagtctcagccttctgggctcaagtgattctcctgccttagcctcttgaataactgggaccacagcaggtgtgtcaccacacccagctaattttttattatttggagaaatcagatctccctatgttgcccaggctggtcttgaacactcctgggctcaagtgattctcctgcctcagcttcccaaagtgctgcaattacaggcatgggccaccatgcccatcccctaaaaagatttaagtgaaaacactggagtgatagggttgagatttggggaccagttttaatagtaatctgaggatttatttgtttattttataagtattattcaaatcaatcctcctttttctttatccagtctatcattcatgggcatttggattgattccaagtctttgctattataaatagtgctgcaataaacaaatgtgtgcatgtgtctttatagttcaaataagtcaaatttctatttggtcaaagttgactaaataatgatttacagactggagttagaagaatgttatagagatgtttgtcttatgtttaagaaagtaagcaatttcgaaggatatgaacagacacttctcaaaagaagacagttatgcggccaagaaacatagtaaaaaagttcattgtcactggtcattagagaaatgcaaatcaaaaccacaatgagatatatctcacaccagttagaatgggcgattattagtaagtcaggaaacaacagatgctggtgagggtgtggagaaataggaacacttttacactgttggtgggagtgtaaatagttcaaccattgtggaagtcagtgtggcgattcttcaaggatctagaaccagaaataccagttgacccagcaatcttattaatgggtatatacccaagggattataaatatatgcacacatttgtttattgcggcactatttataacagcaaagactaggaaccaacccaaatgcccatcaatgatagattgcataaagaaaatgtggcacatatacaccatggaatactatgcagccctaaagaagaatgagttcatgtcctttgcagggacatggatgaagctagaagccatcattcccaacaaactaacacaggaactaactctcactcctaagtgggagttgaacaatgagaacacatggacaccgggaggggaacatcacacaccagggcctgggggcggtggggggcaaggggagggagagcattaggacaaatacgtaatgcatgcggggcttaaaacctagatgacgggttgataggcatagcaaaccaccatggcacatgtatacctatgtatcaaacctgcatgttctgtacatgcatcccagaacttaaagcaaaatacaaacaaaaatataaaaaataaataaaagtcactttgacaaaaagagaagtaagcaatttcattattattattattattattttatttatttttttgagacggagtctcactctgttgcccaggctggagtgcagtggcacgatctcggctcactgcaagctctgccttccatgttcatgccatcctcctgcctcagcttcccgagtagctgggactacaggcgcccgccaccatgcccagctaattttttgtatttttagtagagatggggtttcaccgtgttagccaagatagtctcgatctcctgaccttgtgatctgcctgcctcagcctcccaaagtgctgggattacaggtgtgagccaccacacccggccaatataaatattccttactatgtactgatagagaaatacacatcaacagatggaattgaaacagcagtaagccttcttttggagaaagtagatgtgcactagtaagatttgattttccttaaaaatatatcctaaatctagttgggcatgatggcacacacctgtaatcccagcactttgggagaccaaggatggtggattgcttgacctcagttgttcaagaccagcctggacaaatggcaaaaccctgtctttacaaaaaatacaaaaattagccaggcatggtggcgtgcgcctgcagtcccagctactcaggaggctgaggtagtagaattgcttgagcccagcaggttgaggctgcagtgagtggagatcatgccattacactccagcctaggagacagtaagactctgtatcaaaatatacattgatatatataatgtatctatatatatcctaaacctaaccaaagcttaccaccctccagctctagtcactggacccccacaccgcttagcttagacctgaaccctgatgtgcgaggagatggtggtctttaaccaatgaatgccacagtgactgaagagagagtgaagccgagattctaatgtgtcaccctgaagttttatcccagacctagatcagacagagggagggactggtacctctcaaattatgaagcttacggtccccactgccccaagagtataggagttcccccaacgggctgccagatctccatgcattgtctcagagtgggatggcaacagggaaccacagtttatccatgctcttgcctctgagcaaaactgtctggagagcccattgtgggtgttgcatcatgtgcccttgcttgcttaattgtcataagcaaaacataaaaagctacctcccaaaagagttcagtatctcatagtactcttttaaaaacaaagcaaaacaaaaatgagaatgatagatagaaaatagagaaaacctgatgggttttactcaagtgtatcttgtgtgagaattggagatataatattagttaacttttcagcctatccgtacatttgccctgtctgtgctctgtttcagtctccagttacctgtgagtcctgctcccattccttcctcctccttgaaggtctcatgaagtgacagaagcttggatatggaagtcacattgtattagtttcctataggtgctataacaaggtggcttcaaacaacatacatttaccgtgttacagttctggaggtcagaggatgagctagtctcactgaactaaaatcaaggtgtgatcagggctgcatttcttctgatgcttccaggggagaatatacttccttgccttttccagcttgtggaagctgcctgcactccttggctcatgacccaagtcattccggcctctgtgttcctcatcatatccccttctctaattctgacccttccccctccctttttcaaggaccctgtgattatattggacccaccctgataatccaagaaaatctccctatctcaagatcattaatttaatcacatctgcaaggtaacatactcataggttccagggattggaacctaggcatctttggggaggggatcttaatctgcctttcacacacatgaggggccacccagcccacccatgtgtctagtgcatgcattcctcttcatggttcctagtggtggttttctggctcatacttgaatatttgtattgaccaagaacacatcatcacattttctctcaaaatgacttatgttggaccaatttccctttctgcttggaacttcaacattttaaaattcagttaattctattgtctacctcttccttcttgtgatgggttctgagtcctttcttcatattgtttatggtctggatgacaccatttgtgtctgtctctgtgttgtaaagatagtccctagaactgtaatcagtatttcaaaactggtctgagaaatgcaaagcaacacaggactactaccttccttgctcaagtcacttctcctgacaaaggctgaattgcagtagcttatttgatggccattcttactgcatggaattacaggttttcataggtaatgtggggtcactgataatacctagggcactattcttaatccctacactttaatttcctcatctgcaaaatggaaatgatagtgccttttttataaagttgatatgataatttaatgagatgttctacttctagcattttgcaaagtacccagcacatagtaggtactcaataaagtgtactgctgctgctgttgctactaggactgttactactgccatcatcattaacaacatcatcaacagtaatctaagttcacctaagtcatttacacattttcttttttaaaaaaactaaaggacaggaaattttatttggttccataactcttaacaaatatccagcttgtgtgtgtgtgtatacgcaatacacgtgcacacacacacacacacacacacacacatacatgcatatatataaaaaatagataaagccgctgggacagtgtacagtggtttacatgctatggtgatcatgcgctgtatcctttatccaagacattcataagacagaaacaaggattacagttttcaactactgacggaaactcttacccatctaggtcaagctgttaatggatccatttgactgcagtcactgaactcttgagtttgttcccaattttgtgaccttatctttatcttgtctacagtagtattttgaaaggccttcatatgtgtaaaggctccctagccagcaggcctgctaaagaggaagaaagtgtggtgcacatcaaatttttagagtaataaacttgagaggtatgaggtgttaataaacattgtcagggaaatagcttttcacacgggtgctatgactccatttcatactgacttgatggtttctctcttaattacccaagatgctttctgaacaccatttggactcatgagttttctccagagtcaacctcaagtgtattgatttaattagcacttgtttcaacttgatccttctgcatattttggcaaaacttggcaccttgcaaaattggaacataagcaagctgtaaaattcctggggagaggcacatggagaatgtcgtccaggagaagtgttcttcttgtcatgtattctcttttcaaagaaatctggttttagtctaaaagatttgcaaaagataatggggttacagggatagtgacagttaaagaatggaaaattaaagcatacgtatgaggggtttgattttgtgaacgtgttaatttccggaggttcttttgtaaggcatagaaacagcataatataacaaagtagtgttgtctctcctaccacctctcatttacccacctttaccctattctcatgttaataacaaaaacctgagacccagaggtttctaataccctgtatagactgatgtcacacaccatagcagtagcacagactagaacctgtatctccttattctgattgtcctgtgaacctaatgcctttagtgtatttgaattcagaatctcttttgtaaagaagagataggagaattcagctgtgttatgagctaaacaggccttggggactggcctgagaagctaatgccctttggaaccttactcctttgtcgaacactgtagcctactcagggtgctcatcttctcatgaggccttctcttattaccctgttgaaaattttaactctccctccatccccattcaatactctgtatcctccttctcacttttatccacagtgcctattatcgctcagcatactatatattttacttatttatgtatttattaaggacttacacctgctagaatcaagactctggggaaagaatttttgctgtattcactactgaatcttcctggcttggaataatagtatctagcatacaggagatgctcaagaaacattcgttgaataaatacaggtacatagaaaaagaattttgtgatgctggcagtacatccctcattttccctcctttgggcctagcctacggacagagggaaacaggttaccttgcaaacctcccttatcacctcttgcctttgctggagtctgagaggccacgtccttccagcagataacagtggaaagcaccttcccaagaaacacttagtctttattttgcaggacagttaatccctgtgtggtttggacaagctaattactcattataagaaattcctaaggtaacaacccctgtagctatacttcccattagtcagtgtaggttttataggctatttgtagcagagctacttattatgtgtcacttactccaagaagcaaaagaattctgctgtttttagccaatatattttgctctaaagtatcttgatttgagtgttgttttttttacctgccacatctgttcgtggaaacattattgtcaagaatttcctcccaaacctcttgttaaactagcatgtgcagaccattgtgtgtaccagacctattttttgtttgttgaagtcagttgatttgctgttgattctataatggaattgttaaataaataacatcaaatgtgggagtaaaaaatatatgtagtaatcaagtgaaatagaaagtctaataaacataaaatgtactgggccattctctaaaaattagtaatggaaatagttaaaacagaaaactttcaaagcacacaaatataatttttaaagtgttgaaatatgttgcttttctcctggactttaagttcattgccttcccaagttggtttgtatgagctgtataagagtactagaaattcataagccagagacctctgtattgtttccactaatgtatgttttatagactctttgtaaagggtgactaagatgtaattctttttagaacttacccagtttttctgttttatggcccacctgtatccttgtcagcctaggtcatttgtaaatgatgccatcataaaaagttggtctttatggaggaagatgatctggcacactgatattctcccatggtccatggtattgaggaactaggatacttccttgtgcacactttgacgaagaagttttataaaactcccaattgtagacatagttatatggttatttttctttctagtgattttctttcttatggggaaattttttattagaaaacagagtattcaaggtcaggagatcgagaccaccctggctaacagggtgaaaccccatctctgctaaaaatacaaaagattagccaggcgtggtggcacgcacctgtagtcccagctactcgggaggctgaggcaggagaatggtgggaacctgggaggcggagcttgcagtgagccaagatcccacctctgcactccagcctgggcgacagagcgagacctcccttttttttctcaaaaaaaaaagaaaagaaaaaagaaaacagtattacttttgattttttcaagtgtttgaaatatgtgttaagtaaaaataaattcgaccttgccatctcaccatttacctttaaaaactttctagttgtgctttgttgacttatttctcacttctctatgcatttattatttcccgctagtttaatttttataaaagaagtaaaagcatgctgttagcacatttgcctaagtttgctagttggcatcaaatttatctttttttatcttgcaataataagaaagggttgagatttttaaaaactcaagttttataaatcaccagtagagaaaaaatcgacagtatatatgtacatagaatgtgtctatttgaatatagggcctttctcaattgttttatagcttgatgatatgaaatattaagccgagtttgtctgtatgacggaattattctacatctgtgttcataaaatgctaatctggattcttccagcagtgagatcattttgtccatgaattttggaaaagatttaagttgtaattgtaccctttacagtcctattattttactacatttaggtatttctcctaccctaaattgctatgactataaagtaataagactggtttctctgagccacccctgctaggctgtcattttataatcacacctcataaataaaatgagggaaatattgaaaaatggtgagacttgacaataccttcctacttggtcccagtattcacctcctagatgtagaattacagtgtttctaattcagactagcagaggctggctgttattcttctcagatgttggcagtaagggtgaggacacttttataaaaatgcaaatatatttgtacttttatatgtatgtatagcagtatattgtataaactaaagtttttcttgatagagcactttattacatttcctcatatatatataacatggttttaattttcctttccttataggtgaaatgaggaatgatttatatatcactattgaaaggggagaatttgagaaaggagggaagagcgtggccagaaatgtggaagttacgatgttcattgtagacagtagtggccaaaccctgaaggtatgttaatacttgatatttccaggtcaaacaagtctgtataattgctttcacttaatctttaatgtgatcagttattttctgatttacgatcagttaatttctgatttgcgttattttctatcttatttttctccttcacccctgtgtagttttctttcttttgttttttaattcactaaaattcctttcagaaaagagagcagaaaaacgcagtcttcatgctgaagacaagccaggaaaaaaaaacaacaacttttacagtttgcttaattcattgtgtcaataattttcttacagcagctattacttaaaagcagctttttttttttttttttttttttgagacagaatcttattctgtcaccagactggagtgcagtagtatgatctccactcattgcaacctccctcttccaggttcaagcaattctcgtaccccagcccttcaagtaactgggattacaggcgtgcgtaaccatgcccagctaatttttgtatttttagtagagacagggtttcaccgtgttggccaggctggtctcgaactcctggcctcaagtgatcctcctgccttggcttcccaaagtgctgagataaatgcagcatatttttaaagccatttcattatttaattctatatattttctttctgaccaaaataggcatgaagactagggtactacttactaattggggtgagaatagcaggtgtttttatggaagaagtatttttcatgagccccttcttcatagagacatacagttgcccatttaaataagaaggttggccctggggcgtagtgagtcacctactgaggcacaaaacaggcttttgactatggcaggttgggaactttaccatgtagttgaactccaagtgggccatgcaatcgtccatctcccacgtgtcacccgggtctacccttggcacagtaaatccttggagaccagcatcagaattaaatagatacaccccgctaagcagcagcaagtacagaaacacacggcaaaggcccagcgaggtaatttcatagtgctatttgagaggcaggcagatagagcaaagtgattgctctgccttttcaaaagatctttagatgaagctctctttaacctgtgtgttcttccctttgttaggattttatctccttcggctctggggagccaccagccagtgagtaccactcctttgtgctttaccataacaacagtcccaggtggtctgaactgctgaaacttcccattcctgtggataaattccggggtgcacacatccgcttcgagtttcggcattgttccagtaagtgtttggtggcattggctacctgtgtctattgtgctggagtatcctgcttactgagctgtcatgaagatgtgggttgatcttaagttgattacttttgtaaaaatcagtttgttccattctagaaagattagccagaaaggggaggcacagtgttaaaagctaaactgtttctggtggtcttaggcaaccctaaccattctggtatctccaggagctgatccagctctcacacagattggggaaacccactaggacttttcatggcatgtgaagccactgggaaagcctttggccagttcagatgcatatctgatttgtgtgtatctgcatcactgtactctctcagacagtattcagatgagaatcaaataatgtcagctggaaaaagacttagaagtaacatgaagtaattgcctcattttacagatttttttgttttgtttcgaagcaaagcctcactctgttgcccaggctggagtgcagtggcgcaatctcagctctctgcaacttccgcctcccaggctcaagcaattctcctgtctcagcctcctgagtagctgggactacaggcgcccggccaccacgcctggctaatttttgtatttttattacaggcggggtttcaccatattggtcaggctggtcttgaactcctgacctcaggtgatccacccgcctcggcctcccaaagtgctgggattataggcgtgagccaccacacccggcctcattttacagatctcaacaacccaagacatagaactgttacagggtttgtccacatgggcattgctatccataaagttatcccttctcagtatttctatttccatttttttgcattcattaccaccctctcaagccccatctctctcccccaactacccccagtccaggaatcttctgatattccttgtgtccctgagtatatcttagcactgccagtgtacattgtgaccagagaaagttttggtgaatctagctttgggagcagtacaacaaacgagagatacaggagaatcacatttttgaagaagcagcaggctctcttccagtctggaaggaataggggctttgccaaaagatttgtggtgaatttaccacagtgatgttgtattttacccaaggttcaggcagagaaggaggactttatcttttgctggaactatggcatatttcagaattgactcaagagcttcatacattatgcttgtgtggatgtatctgaatgcaggaagagagctagcagggtcttaaaattcttccaaattcccagaagagtttcatgtaaaggacttgaagtaggaaaacataaaggacttagaatggtgccatactatttcttccatcaatctttgttatgaattctcactggggtctaatatgaggtctgagctttaaggtaagaaaaagagaaaataaaggtgaaatagtggggaaagagagaaagagcatttggaggtaattattcgaattcagaacttggaaagtaaaataaaggctattttcagtaaaatctattggatctctaccttcttgtccctgtactgcaaaaattcctcataggttttttcttttaatcttcataattaaaagtcagaagaaacagcaaaatgtaaagaagaaggaaaaaatcttgataataccacaaactatgaataaccaatgcaatcattttataaagtgggcttccaaatatttatctgtgtgttcatatatttattcaaaaacatcagttattcatgaaacaaatatttgttgaacacccactatatgccaagcattttactgggtactggagacacatcagtgagcacaagaaaatagccccgctcacagagctttcattccagagaggaaagacagataatagctgagaaactaagtacatagtacatcagatagcaagtgatgaagtgcagtgaagacttaaattgcagctagggagtagaaagtgatggtactgtgttgctattttacacagggcagtcaggaaagacttcgcttataaggacatgtgttggcaacaaactaaaagaagtgaaggcctgagccattgagactattctgtctggggaaagaagattccaggcagagaggacagtacaaaaggcttgaggttgaaatatgcttggccttttcaaggaatagcaaggagaccaggaaggtagcagaggtgccagatcttgtatagtcttttatttcatgatgaggactgtgcattttatttgaattgagaagaaccacgagaggatttggagtgaagatacgtctggctactgtatgggataatagattataggtaatatggttgggaacagaaagaccatttgggaagctttttttagtcttccaagtaagagatttaaagtgttctgcattacgatggtaatggttcagttcttttttacagaatattaacagattggatctgaaagaaggagaaaagtccagggtaacccaaagatgtcggcctgagaatgaagtgatcatttaattaagtggggaagacaacagggagaatctgtttggggaacaaaaatcgaacattgcattttagacatgttaaatcagagatatctgttagacactcaagatgtcaagtgggcagttgagtaatgtccagtttggaaacttgggaatgagaacatacagttcagtggttggtctactgagccagcactggggggtggggaggatccctgaactgtagcatttgctgatttccatggtgtagatactcccactatgtccaatttcaagcttccaacatgacatcactgagtgtagaactggggagagatgtgcactctcagctcttacgggccagtatgatccagctccagcacatcactaattttgatgatttctaaagtctgagactgattggagttcctaggtagtaagtttagatagcaaaggggagtcgaaggatgggtctctggggtacttgccatatttagagctgggaggatgagaaggaggcattaaatgacattaagaaagactatctagtaggttgaaggccaatgcaggaagaagagaacccaggagctaaatgaaggcagttttttaagagaggattgatcacatgtgtcaggtgccagtggtagttcaaataagatgaggacgaataatttgatttggcatcatggaactcattgaacctgacaagtggttttagtgaatctgtggtagtaaatgtgagttaaagaatgagatggagggggaaaagggggagtaatgggtatagacaaatcttttgagaagttttgctataaaggatacaagagctatggtcatgcgtaggaagactcaatgtcgtcaagatgtcagttgttcttaaatgaacctgtagattcaagttcctgtattatcattgatgtggaaatctcttcccagagatctttggtgtgatttttgcttgactttttaaaaaacatgaattatttttccagtttctctatggggttgaaattaatgattttaaaagaaagtcctttgctataattacattttcagggatgtcctcatattagggaccagcaccagccagacaaaattaccgttttctgcatgaggctccacttccctgtgcttaaatgcctggagcaattaaatgctgtgttgctaaccttcttgtccagtcttcaggatcaccatacctaactcctccagctcagatcttactgcatcccaaagttgaacttgtctgttcaagtataatgctccacttgtgaaagagtaaccatccagcccttaacaggctgctggctctggagaactctgcccatctaagtacaaggggagagtcaagttaaccaaagaaggttctgttaatgctttctccatttttggaggaaaaaaaaaaaaaaaaaaaccttggtggaaagaactggaatggtacttaagagatctacaacaagttacctaacatctatgacctcaatttccctatctataaataattactaatgatccttggcatttctagctattgtaattcttaattaggcatctgaaaacctcatcgcctcatttccggcttccagagtagtgagctcttgttaaactataggtttaatattcatattgtctttcaacgtgcctaacttattccaaggaggtaactgcaacaggacttactttccttacgtgtgtggatatagggaaagaagttctgtcatggaccagggtagagcttagagattcccttttgatgggtagtaatcaaaacaaaccatttcactttcattcattcacttgttcattcatttatcatatatttattaagcacctactatgttcctagcactctttgaaacaataaacagataagacccctgccctcaatgggactttggggtaaaaagaagaaacaggcaatccacaaattttttaaaaagcaatttcagatagtgattcccataaagaaaattaggcaagaaatgtaagttgcagataagggggcaggaagaggggattagagggtggctgctctatatagatggcctatcagaaaagctgtgctgcattgtgtagtgggaactgttgtgtatgagttatatttctcgatgattatgcttcttgacaaactatgtacctgaacatagatacacttaaataagcaagtaatttgttttttacagcaaaggagaaaggagagaagaagttgtttgggttttcttttgtccctctgatgcaagaagatggtaggactcttccagatggcactcatgagctcatcgtgcataaggtaacatcagtcagatggtggcgatgggcagtaaaaaacagtgctgaaataacacctcactatcttatcattttgaaaagagaaaaaaatgactgaaatgaatattcttgtaagattgctgtcagggagaatgtctttttcaaagtattgtttctatattgggttatattttagaacatattttagagatgatttatgttttcatcctaatttaggggtggatgtttgggtaaacctgtgtattgttcttaaagttctttccattgctgtgatagggttaagtaaaccttacaaataactttttaaatactacattacgcgctttcttatctaggtctgtgtatccccagaagtaaatttagcaaggtcagcattgcttttttttgtctgctattgttactaagcaggcagagaagtggctgtatttcatcatgacaactttagcagttcttataaatcaagaattgtcataaaaaacatttggaacaaagtgtattgtagtaggcaacaaaagaaagcttgcaaaggagaaccccttgtaattatctgagaatactagtaataatgaactatagggtaaaaaatgtatttttaagtgcacaggcaattttctccaaaatattcctcctttgcatttctccatttctataactgtgtaatagtgaggcccttatcaactctcacctatgataactggtcctgctgacctgggtcttgtctccctctagcccagacattagggtcactcatctaaggagcagatccagccatgtcacttcccagcttaagacccattcaaaagcttcttgctgagagaataaatcccaggcatctcagggcatgccagccttctacctccctactgcctcactcctcaccacttccggcctcttgatgctacaaccacatccagcacattctggttcttcaccctctgctgctggctctttctgctcttcccttgccttgtggctcctggagtcagccttcccctgcctctccctctgagtgtcttctgctcatccctggaggctcacctgggccataacctccctcagaaactgtcccctgcttcctggcccaattcatattctcagctggccagttgcccttccctgagctccctggtatctgcacacatctcttaccattgttctcatcacactgtcccagaactatctgttgatccctcagcttgccccattagatttatgagcccctcgagaacaacagctatgtaaagggattctggcctgtgatagatgttcagtgaagattattgaatgaataagagattacaagcaaaaactttctttggattgctagttaaatgagaggcaacatataacacacctggtattttctttttttcttttttctttttttttttgagatggagtcttgctctgtcgcccaggctggagtgcagcggcacaatcttgactcactgcaagctctgcctcccgggttcacaccattctcctgcctcagcctcctgactagctgggacaccaggcacccgccaccatgcccggctaatttttgtatttttagtagagacggggtttcaccgtgtcagccaggatggtctctatctcctgacctcgtgatccgcccacctcagcctcccaaagtgctgggattacaggcgtgggccactgcgcccagcccacacctggtattttctatttttatagaatgtatatttcattgtctatttctttaatcattcattttctcattatttgttcaacatgtttattgaccacagactacagccaggtactgttctaggtgctgggaaaatagtggcaaacaaaacagccaaatccttctgtttctggcctttacgttctctcttcataaagtaatctaaaagagctaacaaagctaaaggtgttaaaatagaaagaaacaaaaatattttaaagcatagtaaccagaaaagcaaacagaggaactacatatactagactgcggggatgatctatttatctcagctttaggtctgaggctgcccgataagatatataatataacaggcaatgtcttgagcttcaattttcgaaaacataaatggtacttcatataaatgtctttgtaacattaaatcttagctcagaaaagataaggctgagataactaagactgggctccccgtttcctcatgatatgtaaaagaatgaatcacttctacatagtatatcccatctggaccctgtcacctatgggtctgagggtgtgtctttggcagtgctagctttccagtcaagtcctggttgacttctcttcgtgagcgtgaaccataccaagattctcagttgctgattagaaacatgcatatgcttaaaatgccagaggacaggtagcagagctcgcttctccatgtgaacatttaggagtcaaacaggtattaattcctagacagagtcctgtccaggtgcctgtcgtcagggccaaaacttttctcaaaaataggactttgactcagttgtagctcttccacaaagattgacttagtactaagaatcctaatccataaagggaaatttatttgagcatgaaaattgtgacctcaaccacaagagaaactcagtatggtatgtgtaggctgtctaatttggggcagacctacattgtatagctccatcaggaagcatttgctccacagaaaaaaccccaagtagctgagttttcttatgaatagggttatttagtatttcttatttacagagttgtgaaatacttgccaagtataacaacttttatttttatttctcatactactgagccaacaaattcagtttcagcttatggccacttgtagtttatgattatgaaaccatattaccagcataatacataatccttcttctgccacgacaggaaagcacacagcctgctgatcattgtgcggccttgaattcagtatttaaaaagaaacgtggagagagaagtgtatttcaaattatgagctaaaagtatagcccatttaataagtggtgttgagataaataaaatgggtattaggggaagtggggaagagctggattcctaccttcctcttattgcgaaaacacattccagattgaatgtaagaaataaaactgggcctggcacagtggctcatgcctgtaatcccagcactttgggaggccaaggctggtggatcacctgaagttaggaattcaagaccagcctggccaacatggtgaaaccctgtctctactaaaaatcaaaaaagttagtccagcgtggtcatgggtgcctgtaatcccagctacttgggaggctgaggcaggaggattgcttgaacccaggaggcggaggttacagtgagccgagatcatgccattgcactccatcctgggcaacaggagtaaaactcagtctcaaatcaatcaatcaatcaataatcaatctgtacgagccttaaaaatacggatgaacattcttataatctacaggtgagaagggcctttctaaggatgtctcaaatgttagaaatcaaatttaaaaatcaagtaaatttggctacataaaatttaagatatttattgataaaacagtcataatctaggctgaaacacatttcaaactgaaatatagttgcaacacagcttgtaaagagttgctttataaccccataggtaacccttataaagggttgctattcctgactgaccaagagttatcacaaatcagtaagaaaaggaaaaattgataaatgctacaaagactatttaaaaataataaatgcaaatgtataaaataaaagcatgaataagtaaagaaatccgtttaagttaaaaaatttgaaacctttttgcctatcagattggcagagatttttaaagcccagaattggagagcaaggttaagggaaaacagtctcatgcatttatagaagaaatatgaacactgttgtgtttctggagggcagtttggcaatacgtagataaattttaaatgtgtatatccttcaactcagccatcccacacatgttggtattttttggaagaagataataagacaaggtgagcaaaggtgattcaaggatgatcactgcagattgcttaaaatatggaaaacatggaagtaatttaaattgccaataacatagatctgattaaatttagttatacccgtacagtgaatgaaatactatataggtggaaataatgtttacaggataattttatatgcatggaaaagtgcttattgttaatactttatacatgcatatatttagtataataccatttttataaaattgcttaactgtatgttcttatgtgtatatgtgcatacagagatgcttggaatgatatccttaaatattaatgactttttattttcatattgcttaaattttttgttagtggacaagtgttattttataatattaataatttttttttcattttgaccaaacaaaaataggaagagacagaaatttaaacttagccttgttttatactatttaattctggacttttatgtaagtgaagaccattcttctgtcatataatcttgacagtaatgtttatggtaaggttttgaaggaacattaattgtcttggatttttataaaccatgttctgtgtcattcattggcaggtactgcccatgatgtcaaaggttgatgagagatgaaaaaaaactgcgttaaaaatgtgtctttaaatctgtcttggagatatgatacagagaatagctctggtttgtagtagagtattggttaaaacctacttgctcttcatgtaaagtattagtttaaaagactcaatcctgcagtgagctaagaagaaatctgctgtgttgaaggctattagtatcctaatttaggccttaaatttgtgaggtagtttccctttgtagcaatggctggacttcacttctcaatgtgttctaaagaaaccgttcttaccgagctgttatagtaaatactttgtcaaggacctggactcaccttttaggcagggtctaaggaatcctaagggaaaaggtcattttcaacatcacttgattgattacatatttagagtggtttccaatgtaaataaactctgaaatctataaaaatttgcatatcattagctctaggagaataagtaaaataacttagttatcattagagattttgtccttccagagcccccagaacatcagtgatatctccaaatggctgacagataagcctaaaaattccctttggaattgctagttcgctaataaccatatttaatcttaagttttggtatttcattctattagaattattgtcttccttaactttgtaggaatgtatttggctaagcttcttcagctacctgctggaaagtaagttaagaaaaaagaattaagaaaaagttaagaaaagagaatgaagcaaaaaataaaataaaaaagaatgagtagaagcaaatttgttctccaaaagtcaaatctcttgaggagattgatgagagaatccaaaaagaggggcctaggaagacagtaactatgtgctcaagtccccattcattctgactcactgtaatggaggagttttagtcactggaagtacattcggaaacaccctcaggtccagtaagaaaatagtaataataccgtctgccttggagaagttggggttttgtaaattcatcactgttgattgtcaagaaccaccatggcagaagtgcccaactcaaacaagctagagttttgcttagtagagaatctgcttcctgtagcggggtttattggcttcctaatccaaggcattcaagaaggaaaagagccaggtacaaagtcagccaaatagaaggtgatgctgtttcctggttggagagggattaatttaatatgatgacatagacagtaaaagtctattgtggagtaacttatttcacctttgttacctaaaaatttgtccataaaccctttgtggcccacatttttctctacaagttttcaggttcttatgctatatcctagtccctaacttggtccatagtagtccaacaaatacacttcactggccactacctttgagatggacttctcaaatccaggtagaagctactgttctctgcttatctcaaacttcagtgtagccttttcctgtagtatgtttgcattcataagtaaaatgaaaagatgaggggaatctgaaaatttaggtagactgacaggattgcaatctagcctgctgcccagtgaaccccatatgctccccagtgaaccccatatgctcccccaactcttctaaaagacttaccctataaccataatctataaatcttagacaagccaggaacatatctgtcttccccaggctttggtatagaagaattgatcacttgactgatacttcattcattacatgctgtgagagaaattaaaaaacatctgcaacattttaaaataaataacctggtaagtttagtataaaaacatatcaagctgaacacataagctgaacagtggggggaaaacactaagctatcttaataggtagacttagtcctagcacttagggatagttaagtgacctgcagaaagccccttcaatgctaaccagttcatactgctacatcttcagctctcccaaaatgttctgccttaagtgagacctgacttgcttctgctgagagggcttcctgtatagctgctggagtagagagcccctcttcctaagccaggtgtctagtgtctggtggtcagctgtctccaaataccctaacgctttccagagatactctttcgccaccctcttgtgaagagctcccctatcctctataaggctcattccatacagcgctgcaattttccatgtgtcctagttactgtcttccaccaacttgtattttgagggccagtgaggaagaggggggaagatggagtggtgtggtaagtagctgattagttttccacaatcagtctagttcctagttcagagtcttctccttctggttgactgtccaacttcctgtcctcttgttttcttggccacttcaactctagctacctccatttgccttctacttcactatggccacaccctaggctgtattgcctctctacccatcagaatctcccactgattagatagatgggtggatgaaatcatccagaagcacttcatatcaaaaatcataaactcccaatattctgaccacagcctttcaaccttctgattttctaactatgcctatttttcagtctttttctcctccactagaccactctattttcttcccattgttatctaaggtatctcttaatccttagttctactgtgcctgcataggaaataaaaaatagtcctagatgaatctgtaagcattgccctctcctatccccagccctagaagaaattagggctggggataggagagggcaatgctgacagattagggcattgctagaagaaattatacagttgctataggttagcatctacctgggtatagatgtgggtccatcaacattgcaggcaaactagtcctcacaagagctatttacaagagcttaccattctccctaccccaccacttcccagctacttaacagagaaaacagatgccatcagacaggaacttccttaacttcttgtgctctctccttgccacctgcaaacttatctgcatccttcctttccttccggcttcctgtctcaggggattgggcaggattcctttgcttcaagactagttcttccacctacttccttcaggatctccctccctcctgactcttctgggaccctgcccctcccaatgtcctctctcttcctcctgcatctcttccagcagtattcacacagatcataaacatgctcaagccttttttttttaataattttttttaaataggcaccatgttccttcttcccttcccgtcatgacatgcagcctgcgtgaaatgtctgtcttccctcattgcctctgcttcctcacatcctcattgctcaactgaagtttttcccctttaggtcactagtgcccagccaggggctaaagccactagacattttaaaaacctttccatacttgactgccctatagcatagagcactattaataacacttcttgaaaatcccacactccttggcctgacgatgtgctcctgagtttcatccttcctcctctttgaggactcatttctctttatggataccttaaatgttgatgttaccaggggtttagcccttggctaccatctgtgtcttatactctctagatccatctcatccatttgggcaggtaagctatgctgttaactgccagatatgtttttctagtgcaaaacttttaccagcctactgaacatcttcagttggtcttcccaaagacactgcacactcagcatatccaaaactgagcattttgtcttgtctccatccactcctgccatgaagagaaaccttgtcacaggcttctcttgtcacatttacccaccatgtctaaatagttggttgcatgactggtcagttccacctcctcgataatactttaatccaaggaatttaaaccagaggtgagtattagaaccacctgagatttttcttattcaagagatttgggggtaatcccaaggcttttatgtattgaaaaattccctactccagacatacttaactatgtatagttgcctcaatatgcccgtacttttttttagcagttattttaaagatattttaaatttatagaagagttgcaaaaatagtacaggaaattcccatataaccttcatccaacttctccttatgttaacctcttatataagctatagtatatttatcaaaactaaattaatctgggtacaattctgttaacatggaatttatttggatttcacaataacttttcccacgaatgtcattttttctgttccaggatccattccaagatcccacattgcgttgaatggtcgtgtccccatagtctcatacgtgtgtttttattccccggtgcctttaagtgtattgtttcttccctcccttgacttttcctcccttgcctgcttgatgacccttttatcctttacaactgaggtcaaatagtcctttgacctcagatcaaagaccatccttttcgataaggtcttccttcccttccccagcagaactggtttctagtggtctttatcccagtgttgtaatcggtattaacagataagtgtggagatcagacatgcagtgccctcaagggcagagactgtgttcatttccttgttacattcttaatgctaaactggaaggctgacaaatatttggaatttaataaatttttaataatgacataaaggatgactactcattttgaaaaagttccccaaagaaaggtattttcctccaaaaactatttaaatctggtttttattaactggtaatacagagtttcaactggattgtctaccatactgtatttttttaatgtgattacctacttttcacaagttacagaccccttaatttgactaattccatgaattcctgtgccagtttttaaattagtaaattgtagatgtggatctctcaatcatatatcttgtataactcaaatatcacacttctggaacactgtccgggactgaccactgacattctctttcacatatctaagacagtagtcaaaaagtagcctagaacataatgcagtattcattgctgtaccaactgatttttattccagagaaagaaatacactgtgagccaaactatatgatctcaaagaagatgagactactactgctgctgctgctgctgcaaagcctgcattttaataattctgtaagagtctgagggagcacatctctctggccagatctgatttcagactccaagtatagtaaagcaaggatggttctcatctctctcctctctaatttgtaaattatctccatgccattttaagataacttgcacagattccaacatagcaaatgcagagaactatccttcactattacagtgacatcgttttgttcccccagtccagtagcagcttcaagaagccggggtcacattgccttgtttcccctggaaaaaacaaatggcttcattaattcttccctcatccatctgccagcatacatctgccataacactggtaacactttagctgtgcttgtgtcttccacaagaaaacgagttctctagtagagaagacagtgtcttcttactctcatatccacattgccatgctccatgccttcactgggtttggtagaaaaaatattctctatgtgaaagcctaaactgtggttttacaagtattcctcagaatgcaaatgatccgtatttaaccaccccatccaggttaggagtatagctggattttaccatggtaacaaagccatctctcaattacatgcagcacaagaatctcacatctgcagtttggtgctgttgagcctgtattgctcagatttttaggcatttaagcacccaaccactattctgttgcacttaatatttccaattaaagcacaggcagtgccaaaccatacttttccagcctcatttctatgacttcattgactcttagcctttcacctaatgggaagactgtttattcccatttgttttctccagtccatactctagttcaaaatctcactcacagtagacccttttcccacctggggaatttactgactccctggctggttctagtattaggaaactggataaccttttggcttaaactctaggcaacagctgtttctgccttacaagtctaccttctagaacctcatttgtattattcactgctcttgaacccatttcttccctatcccttgtcgttgaatgaaagagtgaatgatttctagcacatttgttgtgttcctaagctcctgtgttatgccccatctgctcccacctgcccttcctccctaccttatccaggttgcatgatcccttttgctccctgcatgatttgaagacataaactagccatttcattataagattcgtgagcttattgcatttgaaattatttcagctccatataccactctgagccctctctcagggtgtctcccacaaagatacctttcttttgaaaagctaaccatttttggtctttcctagcgatacctaccatgcagtattttatctataaattaaaaatgtttgaattaattacttgaattcaaaacttggctaaaacaacagtagagggaggcaatgttatatggtagttgtgaatacaaattttggttcaaattctgactgtgatactttctaatattgtgacattgggcaaatcacataagctccttacgttacaatatcttgcctcaaggattgtgtgagaagagaatatacacgcagtgcagagcagtgcctgtcacacagtaagcactcataaaaggtagttgcttggattgccttaaaaatctccagtatttgtatggtatattaagggtgcgtgctgaaaacctcaaggaacaataaaagatatgctatattttctgtgtgatagcttaagtttttcagaaatagattaaaacctaaccccctatctagtgtaatcctactggataaaaaaatcagatttgaacctctggtaaatatataaaagggttcatagagaccaaagagtagttacatgtttttcttcactgaattgatgggcggaattctctcctgctacccccatctctcttacacacaccccagtgttcttgctgaaagctcttgaaataacttttatgtccagagtattgttcatatttattatattttatacttgagcaagggtgatagagtttagctgtaagaagctatcaagatgtcataactcagacagactcagatgctgaggtcttggaccctccaggctgggggagaagtgagaatgaaggcttggtggaactgacctgaccacatcaccttttcctggcccatggaaaagcagccaagtcttctattcatagatacacactaaggatacagcacagccatcacaccctcactcatacaagtggtccatcccatggcaaccagttgagctacatgggatatcaagcaggaattccaagaggctgcagaagtgctgcagagatggcaggcagttagggggaggagagttaataagagatatgtttacaggggcagaatttctgtgaacagatggatcatactagaccagggcaggctccaaatcctgaggaggaggcctggaaatagcaggacagagtgtctgggctgggtttggcatgagacttagtcacactaggaagtggtggttagacatatggaacccaaatcaggatagagatgagagatcaaaggatgtttccaacactatagaccagatagggtgaatgtggggtgctgccctcatgctttgacttgccagggatgagattgaggggagggggtcagtgatctagggttccagaacattactttgcctaaacacttttcctgaagaaagcatttgaagtattcactttataattattctttaaaccatatatgtatgttttatgcattcttctgtctatatgaattactttgcagtagtaaaagcaatgatttggagttgtaatattaaaagagaagtatagaggctgtttattatgtttgtattggtgtttctgttactggacaggtgtattagaacatcttgtcatattctgattctgtttctctaaacttgttagagaggtctttcctaaatatttattattaaaaatgtagccaggcatggtggctcacgcctgtaatcccagcactttcggaggctgaggcaggcggatcacctgaggtcaggagttcgagaccagcctcaacatggagcaatcccgtttctactaaacatacaaaattagctgggcatggtggtgcatgcatgtaattccagctacttgggaggctgaggcaggagaattgcttgaacccgggaggcagaggttgtggtgagccgagatcacaccattgcactccagcctgggtgacaagagcgaaactcagtctcaaaaaaagtaaaaaaaaattgtgagtcacacataatagtctagaacactaaagggattctatgcttaaactcctacctgttactagggcagtagccttgaaaatatttgaacaaattcgaaagaataaagttaatacaggtttttaaatgtataatcagaatcatctgagcgtaccagctgtatatctgttacaattttttcctcaaaattttaatttaaaatcacctttattattacagcattaaaatcagtatacagataaaccaaaataaaataaaatgccatattctcattacccaggtgatgttaactattagctccttagtgtatatcatccagatattctgtgtggatttttttacccaaatgatattataatacactatacaatttttctcatttttaatttttgtgggtacatagtaggtgattatatttatggggtatatgagatattttggtataagcatgcaatgcataataatcacatcatggaaaattgggtatccatctcctcaagcatttatcccttgtattacaaacaatccaattatacattttagttatttttaaatgtacaattaaattattgttaactatagtcaccctgttgtgttatcaaatactaggtcttactctttctgtcttctttgtacccattaaccatccccacctccctgtcatctcccactacccttcccagccactggtaaccatcccctactctccatctccatgagttcagttgttttggtttttagatcccacaaaaaaagtgagaacatgcaatgtttgtcttttggtgcctggcttatttcacttaacataatgacctccagttccattcatgttgttgcaaatgacaggatctcattcttttttatggctgaatagtactccactgtatccatgtaccacattttctttatccattcatctgttgatggacacttaggttgcttccaagtcttagctattgtgaacagtgctacacaacaaacatggaagtgcagatgtctctttgatatattgatttcctttcttttcaatatatatccagtagggggatggccaaatcacatggtagctctctttatagttgtttgaggaacctccaaactcttctccatagtggttatactaattgacattcccatcaaaagtgtatgagggttcccttttctccacatcttcaccagcatttgttactgcctgtcttttggataaaagccattttacctggggtgagatgatatctcgttgtagttttgatttgcatttctctgatgatcagtgatgttgagcacctttttatatgcctgtttgccatgtgtgtatctccttttgagaaatgtctattcaaatattttgtccatttctcaatcggattattagatttttccctagagagttgtttgagctctttatatattctgttattaatccctcatcaaataggtagtttgcaagtattttctcccattatgtgggttgtctcttcactttggtgattatttcctttgctgtgcagctttttgacttgatgtgatcccatttatccatttttgcctttgttgcctctgctcgtggggatgctcaagaaatttttgcccagaccgctgtcctggagagtttctctgatgttttcttacagtagtttcatagtttgaggtcttagatttaatttttaatccattttgatttgatttttgtatatagtgagagataggagcaagttagcaagtttcattcttctgcatatggatatccagttttcccagcaccgtttattgaagagactcttttcctcaatgtatattcttggcacctttgtcgaaaaagagttcactggaggtgtgtggatttgtttctgggttctctgttctgttccattggtctttgtgtctgcttttatttcagtaccatgctgttttggttactatagctctgtagtagaattcaaagtaacgtaatgtgattcctccagttttgttctttttgattggttcatcatttagtctttctgcttaagtaaagagtattttacacaccacaattacggcattatactattctgtgtttttctgtgtgtttactattaccagtgagttttgtaccttcagatgatttcttcttcctcattagcatccttttctttcggattgaagagctccctttagcatttcttgaaggacaagtctggtgttgatgaaatccctcagcttttgttagtctgagaagatttttatttctccttcatgcctgaaggatatttttcccctggatatactattctagggtaaaggttttgttttgtttgtttttctttcccctttagcactttaaaggtgtcatgccacactctctttgcctgtaagatttccaccgaatagtctgctgccagatgtattggagctccattgtgttacttgtttcttttcttttgctgcttttaggatcctttcttcatccttgacctttcggagtttgattattaaatgctttgaggtagtcttctttgggttaaatctgcttggtgttctgtaaccttcttgtacttgaatgctgatatctttctctaggtttgggaatttctctgttattatcccttcaaagaaactttctagcactatctctttctctacctcctctttaagaccaataactcttagatttgcacttttgaagctattttctagatattgtagaagtgcgtcattgttttctattcttttttcttttgtctcctctgactgtgtattttcaaatagcctgtcttcaagcttcccaattctttcttctgctttatcaattctgctattaagagactctgatgcattcgtcagcatgtcagttgcatttttcaactctagaatttctgcttctttttaattatttcaatctctttgttaaatttatctcatagaattctgaattccttctctgtattatcttgaatttctcggagtttcctcaaaacagctattttgaattatctgtttgagcttgtggtgaatgctgccagacctgggacttaccctgctcccctctcatccagggcaggtccagaaatgctgtccaagagcctaggcctgtactgggggaccccaagagcctacttggtgctctaccccactgtgactgagctggtacctaaggtacaaggcaaagccccctttgcttttccctctgcttctctcaaacagaaggagtctttcactgtaatcatcacagctgggaatgtgctgggtcacacatgaagccaggacgtctcagagcccaagccctgcagcatactccctgggtaacactgctggttatttagggcccaaggggtctttagttagcaagggatgaatcctgccaggattgagtccttcccttcaaggaagttggctcccttttggcccaggatgggtgtagaaatgtcatctaagcctagaatggaggcctcatgactctgcccagtgccctatcttactgtggctgagctggtaaccaggatgcaaaacaaagtcctctttacttttcactcttctctcctcaagcagaaagaaggagtcacttttgttgctgcaagctgcactgcctggggttgggggagggattgtgccagatttactattcccttactcaccccagcaggtgtctccctaggtcacatgctacccttgtccatggactctaagcccagcctagcactaggagttgtctaggaattactgtccttgtctcctagactgccttttaagtttacctaggacccagagcacttcagcccatggtagcaaggcttgccaagaaactcaagttccagctgctgagatggtgagtctcttctggctagggctggtctcaatgctccctccttgcatggccactgtgagcccagaacagctttattttctactcaatggcagggcagcagtgagttcaatgtaaagtccccaagtcactgcattatcctacaaacttgcacagattctttctccatgctgcatagctactgccgggggatgggggaggggtgggagatgggagaggacgttggagattcagaactgtctcttctgccctcctcaatacctttttcagggatatgaagttaaaaccaggtactgtgattgctcacctgatttttggttcttgtgatagtgcttttctttgtgcagattgttgtgaaaatttggtgttctggggttggcgcaggagaatgagcagtgtaggcttctattccatcatcttggtctgcttcatatttatttttaatccaccaattttcagttaatgattttctgatcactacgttttttatctcatgtggaatttagtcaatgtacagatttttaaaaagtcggacacatcagcaggtttgttcaaatctgggaccatatgttgcatctggctatctatttcttaagtgttgtttaatctagaacaatcccttttttggcaacactgacttaaagagataagaccaggcatcttacagcaaacccccatcttttggattctctggtttcttccctgtagtgttgctcaacatgttgctctatctcttgtgtttcctgtgatatggaagttgaatctagatgtgatggactggggttcagcacttttggtaagaatgcattgtagatgatgatacgtgtctttgcattgccctgcattggtgtaatgacagctcgattcccccacatgcagttatatttgtcttcttgccagtaggaagtaatctgtatgtcgctacattggcatcatatgaacatccgattcctcttcaacaattctgctggttttagcactaagcaacaatccttgactaaaataattacagtagggatatgaaattatattttctaagtctgtaattgcttttacatgtgttagctggcgttttctatgaaagtagagatttccctcacatagtaggactctcaaattataatacctgaaatatcttctcttttaattgccagttttcaaagtaagggagtgtttaacagctgcctcagatgagatgttggaagaatttaagtgtttttgaaaaaaatactatggtcactgcaaatatgatttattgatcattttcaaggtatcaggactgtgttaaaggctttatataacctaattcttatgacaacacaatgagattttagagaagataacggaaacagtgtgtagttaaataatttgatttgatatggtcactcacatgggaagttacaaagctgggatgcaaactcaaattaatcttagtccaaaaatctatgcttaattattttatacagtttttttgcattttatttaaaaaccaaattctacttgtaatactgtttggaatgtttcccagtttataaacactagtaatataaattatgcttaataattcttatgagatctcttccccttcccttatgtttttttaaatatttttaacagtgtgaagaaaacacaaatcttcaggatactacccgctacctcaaacttcccttttccaagggcattttccttgggaataataatcaagccatgaaggccacaaaggagtccttttgtattacatcttttctctgttccacaaaactcacacaaaatggtaatgtataatgttttatttgaaagccctagtacctaataatcatgtatattttggtaagcatattcagtaaacaccaaagtgatagttaagaactttagaaaaattattgatccttccatttgtgatttctagtaaaatggaagcaaatgtgacccagtgacctgttgaatgcatgtcatttaagaaggacttcagaattatcccagtattgaaaaacaagtacacaactttttaaataaaccatcaaaacccagatgctttgaaaaaaaaaaaaaaaacgaaaataccaacaccttaatctcgtgttttatagctccataaacagtgctaattgcaggctttagaataaaggctgttttttgtttaattagatgcatattgcttttcagttctagcattactttttatgtcagtgattgtttagcaagttatgattaataaagcaagctcttctccttggcaaattgctatgaaaacatcttctgtaatgaaggaagtaaattaaacatttttgagttttttatcgttgtcatataagacttctggctagcaccccgaatgctatattaaataagttatattcattatgttgagaagaatcactttataatgaggtattgtgtctcataaaaacctgtgcctaaacaggtgtgcttgttattcgttctttcttagttccttcttctgtgtcagagaacagcatttgtagaaggaaatatttcttcttttagatcatagtctcagaaaaaaagaaaatgtaacatcaaaattttgaccacttttaaaacacctctcaatttcaacatgcattgctactgtatttatataggacaccaagttaagatatgttataccaggttttatcagcattcagtagttaattttacttaaataaaacctccattggcataactcaataaatgattataaagcatttaccaaacctcaagtatttttttatggggccagtttacccccatagaagttatgaagataataaaatcaacctcttattgagatccttaaacagaaatttttatttattctatgtggattaggtgtgtgtgggtagtagagtttgcattcatgtttaactgaatttccccaatagaatattttggggttgtattacttatttattgcagctgtaacagctaccacaaacttactggcttaaaacaatacagatttattatattgcagttctggaggtcaaatatacaaaatcagttccactgggctaaaatcaaggtgccagcagggctgcattccccctggaatggagagaatccattttcttacccttcctagctttagaagccacctgcattccttggcctatggccccttcctccatcttcaaagtcagaagcatagcatcttcacatctctctgactatgaccatcttacatcttttaaggatgcttgtgattacattgagctggataatccagtgtaatctccctattttaagatctttaatcagatctgtacagtcttcttttgctgtgtgagggaaacataatccctcctaattcttggaacaggttcttgaggccattattctgcctaccacacaggtaaacctaacaatagattctcttccatcaaaatatttggtcctatgtactgaatttgtgctagttgtagagtttaggatgttagacacaattatgaaaataagacagaaacaaatcctgaaaattagaagttgctactttttaaaagtagagaacattttcaggtaaatatgagtaaaaaacaacttatgaaataattatattaaacatctcactatgtggaaagtgggatcggaattccatgcaatgattggctcatctttggagacggataagtgtttcattattattttggctttgattaaccttgtcaatgagaattggctcaaatgagccaggaaatgcatgtttcaagagatgggaaggaggaaggaagttagttggtctttctgaaatttacatgctaaacacacatctttgtgtcgaagtaatctagttccaaattggaattaaattgctatgtattcatttttcttgacgtggaaaatatacaaatcttatttctactacaattcagcatttactaagtgatatggtctctaggagcagtttcatagagcaaatttgcatttcagaattcccaaagtgtgtctgtctgcacacgctttgcgttgtccaacatggacagtgtaccaaggtcagagcactatgctgggcacctgtgactgccagaacaggtagagattttaaggttcagaggattaggggtcatggcatcctcctattttatagctcttgataggttaggtacataatatacacctagtaaatgcctgttgaatggaatgtagaaattggtattttctgtgataggttatagctcctaatttgcaactaacatcctcagatggcaaaagtaaaaagctaggatacagcaattttgcctgaacttgaagtattttgcatacatgattaattacatccagatggacataactactgggcttttccacatgctccatcatgagcagtgtagagattcatcagccttcttgcagggaggatgggcaggctcatcctgactcattttctggacccctgtaatctgttttccagccctacttaaatgggccctagtcctcattctccactgctgccacttggtagccagcatagccacctccttcctccccacactcctcacattgagcagggtcctgatggcccctgcaactgcctcactttaaaggaagggaaagagaacacaaaggaggagtgagagctgggatgggggtggagtgggaagtgaggagtgaatggcaggggaaatgcacgagggattatgaaagagaagatgccagggaggggaggcctcctgaagtgagatgcaggaagtaggaagtaggtaggagggaagcagcaaactggggagaacaatagagctttgcctttgtcgccctgagtctcactctgtggaaatatctgatatgccaaatataaccaatcagttttaaaaggtttcagtcataccccaggatgtctgaattacatctgaatagtcaacattttcagggtttttggttatgaaaacatcataaatctctttttcaaagtcagtatttttaaaatcactttatttttctcattctaattcctcctcctcctcttacccgtgtttgttgcagataaacattcctgtttggtactgaattccttactattaatagtaaatcctttgtgaggtttttctcttgaatctggctttggtggagcttgcttctctttctccttgagattcttaatgctttttctcactggtgttctctatattctctttttctttctcatcttacctacttccttggtttggggggtttggagtttttgttccctcatcatctttctgtttctcagaaagtcccttttgggtttctgctaaaacaagtgatttgaagtaaatttcctgcttccctgcctggaaattctgtcctggctcctctctcggccagtctagtctggcaactccactgagccctgaggccagttctaccaggtcccgctgccctgcgcgtgctcggcacacgcgagccttcagttctcactgcattcattggcctccagatgccacctctccctgcatgcgttggagactaataatgcatggagaccatctcccacagcctttgtaacttctgcccaagaaagataaatttattccctccccaggtgaagaggttctctaaggacctgctggaccaaagccctcatgtctgtttaggaaagggttaaagagctgggccctgtgcttatctggactctgggatgaaagatggcctgtggagtccaggagctgctcttctcaggttgagagctccctggatgatctaagaaatcactgggcctgttaccattcttttagtctgcaagatttgggtcacattgccaagaagacctttgttcctgggtggagttggttgctaggcagagtgctatgtgctgggcacccaaacgggaataaagcaggttcccagccctcaagaaactctcatctttccaggaggaggcagaaaaattaatcaacaaatatttgtcacctgcctgatttgtaaggatttgtaagtgctactgtgatgtggaagcatgtagaagggacagttagctcgagatttcaggaaaggcttccaaaatgaagcaacatccgatctgaggactaaaggatgggtaggagtttgtaagtcaagagcagtggagaggaaacagaatacagtgaaataaatgccatcctagagagggctagtcatagtttgtgggagcctgcaacttgagtggctaggagaggggagccacatgtgttaagaattttacttttactagcagaacgctttcatgtgaggacctgttctctattaaggcaattaatcttccttttctattttgaaaggtgatatgcttgatcttttgaaatggagaacccacccagacaagatcactggctgtctctctaaattaaaagaaattgatggctcagagatagtaaaggtatatagtatttcattactattttccttgcagagattcatagaataaagaacatttggaggaaaaagacagatagtatcttatttactcatttgctacttctttatctaacagtttctgcaggatacactggataccttatttggaattttagatgaaaattcccaaaaatatgggtctaaagtgtttgattctttggtaagttcaaattcccttaattgtattttaactgttttgtctctcaatcttgactttcatgaggctggttcagaaacatgtgcttaataatgtaagagttcattttaaaaagaagcaaaaaaaaaaggaaaaccttgatttgcatttagttttataaagctcaattttctttttttaggttcacataataaatttgctgcaagatagcaaatttcatcattttaaacctgtaatggacacttacattgagagtcattttgctggggcacttgcatacaggtaaggccctgtatcttgtaattagtttagaagtggttcctttcaagcttttctcagcagaagaggcgatataggaaaatttaaaagggagtgtaggaagaaatggagcactactgaagtgtctcttgagatagtctcttccctgctaacacaccctttttaaatgggtagaacttattttgattaaaaagggaaaaaaacctcctgaattctattcctgagccctaaaatataaagtctttccttcttgtctctgtttcactggatattctttggtctaaaatgtctggttatctcacttcggctgttaagagtcccacttcatcactgtactccctgatgattataaatgttcataagaaagaaatatgaatggaaaacaaccttttccttcacacctgctgaaagtcatccattcatttatgttaggatttactgagtgccagctgcttgccaggcactgtactttatgctgatgatgtgaagacctggtccctggcctcaggcaatttagtcattgggatctactctttgataggagctgctattttaactgctcctccttttctactggctcaggtggtgctgaaaagttatgaataatattatgctttggctagtgcctgcctcctctcaacatagttgataattgccagaggccacagcttctctcttttagttcgacaaataactgcttaaatagccttggagtgtaccccatcgtctgtctcccagtccaatatggtccttgctgttctcccatatttctaccttataccttaagcacctgtgggcatgcacatgcctgactgttccctgaggtgagtttaaaaagcatgaaatcaggttgatatccttcccccatctatgtaatatataaaggttaataggttatcagataagcatttgatcctgtttacttggatattcccagccatgacaggttaagatcgacgtctccaacatcgaaatgaatgaaggtatttttgttagacttgacacttcatcagtgtgattttttgctgagagtgaaatgcaaccgcaggaatagttttgaaacatcggcccactcagcctaacaatttgggccctagtgtgaggaggttactgcttccaagttaaattgtctttggaagctagaaaacaagagtataatttctcacacttccggttggccaggaaagcaggatcttaaaaagacaaataaggcttgtggaatcctcttaggctgggggtgatcagaaactcactagcatgttatcttaaaaaatagcactccaccaacatctacctactggcacatccaagtattctcccctgacccagagaaacattgctgggtaaactgtttcctagaaaccaagaactggctgggcacagtggctcatgcctgtaatcccagcactttgggaggccaaggtggacagatcatttgaggtcaggagttcaagaccagcctgaccaacatggtgaaaccgggcctctactaaaaatacaaaaattagctgggcgtggtggtgcatacttgaatcccagctgcttgggaggctgaggcagaagaatctgcttgaacccaggagggcggcagaggttgcggtgagccaagccactgcacaccagcctgggtgacaaagcaagactctgtctcaaaaaaaaaaaaaaaaaagaaaagaaaaagaaaaaagagaaaccaagaactgaccaaagttcaaggtgtaagactgtcatcttgagagttgtgggctgttgtttttacattttttcaaaacaggaaaaaaaattaccttggcctttctagaaattctcctaaggcacatattgacataagccaggttcttctcatgggtcagaaaattggcttgataaatccataaggtgtgcatagcagtggggaggcattgtctccatccctccttcccaccccgttttgcctgcagcctaatgatattgcatccagctgtttacgtggtcactgggaaagaaatcccaatgagcagttttacagtattgaccatggcactcacactgccaggcacttggttgggcacagtccttttctccaatatttgtgttcacccatttggaggcattaccagaaacagcagggctatggaatatgtccagattgagtgttgtttctcccttaagctttgaaaagggtggcagtgttgatctgcagatttagtaaaattattatacagcagattgacaggaaaatgtgagaactgatgggaaaagaaacctcctcatgatatagttaagagttggatttgttggcatttaattgagaattagaccaattttacattctgcacattttcccctgtattttagagatctcatcaaagtgctcaaatggtacgtggaccggatcacagaagcagagcggcaagagcatatccaggaggtgctgaaggtgataacatgctgttgataacagcagagtctaacaaagctgttgcatgctgatgcttaaactaattggttcctctacacagacagtaatgggtgatgatgtattactgacattccaattcaaggatcttaatcagtttgtgactgcttgagagctgatgaaatttgaaggggactttgccagggtagtctactggaaactgttcaggattgaatccttgttcctctgggctggagagtacttgaagtgaagtctaagatgagcaggagagagggagggtttatgagagaagtctatatggggcagttaagcttagaagttcctggctcttgcttccaccaacctgacagagaccatcggagaaccatttatgttaaattttaagagcaaatagggtggcttagcggggattataatgaggaaacctgaggctttaccgggtcttgtggcttaacgctgcccacatcgctgggcaccatatgctcagttgtctgtggagatactaatcccttacttgcaaacatgttgaaaaagagtacaaattcttaaaggaattgtccagtaacagccctggtagtcttctgattcctgttgttgaggaccatcctatttggtgtcagtagctttaagtagacaatgtatacattttataaaatagcattttgtgaattattcatttgtaatttgggctgattgaaggtaaaatgctaagtggcaagagtactacctgtcaaaacaaaattattttttaaaaaacagttatctttttgttgactaaatttaaaaaacatctgagggtcaaaaacacttagtgttcatcatactccagaatgataaaatttttttttttttaattttttttttagacggaattttgctcttgttggccaggctggagggcaatggtgcattctctgctcactgcaacctccgcctgccaggttcaagcaattctcctgcctcagcctcccaagtagctgggattacaggcatgggccaccatgcctggccagttttgtatttttggtagagatgtggtttctccatgttggtcaggctggtctcgagctcctgacttcaggtgatccacccgcctcggcctcccaaagtgctgggattacaggcgtgagccaccgtgcccggctaaagtgtttttaaattttctattaaaattctatttcttttaaatttcttttaaatttaaagtgtttttaaattttttttctctcattaggcatcagagaaaagtggctgttcccccttaaagtaaatactgttcaaaaaagcctcacaaggccttggtgtctacatgaataatgtaaaagtttaatgccataccatggtttttatgccgtgtcattgctaaataaatactctttgtctcctttgaagctaacttttaaaaattgtatttttaaggcacaagaatacatttttaagtatatagttcaatctcgaaggctgttttcccttgccactggtgggcaaaacgaagaggagttccgctgctgcattcaggagcttctcatgtcagtccgtttctttctttcgcaagagagcaaagggtctggagcattatctcagtcacaggtaatttcttttcatctatgctgaatagaagaaaacgataagtgcagtttatttatttttacacagcagcgtaatcaaatgttttctccatcagaagtcaattgctccagtttatatttgtagcttaaccaactttatgagtagacttttaaaattcccctaccttctgtgtaccagctgagcagaagtgggttgcctttcccttctctctctgcatggagaggctattggtttgcatcagcttcatttccggttaccagaacacatactgacgactggacatgctgtcaccaccagccctggggaaggaatttcactagggccaatctcttgcagttcttttccccaagcttctcactgcattttaatctgtcaacttgagaatcattatattggactcagctaagctgcatgttgttttgttttattgaacttgaccctaatcatcctgggactgatcttttaagaccagtgcagagctgctgctgccgccaaactccattaccggaagtagccccacatgttttttttaagaacaggatccatctacttcccaaatagcatggccttgaatatgttccatgaggtaattctgaatattttccctatactttcttgattcttcttgtatacttttaattctaatgacttggttaaaaacctgtcagaaggagaagcagcctcttaccatgccctagaggttagagaaacttgtaatcattgagaactgggacataaaaagggagattaggagacaaaattagatccttaacagtattgttatgatttggtactatgtgatgttcagaaagcaaaacaccgggaatgcaccagccctctgataatgtgctgtattttttctgactgttgagaggtctattcttgttcctctcttctttatagaggtggactcatcttccatctgggcaaggatataactcaggctcttttaaatgtcattttggcctttgcagtcaagagtacaatcactgcactatgggaacttgccagagacctcagtgtcaagttgcccactactagctaaaccctgctgacagcacttgatatttgagcaggataatccaccaggctaaccatgcattccttcagatcagagttcttagaagtttactgtctctacaaaagtaattcagaatttgagttttcgtcctgagatttttctttttaccctttatcagttacagagatgaaacttgcctaattcacacctgaaaaatattttcttactcttaagagtaaccgtaaggcatggtttcttcttagggattcaggagacttttttttttaccttagttgtaccactggatcctggaggtccccctaaggtggcttgggccaccggggtacagcagagtggagcagctctgctctcacctcttcaacacactgactcccactgctcttgattctctgagctctatcccacagcaaattttagaaacaactttagcaccttcaaagaatcatatttgatattttttgctctcagcttttaatcaagagataatatgtaaatgtgtccataaggtttctgaatatctttgtaaactctactgaagtcattctgttattttgtgcagtatcacttacctatatattttgatgtgataattgatgtttcttttgatgctaagaaaaaatccatataaaatgataaaatggttagttttctttattaagcaatgagaactttgcctctgtgtatttggggaagacaagaaatgccacacacctctgcctgtaccaggttcccttttgatcccatgctctctttgcagaggcagtaccactaattcaatggatccgatgtgttagttttctattgctgtgtaacaaatgaccataagcttaatggctttaaacaacactcatttattagcccacagttctataggtcagaattccaggcaggcttggttgggtcctttccttaggatctcctaaagccaaaatcaaagtgtaagctttcatgtgttatctggaggtctggaaatgaatttgctttcatgatcttttaatgctattggcagaaatgtttctttgttttcagaagactaatgtctgcatttccttgatggcagtcagccggtggggggaggtgctgtcagctgccagaggccacttgcagtccttggcacatggctgctccttcctcaaatccagcaacaatatgtcagatcctcctcatgctttgaatctctctgactacttctcctgctaccagccagagaaaactgttttaagagctcatgtgattgggtgaggcccacctggataaatctccatattttaaggtcaactgatgagtaatcttaattacatctgcaaaatctcttttgtcatgtgacattatgtaatcacaggaacaccaccagggaacagggtcatgggagtcgtcttagagtcctgcctgccacatttacagccaaataaaatttggctctgaatttgtccaagctttactattaggctgccttataggcagaaacctggttttcttgctccattttgcattttttccatgtgggctacaactcagggcaaaccctgtcttctagaggccatcaccacagtcctttgggttggattgatgggaagctgccccacagatgtatgcatcctggtcctactgggtaggttcatttagtcctcctgccccaaatgcaacttgctaatgactgttcttgttagccctgtcctggaaggactaagggctaacccacctggtacagcagtggttcttagctttctatttcatggacacacacctgctaacccatgatccctaaaagaagaagaatgtcagaaggaatagaggccccaaaccctgctagacaattcccaatagttatctttccctgtgtgtcctggctactaggaaggtcaaaactaaattgtacttttattttcacttgcagtaaaaactctcagcttgccctggcacagccgtcttcctcccctcatcacaagatacttgttctttatcctttttaatcatcctattatatgtgtatcttacactgtaggcacattcagatgcctttttgaagtcaagacatataaataaagaaataatggataaattaagggatacctgaggaaaatcaacttagttgacttttcagtaatcagaaagctgggctcattttatttaacttcatcagtatgactcagctctgcagggtgacgtgaaggttatataaatgcaggctgtaacggagaatatcaagttattaactttaaatatattcaagtaaatctataatttttaagagccaagggccattgctgttgacttatagcatctggagtattttgatggcgctggcatcaaaaacagatcttggctcttctagatatttttgctgctgctgtataaataaatactaaaattcttaaatttgagtttgagtgagtctgtgtttgaatcatcagcacatgtagacgcgacctattttctgatggagtcagatctcattggtacgccaactagcacttgaattttagcatgttagaaactcgtgcctccttccctgactaggtacagttgaagctagtcgactcttcttccattgccctccttttatggaattttaaaaggctgatttggtttgttttggtgtacaatcctagcccaattttttaagtatgccctttgagatttgatgtgagcatcttttttccccataaaaaatgatgatcgggttttttttttttttacataaaaatattgttcttagtctgtacacacagttcttggtttaaaatagatcttgaagcaacccagagggttcttgtaatgatctttttgttttacaggagatgaaactaaagcctaaatgatgaaactaaagggtgctcaaataactttccaaagtcacagagttattggaagcaaagctaatactatgtgtaacttagatcttctgatgccctgtcctgtgttttttcttaaatcagaaatggagtgctttggaggaattaatgtgtttggtttcttaaatgtgaatgagatttaagtgagcatttcagaaagcttcttccaaaaggaatgaatataactgactacaatccaggtcttggttgagcattctttctattcagttttgatgcacttcactgattctgtgaggtttttgtcaatccttttgctaatgtcagtgattttccaaaatttcccagtttttattatgctgctgcttcgtacttttcaaaaactgtcctattctgctgcactttttaaaaatttaccttttagctttaggtaacagaaacatttcatacttctattcctaccattcaaaaacacttgccacggtccttaaactcactgacgttttgcagcatatttctcatggcgtatctgggagttgatttaaatgtcttcttctttttaaggctgtgtttctgagctctttccctgccgtgtactcagaactgttgaagctctttgatgtccgggaagtagccaacttggtccaggacaccctgggcagtctgccgaccatcctgcatgtggatgattccctgcaggccatcaaactgcagtgcattggcaaaaccgtggaaagccagctttataccaacccaggtagggtgagtctcttggaggaaattgtgcctctgaaaagccattttgtatattttgtagccattggtcagcagatgcaattaaaaacaaaacactaaaaggcattttctcaaaaccattgtttatttggatggtaaatgtatttagtagtcaaatacaaaagtatggcaattaaaactttatttctggaaagaatgaaaactaatgattacattattgttttttatgtttaatgggatttaacactccttcagagatgcttacaggtacctgataggatccttatttttctcttttgtttttaaaagtttttcatcaatttatgttctgaagctatatgaaactttgcattattgttgttttttactttaccccaagagcaagtggtcagtgactcaaattaattttgttataataactgttagtaagttccattgcctcttgttttcttctgtttttttttcccgaataaataacagagtgagtactaaccttatcttaaagcttattttaagaaattttaatcagcctcccaagtaaaaaagttcttaaaatagattccattaataattattttccctgacaggcacggtggctcacacctgtaatcccagcactttgggaggccaaggcggccagatcacttgaggtcaggagttcaagaccagcctggccaacatggtgaaaccccatctctaccaaaatacaaaaaaattacccgagtgtgttgagaggtgcctgtaatcccatctactcgggaggctgaggcgggagagttgcttgaacctggaagacagaggttgcagtgagctgagatggcgccactgcactccagcctgggcaacagagcaagactctgtctcaaaaaaaaaaaaaaaaaaaaaaaaaagaatgattttcccatatgaatgtgtgtgtatgtatgatttttttgaaatagttttatatatagtaaacaattttttacatattttcttgtaaaatattttatacatacatttaaggatagagcataataatggcaaatcattaacaaatcttaacattaccacttatttgctttagctttttttgagacagagtcttgctctgttgcccaggctggagtgcagaggcatgatcttggctcactgcaacttctgcctcccaggttcaagcgattgtcctgccttagcctcctgagtagctgggattataggcacacaccaccacacccagctaatttttgtatttttagtagaggcagggtttcaccatgttgttcaggctgctgtcgaactcctgaccttgcaatccgtccaccttggcctcccaaagtgctggaattacaggcatgagtcaccgcacccggccttgctttagattttttaataagaaattcatcacagatatactcaaggtcctcctgtctaggctcccatttccttcatagaaatttccactatcagagattatggttcctattttctattcctttattacatagctttaaaaatatatagtatggttttttcttctttacaaatttttaaatcatttcatctttaaatgataacagtacattgtatgtcactctttggagtgttttttttattaatattattattattatttttttttttttttgagactgagtcttgctcagccacccaggctggagtgcagtggcatgatcttagctcactgcaactaccgtctcctgggttcagatgattctcccgtctcagcctcctgagtagctgggattataggcacccaccatcatgcctggctaatttttgtattttggtagagatggggtttcaccatgttggccaggctggtcttgaacttctgacctcaggtgatccacccacctcagcctcccaaagggctaggattacaggcgtgagccaccacacccggcctaatattatacttttatatttttccatgccactagatatagctctacttcattattttttactgttgtatgatattccactgtatgaacatatcacagttaatttattttttctcctgttgaaggacttttgagatatttcttatttttttttctgaaatagcacttcaaacaatgtaaaagaaagttcaaccttccgatttctcccaataaaaacatatcctggagaaaagatatttcttgtagtggttttccaactctgctgctcagtcctaagggttctgtgcagtgactcaggaatctctccggggttgggaacaggtactgtgcaggagatgtaggtcccaacggagcaccctgctttaactcaaacaccaaccctgctttcaccacactaggaaaagttcactcctgtctcagaggaattgctgatttctgccatatttctcccacactgaccagataattctttgttaagttaaagtcttgcactaaaagagcaagacagtcatcaaaattgttttcaaatgtaaggaaaatattataggggtttgtgttcattgcctctgagcaatgtaatctgtccttgggcccagttccttgttggttcctgatgctccatagataatagagaaatcaggactagaaagatacacagagaagaacctgctgtgatgcgggataaagaatgttgggtcccgtgggaattgatgagagtatgtactatggtaagggatggaaggactcatgagacccaagaaatgttgaccctgcagggtctgtgccagtgccctggaagagaggctcagggccagcgtagggaagctggtaattgtgaatatggtggcgtggaaaaggaagagaagaagaggaaaccctgtctgctcatgttgtgtgggaaggtcccacacatggagaatgattatggagaagcaacagtggctcacgatcaacagaatccttagcacgtgcagatgttcaacagagaaaaggcttctgtcactgccgcagcaggatgtggcttgctgcttcctaactcgtcattgaagaaaacagagactgtgatgtataagatgggctgggcagaacacatcaagaaggagcccatcttcatggggaaaactaggaagtgtccctgagagccttccagggctcagagtaccttctgtttaaattacatgtgactacacaatactgctagggaaacgtggaaagtgcttctagtgactttggcattctaaatcagaaactgtggacttaggggactgatgggcatatttatgttgtctagttgaaagaggagatgtcggaaggaaaagaagatgtgaaatgcaaacagcaggctccacagacagtgtcagagaacaggacgtgatatcttgagttgtggttaactggagagtgtgatcctcacaagggccttggtacatctcacaaaaataggctgattctgtctgactggaggggaaagaagagggacaatataaaactgtataactaaagatctataataaaagagggcccagttgtccactcaaaacaaaaggtaaaagggttaagcctaacacttctgacctttcatttaaaaaattaacacacggccgggcgcggtggctcacgcctgtaatcccagcactttgggaggccgaggcgggcggatcacgaggtcagaagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgcctcaaaaaaaaaaaaaaaaaaaaaaattaacacacacgtacacaatttttacaacagcaaaaggattttttgaggggatggggaacttggaattgaatgccctagttttatatcttattttcccagagataactgtatccaaatgacaagggatgggtaaaaaaaaattcttttattataaacataaaacaatagcatcaccaaaatatggaaataagactcattttagatacagttatgatggagtcatttcccattgctgctgtgacagtaatcgcaaacttagtggcttaaaacaacacaaacttcttatcctactggtccacagggtggaagtccaaaattgttctcaatgggctgaaattaaggtattaccagcatctctacaaaaaataaacaaaaaatagtcaggtgtggtggtgcatacctgtggtccccgctactcagcaggctgaggtgggaggatcacttgagcccagggggttgagaatacagtaagccatgatcgcaccactgcactcccacctgtctgacagatggagaccctgtctcaaaaaaaggggggagcaaagagtacagttggctcacattttaagaagatgaatttcaaaaccttttcagaccttagatgttacaagcccatcaagacatctgggaagttctaaaagttgacattttattagaatcctgtattagtcagatttctccagagaaacagaaccaatagggtgtatgtgtctatacatggaggaaggaaggaagggagggaaggaaggaagggagggaaggaaggaaaggaagggaaggaaggaggaaagacggaaggaaaggagtcataaggaaatggtttacgtgattatagaggctgagaaatctcatatctgcagtcagtacgctggagacccataagaactgatgatatagtttcagtctgagaccaaaggcctgagaagcaggagagacaatggtataagttacagttcaagtccaagtccaaatgcaagagaagaccattgtcctagctcgaagaccatcaggaagagggagcatattctccattactcagcgttttcttctattcaggccttcaacagagtggatgaggctcaccacattggggaggacagtttacttaactctgtctagcaattccagggttattctcctgcagaaacttcctcacagacacacccagaaaaatgtttaaccaactctctggacaccccatggcccagacaagttgacacattaaaattaaccatcacaaatcccaaggagaaaaaagcagaggaggcatgcaaaggaagaagcatggctgcagaatagtcatggttgagcttagagtagaaattaacacatagagaagacagaaagaaggacatatgtgaatgtcagcaccaaagaagggaatgaaatgttgtctgaaatgttgtcatgggaagattcaagccaggttgcattaagggtctctgggcagcctcacagctggacagagcaggcaggaggactgaatcacccccttagtcacacccccaaggtcaaattctagaacatctgaccaaacctaaaggacacagataacttttggaatctaaatagattggtatttaatgtctaaataatctgggatccaggtggacttatttaaagcattaaaaatcagcaactcatttttccctttctcccccagattttattcttcctatttgctgaaggccatgaatagaagagtctaaatggttttggagaagacagctttggcaatgacaaaagggtagatttgatgcagagaggttgttggggaaggaggaagtgtagcgggtagcagagacatagtttagggcgtgatagcgagaggtcaggaacagggtctgccggacttcgcgaggtcagatctgctagagctgtgggttttacattcactttgcgtttgtcaccattgcttggtacttgatgatttgtttaacagatggctggagttaatgctgagctattttcttgctaaaaaatagctatatatgtttctactttggaagaattgaacagtttatcaggcaaatcccagcacagataatagaagtaaatataaagacctaaaggcactgatcatgtaccactggtgagaagcttgctggtacgacttgcttttgcctacagactaaaaaatcaagtgttttagggtaggaatttttttaagtagtcaagagtaattgtttttctttttggcagaaactccccagtccccattaaggattttgtggattttatacaaaactgcaataaaaaattaatggaaagatagagaaaggtagactattagactatttttaaagtatactctaagaattaatgctctccaacattttaggccataatataaagaaaggatgtttgataggtttttctattaatttgataacttcaggaataaaatcttactacagttgatgagtgcctagtagcttttatttcttagaactataaagtgtagtttagtgttgggttttattgcattgcaagtgattacatttcttttattcttaaaaatgacatttgtttagaacttttctgctagccagggcttgcaaaatagagagtccttagaaagaataaagttgcagaaataagggcttcttttttctctagaagcagagtaataatgcaggaccattgcaaaaaatgtacagaccttagtttttttaaatatggaatttgtgatgatgatctaatgtaaaagtatattttcaaaaactacctgggacctcaagaaagcctttggctaaaaatcattagtgttttgttccttcagtctcaatccctttatctcacccctcctcttcccgcttacccgtattcccctctggttccctctccccaggcttttccaaagggaaaaaactctagggtgaagccctttccaggtgttcaccatcagggagctctgaaagcacttgctgaaagtttaacagtttccacagtttttcaggctcttttcttggattttatgaaagatttgcccacataatgattttgggttttctgtttttgttgttgttgttaaaggctaaacagctataaccatgtttaagtggatgttcttaaccaagaacctagaaagatgtatctttgaaaaacagtttctacatctgtctctagacagggcaaagataaaattaatagttttaggtaacacctcaccctgcacatagaacttaagatgaaaaatatacctcactgaaatcatagttgcccctaggttttaactgtgggttttgaaaacaaatgtaaactcacatattttgggagtcacaagactccctttcaacttagttctcttactatgtttctgaacttctcaatgcggattgacagtataacaagcacattactggggaaagggtgacacctgtatcatttcatttcttacacgtcactcatccacatttgcacagattttcagagggatggggagcatgtgtgtcacaggcagctgccgtggcttgcaaggtagtgggaattgctgtctccccgtgctcagagcaagcaccagcagatggagtcattgtaaaccagactgataacgggcctcctcactcttcctgtttaagctgtgtttaaacctgaagacagaaatgccaggctctatttgagtagcctgtaatatccagtagaactcatgatggagtccattcattcaacaaatatttattatggacagactccacagtattatattagaaatatattaggatggaaatactataacaaattgaaccaatagagtccctgctctctgtctgtttacagtaaagcacaaaagtagatgtcgaacaaataattataatatgataaagtacagcagcgtatgtgatggggcaagtttccagggtgccatgtagcagggaaatctgagcaaatcttggggctcattccacctgcttagcctcagttagtgccatccatgtgctgacctaactctcacatttatatttctaggccagatctctcctcggagctccaaacttgagtatccaactgtgctcttaacatctctggtggatatctcacaggctccttaaactcagcatgtctaaaatgaaaatctcaacttttttctctctgagcttagtctttcctggctcagtaggtggcagcaccatccacctagaagcctcagagtcattccttctcccttttgccctttgtctctgtctgtggccaagaaacctcacgtgcctctgtagcttctccacacccccactgcctcctctctagtccagctgcacttgctctgagctgcctctgtcttttctctccttgtttcctgtatttcctttcaccacccatctattagccaaagttaccttcagaaacataccagatgatgtcactcccagctcctactcacatcccagttctgttttattggggggcactctccagaattgatcttccatgccctgtgatgtggccccgtccacctgcctcatctcatctccttgctacttttctctgtttggaatccactttcttcagctcctgcccaacagagttaattcccatttatccttcatggtttagtctctcattttctcaagaaattttggtgccccacccactcaattatcacttttatagtacactgtgttttgcttcttgaatcacctagcacaattataatgaaatagagaattgggtatttcattgattaacgtctgtttccctcctccaccccagaagggaaaccccagaggccagggactttatttgccttgatcacaatgatatctttagcttccctaatagtgcctggtgcaaagtaggtgcttaatagatgtttcatgaacactaggtactgactgaatcatgggttagggatcgggatacagtagcaaaagctactgaatagctgggtgcggtcgctcacgcctgtaatcccagcactttgggaggccaaggcaggtggatcacctgaggtcaggagtttgagactagcctggccaacatggtggaaccctgtctctactaatgtagcaagatgagccacagacagaactcctcagacaccgagttaaagaaggaagggctttattcggctgggagcatcggcaagacccacgtctcaaaaactgagctccccgagtgagcaattcctgtccctcttgagggttacaactctaagggggtccgtgtgagagggtcgtgatcgattgagcaggcagggggctgcatgcactggtaattagaatggaacagaacaggacagggattttcacagtgcttttccatacaatgtctgtaatctatagataacataaccgattaggtcaggggttgatctttaactaccaggcccagggtgtggcaccaggctgtctgcctgtgaatttcatttctgccttttaattttcatttcttctttctttggaggcagaaattgggcataagacaatatgaggggtggtctcctcccttactaaaaatataaaaattagccaggtgcagtggactgcacctgaagccccagctagtcccgaggctgaggcaggagaatcacttgcacctgtgaggaggttgcagtgagccgagatcatgccactgcactccagcctgggcaacagagcaagactccatctaaagcaaaaaaaaaaccaaacaacaacaacaacaaaaagctactgaataaatgatgtgtatttaaaaaaatcttattggaaaagcaactttttgagctcaggatgagcatgaatatgacaataaaacagtgtgtggcagggtggctatgtaggagtcccaggccaggaggtggcgtaactaccaaaagtaagatgtacacagtacatgtgtcttgctttaggaaggatgcctgaggtggaggcattcagggtgggattaaagccagtgggtgggatctgggagcttaatacagggatcatccgtagccctccactgttgctttcctctgtgatcctgacattgtctgcatgagaacgtagcccactgaatctgcagtcctttcctctctgagttcttgttgtctgtattccagtgtctgaaaggcttgtttgcaggttttgcgactggctctgactttggcagttcaattcctggtggctttgatcacagaggcccatcccagctctgatgtcaggctttctgtagtcagcagctctgctacatgcaaagctgtgctgccacatgtccttctgcctcccttgtttacaatctccccgtactgaggccgcccctcagcagtgcccacgtccagcccatgctagagcccagtttgtggaatgtaacggccaacccttgtgtgctgccatggaactcacagacctcgcgctcttggtgactgatgctgacttcaaggatccctgtctaaagcttgttgatagaggaggcaaaagtatgactcctcaaaattaacctaaaggaggaaatctacccagcttcccttgttccttcctagtcccgtgtccagtggggattactgatgggagctggctgtatatccactcaagtgtagaccaaaaaagtaaatgagagtcactccttatacactcaaggagacatacaacacagtgagctttatctgagatgtggaatatgagtgtatcggccctctcaaggagagaacctgcacggcagattctgttgttaaatgcatggaaagttagtgaatgttcaacttggattgttttatggggggtcttatttgatgggcctggttgttttcttttaaaggtaagaattagcatatcaaccagtcagcttgtttggcatttacccacccagtctatcaattgcactggctggcattgcccaagtaatggagaaaaagcaaatctgcaagctgggttgttatgtatttctttgtatacatgccacacacaaattatttgtccaccttacttacttttttgcagttgatattttcttaacaattggctgcaaattgaatttttagaaatcaaatccccctagctgaaggaacatatcagataagctttatcttcctttctaattaaacattactaggcaatgactactggcacttaaattttcagggtttttttttttttttctggttctttttgttaagtaattgatttgtaaataagtatttaagttccctggtgaggcttactgtttaaagaaggcttgcaatgaattattttacaagtttggatttgaatattctgtatttgttttcttaatgtatagaatgcctgtgccttatgttgtctgttttgatgctaaacctgaggccagacctggttattttggtaacccagtggcaggcatcaaaagaaataggagactccggctgagtatggtggctcacgcctgtaatcctagcactttggaaggccaagaaggatgaattgcctgagcggaggagttcaagaccagcctggggaatatggtgaaaccccgtctctactaaaaatacaaaacattagccgggcatggcggcgaatgcctgtaatcccagctactcaggaggctgagacaggagaatcactgaacccaggaggcggaagttgcagtgagccgagatcgtgccattgcactccagcctggatgacagagtgagactctgtctcaagaaaaaaaaaaaaaaaaaaaaggaaggagagagagagagagagaggcactttcacagttgtggatgctttatttgcactccttatcacttttagtagcatacagaatcacttttatctatagatataggataaaattgaaagaggaagaaaggagaataacacttacatagcactcattgcattccaagcactgctagctaatatgatccgtaaaacaatcccaggaggagttaccattgctagcctcgttttacagatgaaaagactgaggctagtatttcacggaactggaactctaatctaagcagtctaattcttgggtcctcaagtagaaagaaggcaacaaatagggatcttaaacagggtcagtggtgcaagtcaagtagaatttttaattttgatcaaatgtaatttatcacttacctttgatagtttgaggttttgtacctgtttaagaaatctgtatctaactcagagtcactaggattttcttctatgttttctttcagaaattttttttttttttttttttttgagatggagtcttgctctgtctcccaggctggagtgcagtggtgcaatcttggctcactgcaacctctgcctcccaggttcaagcgattctcctgcctcagcctccctagtagctgggacttacaggcgcgtgccgccacgcccagctaattttttgtatttttagtagagacggggtttcattgtgttagccagcatgggctcaatctcctgacctcgtgatccacccgtctcagcctcccaaagtgctgggattacaggtgtgagccaccgcacccggctttttcagaacttttatacctttagcctttgcattttaggtctatgatctataccaagttaaattttgcatttggtgtaaggtaaggatagagggtttttgtttttgtttttaacatatgtgtatccaattgttctagcatcatttgttgaagaaaactattgtttctccattgaattacctcggcatctgttaaagtaaaaaataattaatgacatttgctgaggatggtaagtgttacacgcgtccgtgtgaagagaccaccaaacaggctttgtgtgagcaataaagctttttaatcacttcggtgtaggtggactgagtccgaaaaaggagtcagcaaagggagatgggtggggcagttttatgggatttgggtagataatggaaaattacagttaaagggggttgttctcttgagggcaggggtgggggtcacaaggtgctgggtgggaagcttctgagactcattgtccaggagaaggaatgtcacaaggtcaattgatcagttagggtggggcaggaacaaatcacagtggtggaatgtcatcagttaaggcaggaactgactaatttcacttattttgtggttcttcagttgcttcaggccatctgtttatatatgtgcaggtcacagggggtatgatgggttagcttgggctctgaggacagtacgtcaggcttttttcaaggtgagggtcatggtgataggtgtgggggtggctgcaaaaggattttgcaataagggagaaagattgggctgaatttctaatgtagcatgggtaagtgggacttcatagccaaggaacagagtcgggtgggtagacaggaaacatcaaagataagggtgggaggtgggggcagggagtgtgcagattctggttaaagtgacctaacaggattctcgctgaggacagggcaaggtgatcagacatcacctggggatggtggaggatgaggaacccaatcagatatcaagggtgttatcaactttatattaatatattgttggaattgacttgctaaagttttgaaaagggtttttgtatctgtacttacagatacaaaaagaaatttttttaacgtataagctcacaggtttaagagaatggaagaagagatacaatgcataagaaatagcagcaatttttacaaggctgggtggcagttgacttgcagacaagagaaagctgaaatgtgggcacggtgtgtgtggagttagggtagggccaaggagcaaactaatttattccacagaacctcagaagactcaggtaggcttcagaaaggatcaggaatcgaaaatatcaggtagctctgaagatgaaattgattcattttcatatgtgttgcacccttcatcttcagagaaactgatcagcccaagagaaaccatctcagatactgaactctggggacccctgctccagtggaacacctagcttccccatcctgcagtgatgcttcattagttcacaagcttgcctaggcatacagagattttgtgatttccagttagcattttggtgccttacttgtgaagatgaatggacaatgaaggatcatcagatattggagaaaagcccctcatgtgaaaagcagaagccaaaataaataaagaaaaaagtaatcccagcactttgggaggccgaggagggtggatcacctgaggtcaggagttcaagaccagcctggccaacatggtaaaaccctgtctctactaaaaatacaaaaactagctgggcgtgatggcacgtgcatgtagtcccagctactggggaggttgaggcaggagaaacacttgaacccgggaggcagaggttgcagtgagccaagattgcaccactgcactccagcctgggcaacagagcaagactccgtctcaaaaaaaaaaaaaaaaaagtaactaggaagaaaaagatagttcagggagcaaaactgttaccagaataagggtcttgagtgtgagatgttcaggtccttggcattctgaacaaagaattcggcaaaactcacaaagtaacaaaggaatgaaacacaagaaccaagcagcaaaaatgggaatttattaaagcgagaaagcactccacaggatgggagtcagcccaggcaagcagctctagggcccggttacaaagtcttctgggtttgaagtacttcttttgaagtcctttatctggatgaaggatttgatctgtggctaattaaaggctgaggtgaattggtgccctgtgcagataaagggatggtcaatggtccctggttggcctgtggccaatccagagcactttacctttccatctaagaggtggtggaaggggagggttgtagggagaggagcctttgatacttgttactcagactttgggagaggggggtttttccttttggttcagcttttggaagtttgcattaataggccttaagttccctgcccccagactcaggtgttttccctttttatccagctttgggaagtcagcatgaattggccttagagtccccgccccagaccatggtgtttttcatcgattcagctttaggaagtcagcacaaattggccttagatttcctgcttccagaccctattttcctgcctcaaaacaaattttaaaaaatatctgatttcctcagggagagaagagaatgcatctgtgaaacaagagtgggaagctctgaaaagagaacattcagagaaataaacaggaatggctgcataatgaaaatacaagacctgttgttcaaaagttaagaatttcaaggtggcagtagcatcgctttcaccaagcgtggggtccttctgagcacagggacctgtgtggcttctcaggttacacagccacaacactggccctgggagggagaaagctcttggaaataaaatatctgatagcataaataataaaactgaatacatgatttggaagataaggtatgggaattaccaggaagttgaacaaaaagaggggaaacatcctagaaaagcagaagatagctcaagagattcaatgtaaatgtagttgaatttacagacaaaggatagaagaaaataatcctagaaataattcaaggcaaattcccagatctgaagaacacaagtgtatagattgaaagggtcaaggcgagttacataatcatgaaattttgaattaccagggataatttcccaaaagctttcaaagagagaaaaaaccaagcaaaaatccattcatgtacaaaggtttggaaatcagaacagcagcaaaaacataatgttaacttagccagaaattgtgatataaccattttgagaggcttggggagaaaagggagtgtattagtccattttcgtgctgctgataaagacatactgaagactgggtaagttataaagaaaaagtggtttaatggactcacagttccatgtggatgagaaggcctcacaatcatggcggaaggtgaaaggcacatcttacatggtggcagagaagagagaatgaagccaagtgaaaagggaaaccccttaaaaaaccatcagatcttgtgagacatattcactaccacaaggacagtatagggggaactacccccatgattcaattatctcccaccaagtccctcccacagggagttatgggaatgatgggaacaattcaagatgaaatttgggtggggacacagccaaactatatcaagggggaaaaaaaaaaacaaccaagtcctcttctaccgtagtagaaagtcagtaggcgatctatcttaacgaaaattcaggaaacagcaagagaagcatgtaatttagaaatttagaggtaaaacaaataattttagaaagatatctatttcacctaaaagtgtcaaaggcctcctgaggtaggaattgtgcattagggaaaggaactgctgtttttcaatataaaccttgtagaactaatacctttgtaactacatgtgttaataatttagcaaccaaaattgaattaaaagtagataaggatttgccctaggtattgcgtgggactccaacagatgtgacactaatgactcttctctcttcagattcccgatacattcttctgcctgtcgtgttacatcacctccacattcacttgcaagaacagaaggacctgatcatgtgtgcacgtatccttagcaacgtattttgtcttatcaagaaaaatagctcagtaagtaaatacaggtcatagtatatagctcccttcaaatggcttctggaaataaacttgtaatagtctacaaagaaaccgcactaaagaggaagcctctgagacccacttttatttccagctgggctggactttttgcttctctttggaaggaatttttttaaccttgtgggattctgtaaccccaaataacctgggttccccaaacttgtatttcaaggaagaactgcatactgagtgagaaaaatgagaaatctcaaagcctcccacgtgtgtctttaatcttgatatgatgactgctctgtggcaagaataaattactgcttgcaacatgaagtcgtttttgatccattctgtgaaaggctacttcatgatactcagaacttggctgtggtccttgggccgggtcccctggaaattgcagaagcaaaggacagccccaggagattaggggtatcttacagtataaccattacttggccccaccagtgatctccaaattgttatggatttggggattcctatcaacgtgcctgactcttgatgcaatgcaattgcattagagaatgcactgcaaaatgagaagaatcacatgcttgcttataaatgggacaactcagagtatttgtgttcatggctcaggggtctggtgtgaaatccacatatggagaatatcctgttccacttctgccaatatgcaactgttaaccattttgctcatcggtaacaggttttatggagcggagtttggcaatgagtgccaagaatcctgttcctctgcttccctattacctttatgctacagtttccccaatttgtcacttacgatcagcttctgaagatcagtgaggtgggatgggacctcagtggagttgttggagatagagccccagtagcgtgggaacagagttggcagttgagagaaaaaagctagaaattctgcctctggaagtgtaataagaggaacctgcatggaacaaagcagttgactttttcccacccccatgatccaggccccaaaggtgatctggaactgaatagaacagtggtgacagaaggcatgaattcagttttaaacccgcctctataaaattatataaagaataactatgctatgcctagttagaatcgttttccaaattataattgctgagagtaaaatgtaagttagatagttcactgcacagaaccaaaaacagcagaagagaaataaaaagaaatcacctccacaacttctgctctgtaagacattcagagcagaaaccaagtcactggagggaaaatcttggtagttttcttgcaagtgtaagaaaatttatcataaaatcctagccaaaaagctctttcaaactcgtactttctaaaagtattttttacaaagagtgatctccttggttagaagcatttgtacatagagttttgttttgtgcaggtgtaataagaacccaactccacatacagtcagtgcagagcaatttgggtttctcttgcaagtcctggggcgtggatactattaactttgcatcaggaaagcagtttccacatggccactgaccttagatccactctgtagctaagggtatttgtctgggccaaacaccatttcctaatatttacatgcaaagatttttaaaaatcattttttataggaatagtcatttgtacttaaagtttcggaaaatgactgatgtaactctaatattgagaaaagtaaatataagcacagtctggaaccaaggaatcatagaccaagaacaaggatggactctcagtgaagattcaggctcagagaggcagactgacttgcctgaggtcacacaccctgttgggagcctcgctggtgttctgagttagtctggtgtgccttcatgatatcacccacctttttacttgtatctcaggtatccattgcaccactgagttgtgtactcttgggtaagccattaacttctctgtgcctttgtttactgtaaaaggagatcattcacttaggtgaaatccatgcctcaagttctctgactctttgatttccccttttctgttagattgaaatgcatgttaaaccccagtttcctgaacatattattttttttctcttaaggaaaaatctgtgctggaggaaatagatgtgatagtggccagcttgctggatattctgctgaggaccatattggagatcaccagccgacctcagccatccagctcagcaatgcggttccagttccaggatgtcactgtaagatcatagagcagatggcacgtggaacagggcctggttatgcttcagtcacgttgcaggtggcttgatgttataatctggaaaatgtggccttaggagagtaacccatcagcatttcaaaatcatatgaggttaccttaattttacaaggaaaccaagatataaaacatgtttgttaaaggaacttggaataagcagtttttaattgcagaaagccagctttgatattagtcataccatgcccggtttaaattaacccaagattttatattccaagtcaacttgatgactttttattctcttatcatccatcaaattgcttgaggaaacgagaagagtgaaacagagtaataggagtcagggccctgagttttcattccaaatttttcactctgactagtcagaatcgtaacttttctaggcctcagttttcttagctaggaaatgagaaggttggaattggcaaagttttttttctttttttgagacggagtctcgctctgtctcccaggttggagtgcgagtgtgtgatcttggcttactacaacctccatctcccgggttcaagtaattctccgtgcctcagcctcttgagtagctgggattacagatgcccgccaccacacccggctaatttttgtatttttaatacagacagagtttcaccatgttggtcaggctgatctcgagctcctgacctcagatgatccacttgccttggcctcccaaagtattgggattacaggtgtgaaccaccatgcctagcctggaattggcaaattttaaagtgctttgaagctggctttctgcaattaaaaactgcttattccaagttcctttaacaaacatgttttatatcttggtttccttgtaaaattaaggtaacctcatatgattttgaaatgctgatgggttactctcctaaggccagattttccagattataacatcaagccacctgcaacgtgactgaagcattttgagtctaatattatatctgtattttatattcatgtaaaacattaagaaaataatattaagaaataatacatctggcagtttatatatgtgtatctatttatatatatacaggaatataaaatggtatagccactatggaaaatagtagctctactatatatacaagttatgaatcgtccactttctcaatactctcatcatcatttggtgttacccgtttttttggagtggagagcattctgatagctatgtagtgatatcttattgtagttttaatttgcatgtccctaatgactaatgatgctgagcaacttttcacatacttatttgccatctatatatcctcttcagtgaaatgtcttttcatgtctttttgccattttttacactggattgttttttcactgttgagtttttatttctttttataatatgtggtttgcaggtatcttctcctactctgtagcttgttttttcatcctcttaacaagctttgcagagcaaaaatttttaatttcatttaagtccagtttattaatttccttttatagttcaagcttttgactctttttgcctagccctgtatcttaaatgttatctcctagtttctttcctaaaagtagtatagttttatattttacatgtaagtcccttaaccattttgtatgtgtcagataattctaacaatctgacgttgcagtgtggacatctattgattgtctttttcattcaatttgaggttttcttagttcttgataggatgtgttattttctcttatgaccaagacatttctatattataaagctctggatcttacataaaccttctgttttagctggctttgtgtgataccactcatcaggggaacagtgcctacatgttatggtgagacagtgatagaaatccaggttcgccacttggtttcctttgacagctgaggcaagagggcttcttgttactgctgggtgaggtggaagttctggctctgcatgtggtctctactgccagtgtggtgggagtggctttgttactgctgggccatggtgaccgtcctgactctctactaggcctctttgacaccaccccagtggggagggaaaaaatgtgacttgttactgccagttgtgggtggaagcccaggctcctcccattgttttcaccaacactgactcgtgggtatgaaagtacctgctccctgtttgaccttctctggctccactctaggagagatgttgggacacctcactacatcctcatgagggtggaagtctaggctcctcactcagcctttgcagtgaacaggtgactgaggacaaagttttctgtggtgttcagctagaatagagcaactgcggctaaaagcattgccctgcagggctgccctttcctagtcctttggctggagaaataaggttttttgggactttttcttttgtctaccaactattggtctttcacagttgctggcctcttcagccccatctttgaaatatacgaggcaaaaaagaaaatccaaagaaatctacaccgtgcccttgctcaggtcccaaggaggttcttggccagtctgccctctctcccctcctgtcagagtctttttctgtttgttttatatttgatgttcaggtttttagttgtacttagcaggaggaataggggagaagtatggctacactttcaacgtggaagaggaaggatgtctccttcactgtggttttgatggtgacattttaattgcttcctggcaatataacttacatagtttgaaagttataatggcaagcaaacaaagtcatagcaaatgctgggcatagttaaagattgcctgagatcagaagctaaaacactttttaaactgctttctatcgacgtgcagagcgtacaaggttgttgtgcaccaaatctctatgggatacatgtggtcttcaggccatacagtgtaataagtaatgccaattacgagacttcaggaagtcagtgaatcaggtctgtgggtggaggtggggtagggcaggcagagtgattgtcctgtgtactaaattataagaaaatcacatgaagagaatccttcctgcatagctctgtggtaccccttgctgtgtgagaaaccagactgtccaggtgtgtggggtgaaattttccatgaaacacacacataaattatttgacatctttgcttttatgctttaagacttttttttttaagagtactcagacagacctagcttgattccttctctgtcattgcactgactctgtgatgttggtcaagttactaatgtctctaagcctctgtttctttaaaacagagaaaataggccaggcgcggtgtcttatgcctgtaatcccagcattttgggaggccaaggcgggcgtattgcttgaggcagaggtttgagaccagcctggccaacatcttgaaacccccactaaaaatacaaaaaaattagccaggcctgttggtgggtacctgtaaccccagctactcaggagactgaggcccaaaaatggcttgaacccaggagatggaggttgcagtgagccgagatcataccactgcactccagcctaggtgacagagtgagaccctgtctcataaataaataaataaataaataaataaatcagagaaaatagttgtacttatctcaaagttagtgtgaggatttcatcaaatctgtaaaggtgtttaaacagtatctggtctgatactcaataaatgctgaccgttagtcattgtggtagcagcagaagtcacagtcatatcatgattgttgcagacgtgcttcaggtattgttgttgttataataattctatggcgagaaatatgccctggtcttgtctttcacaaaatccattctctggagactgaagatctgttgaatttctttatcattttctcacagagaacaggctttctgaatagggagtcttcacatggcagtactacattgagcaccttttcagtctgtgcagacacatatggaaaagtgcccatgacaagtagacacactgtgagtaaacgcagatcccacaatgtgccattgtgaattcttccagtgctctgtaagcaccatgattgttacccagcctcccagccacaccagcatgagcactggcgtctgctgtatcatagttccagataacagaggccttatttttaaaatttaaaaggattgtactttttgtttttccaccgactgttttttgaactttaaaatgctttccctagctagaaaaaaaaaacaaaaaagcaccattgtgatcagttcctttcaaaagtctaattataggtagaagcagattttataaagcagtatgaatgaccacttgccttgcattctcgactaatggagctccagagttccttacaatttataaatgcttactcgttcgtaactctgttaaataacatttacggagcatgtgattcttctgggcataggccaggtctaagacagctactctgatgtgtttatctaaaattttcatgtgatgtcggtttgtggtggggtatggaaatgggcctgggttaattctgtaagaaatatgtggaaaaaaataatgtatgtgtataataggtttcgtgaagacagttgtagccatccaatacccttgctatacacagtcatttgtagaaattcccattatactcaatctatacataaaatggccactgaagactacagagttttcaaggtgatttatacaaaagaaagtttcacactgcagctaagtacatcttggccactgatggctttttatttctttttaataaattatgagtctaggattttcatacagatacattcttaaaatatcttaaaaacaaagaaaattacattatggataaaatatacattagtaattggaagtcaccgctaaaagacttactcatgtaaccaaataccacctgtttccccaaaaacctatggaaataaaaaatttaaaaaattaattaaaatttaagtttaagaaatagagcaaaaaaattacattatggataaaatatacattagtaattggacatctaggcctcctaacagagttgaatgtggttggagttcctaaacagcataagtgaataaatgacattgtagagtagatgttgggattgacaataatcatcataaatgcccaagggattatatgtcatgattataagttattgcaatgggcataagtcagatatgacaaaatcataaatctggattcaaacaggttgttcccctatgtatattgactgtaaaggcttaagatgaaagtctattccttattgcataatatttcttgttactactaaatttgcaaataatatgtcatttttcccacttcagcatatttcactattcacaggattgtgtgttgaagtaaatgtcttaggaaaattaatctagtagctgtaatggagacaatgtgaatatgatatggaaaaactaagagatggaaaagagatgaatggatttctactaactagatttgcatttttaagtcaaggcatagttaagagaaaggtaaaaaagtatgaaccttagttatcaactgatgaattcaagtatacttactgatattgtaattataaccaaaaacctcaggtgtattttctctatacaatcaaatagtctgagcagaaggaagatgagtcactgagtacagacttctagaaccagggatacctgggttcacatcccagtctcacaattctcaagctgtggaacctggggtaaatttctgaaccttaagagataattatcttttctttaaagtgaaattgattgtgtctacccaacaaggcccaaacaaggaatgaactcaatagcatagtcaaagtatggtaatttacacatagtgccattccataaatcatagtgttgtcatatgtcttttttattttattgaggtataattgacataaaataaatgacacctgtttgaaatgtacaattttagttttgacatatgtgtattcctatgaaacatcaccacaatcaggatagcaaatacattcatcactttcaaaagcttccttgtgcccctctcggttccctctcttttgcccctccatgctacctcatccccaagcaactactgacctgctttttgtagtaacttatctattactgtacataagtttacattttttagaatttgatatgaatggaatcatgtagtacatagctattattattaatcatatactacatagttttttggggggcataggggcaggggattctgtcttgacacaatatatttgagtttcatccttattcttttgtatatcaatagtttattccttcttattgctgaatagtattccattgtatggatatactgcagtttgtttattcattcacctcttggtagacatttgagttgttcctgggtttggctattgtgttccatttacctgtttttctgttttgacaccagtaacatactatcttgattgtcatgttttataataaatcttaaagtcagtaagtgtaagtcttccaactttacttttctttttcaaagttgttttgactattttagatccttttcactccttatggattttaaagttagatcagcctttcaatttctaatccccaaagctatgctaggataattactgggattgcattgaatctatatatcgatttggggataattgacatcttttttttttttttttttttttttttgaggtagggtttcgctaatgtcacccatgctggaatgcagtggtgcaatcttggctcactgcaacctccacctcctgggttcaagcaattctcctgcctcagcctcccaagtagctgggattacaggcttgtgccactacacccggctaattttgtatttttagtagagctcaggtttcaccatgttggccaggttggtctcaaactcctgacctcaggtgactcacccgcctcagcctcccaaagtactgggattataggcatgagccaccacgcccagccaaaattgacatcttaacaatattgcatttcccaatccatgaacatgtaatatcttcattttttttaagtatttaactccacccctcagtgttttgcagccttcagtgtgcagattttatacatcttttgtcaaatagatcagtaattatttcatattttaatgatattattttaaatttcaatttctgattgttcatttttagtgtgtagaagtaaaatttatttttgtacattgatcttatattttggaatgtaaataaactcaattagttccagtagctctttatcaatttcatagctttttctatatacacagctacgctttctgtgaagaaagacagctttttaaaaattcctttcaaacctgtattcctgattgccttttcttgccttattgcactgactaaaaccttcagtacaatgttgaatagaggtggtgaataagctttgggaggtttgaaaagtctttattttgtctttgcttttggaagatatttttatattttatattttggaagatatttttcttggttaatagtttttggggttttttttccttttagttctctgaagctgttgctccgttgtctttcagcttgtgttctttccaagagaaatcttttctcatctttgtctttgttcttctctatgtaatgtgccccttttttttctgaatagtgttttaagattttctctaccactggctataagcaatttgattatgatgtgccttggtgtaattttcttcttgtttcttgtgcttggggtttgtggagattttttgatatacaggtttataattttcaaagagtttgaaaaagtttttttctcatttcttcaattattttttctgtctcttccttctctctgagactttcagttacatagatattctgctacttgaagttgtcctccagttcactgatgcttttttctgtttttctttttatttcagttttttctgtctatgctttattttggagaatttctactgccctacctttcaagttcaataatcttttcttctgcagtgtctaatctgccactcgacccattcaattaatattcatctcacaaattgtagccttcatctctagaagtttaatttgggctctttttatgtcttccatgtctctaaattaacatattcagtctttcctctagcttcctgaaaaattagaatacagtaatataactatgttaatgttcttgtgtggtaattctattatctatgtcatttctggatctgtttctattgatatattactttttctcctcatttgcgtcattttttccttcttcttgacctgcctggtgatttttcattgcatgccagttattgtgaattttacattgttgacaggtggatttttttaatttctaaaaaatatctgagctttgctatagagtgaggttaaatttattggaaactatttgatcattttaggtcttgcttttgaaatttgtgaggtaggaccagaacagcattactctaggagtagtttttctccagtactaaggaaacactgtttttggtactctaactaatgccttattaattgtgaggtttttccagtctggctggtattaaaaaaaaaaaaaggctctattattcccagtcctgtgtgagcacaaggcactgttctctcaatccttctagatcattcttttcctagtgttgggttgggttactaccttacacacatatacaaaaatattaataatattgcctttaaactttttatttcttttgttaaatatcaaggattcccatgttcattaacaaagtatatgttgagcttgaaggatgtttcttctggcccacactggttagtttcttgaatatttaccctaaaaaatgtatatagataattatttgtcatacctgtgtgttgcaaatgattatctgcaaacagagatctagcctgagtacctggttgccttgacatggtctttaagtattatagcatccttgggtctcccatggcagtgggcgaggatacattgaattttcctcacccagctgcttctgttgaaaaattcccttctcagggcttttagtctctacttataaagtctgtagtctctttccatgtaaaatctaagaaaccagttcccaattaaattgcacttctgtaaatatacagttagttaccagtgattgcctctcctattgtatttgttttgttttaaatgttattactctgtttaaaagtagataaattctttgctgagcacaaaaggttgcattgaaaatgcaagcattttaaattagaagttcattcaaaaatgcaagtgatagcaattttatgtaggtcttcaaatccatagatgctatgtttacttttttattgttaatttttaagaattagaatttatggttacaaatcacatagagcccaagcacaaaaagaatggccaattaaaaaaattgttttcaatcttccaagacatctgaataaaactattttttaaaaggagattgaaatgaacattatgcaacatatggcattcattataccctgtgagtcagcagatcaactctctgatgagttggaggaggtcatttgaattcaaaaatggagcatgaagctacaggaagggctttggaggcagaaagactggggataatgccagctctgctactttctagctgagtgacttggggcaagtcatttagcacatcagaaactacattttaccttcttcaaaaaggtattataccccctacctcatagtgttgatatgaagcttaaatgttagaattattacagacatgttaaatgctcagtaaatgatcataaaccctcggtgccttaccttctttaaatgtgtgaagttagttcccaagtgaaaagcttccactcaagttaaaaaaaaaaatcctccctaaaattataaatttgtgaataccaagtaaataaatggtaatcatcatagggagttttggctgtgacattttggataatttatattaagaagacttcacagggcaagtttggatcatcgtgatttcattttaacctattctctttgaggacagttcagtgtaagttactgatgttcttttacgtccttactaaaaataaaatgtatgctttttttttttttaacttagggggagtttgttgcttgtctcctgtccctattacgacaaatgacagatagacattatcaacagcttcttgatagttttaatacaaaggaagaactaagggtaagtgacattttaaaatgttttctttaacatatcttttgggtttatcttgtttttattcatcactgttgagataaatcctagacaattgctttacctgtttccattaagttctaagctgtttttctcagcctcatccacagatctgctcatctatattggcttttaaagatttctattactcaagcaaagctattaactctcatttcagagaaggatataggatgtgaagtacctgtcatcaaagttcaataaactagaagcagaataacagaactgaagagataaaaacaaatagattaactacgtgaacctagaaacattgccttaatagaagataaaagagaatatgtaaatatgttcactcatttcatctcactaaaaccataatgagaagttctggctacaactttttgactagggatacagagttgtatttgatattctctatcagctatagtctaatcaatatgctgtgctactctgacaagctgacattaaataggaaataaggatgccaggtttataaaaatccagtatttgctgagattcacagaactgtaatgcatccttcatggtttcactaaatgcttgattattcttagttggaggaatgatatgatctgtcatcttccttatttacttttatttctcttccatctcttcagttttctggacaaatttcatatggaaaccatcatattagaattgttgcttttaagctgggtggtggagaattataggaccaaaagtacagttctgctatgacatttgcttgattggaagccttcccagtgccttaggggaagaaattgttgattttttaatatagatagtacataggggtcacttatctttgactttaactggaaaatattgtatgatctcagaaaaatcttcctgttgttaccttagagaacttgaaaagctgagtcatataaaacaaagaatcatttttggcagatttaatccctcagcagtcagtcatttggcatatggcatcatgtttttcattcttacattgaatcttttttctttttttttttgaggcagggttttactgttactcaggctggagtgcagtagtacaatcatggctcactgcatcctgaaactcctaggctcagacaatcctcctgcctctgcttcccaagtagctgtgactacaggcacatgctaccacacttagctaatttttaaaatttttttgtagaggcagggtctcactatgttgcccaggctggtctcaaactcctggcctaaagaaatcctcccatctcagcctcctaaagtactcagattacaggcatgagccaccatgcctggccttacattcaatcttgaatttagaattaaaaatggataaaaggccttaggacttacccactctgagtacaaaaacccataatgtcaaaaggaagagaactgtgcatttattaactttcgttagaagctgtattcttaacacagttaaagaatcattaggttttacttaagaagtctatgacttcatatttgaaaatttcccataggaaaagcgtacatatttttatggagcctgggaattaaaaaatagcagagaagcataaactgaaagacatgactaattatccaggtgttgagttttatgctttggtattcatgttagcagtaataaaacaaatggaaataatgaataaaatgttttatgtggacttttctcatttcagtcagccaatacacctcttccaaggacaattatattaccctctttaaaattactgaggctggcggggcgccgtggctcaggcctgtaatcccagcactttgggaggccgaggtgggtggatcacctgagatcaaggccagcttggccaacatagcaaaatcccatctctactaaaaatacaaaaattagctgggcatggtggctcgtgcctgtagtcccagctatttgggaggctgaggtgggagaatcgcttgaacccaggaggcagaggtggcagtgagctgagatcacaccactgcactccagcctgggcaacagagtgagactccgtctgaaaaaaaaaatagcaaggccttctgactaggagaattatttaataatattaattacttcatctgccattcaggaagtggatattgagcaactcaagcatggcaagcactgtgcaccacgcactagggatgtaaccaggcacaagataccctgttcctgtaggggagtaatcaggcaaataatgggcatgagcaccctgagtggtgaatgttcagggtaagcacgcgatgctatggagcgtgtgggaggtgctgccaacccagactcaaggcaacaggaaaacttcccaggggaggtctcagctgagaactgaggttagtaggagtgtgctagatatatatttggctggaacattcagacctctctattaaaatatcacctgaatgccccgactgacacagcacactctctaccccacctttataatacttattggaatctggaatatttttgtttatttgtttatgtgtatttcccagtttatgtatatatcccactgggccataagctccttgatatctgaagctttgtctggctcactgctgtatccttagattccagaccattcctagcacatagcaggcattcaagaaatagttgttgatcatttgatagaatatagagtttaaggctgtatgaatgagtgtagactttgttttgaggacattttgaagcttgtgattgttttaagaagggagagataagatctcatttgagggaagaaagacctgtctggttgcactattgaaaatgcatttggccagacacggtacctcatgcctgtaatttgggagcactttgggaggccaaggcaggaggatcacttgagcccaggagttagagaccagcctgggcaatatggcaagaccctgtcgctataaaaagtttgtaaaaactagctgggtatggtggcacacatctatagtcccagctactcaagagggtcagatgggagtatcgcttcagccagggaggtggaggctgcagtgagctgtgattgcaccactcctctccaacctgggcaacagagggagaccctgtctctaaaaaaaaaaaagaaaaaggaaagaaaagaaagaaaggggattcactgaagtcaagatgagaggcagaaccctgtaaaagattttaggtagtaacctaagctagaaatgactgtggcttgaagtagaggcgattgtggagatagagtctagggacatttaggaagttgaattggcaggacttgatgactgataatattaaaaaggtgaaggagtgggaggagttgtaagtgactcctaggccttttgacaattggctgggtgttggtgtggtgccattcactgcatgaggatcccaggaggagttaggtattcaggtttgggagcaaaggtaaattcggtttcagcctgagtttggtcacctgagggacattcagatggagatgtttagtaaattgtgcctgaagttcaggagagagagagatgggttatgggatgtagatctggaaactgtcagccagtgaataataactgacatcatgggagtaaatgtgaacatccaaggagagtgtagagtatgaaggtcaaaggacctacatagaatcctaagcctaaggagggaggcgtgataaacagtgcctgctactgcaaggaggtcgagtaccatcatgaaaggttccctaaatattgttggtgaacctgatgggcaatttcactgatgagggtgaaagccaacttgtcatggattgaagaatagaaaaaaaaaaaggaaaatatacagtggattgtatgcagtgtttcaagaagaagagggataagtttggatgtgtagactttgttttgatgaatacttatgatggaggagacttaagcatgtttaaatatattcatgattacagctggtggagagggagaagctggaaatctaagaaagaggtactaacttccagggtgaggtctctgagaaggcagcaggaagggacagaattatccttgactgggactaagattcttacactttcccagtctaagaatgaaagagaaataactggagtgaatgcaggctagaggacatttatttaatttagtaaaggctaattagtcatcttgttttttttgttttgttttgttttgttttgagaatgagtctcgctctgtcgcccaggctggagtgcagtggctcaatcttgactcactgcaacctccgtcacccaggttgacgcaattcctcttcctcagcttcttgagtagctgggactacaggcacgcgccaccacgcccggcggattttttgtattttagtagagatgaggtttcaccatgttggccaggatggtctcgatctcctgaccttgtgatccgtccacctcagcctccctagtcatcttgttttaatctgcattttaaaagttcatatatcaccttataaaagatattaataaatgtttcctgtgctcaattttgtttaaaaccaaatatttctagttatgttcctgaacctatattgtaatattttcaaagataataacacttgtccctagacccttatacaaagtccttagtaccaattttacttcagaaatcagaatttttatgatttcataatgataatgtacatatatagcacctccaataaaatctagagtgatacaaaatattcactccatatgggataaataaagactataaatcattctggtcaggttttgctgccaagtggattataagggcaaaaacttttagagtaattttgggttttgatatcgtagtaaaggaagtgaagacctctaaacagcaagcattttatatgcaatttagtatgtatcaggcactgttctaagcagttgcttaatattaactaattttaatccttaaaaggatcccatgaagtaggcccccattattttcttacagatatcaattgttgactcaacaaacatttattgagcatcttgcttagacattagagatatcaagactaataaaagcctgttgttaaggtcatctaaatcattcttgtaaataaatataatatgtataaactgcagtgatattggctaacagttacggaacacctcctcaaccccatcccacagccatgagccagttgtggtgcttaacccacatttcatcctctccctgcctcccccgccatgagattgactgatgctattattgttctcaagtaattgggagaactaggaattctattaacatcctgagctcattgctcaggcagctaaactcagcttttccctaaactttaataaactttcttaaaccaaaatctttcctatcaaattatataaaattgtaattgtcagctctctgaagttaataaagcagttctagtcatagaatggagatatctgagaaaggccagattaatagaaggagagttacttggggttttgtatgtacatttaggttagaaagtaaataggtaaagtacaattaatagggtgatatttaatgggaaattataagtgatattgaaattagacaccaaaaattccacataaccctactgttttaaaaagtgataaagtgtatttactctcctcctaacccccaacgtatcctaatccccagaggtagctgctgttaacatctaaaggtgtaaccttgtagatgattttgtatactatatatatacatatatatatatatatatacacacacacacacacatttttagtgttaatataattatttatattgatgtatacttttttacatgataatatctcatagatattatatagcccactaccttattcttctgaatctcattatatggatgctacataatttaatcatttctgatttttgccattagaatgggtcttgcagtaaacatcttgatacacctctttctgtggacttgtacccatattgctgtagaataaattcctagacgtgtaattgttgggtcataggatgtacacattttacattttaattgatacttgatcaattatatattgagattttcaaatgaatattcatgttgttttttattcctaatgttgctttttcctttctttttaacagttcaaagaaaggtaaagtttgtcttagcatttcccagtggttctataaatcaaaatgaattttaaaagtatgtggctctcaagtatctactaagactaaaggtctttcaactccattcatgcctgaagagcctggatgcctccagggttactgctgaagtagcttctggcttcctgagcagtgtgccacttcttcccctgtgtccttaggttcttacttgtgtgtgagaggcatgagtcacagtatcagaacacaagtatgtgggagcaaagacctgagggctggtactctgtattgtttttttccttctctagaacataatattattttaaaatgaacaaaagtaaacactaggtagtgatcaagatttttttcctccttctgttgtcagtaatgttttattatacacccacctcatactggaggctacagttttgtccatatccttggcatttcatatatatacagcagtgagactcctgtgctttgttgattataacttttcatagaactgtggggatcttgctataagcacaagattatacatgagctggaagttaagtacagcacgattataactgcattgtctcctatatactgtcccactagctttcaaaaattatatctgatcaagccccaatccagctttaaaactctgagtacttcccattccttgcaggacgaagtccaatctccttatcatgttgtttctatcctcaatttaccttccaaccacattatcctccacccccttctaaacacctttcagtcactccagccacttcaaactactgttatattccttaaaaaccaaatatataatttttaattcctctgaatcattttttttctatctgtaatgcctattctaccaccacctcacttccattacctaatgtgtacccctgttaatcccttctctgattcagctcaccctacaaacccactcaggtatcagcttctcgatgaagccttcccaggatacagtcctccctctctgatagcgtgcaataatgcactctcattatttgccatttccttgtgtttttgatgactatgggccattgagagtcgagaccatgtcttggtgtcctaagcacagaacctggaacattaaatctttgttgaaagaatgcatgctcttaatattcctgcctgtttcaaaagattttcaatataattattttgacttatctttatttgaatatattgattacagaaaaatggttatatagctctaaaagatggacgatcatttgggagttattttgcgtaagatacttaaagattccattttaagaatataagtttcaatgtgataatgattattaacaccctttaattgaattcaaacctcacatcaagggtattatacgtttgaaatttatggcaaatttttttaatgacatttgagtatagtctgagggtctgtcctattcattgttcttgaagtaagaagaaaatgccctagtctgtgtagcagcctcatgatgctttgttttatggatgtcttaactcatgtttcatgaactcaggattcatttctctgtgtcttgccaattctgtttcacaagcctaatttttgtcttttgcctttctcttttttaaaaaaatatagattttaaaaaatttttagattcaggtggtacatgtgcaggtttgttaatgaatatattgcgtgatgctgaggtttgggccccagttgagtccatcacccaaatagtgaatgtagtacccaataggtagtttttcagcccttttctttctccctccctcccttcttttgtaatcccccatgtctgttcccatttttatgtcagtgtgtatccaatgattagctctcacttataagtgagaacgcagtatttggttttctgtttccatgttaattcacttaggataatggcctctagctgcatctgtgctgcagcaaaggacatgattttgttctttttttgtggctgcatagtattccatggtgtaaatgtaccacattttttaagcctatcctgtcttgtgtctttcttaatatcatagtatcatatgtaagcacaaaacaatttttatatggtacagttaaaaaatctaaaacacaaattcgatcctctcaaacatctgcataatacccctcagtgtctccacaatgcctgcaggataaatgtccagactccttactatggaaaaagttatgaaatatgtctatcttttatttatccctatttatctttcagccctatgtcttgccactgctccttgcagtccaggcaaccctgtgctctctcttgcttctgaggcctacaggtgttgttccctctgtgtggaatacctgaccttcagacttattcacattttcaaagcatacatgtatctgtgtggtttttagattaacatttatctctcccactaaactgtgaactccacgaaagcaaagagcacatttaacctacttactattgtgtggcatgttccagacactccataaacacctgctgcatgaataaataaaagaatgtctcttaccaggtatccccagcatctaacacagtgcctggcacatagtaaagcacccgatatttataaatcagtacatgttagtgatcatttctaaaatcataacaactgttcctactttgttttatatttaattatgggactttttattgttttggaagactttcacaagacctttcttacttgaacctctctcttacttgaacctctgcagaaaaaatacttctataaaataacacctccctgtttcttttttatcttgaaccctgatttgaagaataccaataatacagtttaaccatgttaaataatttaacctgcttaagtgaccatgttgtgctgtatgatgtaaaacagaaaaagaaactgctcccattctgccaggttttaaatggtagcatatgaagcacttatttctttgtgctgtccaagcaggaatattataggcatggcaatgttctttttcaaattataaaaagaatctgttacttagttgtatgtgcaaaataaccacatctatctatgcaaaaacacatatttagtgaaatgaccagagttgaaaagtactcggagaggacagtcaaggaaataccactgtattttgggtgggagggagggaaatgttaaagaatctagcattgaggtcatattgctttcgagtattggaactgagtttggaataaaccctgttgcatggcagtagacaaagacttgctaaactaaattacatgtaaatactaaaatggaaggtatttgtgttatgacaacatgatatgatgaaacatttgcctacattttagaagtaagaaaaatgtggagatgccttttgaataactaaatgatcatactgattttttttaatctcctctaactacaagagacctcaaagcccccacattttacaagtatgggaactcactcccagagaggttaaacaaattgccaaggtcattgggctagttaattgcatagccaggatttaaaatctaggttttctgatcctcattattgtgctcttttatttttcttataaggtttctactgttgaatatgtttggttttataaatgtcaatgaagcttgaatggatactgtagaaaactacttgagacactgaaaagttttcttgggggaaataaagatttatgtcagttcacaggcattggcaatgtcacatgctgccacagccttttatagtgggagataaatgtgactaggaaaatgagatagcacagaaacaggtcatctatccccaactccttcacctgcaatactgtttcctttgtccccagcactacaaaagaaaactcaagttgctagctggtaagatagatgttttgcctcctatagccaatcttttcagccagtatttttcctcctttcaactgacagcacagtcccccaccccacacaccacatacacacatacatacacaccaccactaccactaagagtgctgcctccagtttccagttctcttacaacttttgaggcgagaagataaaacttcagcatgttagaatttatttgtactgttcctaactaattgtagaccataaagccaaagaatccccactctcatgactttcacatctatctaagcaaatgcaccaagataggaaactgaagtggggtataactctttcaaagataaatgcacaagccatttttgcagggattatatataatatatatacatatatatgtctgagtaactcaaaagaatcaactgagaaaccattaaaataagtttcagaaatgcattagaaagggcttctcacagttttagtaagctaatgacctactctcccaagagagctagaatgtgaagtgtttcccaaaattatgtgacctacagtgaaatacatttggcaaactctgcttccagtgattctggagacatggaccggatctgtctagccatttaaagatggatgacctagtgggcatgtttccacatggcgcatactacatatcaacatatgtgtgttgatgccaaagaagctaaaataagttcttgtcaaaatatttatggacttgattgaagttgttagcgtatataaaaagaaaataaagctaccacatggtttttagtttttagattttttctgtcttctgtgcacatgagtgacaaccataatcttacattcaagcagcttacatgtttaacgtaatgtgtcattgtatttgataaataaaactcttgtgtttggggttgctttttatttttgaagcaacaccatatcgttatcttcaatcagattgttagagaaatatattttcctagaatcacttaggttaccaaaaactctttaagttttctagttaataaatctaaatcaaagctagattgagctaatccctttttgagtagggaaagctcatttcattcattgtgtgtggtacattatctccttgattccactttaagtattgtatgctatagcgcatttgaccctatctcttgtaatgttgaaggaagcaatataccggccaggcctggtggctcatgcctggaatcccagcactttgggaggccgaggtgggcggatcacctgaggtcaggagttcaagaccagcctggtcaacatggtgaaaccccgtctctactaaaaatacaaaaaattagctggacgtggtggcaggcgcctgtggtctcagctactcgggaggctgaggcaggagaatggcttgaacccgggaggtggaggttgcagtgagccgagatcacgccactgcactctagcctggcgacagagcaagactccgtctaaaaaaaaaaaaaaaaaaaaaagtaatatttccatgtctgatgatagcttcttgtcaagagtgttttcaggtgatcgatttaaagataacatctcagtaaatactactaccatctcgcatggcatctttgtgaggaatatattgataatctcataactactaagcactcctcactgggctggacttagcacatatcctcatttgaatgtattgtgcacagcacactctggaaaattcactcaaattctataaacctgcatacattccattaatactgcatctcaagaatgccctgtaagaaaaataggtttttgtatgagatgctttttgatgagcataactttctaaaatttgacaccctcttaaaggaaagcagagctgagccaggactgttcattgttctcctgcattgaaaagttctgatgtttaagatgctataatagaagaaagggaatgtatttccctgttaatcttctgttacaagttttccactttattttcaaaaccctaaattgttagaacctgtggagagaaataaaaactcattttcactgtgcccaagaaagaaaagaaaacatttgggtgggtttgagtcctgagaatgggaagggtcatgactccttcccttgggcaaactgttaaactatggctcccttctctataattgctttggaaatggtaacagtacaacagtactgcctgtgtatgtgcgtatgtatgttgacagttacaataaaccaataaaatgatctattttctccttatccaaggatttcctgctgcagatatttactgtgttccgaatattgatacgcccggagatgtttccaaaggactggactgttatgcgcttggttgctaacaagtaagacatttaagttgatgataattgcagctcaatgtatagaggaagaagggagtacaaaattatctttttcatttgatctcaagtttgcagttttttttttgcctctgaattaagcctttaaaaaaatgttaccacttgtttagaattactatttcctttgtatatattaacatcattcagaaatcgaacaacataatagcatatgcattgagaagttctgttcccattgaccctcttcccctaggctgtataaccacttgtatttgtttcttacatgtcctcctagtgttcctttatacagagaccagcaggtaatgtaatatacacactgttctgtataatgctcttaagaaatcctggcaatctttccaaattaatagatagaaagcctttcattcttctgtgtattttcctttacagctgaataatattgcattgaatgaccataccatagtttatttaaccaattctctgttactagaaatttgaatcatttctgatctttcttaattcttctcaacaaaatacatacatgaagcatctgctcaacactgggaataagacatgacctttgagttggacacatggagattgacgttctttttattcatccaagtggtatggccaatagagagctgaaaatactgccccgaggaaacttcagaacaaaatacaggcatttgggaggttattgacataaagtcgatattggaatctctagaagatgataaattcagtttatattaagcatatccagcatgatctgagagcaatactagaagagagaggaggcaggaaaggatattagggcagtcggaatggcaggagctgatcccggagagtacagtgtcatggatttatctgctctctccacttcctgtctccatagtctcaagatacagaatggaaaagtgttctaggaaactggcctggtcttcacttccaagcttgttatttaccctatttcattagcattgtcactctccaagcccacatttgcctgcttccccttcttcctcttttccaaacgccaacaccctcatgctcaggatgaaggttggattctctaagcatctatctgtaggccacggtcgccctgtgttttctccagatggcaagctttgatggtggtgagagctgcaggaatataggattcgattttgattatatatgctcaatatggcttctgctgcagtatacatttatagacttggaggtgttaaaatgatgtgttaaaaactttgtgaagtaacaaatagtataacatagcatattatattttacataagtacagaagcagcttttccattttgaagattgagagtgttgaaatagctctctttagaatttaacatatttagtttgatatctgtgagtagaatcaaatatctattcatttggttgtccgcatgctacagatttaggtgggagtttttgctcattcatctggccttataaccaaagagcaaacattctgggtacctaggaagggctgtgaggtaatccaaggagccagatgggaagaggtccaggctatggacatcatcatcacgcagcatcaacatttggtcattctgcctgactcatgtgcagaggaatattttggattgaattaaaatttcagtggtagaaattcaaactgaaagtaacattgacattttattccttacatatacaatttctgcttaagcttgcctaaaattgtaacaaccatgtggctttttgatattaaatactgcctctctctgccccatcgttacttcagttttaaagactttatggtcacacaaatggatagcagtctgagagtatagattctacctttgcgtaaacacacactgttcagaattttcatttacagtgttaaccaaataggaagatgattttgttagagatgagctctgtgtaatacatttaaacagaaggttactcccatagcaaacccaagaaatgtgccatcaccctttgctaaatgtggtgacttcattccattgccacccatgtgagtgctggtaggagtctggcgctgcctctccactggcaatggctggtggctgcaagtccaacctcattcatggacaggactccaggaactagagagaccactgccaagttggagcagccagtctgctgtatgttcttgctcttgcctcttctttcctctcctctcctcttttaatagtctctaaccattctcctccattcaagtcatgaaagcagatgaggtttgctttgcttcataaatgcagcatagtctgaaaattagccctctactatttgtgctttatctatgaaaaatattaacccatataatattggtagaaaagtagatttctgaaagatgttaaggacatcttaaatacgttaaagagcatacactaggaagaaaaagtttccgcttggctaaaccatgttgaagcacgttgcaggagttacatctatgtctctgaagttgaccaccttttcttccatagtttcaactttcttagacaaacattttttcagggcctctcaaagggcattttaacccaaactcccacttttattaacccagtcgtgtgcttaatacatgtcaaattgatagcaggtggctgagaagtcaccattgctctacccttgaactcaattgaattgctcatccctcaaaatgaatgttcttttatgtgttggtcctttcttcctctgttttcaagtaaattaaatgcctttaactttcatctataagctgtgttgttccaaatcttgtagcttgcctgcttggtgtgaagctctgccagagtttgtgaccagacacctggtgatttgtatggttccttgtttttttctactgcatgcctaatattgtataacatagcaagtgtgcccacttataattctgccagggcaagaagcatttcttctctttcttgtttgctgtagagctatctcatgaccccctgtaagttcctggtagatgtttctgatgacaacaactgctcaatctaagaaagaaggaacataaggaagatgaaaattaagtaccaaaaatacaggacactttgagacaagcttctctccacccccttcccatacacattgtgaaataaagtacaaaaataaagtcacagctttatacatattttcaagaagaaaaaccttataacacacttgcttactgaggaaggtaaaaactccttctctcttcagttgaaatttcaggtctttattttggttatcttgtgtgcatgttggcctcaaacatatcatgcactaaccaacttgggtttcaaatgagatctatgtagccaaaaagcgatttgttaaatcaaagtttcttagagaggttgtccattcatttactgacccacttattcagccagtattttccagtgcctgatgtgtaaaataagtactataaagacaaagagcaccgtgatatgagggtgttatgaagtgaacattgttctggactagaataggaggggtctttcatgaaggagtgaagcttgaactgaaagcttagcagggggtaacaaacagcaaaggaataatgattctatcagtaggtagcatctacaaaggccctgtggccagagtaaatgtggcacactcaaggaactgaaagactgttagtgtggctgaaatgtggggagggaaggaaccagtaaagatgaggttggtggaggaagacagaacccagatattgatatgtggagagaccaaagagaaaccagggagaaccagttaggagcttactgcagccatccaggtaagagatgttgatgatgacttggacgggcggatagcaatgaaggtagtgagaagattggttttggaaataaggatgataagacttgcaagtgactgggtgtgggtgggagagaagaaaagtaacggaaggtgttccttagatgcttggcctaagtaaaaggatgaattgtgccattcacctagttggaaaaaatggaaagaggagtagcattggggatgagagaagtgaagaattccatgttgaacataagtttgaggtgtactagatattcaagtggagatgtagaagggaaagctagacatgcttgcatggagctcagggatgatgttggggctggacatgtgcgtttgggctcctcagcatatggttaggatttgaaaccttggaactgaacaagagcactgaggaagaaagtgcagactgaaaagagaaaaagacaggactgagccctagggcatgccacattttaaaggtcaggaagtggagaggtatccagtgaagaagactgaaaaagagcagcctatgatgtaagatgagaaccagcagagtacagtatcctgtgaagaaagcatttcaagaaggaagcagtatctagagctgctgggaggttggtggtgatgtggacagacaattggtcccaggatttggcagtgtggtagatattggtgaccatgacaagtgttgtttcagtggagtggtgaaaaggaaaacctaattagagtgaataggagttgagaaactgaaaatagtaattacaggaagagttttgctgtcaaagggagcatagaaacagggctgtatctggaaggagatgtgaggactgggattccttttagaatatgggatattacagcatgttgatttactaataggcatggccctgttagtaaaagacagaaatattggtgctaaagaaaacagggataattaaaagagcaatgtccttgggcaagcagggataggattgcatgcaaggttgctaggtatgccagcccaagaactaactgctacctgtccatgacaagctttcacttaaaaataaatcttcagtgtaagcatgcagtttaattaaactgacattgttttttgtggtaagactttctcaaggagggaagcttcccgcacttagagcagcattgatctagtgcacacaaagaaaggtaggagcgtcgacagtttatccataataacaggaaggaaggtggaatatgcgccactgaccctgaaaacttgagtggtagagtagctaatctgctgagcatccattgacacagctactgttgttttgattgtgatttttttaattaagtgtagttatccttaaaggcttttactgttcagggagataatagatacttattttttatcaaaactatatattactatgctgaatgtgccaaacttgaatagttacagcaaataatgacaaaagaattgcttgcacaatccatctcctccaggtgagttgtgaggtgttggtagagagaatgaatgcatgaaggaaaggctttcttagggtttaagcctaagaggtcaaaacagaggctattgccatatgagtgattttccaccagtactgcccagtggagtactggtcaaaagagttttcagagtcactctgtgtaaatcctttcccattctttttgcttcatccacactgcgtgccccattgactgaaagcaaaatcactcctttctctgcttccctgctttagctgattctgtgccctccacttggatcagctttgcctgtctaatttcagtctgttcaaaatagctaaaaataaataaataaatgaaattaaaagttgtataagcttcacattttagagtcatctaatatggcaaacaagtataacaaagcatagactcaaatgtactcatgaggccacagtcatttaacatacacttactagtctctgcccctgtggatgcagtggtaaaaaaggccagattcccagatgccattgttctctaagttccagcccttccttgtcttctcttccatgtgtaacaccagtcctcaaaataagaaggatgaccacatgcatcagaatcacctggttgggcctggttgcaaacctcccaagccataggtagtggtaagaccctgaagtcttaagcatcctttgggtgattctcatgcatgctgaagtttgagaaccactcgtttagatgcattcccacattggttatccacgaatttcatctccccaaaatgtctttgcgttgattttttgctgccccaattaatccaccaggttgtagggaaattgctggactctaggtttagatgtccttagtttttcattgtataaacatcaatattgtcaagacccagtttatccacaaaggtatttctctcagtccatatatgatttttggagacgggcttgtgtatgagcagattatcaaattggagtaattaaaaaaaattatgggagataagctttcctggatgagagtgagagggagaaatagggttgcttgaagttatttcttaagcccaaaatgaggtggcaactggaaaaccataaagcaataactttgatttcatgtacaccagtttttcttttatacataaattttatcatgctgtgcctgtagattatgattgtcaaaaatgatcctactgcatgccttgctgtggcagtaatcagtaatttgggccacacacagtggggccgaggcgggcagatcacttaaggtcaggagttcgagaccagcctggccaacatggcaaaaccccattttaactaaaaatacaaaaattagctggcgcagtggcgggcacctgtaatcccagctacttgggaggctgagacaagagaattgcttgaatgtgggaggcagaggttgcagtgagcagagatcacaccactgcactccagcctgggtgacagggagactccgtcagaaagaaagaaagagaacagagagagagaaaaaggaggggaggggaggggaggggatgggggaggggaaggaaggaaggaaataaataaatgaataaataaatcagtaatttggctgtttgtggtagcatattgaaaatcttttttgactattgagttggagcactgagatttgcaatatccccatattcaaacactgattcatgagtaaaagaatgaaaccagagaatccacatggttttggataaattgaaacaagtaaagaaaggtccctaaacaccacaggtatccactaaaatgaaggagcaataatgtataaatgtctctggctagcttagagacctgtgtgttaggaaatgatgtcagtgatgagttaccatagaaagctctgggaactgccttgatggcttgggctgaatgttataggtatgaaagaaaagcatttgaatagtccttttaagatctttctagccctgagcagtcatatttttggaggccctactcctcatcctatcaagcactaaatagacccacatgccacattagatacaattttgctaaagaaaaaaattaaaagtattttttatatttgcttcttaattattggcttatcaagtaaaataatttaattttgattggctgtgatttctcagcgtttatgtatactataggaactgtaaaagtttaaaataatctataattttaaaattgcataaatattaaaattggacagttaatgaaagtcatcgtgtcactttctgtggacatgtgattagtcattatttttactttttattttgcaaatttcagtttggttgcataacattctttcaggtctcaatgttttcgaaagtccctgaaaggctcacaggcccaatgccctgtgcctctttctgcctaatggtaaggcagccctgataagagggtgaggtgttcaatctagaaataagaactgcaagccccatacaaatcgtcctaatattccagaagtcaggagaatgctgaaacagaatttgtgggaatatttctgattctggccactccggagccttgctcttcattgggtggttgcaaaccaacagcattagcatccgctggagcttgttagaagtgcagaatctccagtcccactccagggttgctggatcatctgcactttaactagatcaccaggtacctgttaaagtttgagaagcactgatctaaggtagagcagtggttctcagctccgggtacaccataagaatcacttgggagctttgacaatcctgatgttctgactgtagcccagaccaatcagtagtctctggcgatgtgacccagcattgtattttaaaagctcccaggtgattctagggcccggggcaggttgagagcaactgttccatagtaaggccacagagattccatgttgtttaccagcaagtgtacttcaaaaagccacaaatatattttgtgtgtttgggatccaccatgtaaataacaatttggtaatctttgccatggaataacttctctctcccttggaagattgagtttgttagctcctttctgtgacatttggcgtgatagtctaaattccagatatgtcatatttcactaacaccagaggtattgtgtctgaacgtcaatctaagctgaaactgtggaccacaaggtgatttttaatgtaaaccccaggtgtagtgggactgtgtgtatttctcgttgaacatcaaagcagaaagtttgtgcttataaccacatgttaagcatacagatttttcttctttaaacttagaagtccagtgatcttactggatgctaggcaagaacaacttccttgcctgatagcctttcattttctgatgattcagcttcagtttcatatagtaaaacttgagtaaaatactttggaacagtaatgatgtcttcagttatcattgatttttccagtgtctttgggaaattgccgcattataccatcatttgcaggtgatgtatctctttgatatgacttgcactgatgatatctgccatttaggggactgaagaaaccacaagacttctcgatctcataggtttttattatacttaaatttaataataagattcactgaaaggtacatatgacatatgtaaaatgcacacgcatgtaacagtgcctgttcatggtagagcgaatgcccatgaaatcgtggttgtcttgtttccttttcattaccttgaacttccacattcaaccatcaacttacccttgttaattacccttgttaatatttccctaccccacaagaaagctataatagtgagtttcccagcagataacaataatgaatatttatgtctttcaaagtctatatttttctaactagtaaatataatctatattagcaagataaccaaagtttgaagttgatactgtattttgttttcttttgttttttcattttacctagggtgacataaatacatcctccaattgcaaatcccatgaagagaactgaggctttaccatatcacacactcattacacatgcatctcagaaaaggtcaaagaaattttaaatatcgacaatttatatattgatcctcagtttatagtagctcaaggggtggctaatcttgctttagtataatgctgtgttaaacattaagtgaaccaattggaaatatgttcaactttaaatatttatctcctggttataaaaattagcagattttgaacaaattgcagagctctagaactaaccaagaatgctcatcaaatccttctttttaaaatctccccagcgagctacctatggctgtattggtcaggcttttcctgatttctcctgccctggagatgaccctttctctgaatgtctgtaacactgtcggtttcacacagcttcgtactgggttatagacaatttcacagtctgtaattgtttctttagtggcagtcttgtcacccttaaagagggaatctgccttctatagctcttgcatgccctctaataccttaaacaggggagaacagagagaagtctaataaatactcaatgtattctattattttttcctatctattttgtctttgggctccattttttcctctgcattttaaaaagcatggctttcttttatgataatcaaatatggaatgttgcctgtaatcctagcacttggggaggcccagacaggaggatagcttgaggtcaggatttcaagaccagcgtggtcaacagagtgagaacctgtctcagaaaaactgaaaaaccatttggctggacacagcagcatgcacctgtagacccagctacttggaaggctgaggcaggaggatcacttgagcccaggagtttgaggctgcagtgagctatgatcatgccactgcactccagcctggacaacagagcaagaccctgtctcaaaaacagaaaaatatgaaatgttatgtttgtagtaaatcattttgctttgtttggaaattaacaaaaaacattacaaaacatcaaggtgataatatatttctgtctgagccatatgaattcatagatctttcgtgtatcagtttacaaaggtcctgacttcagtgatagatttcttccccttttattgacctgttgtctcttttttgtttcaaatatgaattatttaatattgctccagatgcttactgaagaaggttttattttatcttagtaggtttttattcttgtatactaaatgattttcactaatatgaagttttcaccttgtcattttttttatcactagtgttattattacaacagttctatacctctcagatgcacttcgtaagaacttcttaaatgaaaactttgattataaggtaagcattcatttatatgactctcctgcttgggctaaaagaatcacattgtattataggaaattacctaacattttcttgggccgtattagttttaactatgaggaatattagaacagttttcattatatttgtgaacagatgaagactgttcacatagcgcttaaaaggagatcatagcgcttaaaaggagatagttttttattgttactatacattttaattcttgctcttttctgtatgatccctgtttatgacaaaggagactcaaaacatagtgttttttactttttagaaatggagtttatatgaagaaaacgtttacaaagtaaaccctttagtttcttatttctttgtcttcccattttttagaatgaattaatgaaaagaaaaaaatgaaacattggtaaggttctttaaggcagaaccctctgtatatctatgatataatgtgatatgcctgggtgcctacaaattcttgatatactatttttcaaatagcaagtgataaatagcaaacaaagatgagcagtgcctatcttggctttcttcctcaatggtggttctttgttttgggcatctttcttcttactctgttttgaataacatatttcatattaaacacttttataaaatttccttattggataataagaaaatacaaaaaaggacaaatacaataaaaaaggaattttaatagttacataatatttgtctatgtcatagcttatagtatatcaaaatttcatatttcattcttataaattactcattttatgtacattcttgtaaaataaaacttggcatatatccctaattatttctttggttctttttttgtttctggttttgttttgttttgttttgtttttgagacagagtcctgctctgttgcccaggctggaatgcagtgacgcagtctcggctcactgccacctccgcctcccaggttcaagcgattctcttgcctcagcctctagaatagctgggattacaggcacacaccaccatgcctggctaattttttttttatttttagtagtagtatggggttttgccatgttcgccaggctggccttgaactcctgacctcaggtaatctgcctgcctcagcctcccaaagtgttgggattacaggcatgagtcaccgcgcctggcccttaattatttctttggataaatatttattagtggaattgttgagtgaaaggttgtaccaattacatttgattgcttcttttcctgcagctacaccaacattagaagagattttttttctgacagataaagagaaaaatcctgtttgctttaatttacatttctcactaattattacttattgactagttactagttattgatcaaaattcatatttttgtgaattgtctattcttgacttttttttttcttttttttgttttgagacagaatctccctctgtcgcccagtctggagtgcagtggcgcaatctcggctcactgcaacctctgccccccaggttgaagcaattcttctgcctcagcctactgagtagctgggaccacaggagcgcaccaccacacctggctaatttttgtattcttaggatagacggggtttcaccatattggccaggctggtctcgaactcctgaccttgtgatccacccgcctcggcctcccaaagtgctgggattacaggcatgagccaccgcacctggactgttcttgacttttattcattattttacttagggttttattatattcttttttatttgtaagagctatttacgtataacagatactgattctgtgtcatatgtctcctggtttgttatgtctttaattttacatggtgtcagtggagaagtgtgttccttccattatgtccttttttttttttgctaagtttatttcagggaactttattcagatctctttctgattctgttttttggtataagaaaacttaaaagatttgcctgggcagggaatttttatataatgtctgaatttaaagcaattagcatatctgaagaagtgtatgcattttttacaagttctacgttaaaaggagttccaaaaatgaactcacacaggaataaagaaatccatcttatacctcatcctcttggagatactcagacatattacaagagaaaccacgcatctgtcttttagcatataccaaaaagctcgtgaaacctggaatacagctttggagcaatatacacctagataataatagtacttatttatttagttacttcttcactttagaaaattttaagcatatgtacaagtagagagaatagtataatgaacccccatgaggtacccatatccagcttcaactattatcaactcatggtcagtcttacttcaactataccctcaaccacttttgaagcaaatccaaaatactatgtcacttcacctgtcaatatgcttgtaacaccatagtattgatatatcttgttcttgttttagatctgggattcctacttttacctcgcagtcatttttataaaccagttgtgtctgcagttggagatgttcacaccttccaagaagaaaaaggtgttagaaaagtaagtatcagtgtataatcaggtgagaaatgttgcctcttaaagagtatttagttcaaatgattcataaatcagaatgcgcataactggaaatcacacagtgaagaaccagtgaccaaggggtcaagaagcagtcttttctggatgttttgatatttcaaacatgtttgcacattgttttgacctggctctttcaggattcaaaatttctatagatgcaaaaaattatgaaacagatctcttttactaaaaggtttacaccagaatttgacttagaggcatcgtgacatgtatattaaatgtctttaattaaaaactccttgccttgtaattcagaatgatagattgtatcctaaagacacacaaatacttccttgttctggaggcattgtatcaggtttggttttttgttctatttcaggtatggtgacatgcgggtaacaatgggttgtgaaattttcagcatgtggcaaaacctaggtaagtgaggaaaagagaagccacatctactatacagctcctcgctgtaccttgaagtgtacaaatgaagaaaggcaatttaccagtgacaccatgtgaaaccaaatgtctaaatcaataaacatctatagaaagtaattgacactttggcattgaatgaggttacaacaaattctttaaattggtctctaagaaaagtcaccttacctttgtgtgtttcattattaattaacgataaattttataatctagcattgctccaacattacacatatttccagcgatgaggcaacctttcagaatttggaactgtaacaactcaaaatttctagaactctgagttgaagctatgaatcataataaatttaggttaaacttcatgaaacattgacttgaacgtcactactcttaaaaacttgagaccattgtcctatatcataaagagtatagccaaaggattttaaaagcatctgcagttgctaagaaactgttggatccaattttgttaatctgctatagcagatagagtatattattccagaaaattgatggtacagatctggttgcatagaaaacagtaatatttggaaaacaaattgttttaaaattcattggcatagggtccctttctagagatttataagttatttcatttggtatgttaactatgcaggtttttagtattcatttactattactgcatcttaatgctcctctttgatttattaaaatgattgacctatttgagttgaatacgtaatgacctgaaaatatcttttctcttgggcttatccaagtacaacttggagattggaaggatttattttctgtgaatgaaaatagaaccattattgttttacttccactcatgttaacagactgatttttgaccaggatcattacagggtgatttttttttaatagggtatgtatattcctcaaatatacataacaacttgagggagccttggtatatataattaagcccagtgttcaatgcttgctggtgatttcagaaaaaataaaaaataaaaaaaaataatgaagctgggagcaatggctcatgcctgtaatcccagcactttgggagcctggagcgggcagatcacttgaggtcaggagtttgagactagcctggccaacatggtgaaaccctgtctttactaaaaatacaaaaattagccaggcgtggtgggggggtgcctgtaatctcagctacttgggaggctgaggcaggagaatcacttgaacctgggaggtggaggttgcagtgaaccaagatcgctccattgcactccatcagcctgggtgacagagtgagactctgactcaaaaaaaaaaaaaaaagagttatcatcttgaaaacaaccttcaactatgtaaggccagccagaagatatcatggtctgtctttagttgcagctcaaaaatagttttcttatttggagactgctcttcttagtcttcagtgttttcaggtttcattgattctttgtgtccttgtttttcctaaagaagatcaaggcccttgtagtgtccatattgcattcgacattaatttagcaagatgtttttgaaagaatgctgcattgaatctgtttgaatgcacttgtggttgtgtaagctcttttctgggctcaaattatgagagcaggacagattctgttcggttacaagaatgttaaaaaagaatgaccagtttctgttctagatacatctcagcattgccatctatggttatttccacataaacctgtatccaaaccataatagctatgcatttaggcccatgacccttgggctgctaaataaagctgtcacatgtaatctccctaaacatgtcactgtatacttcataaacttttatcctgtattttgtctttcttctaaaatgaaactatttctgcctctctggtttttatgttaaattgcttctctgtttttctcagagatctagagaatatggaaaatttctggagcatatcaatacctataatgcagtattttgttatactgtagcatcagcatccttggaagcttgtaagaaatgcaaaatctctcactccaccttagacctactgaaacacaatctctgggattggggcacagcagtctgttttagcaagttttccaggtgattcttatgtacttagctaaaaactgaaaagcactgctttagtttatcctctttctttgttgttacagccataaagacttagctctagcacaatcctaagacgctgttagaaaaggctcctcctttatactcaacttacagattcccagcatgacgtggttcaagcgtagggtcagcgtaaatttttacttcattccttggttgctgcattatttcccaagagttgtgtctagactttgcaaagacttcccaaatattaggtgaattttaaagtttgttgctgttgtgcaatagctagaattggaaaaaattcagaaatgttaaagcctctcttccaacatatatttttataaaatgaggagaagaataattaagtattcagagtgacattttgataccccttataggccttaagtcagcttgttacttaggaatatcaaagtacattagttatcatttggtttacttataaatatgtcatgttgagaatttgaatgctgtaagagaatttattcaggtaattataaatttgccatgttttaatgtaacagtccagtaaattcaatttgactaagtttatgaagcactggatatatgcaagtattttggaggacataagaaaaaatggtccacacctattaaaatcttagttttcaaatcttatattttaaaattttgtccaatttagtttgaactatgacaaagcttgacaaagacaacatcatcatgttttagtaaagctagtaagcttttatgatttcataaatcaagatcctcaatatttttaatagatacaaaatgcactaacttttagaaaataagatgaagggaggaaatgcccaaggccacttaatatacttttttccacttgaaactgtctagttggtctaatttagaaatacacattttgctggataatacttttaaatcagatttggtcattgatgtttacctctgaagtgttgaaattcttccatatgctagaaacatgttgtttttttccattccactgaggacacggaggggaaagacacatgtaattcagtgacttgtctgcttttaaacttaaagctgtaggattttaaaatctgatcattatatcccttagcaacctgtgagcaatttttcaaccctatgagacctagaactgcttatgtttacagtgttatttttaaccataaatcatctaacagacatttagttgtgtgtgcttgaaatattttataattctaaaattacataacaacttgtctgtagtattaaatgtgcttttataatgattatttacattaagaaagtttaacctttgttctgaattagtaaatatttggatcctttagtacatttgtagttcacacaactggaggaagcgagttctaacttctcttctgctgtcgcctcagtcttggagtttttgcaagcagggccatgagcacccatttttatgtctacaggaatgaatccgtggctctgctagttcatgcttcagccctagttctatgaggtctggttgggaacatagaaataaaatcaaaaggttttgttgtccaaagacaacaaatagtcctccacaggtcaacaaggcagggcttctcttcttcccttgtgagacagcagtagatcctggggacagaaaggctttgagctcttgcctggaactttaagtcatgctacctgtctccagtgcatacagagcactgaacacatcatcctgctcatataattaaaatttagttttaaaacattttttaattgtggtaaaatacaaataaaatgtacatcttggttgggtgcagtggctgacacctgtaatcccagcattttgggaggctgaggtgggtggatcacgtgaggtcaggagttcgagaccagcctggcaaacatgacgaaaccccgtctctgctaaaaatataaaaattagctgggtgtggtggcatatgcctgtaatcctagctacttggaaggcagaggcaggagaattgcttgaatctgggaggcagaggttgcagtgagccaagatcgcgccattgcactccagcatgggggacagagcgagactctgtctcaaaaaaaaaataaaaataaatataaataaatgtgcattctaactatttttcaggccacagctcagtgatattaagtatattcacattgcaatgcaaccatcaccaccatccatctctagaactcttttcatcttgtgaagctgaaactctatacccaataaacaataacttctcattcccctgtctccccagcccctggtactaccattctactttctgtctctatgaatttaactactctaggtacctcacgtaagtggaatcatacagaatttatctttttgtaactggcttattttgcttaacagattgtcctcaagattcattcatgttgtaatgtatcaaaattttcctttttaaggctgaataatattctgtcgtatggatataccacattttctttattcattcattcctcagtggacatttgggttgcttctgccttttgtctattgtgaatagtgctgctctgaacgtgggcatataaaatatctctgagaatctggctttcagttcttttgggtacatagccagaagtggaattgctggatcatatgggaattctattgttaattttttgaggaactgttctccacagctgctgtaacattttacattctcaccaacagaacacacacattctagtttctccattttctctccagcatttgttatttcctggttttttgacagtagtcatcctaatgggtgtgaggtggtatctcatttgcagttttggtaaaataatgtatttttagagcataaaagccaactagtgataagtaaacaccttttcttaaatatggtattcctcagcgttttcattttctaagttgaaggactaaaaaatgttctatcaagagccgtggcagaggaaggcatatattttcccccaaaactttacccgtctgtacccctacttgcaagaacagagaaaaaggttagtctttactagaatgttccagtgttggcttttatctttcttcaaggttaagtttttctttctatttttagatgaactaacattcttactaaatataaagtgagctctttgttccacatttgcaaacacagtgtcttgtaactgctgtagaaaaaaaaatcaatacttccctagcaggctgttctgtgtgcataaatataaaactccaacagtccaagtagcaggtgccctaaatacttcaaaataagaccatgtggccaacaattagaggtagagaaagtatactaaatctatggtttaaaaagaaatcatttaaatgaagtttattttgctgttgccatacatagctcaaaattgctttgctggttctgtaggaattaaattttctgtggttggagagcctgttcaggtttgcagattccgtgttcccaaagtatgttttcagcaaataagctattctcatgcattcctgcacaatgacttaaatgtaggtgtggcttctctgaccttcttaactgtcaatggaaaaaatcaggctgcagaatgtagtatatggaccttgtttgaattgtgattgaaagaaaccagctatacatgacatgttttaagaccatcaaaggaaattttaatataggctgggtttttaattaatttaaggaatttttatttcttttttaggtgtgataaaggcattagggttctatatttgtaaaatgtcctatctgttaaagatgcttacagatgtatgtacaagtagactgataacaatgtctcaggcctgctttaaagtactctagaaaaaaaatagttggggtattaggtaaaatgggaaggacaagagtcttgataatcactgaagctagatgatggatgtatggattttttttaactattttctgtgattttgtgtgcgtttgaaatttttcatattaaaaagaaatttgaagaaaatttgattgtaaaatatcataagtggaagagattttttttaagagattcaaaagtactcaagcaagtgcatgctaatatggtcttcattagagaggccaagggatgccaggctccggaaagactaaagaccaagatagtaacatagaagctctgaatctcatctaccagctcaggcatgggagaactattccggctggcaggaaattcagtttcattttgtattccctctctcttccatcccccttttttcacacatacccaaaagctgtgcaaaggtttagtgtcttacacagtgtcaaggcagcagagagagcatagctggggctctgctggggcacagcctctgtggctggactttgagcccctgcagccatctcatgaggcagggttatggaagaaatgcaagacctgttaatctcagaatttgtgagcctttgccccaacagaaattttcttcccccttttgtctttccccccactcaatttccaggacatcttggtgagctgtttagtgggtttaggctttttaaaatgacagtaagagtgattgagttcaggttgcacaggttttctaccctgataaaaataactgagggaaggaattgcaaatgctagctgctagttactggctggaattgtatgtgttgatagaatgaggaaaatatagggagagctatgaatttatatttcagtgagtttgtcagtcttgaaagtatttattctggctgggcacggtggctcacgcctgtaatcccagcactttgggaggccaaggcaggcagttaatgaggtcaggaggttaagactatcctggctaacatggtgaaaccccgtctctactaaaaatacaaaaaaaaaaaaaaaaaattagcccagcgtgttgatgggcgcctgtagtcccagatacttgggaggccgaggcaggagaatggcgtgaacccaggaggcggagcttgcagtgagctgagatcgcaccactgcattccagcctgggcaacagagcgagactctgtctcaaaaaaaaaaaaaaaaaaaaggaaaaaagaaaagaaataaaaagtttcttttgaggtattcttgctctgatgaggaaaactaagcagtcctttgggaaagacaaaagaatatctaggtcaaaaataaaggtaggaatgcaaaaggatttatgagccatgtttcttcctcacacataatgggtatggaaaagtgatttagagatagtgatgacatggctctgatgaatggaagaacaccagggtttttggtcttgcgccaatttagataaaaggacacgcacacatgtggtgtggttttaaggagcgaaaagtttaacaggcaagaaagaagaaaacagctcccttgtacagagacagaggtggggaggcttgaaacaaagagactgcatgagcagcggaaaaatgatcagttatatcagaggctgaaggaggcgatgtttgatttgcatgggcccagaggattggtttgaccaggtgtgtcattcacacagtccgcaaaaaacctggccctcccaccttagtcctttaatatgcaaatgtgggtcgccatgatgttctgaacacatggtgttatccggaggtggccatgacacttggcacaggtggtaggaatcgccatattgcccatgtcagatgaacctagtttttaatcactggcatttgcatatcaaagttttccagcctggctcttcagccgccttttctgttagagaagaaatgtttcgggcggttgctttttattgcaggaaaattttcacagagaacctttaccactactatcagcctgaaagttatttcttaataactcctgtattattccccctttaaagagacgtaaacctaactgctgttagggggtgttggatgacgattctttctggctacttcctgttgaaaaggggtgtcgtgtgggggaacagcagttgggccttctcctgaggttgatttaagggtttttggaagaatagcgtgtctgtgtttggctttgtttgcagcactgtttggagtttggttacctttaggcgaaaaaagataaattttacaagaaagtttaaaatacagagttagaatataagcattaagattaccaccattagtgggggtcctatagaccataactgacagtagagtttgacacctgtttgttacaccagtggattgcaataccgttttgtttttactagatgtcgctgtacattaccagaaacgttaacataaaagtaacatttttcttgaggaaaagcatatatttcccccttgacttgccattagagaggaattttaggcttaggctatttttataacttgcaatatgatcgggagagatatgttattgggtggctaaaataattttagcattaatttgacaatttattaatttttttatagcttccacagactacaacatacttaaactttctgacttgttctaaacatctttccttcaaataaccagttgttgttgttgctgtttttttttttttaggacaagtatttaccatacaaaatctttccttatataaaatcttttttaaataacagtcttttcctagcttaaagtgcattgtattatcaacctttagtaaaaaagtcgtattaaacttagtgatagtaaaacttttatacttactttttatccctattacttttgctataaccaaaacaaccttgagtaaatctttcctgcaattattaatcctgttataaggatgataatcaggcaaaatattacagcaattagaattttacaaccagaattccacattgtgggtgacacagtgtatagttttattgcaattagtagtgggatgataacagtttccacaagagtggcatagtaaataatttccatataaaattatttctttacttgccaagatgtaatcttctttgtgggtttataaagttacaaatgcaatcccatgtataattaaaagttgcttgcaaatatgagttaaaaagaagttttaatatttggtggtgaactttgagaggaaaggttaggtaggagtgggattaagatgaatagcccttacttagttacttattttttatgagttttagcttaagattttctgtttcttcacatttatgtttaggacattcctctgggctgtcaggggttgctcccttagctttttagactttgacttgaatgtgatgtatccagaagttggtttctgtaacttttattgccaaaggggttgaaagaacagtgtagggccctttccagcttggcttatggaaggagagagagatgagagtttttgctaatactaaatgtcttgggtcgaataaaggtggctctgttttctggggttgggcttctgctagttgtgtcaatttttgttggaagtaataggttacatgcttaaccaatttagaggttttctgcctgaaaacaatatctgagcacattgataagttttatcctttcccaagtgaaaagcttggtgaaagattttaaggactttccattggctggagcctggcaaatggagtttgccattatttgaccatagcaattctgagggctggaaagtatgcccttgagaagtggcctcttttatttctgtagggaatactgaagtttaatttcttttatggagccttcctagattagaagcagtttgaagcatgttgatgccttgaggcttccttgcctttgacctagctgcctgattagccaatttatttcctttggctacctcacttgtttctttctgatgtcccctgcaatgcattcttgctatttcttgtggaagaaaaactgaggataataacctattgattttctggtgatattttataggagagtcattagtggtaagagaatatctttcctttcaaatggcaacatgagcatggaaaattaggaaagcatacttggagttagtataaatgttagctacctttcctttgcttaattcaagtgctcttgtaagagctattagcttagcgaattgagcgctgtgcctgggaagagatgttatttagagtgactactgcttatcctccttttgtatttcttgttttactggctgttagctaagagctttccctagaggacagtaattctgccacagtatgtggggtgtaaacagttaaattatttcctagggttaacttggaggctttttttgcctagtagagctattatgacagtggcttggaagcatgtgtatataataggtccttttaactgcaaccaaggttgagaaaaatattggattagagtttcttctgagacactccttacagtcttgctatgggaagaggggaggcctggattagagaggagaaaagagagagactggctttagtgtttagaaggaggtttactttcccttctttaattttcagcattactcagggctcttgtgctataatggcagtttgagctgctggagccagggcttgagccctgggacccatcagtcctgctggaccatctgtgagactggtcctgaacccagtgacctccacctctgggggcagttctgtctccagtggtctctgccacaggctggacagggttgaggtggctttttcttgctgcctgggccttcctttttaaaattccctggcctgctaccctgatagcaactagcagatgcacctcggggatcctggactttgcaagcctgcaaagctgctgctagagcctttgtccttctcctgagatttttctttttcctttgggcctccttctggtccctattataaaagaccaaagtggtcaccattaggagactttctaaggtgctatttggtcctatagcttgcttttgtagtttccttttaatattgggagctgcctgtgtaataaacttgttttttagaatgagccatcccttgattgaattaggggtaaggggttgtattctattagcgtctttctcagccttttcataaaggctacaggattcttatctgtcttttggtctattatagacagtttagagtaattaagaggtttggccctcattttccatggccttctaaaatcatattaaaaagtgcttttttcatttatttcctgagtttttggggtttcagtcagagttgtttactggaactgcttccctcccagttgggaatggtgtttctactatttttttgctttccttatttgctttcttcccttttggtgtattataggaaatatattgctcacctctgaaattctctgttgcttgcacagctgcttgctttttagctgccattagggtctggtttaggagcagtataacatccttccatgtgaggtgaaatacatgagttaaattttggaaaacttctatatacctattagggtcttcggaaaatcagcctatgttttcctttatttgcctaaggttctataatgagaagggaacttaaaagggccccaaataagggggatttttagatggttcccctgaaagttgcttttttaattttggggaactttttccctggctctgtctgataagattgctaaaagagctgggttgatcttacagcacttgcaaaggtttggtaaaaatgccctgtccttgtgcaaaagaaaatgagttgcttttctctttaacgttctcaggttaaggaagttctggtgttttagagtgcacttcagaggggtgtaaactgaagataatttattacccatttagaaaaagaagtgagaataaaagcatttttttagtcttcttcgtttctgtatgacccagagtggaggagaagacagggagcattctccgactgttttccctttctggtttttggatctcggcaccatgttaaacgtgctgcccatggttgaaggcatggtgctgcaagccatggaactggatgaactaagtggtgggactaaccacgcttacccacgcaaccttagcttgtccaccttgtatgattccccctttcacttcctaaatttgtgatttgcctggctttctaaaaaatggatcttggagagcctgtgttgcctttgggcaaggcttctttaacagaggaaacgtgctagattgcctgctattatggcccatgctaaagcacttacctttaaaaaaaaatggttctagttaacttccgaacttaaaatccccttactaattaagtaacattttaataggaaacactataggtgccttagaagaacgtagaaaccaaatggccatcttttttgctgatgggaaaatattgagactaacatttgactacagaagatatcttactcccaactgctgaaggcagaactttcctcatcacagaagtagcagtagaaaaacttaaaaaggaaaagttgcaaagctgcaatgtactgcagagaactagcaatgtgtcctgtattagtgagaaacaattaagttatgtttgttgaaaccttgagagagaggaaaggactgcatgactttggtgatgtaaagggactttcagatgggcacaggtctgagggttgtgtttggagctgtatgtctggctagataatcaaagcactttgagcacttgaactcacactgacactcaagccaaggtaaaatcagcccgcctcctgtgatagagggacactctctgatggtgtaaggtctctggggagcacccattcccaagaatgggggacctcccagatgccccagggtgcagctaaaggagggggtgaacatcttgccagcagagatcatgaggaccttggtcctctagggcactcaagatacaggccaagggcaaggagatccagttcctagtggaggcagatatctgagacagccttaggacagcatcacagactgtggttgagaagttgatacaaagccctctatgtatcttcaagatagaaggtagttcaaaccagtggcctctgtcaagggtaccttttccaggaggatggaaattccaagggaattcaggcttatgaaggtcttaggcacagagcttcccatctcttccttatcaccatattggtctgcagagggtaggcaggaccctgttcagagggcctttgacagagggtactggtgcttacattctaactactatagcagagctccactaattacatgtgacaaagtcgaagatcaaaacaccaaagtcatgttaaagaaatacattgtctctgggagctaggaagcccacaggtggatctggcttcaggcatgatcattttcaagaggacacgcatcagggctggttgtttcccagctctcctttgttctgtgtgttgactttaacctctgtgtactcttaggctttctccactctgtgggaaaatggcttccatcagcttcaagcctatttcttcttttcaaagtcccttttagaatgtcgctcagagccacagattgttcctgctgggtgatgtgcctatcatgaaccggtccctggggccagggatgaagctgggttttgtttgtttgtttgtttgtttgtttagagaagtccttatgtttctcagctgtacttcattttgggcttccgtgatcctcctgcctcagcctcccaagtagctgggactaccaggagtgccactgtacccagctgaagctggttatttgacaaggcccaggtgatatgcctactcttgaggctggggcagtagagtgaggactccccaaccccatcccaaccacatggaatgatggattaatatgggacaaatgacacatgtgattgcactctcccatcagaaagataaaaaaaatccctcttcctttccacccctcaagttcctaaatggctttcttgcatttactctcagacaactttaagaggagaaattggaaatccttgccagctcaccttgtctctctctctttttactttgtaattcattgtaatcaggttttcacttgcattactcttctgccacatctaaaggcctgtagtgagtcccattcctaggagagtgattaagaattcattgtagagccagctagctgggtgacttcgggcaagttgcctaacttcccaggattttagctgccttctctgtaagtgggaggttgatagttcctaccacctagagttgttgtagggagcaaatgaaattacacatgtaaagcacccagagcagtgcctgccatagggaatgcttacaagtaacagatgttattaaggagtcactgcatttgacaaccttgcccctctttgcttctgaaagccttctcttctctatcatttcccatcaccactttcccacttctccttccctaccctgcaccatgtctctttagtcagctcctctcttgtcccggcacatgtgtgcccaggctgtcctgttccttttgttcctcttatattttgccacaggtttcccccatgtgatttcattcaccctgtttatcactgaaagttctgaaatagtacatctccagcccaggcctctgtctcgagccccagaccaggctctttgacacctgctagagtattcagtgttagaagtacctcaaacatgccccaaactgaagttgtgatcttgccttccatcttaagttggctcctgtttctataaatttgatatcatttaatagcagtgtttactctcactcatgctcttgccccttttctctattaccatggctgctgcttttgaaccaatctttgtcatatttacttggataacctacttggccctccagcatctgtgtccccactacagcccatcttccacactctcccagttatttttatacaaaataaagctctaattggccaccaccactgacagctgaactacccaactacctcttccactcagcttagcttacaaaccaagccaccctcattgccagcacatccctcatccaaccctgacccctgccacactgaacttctgagcgtgacacaccatgcctggctaactttttgtatttttttacagatgaggttgcaccatgttgcccaggctggtcttgaactcctgggctcaagcgattctcctgccttggcctcccaaagtgctgggactgcaggcgttgaaccactgcaccaggccctttgttttttcttgatactagatttatagcttagcaatagcccaaatacccattgtgattagctatttacaagtatttttcctaatacagtgtttaaaatacactagacattcttatttcttgagtcactgaatgaatagattaatgactgaatgagttaataaaatggaaatacagtaaacacatacaatatacaataaggtacatttttatgatcttgacattctccaaacttcccaaacaattaaatgaatactttgttccttatcaaaacatgtacaagaaagaagtaagcactactgctttgtctctctttgtgtttatagtaatttcaatacttaaaaattcaaaccattgctttgactgctgtaatgccttgttgaggaaagttgatgtatagagacagaagataccatgacctctctggcttatagactgtggggaagtttttctaaattctcttctctcacactggtagcatatgcagcattgcaacatggcccttcaaatctaaaatatttagctgtgtgcagtaacaggtacccttccgtgtcattgagagagggaggaaagttttatcatgacagaaatgctcatactctgaggatataatagagagtgaatacttgagggtagaattaatcaaacaactcttcttgatgctggatattttagcctaaaggaaaatataatacatgagtttagcttttaatgtttcaacagcttcactgattgtccagaagtcattgtgtgcccactttcctcatgtgttcatctattgccagtgttactttctgtgccaagatatgaaaaacttgctattgacttggtcatgctcttgccaacacctcatagcactgaaaataaggcgattatccagagatgggggcccaccttccaaagacagtggaggtttcccaaggcacttccaatcacaaaaaacagtgaattcacaaacatccacatgttttcccagctctcatctcagtcatcattttagctgctccccagattctttcatattcatgttacttaaaaaaaaccctgtaagccaggcgcagcggctcacgcctgtaaacccagcactttgggaggctgaggcgggtggatcacctgaggtcaggagttcaagaccagcctgggcaacatggtaaaaccccgtctctactaaaaatacaaaaattagctgggcgtggtggtgcgtgcctgtaaccctagctactcaggaggctgaggcaggagaatcacttgagcctgggaggcagaggttgcagtgagccgagattgtgccattgcactccagcctgggcgacagagtgagactctgtctcaataacaacaacaacaacaacaaaaaccctctaaagtcatttatactacctatgcactgtgaatctacagtgtcactggaaaattaccttcctttatgaagccagctatctttctgctcagcctcccaacttgtaaattctaagtggatgctctcagtagcatgtgctttcagccatgatgctgaaggttagctcttgagtgtgtttttcatagcatgcaatagtcatattatagaactagaaacttatgagatttaacaaagatgattagcgtaatagacttaacactcaccagcataatagacttaaaactcacctgctacatgaaatcatctgtgtccataccattccccaccttcctttcctctgaattatcaataccataccttttagcacttggtaaaacaccattgtgggttcactattgttacattttagtcttttcagaaaatgtttatattcttttggggggaccactatttaaatttttatgtaagttgtgtatttattctgttaagaaaaaacacaaggggcccagcctggtggctcatgcttgtaatcccagcactttgggaggccgaggcgggtggatggcttgagcccaggaattcaaggcaatgttgtgagactccatctctattttttaaaaaacaggctgggcgcgatagctcatgcctgtaatcctagcactttgggaggccaagctgggcggatcacatgaggtcaggagtttgataccagcctggccaacatggtgaaaccccatctctactaaaatacaaaaattagctggccatggtgtcatgtgcctgtaaatcccagctacccaggaggctgagacaggagatgtgcttcagcctgggaggcagaggtagcagtgagctgtttgtgtcactgcactccagcctgggtgacagagcaagactccatgtcaaaaaaaaaacaaaaaaaacagacactcgagaaaaattatatcatagagataagaaccacctagccaccttttttcatataaaaaaatcacccgtaatctcaccatccagagataacctctgtggttaacattagggatataatactctagactaagatatatgtgtgtgtgtgtgtgtgtgtgtgtgtgtattttttaaattaaaaatattcctatacatactgtattgcacttgcttttttgcttaattatattgaaaaacttcacctatgttatctttcttcagccttatgttaaatgatcacataaaaattttaatgtgtgcatatacaataatgtacataaccaattcctgatgatttattttatatatatatatatatatatatatatataattttttttttttgagacagagtcttgctctgtcacccaggctagagtgcagtggcacgatcttggctcactgcaagctccgcctcccgggttcatgccattctcctgcctcagcctcccaagtagctgggactacaggcacccaccaccccgcccggctaattgtttgtatttttagtagagatggggtttcaccgtgttagccaggatggtctcgatctcctgacctcgtgatctgcagcctcagcctcccaaagtgctgggattacaggcgtgagccactgcacccagccgatttatataatttttaattgtatctcatgggttattatattttcttgcttgaggagacgactataattgaatatatttctagcaatagttttaaacaaattttatgatattaatttctgaaatcatattaagattgaatatattgaaactcaaatatttttctcactttaggagagcacaagcttcattttatccctgccctgattggccccttcctagaagtgaccttgataccccagccagatcttcggaatgtcatgattccaatttttcatgatatgatggactgggagcagaggcggagtggcaactttaaacaggtaggcagaagtgctcctcagaagagttggaagagtttcagctctcctgaagcatctgtgaacttctggattcaactccaacttgggaaatgaacactgggtcagcagacctagattccagcctggcctatccactcccaagccacacagccgtggatacttctcagatcctgtgttgtcctgagccttcagtgaagccctgaaaaccatttgattccttttcagctgaaaaattttgtgatttcccagatctgtatttaagaacttgcagagactttatttgcacccagttggacacagagcagaagaatcagagagttaatgattaaactcattgagctctcagtggtctgcacattgtatttggcaaatggcttagctttgagcatttgatttacagtatgttttattgctctttgcttgaagcattgagaattaatttaaaggagaaagctgtggaaattcttacagaggaaattccaagggaatgagcttaccatttctcattgacataggttctaatagttatactccagttttgggaaaacaggcttattacaaaaccagatctctgaaggaattcactgcttttgctctgccaggtccttcaatttggagatagtaggcctactgtctgttcacacagtcatggcacaaacctgtgtgcccacagggtttgacccttcctcatgtttctccagaagaagcctccctcaaatctcaggaatggttgtcaaccagtcaagcaatctgactgcagacatggaaccctcctattgccaaaagcatgggtgtttcacctgtatcggtatacacatttattttcaagaaagctaatagatgaatgaaagactatttaaaaattgtacttaggaaagaaaaacccactttccttcccccttgtctttatctcttgattgaaatttggtttaaaggaataataattgggcttagtcttttgacaaagtcaaatattcctcccagtccctaatcgttttaactctctctggccatagagaagtttttcattttctgtctcttctgcctcagatagacatagataaagggatatttttccattcctgatattcaagttccaaaggatttacatcctggaaaatataaatgttttgactacagttttcaggaaatatgtcctttctctctcttgctgcttattgctgacttagactattgctatggatctaccatctgtacgtgggtaaggcaagttctcaacttcagcaaagatttagtgcaacctcaaactgttttgagaaagaaaatagatataaaacacatcaaagatttaaattaatgtatgtggatatgttagtttcctgatgtccttatatatagtgatgtttaaaaaaaagaaaaaagaaacaggacttgccagttttttagctcctaaaaaagaattcaaacgtttaaactgggctgcaagcatttgtgtttgaatcaacaaatagatagatgtctttggcagcagtaaacgctacccagccaggagtgtgaagtcatgtaactctatctagattagtcccttagaattccaaagggttgcctgctattaaccgtagctgataatgtcactttcacaaaatttaccatggctttttccttggcacaaagaaatacgttttaacttgcctagaaatcctacttgtgaaggggaggaaagagaataatagttgggtatgtttcaggtggaagccaagctaattgacaaactggatagcctgatgtcagaaggcaaaggtgacgaaacataccgcgagctcttcaacagtatgtgagtaatatgtttatctcaagttgattccattctgggggatttggtgtcagtactgagcctctctgcaccacggtagctgagagctgcaaagacagcttaggtctcacaggagggctttgtctttgtggagtgtgaaataaaggataattgcctaactctggcgaatggatcttataatgttgatgattaggcatgtcttcctgttttaatctctgattaggacaggttgcatatgttacataacaaatctccctcttttcatgcctgataattttaaaaccattcctgcaagataatgattttaagtggggttataagtgggagaggagaaaaggggtgtgattgtaatgtttgtgtgcactgctttccaaagcaagatactgatgctgatttgctgttggaaaattaacctagtttgcatctgttcttcaacacctgatttaattaattaatactgattgttcgctcagcattaattgcttcctaaatgctttttattagaatatctcagaagcaaatcacttttagtaaattctgtgttttggatttgtatggaagatagagaaataatggaatgctgtaaagagactttaaggttgccctacccatagaatctgatcatagccacaggatgaattgcttgtaccaagtattcatgcgttgtgtttaaatggccagaagatacagtgagaatgttttagtgctttgggatttcacttctggcacttgttttctctacagcttcctatggatcttagtcattttcaaatctaacatatgtgcaaagtatttctttttgaaagaagaatttgcttattgtgcttgaaaaatgtttgcagttctttcagaagtgcaaaataatgcagtaacacatttttttctatgacaaaatatattcgtgtttgtatttatgcccaagtatcacctaaaactaaatatcagtgctttagtattgatggccaggtccaaaactttatgatcatgaatttacaacagtagaaacattaatatataggcttgaagaatataattagtgactaataggttagatagatttcagcatgcctgattaaaaattatcttgaagcttttaagaaaattacattaaaaggaaaagccaagaagggtatagagatttcctgtggtagtggtgggtgataaaatatattctttgtactggattctgaacagtatcatttttttctgatatggtaattaaatgagaggttttcataattattcaccaagacctcattcattctagtgtacacagcttcagtcttttatggcagcttggagtttagcaagaattctgattaaaatctcatgcagtataataaattgcttttgaaaactgctctcatttcagttactagtccttggtttgaacaaagaaccaaaatgagaaagcactcagtgaaatgaatctcttgagatttgtgattaattatttataacaaattcacaagattaataaatactgacatagttctttagtgcctcttatctactttaataaaggcttgataatatgcaatttcagttgctcatgtataaatatgactttgaaatagaagatgtacctcgacatgagaatcaaaccaataattaaaatattaagcctctataatcaggactattttaaggtacctgattcattcaatagagatttttatacttttgttgatttttaggatattactagaaatgctactataaataatttcctttcatgcttttacgatcagcatattgggaataaatcaaatcaaaagtgatacttaagtgtcattactacctgagcacaagaaagaaggcgtaaatattactttatttcaggaaacaataaattgcttttttggcaacagaaatcacaatgaattagtataatcacaatgggtcactgcacacattatgaattaggaacacatgccgttatatggtacaaattctcatttgttacgtgtaattcatgtctaaaacctcttaaaatttgttctgaagctgaaaagctgtaagtagttcactgcttcctaaattgtagtgcttgccaaaatggaccccttggagtaagactttaaatttgtctagtaccttccttgctaagaactcaactcatctttccctaagcccaaacattatcttcattaatgcatactacatctttgtgaaacttatttcataaagatgtattcattttgataacactgaaattctagattatagacaccaacatgcaatatccagaatagagtatcacaactaaattctgcttcccctggctccacctgattcgctcattccgctttatctattgggcactccccagggctggggatccagcagtgactgtgctgtggaagcatacagtaggtctacctacagtcttgggggctctaaaggggctttccagaagaagtaacattcatctcaggtatttcttagtctttcgctctgccttctcctatgcagttctaaataattcaataagactccacattatttcaaagatttttagtgatcacacatttaattaccatttggagacagagaattcactatgtgacaccataccttacatctctaactctactctttggattaaaaagagcatgcacagacacaggtgttatatattagagtgatgacttctacgtaaccccattatgataccgagagagggagattgagggtgaaatccccgacacacacacagatttctttcatagagtgaaaacctggtgagcagagtcatccctgcagggccatggcttgtcttgcttcccagggttaggaatttctattgcatagaacagagcagccttatcaattagcaatgagaaaccccctttcactgttatcagggttccctagctcaatgtgggcacatgggcattattatagagtaaatgaaaatacccactctcacccgggttacctagaaagactcttctcttcttgatgatagcctctctttctcagtttgtatcaggtaaacagggaaatggcaagattcccaagagagggaacaaggctggctgagcacacagatgatctgggttttagactcagtcctaacatttggtcttgagttagtcaaggaaacaggttgtgcataactttgcctcttcttacaagaggattatgtagctcttactgcatcagaagtctgtgcaaattaatgaaacttatgcccataaaagaagtctccatgtatttttagaattattacctaacttgagttctttgtttttcagcctctaaagtatgaggtgtaggctgtcacggggaaatttctacatcattccgcattgctttttggcaggcagattttcatttgagttcaatacaatttgcaatttaagcctgaaagaggtgctgttcagaggtttttaaaagaaaacacattttaaacaaactaggggaccttcgcttgcaggactggtcagggcagattccatcccttccatatgcagtttccactcttaacctaagaaacagtttagaataaaccagaaaaacaggatgagggatgcacaggaaacacaggaggagacaagacagaaggctgggcactagaatgccaataacaagagaaagaggtaggggatgatggagagaaaacttgggagagaacatagccacagacaagagaaagctttgacaaaacagctttcttcttgaatgtttatttttgaactaagtacatatatgatatgcttagactgtacttgtaagaaatgttttctctcttattcctgaaactaagatgaaagacaaataagattttagacagaaatggcaatcattaaatttcaaggggtagggaagtatccacatattgccatgcttaatgttcttgcttttatcttttgggggaagttcaatcataaagcctttgccaagtacactgttaatttgctgagaggtgggagtgaaagtgacacagattgtaattatcatgattgttattattttgtgtttacatagtacctgtgctccaaggtgcttaggattaggggaaatgtaggaggagagatgtggttcagtacttgtcatcaatctgctgtaacaaccacatggaaaatcctctgtgattagtgacaaaatgaatgaaactgttgagtgagtgcacagatagtacaatatgtattgagtgggcaaatgttaagtgaaaggaaaaaacgcaaaacgtcataccagctgtacaaggattttcctgtagcagttgcattgcagtaaaattgcttggatgaagatgcattccactgagaggtaggaaaatatttttatgtgaataaagcaagatcttgcttaaaagtaaacttggaggcactcctgtttttgctttttgcagtgttatttgatgtggtaagacgcaagcctctgttagtgtaagggagaagctaggaaaaaatgtctttgagctgtgagatgcttgtatattttgaaaatatgattatatgcatgtgtttgtattttatgacttggataatctgaaaatcaatttgctttgtcaatgcttcctggattagaattccactatttggtccctatcctaggtaagacattgtttgcaaattgtgctacttgtgagatgttgcagtggttgctaaggcatttaaggtactgatgaaagtaaagtggttgtcatggtgactgataaaaataaatgttgaaaatgccccgggttctttcttttccagtctactaaagaaaattgagcgggaaacatggcgggaaagtggcgtttcattaattgctactgtaactcgtctaatggagaggttgttagattacaggtaagccaagtcgcatgtttttctgaactccagttcatgctgaactccagttagaaaatcaaatagaatacaatcaacgttccactcttgtgaatcactcaattgattatcagaccatggaacctggtatactaagataatgaacttctaaccagctggttcagagctgttaatttgagcttttgtttgttttttgttgctttgttttgttttttgatagttctttcaaagtcttggtgaattgagaggattctcggagtccctgagagttctcaaaaaaaaaaaaaatctttattttggtatttagacttagcccctagaaccagtagaaccaatccattttagggtgaaaacaatgtaatggagaattgtacaatcatgctattctcttaaatattctcttaaaaaggggacgtgggtgagatgaaactcacagtgtcaccttccatagacctatgttttttatttttatattatctaaactgttaaagtagttaatcccacttaaatacatggtagtttggttttattttaggaatgaaaccctcattctcattgttaatggccaggcttaccagccacttctcaccctactgtaggaagtgtacaataacacattttcactcctctaacttcctgagcccatgtccattgagagggagcataatcttgacatggcaatgaaattcttaacagaagctgatgctcaggagtctctgactccccagattccctagagattagattatcagtccttggaacatgtatctaaatgaacgaacgcttgcaatgcaaattgcctctggtccctaaaagtggcttctttttttttttttttctttctttctttctttttttcccccaaaaagaacaaactgtgtttgcccctaggaaggaagttctgagttctgactattgctttttgtttttagggactgcatgaaaatgggagaggtagatggcaaaaagattggctgcacagttagccttctggttagtaaactattcccctttttctccttttctcctaatacttgtatttttttcccagaaatactatgttttgtttgtgtttaatctgcaatgtgatgtttcttagaagagttatttttaaatttacaagtgtttttaagagaagcatagtgagctgcaggttaaattaaagtccaggaaatcctcagtcccagacattacaaggtgcatcccctgcattccccacagccctaataggagacccgtgtgggatcccagagtgatgccattgggttccccggttgcactacttcaccctcctagagtcttgttgctgtcctagcaaaaagcactgtatcccctgttagaggtctttctactttgtgtagcaatttctttctgttcttttcctttctcacagagtgatatgcagtccacattttgataaatattagtgatctcttcttttgtgaacaaatgacagttttctatttaacaccctaatttttactctagcttttttgcaaattgaattcataatagcacttttgttaaggtttgctttgtaactaggatgaccaagcaggacatttttgagagtaaaattaaacattctgtaaggataacaggctaatccaaagctgtcctgggcaagccaacatttatataaaatgtcacataactaactattaaatagaatggtattcttaccacagagcaaaggagtggccctacatttagatgtttatttgtcatattttaatgtaagtcaaattaatgttttggataagttccttcaatcagatctgaagtacaggaaaatataaaatacaagaaaagtctagttctatatttgtgaatctcatggtttctttttcttatattttgtagaataaatgaatcctcgccatctattacattctaagttcttgcacagtcattcttatccttactctgatcatttgagttcctcacatgccatatagttctctatttgcttgcaccttgaaattcttttgcccctactttgattttgtcttttcttagctcatcagtttctttttgttttgttttgttttgtattactttgtttactcctgtcacagttcgtcttcaaagctcagggcttctgctttcttgtgactgtcttttcatctattttcctcatgtcttgctgtactgcttctcatctctgagcctatgatggtatccgtctttatcacacccactgcctcctccacatttttaatctaattgttacatctccacctccaatatcagtccctaaaaatagtgagacctaagcatcctctatcaggccacatcttgttcactttcttccataatgttttcattagacccaacggtaacctgcaggccattagcccacgctcactgggtcagaccattgacctctgctctcagtactcatttctaacttgaacatagtcattccctctcttaaatttcctagttgattctccagtttctcacctgcttttgccagcctctcatcacagtgaagaccctcagcctgagtttctcccacattcgtgcttgtatgtcagtgttgggagaaaagctaagtgcttgataagctttaggtcttctctgtcttcttaactctggttctacctcaactccaggcacaaagtcccataaataacctcaaagcctttacctttccccaaagtaatcctctccattcttccatcttctttctcaagtaccttccatttggagatgagcaaataaatatagaccttatgttcatttccacaattggtataaaagaagagatcacttccttggatgaaagaattaatactctgcctttaatgtatttactctagtctcccagtaggaatacacctgagatttaatatagtataatcagtagccccattactaaccacttgagacattatcctgatagctttgcactgaccaagaatagtccttctagaaaattttaacactttgaaagctctacttatttcaaactagcacaagaatacttattaaagaagcaaatctatcactttgaagctaatctttttagcctctactccacatggaaggttcttgattttttctagtagcaatgtggttctcttcatttactcacttcctcttagagacttctcttaactctttgaaaaagtcaattccagattgtcttcaggagagctgtgacatcctttacaagatcggggttaaattggttttaaaaaagtaatatttgacatgactaatactaggaaatgtaattattgttttgttctttgtgtcacacactttgtcagacatttggaagattatcatctgctgactggaggtatttttttaagagaactatttatttagagtgattgcttgttttgttctcaaagctgcttcttaccagaaagctattagagcaaatcatcctttagtcatataaaaacctgctgtggagttgttagacttgtgtttatgatacaacaattcttgctaattaaaatgattttggttataataagagagacgtgaatagcattatttattgagctttttaaagaatgccaagatctacaggagacaagaataaaagagggaggataatggtataaattgaaaaaaaaatttatgatgcatttgacttaatatcagtgtctcaaagttagaagagtcctcagactgaagaatggacacctgttaggtaatgggcggaaagtacatttgatagcagatcctcaggcttcaagcccaagtaccatttcaacagccacatttgctagatcggtccattattaccaaagccctgtctactaatcagctttaaaaagtttttagaattcctggcctttcctcttagaaaagcctatcactcctccaagtcaacagatttattccctcatcaccgatttccccttcttccacacaccaactagcatcaattaaaacagtaacaataagtagtaatagtagttcaagtgtctccagcagagatttcataatgcacaatgatttgttcactaaacatgtcttgtttggagactcacaacattatgcttttactagaatccaacttcatttacattcacttttatgttgaataagttcagtgaggactcatgtgctttataatgtggtgaagaagtagctttggatgcttatcagtatgcctttaaaatgccagcctgggccaggatcagtggctcatgcctgatcccagtggcatcagcactttgggaggccgaggcaggtggatcagttgaggtcaggagttcgagactagcctgggcatcatggcaaaaccccatctctactaaaaattcttagctgggtgtggtgatgcacacctgtaatcccagctactcaggaggctgaggcaggagaatcacttgaactcggaaggcggaggttgcagtcagctgagattgcaccactgcactccagcctgggtgacagagtgagactctgtctaaaaataaaatagccaacataatttgtccaggtaagtaaaagttgagttttggtaaaaacattttagagatatttcctaagatctaaatacttcttaggaaacaaaatattttcaataaacatgtttctgtaataataatttgaaataaaatctcttatttgtccctttatgttttggacataaactggaaacatttgaagtccaacgcataggaaatgcagaataacatcttaaaaataaagagcctttttatttaccctctttcccattcttttacattgcttttactcatccttacctgtatgtcttagagatttttgctttttattttttttttttagagatttttatttttatttttttagacggagtctttctctgtcaccaggctgcagtgcagtggcatgatcttggctcactgcagcctccacctcctgggttcaagcgattctcctgcctcagcctcccaagtagctgggattacaggtgtgtgccaccacacccagctaatttttgtatttttagtagagatggggtttcaccatgttggccaggatggtttcaatctcttgacctcgtgatctgtccacctcgtcctcccaaagtgctgggattacaggcatgagccaccgtgcccagctgagacttttttctttagagcaaaatagctttgaaatttaaaatgaaagaaactgtcctttgagtatcaatcggccaagttaaaaaatggattaatctgttacgtatttttaatattttttagttgaacaggctgattgttcattgacatttaaactaacaaaaaatcataaaaagtaaagaaatgtgaatcagggataaaaacccaagaaaccaacttatccagtaattgctaggaaatgactgacactgtcactgagccaccttatttcatttttagagatatttacatggaaaaatgaatccgttctcttggctccagacatggaactttagcagagtaaaaggcagataattgtaggccagattgttgaggaactatccatacctgtactctttttttacagaacttctataagactgaactgaacaaggaggagatgtatatacgctacattcacaaactctatgatctgcatctcaaagcacagaactttacaggtaattctgtcttttggctcagattgggaagggagctgatgtattaatcatgatcattcctccgctttttgtaattagagtggaaagactcaagcatttctactttaaaattaaaatttatttttaattggatatatatttctgcagattctatatatatcatatacatgatacatacatgtaggttgtttgactatttctctttgcatactttttcagaggttgctctggggattacaaaatacatacataacttcttacagtctgcttatagttaggattttaccacttcaagtttgtattagtctgttttcacactgctgataaagacatacctgagactgggtaatttataaagaaaaagaggtttaattgacttacagttccacgtggctggggaggcctcacaatcatggtgaaaggcaaaagacacatcttacatggcggcagacaagagagagtttgtgtagggaaactctcccttataaaagcatcagatcttgtgacacttattcactattatgagagcagcatgggaaagaccctcccccatgattcaattacctcccaccttgtccctcccatgacatatgggagttgtggcagctacaattgaagatgagatttgggtggggacacagccaaaccatatcaaagttaaatgtgggaattttacaactatataggtctcattatcctccccactgtatgttgtagttgccacatgtattacatctacatacattgaaagtcgcatcagatggtgtcataatttttgcctttcaatagtcagacctattttaatgaatttaagaggataaaaatactttatttactcagatgtttaccatttctattattctttcttcattcatgaagttcccaggttccttctgttataatatttttgttgagcctgaagatcttgttttagtatttcttttaaagcagatccagtggtgaagaatcttctaagttttccttcatctaagaatgtctttatttcacctttatccctgaaggatatgtttactggatacagtattgtaggtgaacagttcttttgtgtctgtactttaaaaatataattccactgtgttctgaccttcatggtgtctagcaagaaatatgcagtcatttaaattactcaagtacaaggccagacgtggtggctcatgcctgtaatcccagcacttagggaggccaaggcaggtggatcgcttgagcccaggagttacagaccagcgtggaaaatgtggcaaaacccccgtctccaccaaaaattcaaaaaattagcccgtcatggtggcacatgtctgtagtcccagctactcgggaggctgaggtggatcacttgagcctgggaggcagaggctgcagtgagccaaaattgcaccactgcactccaccctggaagacagagcccgaccctgtctcaaaaaataataaaaagaaattactcacctacatgaagtttgtaacatttttctggttgtcttcaggactttatctttggttttcagtggtttgattattatatgtatgggcatagttttcctgtttagtttaacttgtttgggtttgctgaggttcttggatctgtacatttatttcctttaccaaattcgggaagcttccaagcattatttccttaaatatatttctctaccagttcttctcctcattttgaggactgtaatggcatgaatgttgggccttttggtgttgtaccataggttcctggaactctgttcatttttgttcaacttctcttcttcctttgttttcagatcactaatgtctattgagttaagtccactgattttcttctgttgcttcattcagctattgagcctttccagtgagacgtttatttttgttattgtattattcagttctaaaatttccatgtagttattttctttttacagcttcaatttctttgcaaagaatgtctatctttttatttattcaaaaatgttcacctttacttcatggagcatggttatgataactgcttcatagtctttgtctataattctaacatctgcatcaaattggggttggcatcttttcattgcttttgccctttgagagttgtttagttttttaaaagtcagataattttggattatattctagaccttttgaatattatgttataggactctggagtctgttaaaatctttaggaagacattaattttttgaattttaacagacagaagtccttgttatattgatccattggtttgttctacacttgtgcaccttggagatgagtctgacttcatatgcagaatttagtatccctttcttgagctccctcccctctgtgatcctccccattcttcctttctcccaagaacttcctttcctagtactctggctatatagccaaggcttgatcctctctcttcatgccatgatgcactccctgcagttggtctctctgtgggcaaagcagtcaaagaaaagaactgatagaaggcactattgccactgccactgccactgcccccactgccacccctacagtgtgcagctttgtttctgagactgagtgaggccagaaatgtctacagcgcttcaccccacaggggatcttctacccagtactccgactaaagggacttttcttggagctttttctgtctgttcccatttgcagttccaggaaacagggaagtctaagccaggagatgtggaaggcaaaaaactaaaacagaattaactgtggtatggtcattctttgagtattcgtttttttcctcagtccatctgctcttacttttcagagtcctccaatagttgtgttatatagtctctccaggctgtttagttgtaatcagtgggagagatagggtggaatgcatgtactccatcttaagcagaaccctttaattagatttgggaacctcaaatcttggtcctttgccacattgttcttccaaggaactcctgaatcatggctcctccccaactttaaaagagtaagggaatcctttatgaaatggtacttctgttcccagaatttactcattcctctagctgaggttccactgtctcaattagtagcatcactatttactcagtcagaagaccctgatgtatctttgacttttctagcctccctcaaataatcattcatgaagttctattaattctgttgcctagaaatctttcaaaaccatttccttttcactgttcccacctttactgcctcagttagaccatcatttctcacctgtctgcctctgaactgtcagcagagttattctttggaacaggagtcaacaaactacaacctacaggctagctaccttattttgtaagggaagttttataacagctcacccgtgcccacttatttgtgtattgtgtattgctgcttttgcgccacagtggcagaactgggtagtggagacaaagaccacagcctaaattatttacggtctgggcctttaagaaaaagtttgccaactccttccctagatatcactctgttgtcagtgtatgtgttctacaaaataaacttcaaattctttattcaaggtctgttgtaattgaaccaacgcttgtctgttcagcctcatcttaccacttgtaccacataccctcctttcatccttcaggatcagctccttcaccctcttttccatgcagccatccccctcctgaagttctttttcttctctttctctcaccatctccatgccccacaatccttctcccataggctaagtgatttccccgtctcttttttcccattgcattttttccagatttttttgttttgttttgcttttgagacagagtctcactctgtcgcccaggctggagtgcagtggtgcaatctcggcccactgcaacttcacctcccaggttcaagcgattctcctgcctcagactcctgagcagctgagattacaggtgcctgccaccatgcccagctaaagttttttgtatttttagtagagacggggtttcaccacgttggccaggctgatctcgaacttctggcctcaggtgatccacctgcctcagcctccgaaagtgctgggattataggagtgagctaccatgtccggccccagatttctattaaagtacctatcaaactgttttttattaataattgcatattatatggttatatattgtgtatgtacatgcatgcatgtatatatggataatcttcagttaaggagtcccttgaggacagtaatattttcttttcttttcttttctttttttttgagacaaggtttgactctgtcacccaggctggaatgtagtggcacgatctgggctcactgcagcctctgcctcccaagcccaagcgatcctcccacctcagcctcccaggtagttgggaccacaggcacatgccaccacagccagctaatttttttttttttggtagggacagggttttgccatattgcccaggctagtctcgaactcctaagctcagaagatccacctgctttggccttccaaagtgctgggattacagatgtgagctaccgcacctggcccacagtgatgtttttcttatctttagtcttctcagttcttagaatagtgcctagcaatgtgagatttaaataaatgcatcacaagttaatgtaccctttaattaaacattaacacctgataagcagattttctttctcaatattggtaattctcgattcaaaaagaaaaaaaacagtaaactttttgaaaatttttaaagttcataaaaagagaaatgcgggaggtaagtgaggataagctactccagatatataacagatatattttggttctctgaaataaagtccaaatttgtctgattatatttcaaaactgggttaatcttttttctttaatttgtttactcaacttgcagtctttatgttccccaaagtcataagaaatcagttcttttcccatgtaacattttattcttctctcttctatcttcatttctgttcttggagacagtgaaattgacagggaacttttctatctttctaggattctgtttaagtgacttaacccttttccagccttttgtgacagcagcctccatgcctaactcatctctactcttctctcttatttctttttgcatattggtgtccttgtaatacacttctcaaaatggtagaatgggattaataaaaatttactactgcctcctctagacacagtttttctcagatatgtgttgtcattttcccaaatcaaattctgaaacaggtgtaatttgtcttcacatcttttccatgccatcgctcagtcatttgtcagtttcatctgattgcctgccagtgccttcttttcccaggctttcccaggggcacctgacccacacctggcattccgcccatcccaggaccttccaagggcaagctgattgggaaagcatttggagactggagaccttcattgctctttttgttttttggggggttttgtttttgtttttgagacggagtttcactcttgttgcccaggctggagtgcaatggcatgatctcagctcactgcaacctccatctcctgggttcaagtgattcacctgcctcagcctcctgagtagctgggattacaggtgcctgccaccatgctagctaattttttgtatttttagtagagacagggtttcactatgtcagccaggctggtctcgaactactgacctcaggcaatgcacctgccttggcctcccaaagtgctgggattacaggtatgaaccactgtgcctggcctctttttgttttttaattgtgcataacataaaatttaccatcttaaccatttttaagtgtacagttcagtggtattaagtatagtcacattgtcgtgctaccattaccaccatccaccgacagaacttttctttttttttgagatgggggtctcactctatcacccagattggtcttgaactcacatgatcctcctgactcagcctcccaagtagctgggactacaggcgtatgccaccacacctagctaattttaaaatacatttttttagagacgaggactcactgtgttaccaaggctgatcttaaactcttggcctcagcctcctgagtacctgagactacaggtgcagaacttttctcatcttcccaaactgaaactctgtacccattaaacactaactccccattcctcttacccctggcaacaactattctactttctgtctctgtaaatttgactttcatcgcccttgaagtcatcactgcctgtgggcagccgtgggaaggacattcctcagtcttcctaattcttcgaaatgatcagttagtctctggggtattttctgagtagtcacatgctgacagagacacaaaagaaatttgagtgacaaagaaggtaactcctgagctgggtcattaagagaaagtaggagttatttcagcaaagggggaaagaaggtcttgcaggcacaagctgtgaggcccttaggtgtgaatcagagaggtatgtgagaggaagcacagcttgttcggatgacaagagcaaagagtgtggatgcaagaacaaaaatatgcgtagggtttccttagatacttagcgtttattataatgatacatggggaattaaacatcaggaaatcatctcagggatgtcagagaaaactagatgcctgttaaaataacagcacccttctgaggatctggttattataattcttgtgcaatcagagtagtcttccatggctacctatgttatggtgattcagctctgtgtctgtgtccgccagttaactgacaccctttagtggctgctttctctgtccatctcacgttcaatcccattaagaaagagaccagcaagagtgcatgcaacagaaggcatcactgtccccgtcgggcagctttcttgtgcccagctgcctctggaccacaatgcatcttgctcattcctggaaagtggataatggggtccgggggctccaactatgaggactggagcctcagcagctactgaagcttcttaaaagagatggaggtgggctctttcatacctgtactacatggagacccagtgagaaaatgtggatagagagcttggtaagaaccagatcatgagcaaccttctctgtcactgtaggaggcctaaatttattgtttgagctactgagagtcatggactggttttaaccatgatcatttatttgcattgaaagaagttcatattgctaactgtgcaaactgaatggagggggataagagactgctggtggattaggaaagctttcacaataataattgaaccaggagattgtataagctcaccaaaggtaattgaagagaaaaaagaccagtgcctgtgataggggccctggcccttcttattgcaactatcttttttacatggagatggccacatcatagcattataactcagcatattactttagggctttatgtgtagttaccctaaaggcaaataaatgaagaaaaggaattaccattattgataccatcttaaaagctatcattatgtcttttgagaaacctgaggtggagttaaatggattaataacataagtatttgtccattttattcaattgagtaattgagtaggctattatgacattataggaaaaattattatagtcctttatcagtgacaattctggttcctattcttgatctattgggctatatttacaattcaggaaaaggagagacctgcagaatggcaagtatcctgtcaaatacactatctgccaaccatacttaaatccataggtcaccttttccacttatgtgtatatggaaaatcaccccttgtttctgcaggaaatccaaccatgccaagcatgtaatgatatcagtattctttacagaagatttgtggggccatctggggcaaggcagtcatatcacacagcctgcaacggttctttctctctcacacacacaaatacacccacacacccacacactccccccactcctcatgcagcacttccaccctctccaatccctaccctgttattagattttttctttttctttttttttttttttttggtcttcactcagctcctctctggcttctttgccccttgtaaattctgcctccactctgaaccccctcctcaccagtttcgatttttcagccctttattatcccaaagaatttgccattttttatttcctaagcctgccctttgggggatgctcatagtccccaaggaacttactagtgaactctctcagcaaacaaaggcctgtctccccacatctttgaaccagcaacagcatgatatccttacacattttgattatactgtagcatacagacattttagggaagacaaaaacaaaagacaaaaacagaaacgaaaatacaggaaacaaaagatgaaatacagatctgattagtccaagtccatcatccaggggaagtcctcgttcattaccctactgctgcatatattctggatatttttctgctatatcacgaaatttagaaaatagtattttttttccccagtttgtcggaaactggccacatttgagggaatgtggcttggggtcctgtctcaatcattgtcttctcacgtgacttgcagaagctgcatataccctcctcttatatgacgagctactggaatggtctgatcggcccctcagggagttcctgacctaccccatgcaaacagaatggcagcgcaaagagcacctgcacctcaccatcatccagaactttgacagaggcaaagtaagtggccctgccccgcccggggtccctcctggggtgatggtgttgatgtccctttccctttcatttctagtttatgaatgcccacctccttaagcagggatcctcacatcttaatgtatattagaaacacccaaaagcttgttaaaatgcagattcctaggtgccactcctagccattctgattcattttgattctgaatgagccattctgattcgtgccttgtctggcatgaggctggggaatctgtgattttaacaaggaccctaggagagtccaatgtgcatgaccttttcattacactttgataaacaccgatttagagattttgatccccagtaacatagtccattcgtggcggctttagcaaaataccctagactgggtagcttataaacaacagaaatttatttttcacatttctgaaggctgagaagttcaagatcaaggccctggcagatacagtgtctggtgagggccatcttgctgtatcttcacatggtgaaaggggctggctaactctctggggcctcttttataagggcactaatgccattcgtgagggctctaccctcatgacctaatcacttccaaagaccccatttcctaataccattaccctgggggttaggatttcaacatatgaatttgtcagagacccaaacatgcagaccatagcacgcagatattgtattctctgaaaaaccattatcatccttcacactctcccgaaattggcatgcattctgctccattatactttaaggtaaaatatatgaaacttaatttgtttaaagaattttgtggcatcccatcatatacttaagagatgccttgaggtgttgaaaaaacctcactgacttcataaagcaattcagtacatcacctccctccacttcctacccctcttcaagggcttgtagtactcttttaaaaaattcatgaatctgaccgccattgtttattggatttgaacacttggatgctttggtggtacatgtcttagactcaaatttatcttccagattgcaaaggttaaacagaaaattaaaatacaaccaatggctgtaattcttttacaaaatataattgggtacacgtaaaaatttgatgcaaggaagttgcttcttccacatcttcctttattatttatctaggtacactgacatatcattacatgaataccaaaagaaatgtttttgtgccctcctgctgtaaagtttccacctgtgggataaagtggtgcaaactctctgaattcatttattggtccatccccgggagtctgtgctagatcaggggttgcaaactatggtccacaggtcaaatggctcactgtctgtttctgtacagccccaaagctacaaatctcttttacgtttttaaatggttgaaagaaatcaaaggaatcataacattttgggacatgtgaaaatgatatgaaatgcacattttagtgtccctaaattcttattggaacacagccatgcttaattgtgtctatggctgctttggtgctataacagcagaattgagtacagcagagttgtgacaaaaactaaatggtcctcaaagactaaagttttgactttctggccctttgcagaaaatgtttgctgacacctatactagattaaagaatttttacatttctgctgagagtaaccaacttggttagacctctcacaatttgcaagcacaactaagccaagcaaggaatccagggtaccagtcacagataattgggccttaggggtcagtggtaattctctcctctgcactgagggcctgtttatatccatctactcggccattgtggaactgtagtcatttcaagatgattctggaatgacaccagaaaatatagttcatgtacaatatattaatgactgttgtggtagattatcgtttccagcattcaaaggatttttaataatttacatttcaattacatggtgttttcaagcttgaagtctcaaggtgttttataaagattaagaagtggacgggcgcggtggctcatgcctgtaaccccagcactttgggaggccgaggcgggtggatcatggggtcaggagatcaagaccattctggccaacatggtgaaaccccatctctactaaaaatacaagaattagctgggtgtggtggtgcgtgcctgtaatcccagctactcaggaggctgaagcaggagaatcgcttgaactagggaggcggaggttgcagtgagccaagatgaggccactgcgctccagcctggtgacagagtgagactccatctcaaaaaaaaaaaaaaaaaagattaaggagtaaggcttggtgctctgaaagcactcatgttctgacttttgggtagaagtaagtggatattgtcagatggttccattgatctcattcatttgtccacagtgttgggagaatggcattatcttgtgccggaagattgcagagcagtatgagagttattatgactacagaaacctgagcaagatgcgggtaaggtgcctggatgcatcctgatcaggccatagcctccctttgtgattagctttccagtgtggttctatgaaattaactttgtggtcttgcagaaaccctttttaagataaatcctctgaagcatacttagctatttatatagagaaatagcaaattgatttgtgtaatgcttttatttaatataaaaaagtgagcacttgatctgttttaaataccacatatgaaatatacaatctaatccaggattaacacttttagtttattgtggaaaatctccaccctgtttgaagagtttccacttacacataagtttctgtaacaatataccattcttagtcccataatctgcaaatctgtaggaatggctgacctatttctaaataatttagggccaaattctgtaggtgtcacctctctttagcttcagcaatgtgtttttatttgctggacttagatcaacgtttcagtacctaagagctcaaggagttgagtattctgtttctctgaaccaaatgttttatatctgctttgctcttaggttcaaacaagtcctccttgccctccaagtccttactcttgagcaacatgaacgtttgtgtcatcttgtaatacacaagatcctgctgagtgcttcagttcttcagggtttctaaaataggatcatcagtttttatacattaaaaaaaagagtacaatattgccttttaattttgaggtagccatttaagagataataccataaacctgtaacagctcataaaatcccttatatcccaacaaggaatttattcaactggcaggaactgactctgtccttttggcacagtatttcatgtcagcagttcatcgatacttctcctaacatgaaaacgaaagagaaaaagcttgttttaacttcagtccatcatgttgactctggcaggcactgcagttttatatgaaaacattgctgttcatctcttggcatcctgtccctgtaacagaagcgaggtgatgatgtttacttgtgagagcccttgggtgccatagtcactaagatttttataaacccaaagcattacacttcatgccaactgctctttggggtgctgttactagaggggggatagagggggaatctttaagtgtaatattagtctttctctggaaaccctggggatgataataccatgaatgggaaaccataagctttatatgcttcatagtttcaacattgtcaggcgcacttaagagctttcagcccagacagcactttgcactatgggtctcctttggtttggtttgttgttttatccttgcccaacctgtgcaagattgcaccttccaaatgtcctgaattaccatgtgccaggtggaggcaaacccacaggtaagtacatctggcacaagaattctctagaaaagttttgcctctaataattcatgttaatttctacttgattgtgaagaaaatatttttcttgataggactacatgcatagaaataatttttctctggggataacatgtgataatacacttgatcctttaaagcagggatcagcaaactacagcctgtgggcctagcagaattaagtagttgtgaagagacgatatggcctgcaaaatgtgaaatagtctctggacatttatagaggaaatttgccaatccccgacttaaagcatcaaaaagaaagtcaaactttctttccagcaaactcaattaaaataaagttctcctttatgtaaaaaagaaatcttattctataaatttgatagaaccgaaagatgagataaaatgcttagaatgtttcctgtgctttctagatgatggaagcctctttgtatgacaaaattatggaccagcaacgtcttgaaccagagttcttcagagttggattttatggaaaaaaatttccatttttcttaagagtaagtaatatactatttaatttgctttcacagctctcatatagatatcccaatcaagaaaactaagatgttaatgacattttatatgacaggtaataatatgcatgagactttttttaaacttttactttgcagacactatattaatctagaatgccttgtttaaataatttccgagatagcaatcaaccccttcctaaatttggtatattttgtgagcaatctttgataattatagtttcccttgtctgatacccactattttaattcagtctgcaatttccatcaagttagtattagaaaaaaaatggtggggcactgcaggaggcttggagttgcagagtatcgaaagcaatgcagtttcacatcatgtgaaaaccctacctccagcaccatgtaaagagtgttgtttggccattttgatgaatttgtaaaaagataaatgtcacccagcaaagagacccaatttattgctagtataaactccatttctacaaagagaaaacttttagacattctaagacacctataagataataaaatattcaactccattcttttcatttttcacattctgcccagtagtgtcttctatgcttgaatatttattgaatacttcagtatatacaccttccttgtacaaaaacattgcttaaaagagcaaatgtaattccccaagcaactaaggaaaggtatctgggatagtttataaaattgaatcaattgttacaactttagttctcaatacagaaatattttgatgtttgtgtttacctaaatcttgcctgtcagcacatatgacagaatactaggatgggtgtacttggagaagaagagaaagatttcactttattgtttaataatcattatctgcctttcagaatgaaaaagacagataggtagatcccaaaatatccaatacaggttcattttagtatcacgtggaacagatgttttctttagtcagttgaaatgaccatgcatttgggtgctacacagacataatgtgaaatctccttgttgcattaaaagagactccacacagtgtagtgggcggtcacaaagctgactttgcaggtgggcctgcctaaaactggaggaaatcttgattcctgatcaaaaacagcagcaagtgggcacagtggcacactgtaatcccaaaaacttgggaggctgagataggagtatcacttgagcacagttccagaccactctggacaacagagcaagacccccagaaaatgaaaattaaaaaatggcaaagtcagaatacatgttgaatttaaaagactacgttttggaggtgtagctgatcccaagctgttatgagcaaccccctaaggactgcagatggcctggatccaggttctgagcagagcagcagacagtctagagctatagccacacagatggctggggattgcgcagcagggtctagacacgaccctgccacagtaggtcgtctccctctgttggcacaaacagacatgacattgttggcagagtcatgtctgaaagattataattaaaagtataaagttttaaaaaattagaagtagtttaagagtcataattttaaagagagtttagcaaattggaaaactgcattagcaaatagaataaattttgttaaaaagtcaattagaataaatcaatcttctatatcattcttcttttaaaaatagctttcctgggtataaatggcatttgcttcacaatgaaagagaagggtccccctctgttggtttctaaagggcactacactcttcagaatcctggagcctgaccttttttttaaggaatcagattctagtctggtcttggatttaaaagcaaacaaatatcaacattaaaaacatccttttggccaggcacagtggctcacacctgtaatcccagcactttgggaggccaaggcaagagaattgcttgaggccagaagtcttttgttgtttgatcaatttccaagataatttttagcactcaaatacatttatccacttttatgatctaagtagggatttttcccctcatgaaaaacgggttatttagctgggcacggtagctcatgcctgtaattgcagcactttgggaggccaaggccagaggatcacttgagcccaggagttcaagaccagcctgggcaacatagtgagaccccatctctactaaaagttaaaaaaaattgccaggttcggtggcgtgcgcctgtggttccagtttcttaggaggctgaggcaggaggattgcttgagctcaggagtcaaagcttcagtaagctgtgattgagccactgcactccagcctgggtgacagtgagaccctgtctccaaaaaaaaaaaaaaaaaaaaaaaagaaaacaaaacaaaatgggttatttaaagaatattaacgcagaagttctacttctatatacatgcttaagaaaattgaaaatatatatttacacaaatacttgtatctgaatcgtcatagcagcattattcataatagccaaaatgtagaaactgcccaaatatctattaactgatgaatgggtaaacaaaacacagcatatctatgcaatgatactcagcaataaaaagaaaggaaatacttatatgtgctacaaaatggatgaactttaaaaatactatgttaagtaaaagctagtcacaaaaggccagcacattgtataattccataataggcaaatccatagaaacaaaaagtagtattgtgactggctggaggaagagaaaaataggaagtaactgctaatgagtatagggtttctttttgacatgatgaaaagattctgaaattaaattttgttaatgtttgcacaactctataaatatactaaaaaccactgaattgcacatttttaaaaggtggattttattgtatgtgaattatatctcaataaatctatgtgtttttttagaaaaaaaaagagtactgataaggaagatgctttatttcttagagacccaaatatcagacccaaaatttcattttattttaaaatggcttcttaataccattgaatgcctgtattcttagagcaaatgccccgatttttacaaactgtcatatataagcattgtttgttttaaaatatatttcatttactaggatattcaaatatttatttgggggctcctgtaataggcagagagggatgtattgtgttttattttaccaagcaaattaattatcttttgagtagaatttttaaaatacagcatcagaaattgtaacttttatctataaagttttaaatctagaattgtatggggtccacaattataggtagagcctgccctaaccttgtgtttttcaaaagatcatgatatatttaggggtttgtggggaaccgaggtaggttatccagcccagttcctgctgtatttcctctacctgcctgcagctgccctttccctgcggaagaactgagcctctgcccatgacttgtttctcactccctctctgtggcctggagtccctctttacggcgttttacataagaacctcatagagcggaaaaacagagaaaaccttggacctcagctcctctaggccccaaactgatctccccttaacttgaagatctccagggcctgagatcccacaagttttcctggtcttggtagctcctaggtgtttttcctgcatacactaggccatgttcagagtagaaagagcccagggtttggactcagaccagaatttcaatctagtacacgtggacaaagtatttcaagacattaagccatggccaggcgtggtggctcacacctgtaatcccagcactatgggaggccgagacaggcagatcacctgaggccaggagttcaaggccagcctggccaacacagtgaaaccccatctctactaaaaatataaaaattagctgggcatggtagtgcacacctgtcattctagctacttgggaggctgaagcagaagaattgcttgaagtgggagacggaggttgcagtaagctgagatcataccactgcatgccagccagggcaacagagtgagactccatcttaaaaaaaaaaaaaaaagactttaagccctggttccccaattataaaatggggtgttgtagggggcactgactacctctcaagcttatatgagttaaataagacatgcagtgtgcttcatcaatgactgtgctcaattacaacttcattatcattaaaatgtcagagatccgtcatatctaatcagatcattcaggtactttttggaaaccttcccatctttccagctgtcttaacctacctcagaaataaccttcaccattcttaactgaaggagagcatcatgaacggcagaatacacacacacacacacacacacacacacacacacacacacacacaaaaagcagacaacaaatttacttttcctccaaattgtgaaattacccacatgaatttgatatgtactttataaaaataatctttacacatgtgcttattaacatttagagggatacaattgttttgttttcatactttggtgctctgagaatccacctctttgcacctcatgcaagtgaaccgggaagagtgaggcattctattgggccttattaaatgcagtagagagtgaactcatgatctttatctgcatttttaacaattgggcaaacttttcagattgttccagcgtaatttttgttatagtgtcttggtatggggcatgtggtcagttactgccagtgtcatgttttttggctctgtctgtaatccactcagttatatagccctaatttcttttttgctttcatctccagaataaggagtttgtgtgtcgagggcatgactacgagaggctggaagccttccaacagagaatgctgaacgagttcccccatgccatcgccatgcagcacgccaaccagcccgatgagaccatcttccaggcagaagctcagtgtatccgcacctacaagggctggactcagtgagattgcactggctcttagctgcagagcatttccatgcaaggttgttcagccaccagtcccttttcaatagccacatcgttactgctccctctttcccatcatcttaattttagcttaactccttctgaatagaacttaattgttctatttattacgatgatgtcagttgaaagaactctcttgaaagaatttttcccttttaattaaacctcttgtatagctcaaccctgcctttaaagctcttttttagtgacatcctttagaataaacttcctttgacatatcctgtggaaactgcttaagttcaagaaaatcatagtattgtgtttactggcacatattattcacccctccccccaccctgattatttgtattctggaatgaggaatggaagagaaagagctactccagtatcttttgggggcttttagctatggcatcctgaacagcctttaatcattgctgtataattcatgctcttattgtctaaacacaaacaactgagctgaaattatataggtgttagagacaaaggcagttcaccccagcactcttttctgaacccctctgccttttcctgaaactgatggtcttaaaaaacacttttaaaacttccactgacaattatgaataccatttcaaagcagaaaccaaaatgcaagacatgcaagaaagtacataggaaaaatattttgctatctttctttaaataagaagagaaggaggtaaatatacaagttaatatgatactcctttaatgtaatttttaaaaatataaactataactaaacaccctgcatatgaatacaagatttgggacagcagttatcacagatgtgggaaggctagggacacagataatcacacagataaatgtaagtcatcgtcagtgttctagtttctgtctttggtcatggttgcataggtatttacatgttattataagcaaacaataaatttaaatgtgtcatgcacagactaatagatgtctcatgaacaaggattaggattatcctaattctgagtatctaaggcccaaaccattcccatctacctacacacacatacacacacacaagttagtgatatctaaattcataggtcatgaaaattttcaagtcatggaaatttcaagctgatacttcacctacctagaactagttcaagacctgtagtttgagaagtgatttgctagaactgagttcctggcgtcttcttggtaatttttttaatgacttcaactgaaatggaaacagaagattgttacccatcctcttctctctgccatagctcagcccaagccagacttccatggagtttgccaagtcaggttctctccttgactcttgaatcctagatttgcagatatatgctgtgactcccattccagagagccaggaggtcctgcagagagagggtgttccggacaacatcaaaagcttctataaagtgaatcacatctggaaattccgctatgaccgaccatttcacaaaggcacaaaagataaagagaatgaattcaaggtaccatgcaattcttattacatgctaactcctcagatagactgcgagccccttggggcacagcccttggtaaatatttactcagaatagtgtcaagtgacagaaacagaagggactatataaatcatttagtctagtggttctgcagctccacgtgcatcagagtgacatggagtgctccctaaccaagcagatttctggtgcccagctcaggaattctgactcagttggtctgggaggaggtcctaaaatcagcttttttgtaacaattctaatgctggtggttcttagaccagtctttgagaactcctggctgaagtcagtcctcttattcatttatgttgaaccaattgtgggaatcttgggatgtttattttcacgtaaagttcaatgaataaagaatacataatgaacagagaaaaggagttcctgaagacagagaacagttgggtagactgctggtacgttgggtaagttatgtgccatctttgctgcttgttcttgttagaacagtgtgtaattagaacttctcaggactccgagtaaaagcaaattttggattctttgtgtgtgttgagttctctgctctcagtagttccaacacgccttcctacttcagcaccctcagccagaatgggacaaggtttctcatagccccactgcagaaaagaggcaagattgttcagtagagtctgcccctttctttgcaaacaatgacatagtgacaccccccccagttagtatttcatatctaaacaaagaatgcaaaattagcttatttttgtgagttaattggcttagcatttttcgtcacagatgttccctgcttaagctaggaaatgtgctcctaacacgattgtctcatgttaactcacttggtcagctctgccggtgtcagttcccagtactccccgaagtatttccagggatcattcacaaccgagaggagatcagaaggggaaggttttgcagagttatgacaggattgaataaagagcagtcccttgtgcccagagatttgatgggctaaatatcaaggcaaggaggccactggaaaacaacaatgggatagtattaaaaagatccatgatcatgttcttgttttttctggaaacttattctttgtgccttccaaaatcaattaaagaagatatagctagttgatgatatagttcttcttgcagttgcttttagtgaaatcatagtcagaaatcactgaaatcaggcaattgacttgttcaaagtcaccttctagttaccggtagctccagtcctagaactcacattttctgcctccttctccattgttttttccaccgtactacatttcgttgtggctgtcactttaaatctgtatcagtggcgcagcaatctccctaaaaaataataataataaatctggctcctgattcctctgctttatagccctcagaatctggctccaaactgccctccagaagcctcatctccaccacaacccactcacccctcctccctctcagcctccgcgacactcagcttctctcttcctctcccgccaagccctttcgcaagccgctcctcctgccagcgctgctacccccactctcctcctggcaaactcctactcactcctcagaatgcagctcacgcgtcaccccctctgagaactgctgtcctcctcccgcaggctggcgtgtgtgcctgcatccccctctgttggcccccaaagccttgaacatccctttctcttcactctgagctcttattcatctgcttacctccctgtcaccaccagaacactgcgagctcttgtcacaagatctctgccctattcatctcagcacagcttggctggctcaaagaaactcttccatttttttttttgttgtggtttgagtaaatggcactatttcaggaattttgtaaagtgtattatcctcttgggaatacacttggtttaagtaagaaagatgaggcgtagatactaaaacctggttgacaaaaaagaaacgtgtcatcaacagcagctcataccaaaggcagcatggtttcacatgtcctggggttgctcgtcccggccagaggaagccctggctctaaaatacagatttgcctctattaacagcagttcaaacaagcacaagaaaatgtggcacagtagatttagcaactgacaaggagtcagaggtcctagtgggtaggttctaatgctggctctatcggtagtgtagcttttgagcaagtcacattgctgctttaagacctagtgtcttcaaaaaaaaataatttttttgagaaggagtctcgccctgtcgcccaggctggagtgcagtggggcgatctcggcttactgcaagctccacctcccaagttcacgccattcttctgcctcagcctcccaagtagctgggactacaggtgcccgccaccatgcccggctaatttttttgtatttttagcagagacgcggtttcaccatattatccaggatggtcttgatctcctgacctcatgatctgcctgccttggcctcccaaagtgctgggattacaggcgtgagccaccgtgcccggctgtgtcctcatccttaacatagatcatgctgtgtggttcctaaagcctttgcttcccttaggactctgttgttctaattctacgttgacaggctgatacattgactggctgacccttctggatataagtggttagatgttaaggagtgaagagagtttgaattagaatcttggagaagtagcaaagaaaataacatgatagcctatttttgtatttttaagcttgctgtttgaagtaggagctcatttattccacatggaaaaaagtttgatgacatacagtggaattgttaaaatcagcttcagcaatctctcactgtgatagtttcatgagtgcttgaatgaagactaaagaaaggctgacaggaataagcaaagcctggtaacagtgaccgacaaacactagtcatggaagtagctagaaagaagggcaacttgggagacttaatgtgttttgtgttttgtagagtctctgggtggagagaacgtcattatacttggtgcagagtttgcctggcatctctcgctggtttgaagtggaaaagcgtgaagtggtaaggatcagagcttgttctcaagcactttctcatcacagttgttcacttggagttgtgccgtatattcattacttctccttcgacccagattctctggaagcactcatagtaaaatagtgaatgtttatggtcttgaccgctattaccaaggctgagaaggtgaatattaatattatcctaatgtgtccagatggagggattccttgaaaacaactcaatttgctacatgtaaaaaaactattcaggcccttgagttagaagacttggaattccagctctcctaattactatagctgtgtgaccttcagtgcttagtgtatcataccagtgctaatactacctgctttatcttatttaatcatcatatcaaagctatgaggtatatattcttattcctgtttttgcaatttttgacaagaggtcaaaagcctttgccaaagatcacatagcaagatgttgaagagagactccaacccagatatttctgattccaaagccaattatattactctcttctagcagtaggtttcttacaggctgaaggaggctaatgtcaagtctctgcacagtgcccgatgcacagtaagtccgtgttgttacagttcccagtagaaaggatggcagcgtattagtctcactgagcagtcctgggtggagcacccactgtagatcagtgggtgccactgtagaacctggtaaccacagctcccaagaaccctccggttgtaaaatgtgaccccagctccaggccccagttgtggacagcagggagagcagcagctgaaggcagccacatccagggtgggaccccacccagctgtctgtgctgttcttccagcgacagcacctcgatgtcagccatagccctgcagtctcacagcctcccttgctacatccattatagccatttattaactttatttcacttagtgtgaatgttcatttgtttcactgcagaaataataatgtgtttgtttttgagcctgggtctcaccctttcattgccatagttctctgataggaagtgtgccaattgtgcaaatataatgtaattcataccttatttaggtcacaagcctattctgtcaatccagaagaaagaacagctcctgaccaaattgtttttcaagaattgtttgtcttacctgaaatgtctcagcattgaaactactctcggcctatcatgttcaattaagctaaggatttaaaagttaaaattgaactctattcagcagattacatcagtgcagttgtattcttgtccagtctgaggtccagagtccccaaaagctggctgcttacatgttgtgccctggtaccttccatggaagtggggagactgctaaacgcagtgctcaaaaagtcttattatgcttcccgctgaatggcatgggtccaacttgtagaagtgtttttagtcatccatgctgcattaatgattcagagagcctttagctacttactacccagagcattaaatcctgtgaagtctcatcaatggtcctagcccttggaaatgtcatatacacatacaatgctaataaaaaatagcatgctgataatgataaaaggagcattactaaacacaacctttcaaacatcagctgcctactttattagaatatgtaatcttatgttctgtcaaatggaacaaatcaaattcagctgttttgttccctgaacacagcccactcttaacagcttttgtgtttttctcttgttcttgctgcctagaatgtcctcactgtcgattaaagctattggtttcctggtttaactcctagtgtagaaggtcttcaagaacagggacaggtagtaggtgctcaatacaaatacatcacgttgaattgaaattcctcatctgcagatgtcagcatctgaaaaccaagagatgttttcatttgttcggctccaaagctcatttgctaataatacacccaaccttttctaatgcaagtccatttattaactttatttcacttagtgtgaatgttcatgtgtttcactgtagaaatattatatttcctttttgtttttgagactgggtcttgctctgtcacccaggctggagtgcagtgatatgatcatggctcactgcagccttgacctcccgggctcaagtgatcctcccacctcagcctcccaagtagctgggaccacaagcatgtgccatcacaactggctaattttctgatttgttgtagagatgaggtgtcacgatgttgctcaggctagtcttgagctcctgggctgaaacagtcctctagcctttgtctcccaaagtgctgggattacaggcataaaccaccatgcccagccttattaatgtaatgcatttgattaaaggaacctgccctagatcctgctaggggttacataatataccatatatggccctatactgcctttctaaaatctgaaaagttcttcattctgaaacatgtggcaccaaaggtttcagatgaaattggggacctttattttctaaatcacagaccccccccccaatagcttatcaacttttgttaagatatcaatgcctttgaactattgtttcctctgtagtttattattttcaaaacccaaaaaaagtgtttttgtcctgattaaaaaattagctcatttcagctgggtgccatggctcacctgtaatcccagcacttcgggaggctgagacaggtgtatcacctgaggtcaggaattcaagaccagcctaaccaacatggtgaaaccccgtctgtactaaaaatacaaaaaagtagccgggcatggtggcacgcacctgtagtcccagctacttgggaggctgaggcaggagaatcgcttgaaccggggaggcagaggttgcagtgagctgagatcacaccactgcactccagcctgggcaacaagagcaaacctctgtctcaaaaaaaaaaaaaaaaaaaaaaaaacctaagctgattaaaaaatttttaatcaagacaaacatttatagtttagaatccataaatgattttttaaaaatccaactaaagattacgagaatattttcataccacatcctgcccatcagaaaacaatgtgcctctttctaaatactgtatacccagaatctaaccactcctcagcgcccccaccgatagcgccacctagtgcctgattactgcagtagcctcctaaaagatttgctttcccccttatccctgtagtctcctctgtacatggcagccagtgacctttttaaacttaagttatagcatacaaaaatagagaaaatgtataatgatataatgagcctgacttacccatcattgcttcaacagccatcaagccaattttgtttcatctacatgtctacctgctccctctcaactggactatttttgaagtaaatctcagatgtcatatcacttcatctacaaatattttagtattcatatttatttttaaaaacctgaaatattgtcacattaaaaattaacaataattacttgatcataaaatgtacagtgttcattccacactttaccaagtcttttattctgcattttagaccagcctgggcaatgtagtaagacaccgtctaaacagaaaatttaaaaaattagtcagcatggtggcatatgtctgcagtcctagcaacctcctactccagaagttgaggccagaagatcactggagcccaggagtttgaggttacagtgaactatgatcataccactgtactctagcctcggtgacagtctcaaccctcttttttaaaaaaaaaaaattatatatttttaggccaggcatggcggctcatacctgtaatcccaacactttgggaggccagggcaggcagatcacttgaggtcaggagttcaagaccagcctggccaatatggcaaaaccctgtcgctacaaaaaatacaaaaagtagctgggcatggtggatcacgcctgtaatcccagcttctcaggaggctgaagcaggagaattgcttgaacccagaaggtggaggttgcagtgagccaagattgcaccactgcactccagcctgggcaacagaacaagtgagactgtctcaaaacagaaaaaaaaaaaatatttttactctattattcgaatccagatttaaataagggccatgcattgcaattgattgaaatgtcttctaagtctctttcaatctgtaagtttccccttgcatcactttccttatttttttattgaagaaactaaagactgtttatcctgaaatgtttccgtatgtgtggattctgcagactgcatcccagtgaagtcatataacatgtttctctgtcacctgtattccttgtaaattggtagttagaactagagacttgataaaatgtttgcttttattttcacaagactacttcatacttggtgttatgtgctactggttgtcgtgtgtgtgtgtgatgttggcagccactggtgatcattgaccagatccattaatcttttatgggttgcaaaatggtgatattttatttcatgtttatttactcattggaatactctgtaaagagaaatgtcctctcactaaatatttgattaccctgaggtacaggaaagataatgctgtattctacaaaagcgactggaggggtttttgtttggttggtttttggatcattagtaactcatggatataagtatatttgttttgttttaatccatggcagttattaaatttaaaaatgttccatctttgcctgttgggagcatcttcaaaatggctcctgagtctgttttcacagtatccaagtagtgtttgttactgagctaacacacaggatctgattgtcaagttcgatgcaggactcagcgacccctcccagcatcaagctttactagtaatttcaaggcaggcaggatgctcagataaagcagcgagatttctgagacattacacatcgtctgctaggtccttcttccccacatcagtaataattcagaattataggtggagtccctgaggttcacagggttcctcattcagaagcacgtttaaattatgaagtgtcgattatgaaacattccattttctactccagagagttagttgtaaagcttctcagggacattctgtaatcatgcctcatggattctggtttatttatttacttaaagaaatcctttgactggggactttagggcattctgtagataacatctcttcctcctagcaattacttttagtctgtttacttgaaggttcaattgacaaagagataagacatagtcacctgtcttttctgtcccttaaggacattccccagtaaagaaaatgaatggatcacaggccagatactttcatgttttcctcccatccttacctttaccatccttcctggtaagacgaggtggtctaggatcacttgaacatctcctgccccagacctgaaagcagctatttctccaatgactccttattcattttagtggtgaacaatatttagagattgtaatctgaaggatagaggaaagtaattcttggtgaacactctatcacatatctttgcacacttctttgaccgtccccttatatttccctagaagtgaattaatcaaaagtatccccactgtaaccactgattcatggctcagcaatgggatatatcgtttacaccctgtctagaggggataactagtcttaggaatacttatttccccagcatcttctccaacactaagtgttgtatattttaatctttccaaataatagaccaaaattatactggggttggatgttttgtttcagcattttttgaatgctaagtgaagatatgttttcatatattgatgaactctataccaatcatatcctttgccccttttcttcagtatttggcaaatattaacattttatctatccttcatgttggaaatattttccaagtcgtttgtattttgcctgtgtttattatgtcttgttttatttacttttagaaaatttgatttttaatagcatttgaatttataaagatgaagattgcttttttcttatagccaaaagcacataaaacctactattgtaaccatttttatgtgtgcagtatggtagtgttaactatatatacattgttgtgcaacagatgtctagaagtttttcatcttggaaaactcaaactcgatattcactgaacagaagttctcctctcccctttcccctagaccctgggaaccaccattctatgttctaagatgttttgcttactttttaactttcagttactcagagctctcagacttttcctttatggtttaggttttgtgtacataaaacaaaggtttagtgttacaaataatctgaaagtaaatacccgttttccaccattcaggtaaagaaacagaacattgccagcagtatcctgcaggcctcctgtgcacctcttctcaattatagctccatcttcaccataaaagtagtcactatcctgacttctatggtatccattcccttgcttagtgtatcacctatttgcctctctaaacaagtcgatttggttttacctggttttgaacgttatataacatactacttgtgttctattgagacatatttgactcagtgttgtgtgtaatatttttccatgttattgcatgtgattgaagtttgtttcattgctgtatactattccattccatgaacatatcacaatatgtttattctcttgtcaatggacatacggattttggagattatgaacatttttgtacatgtttcctggtacacgtgcacaaacctcctaccccacttttccttatatgcctagaatttctgaatcgatatacacacacacacacatgtatatatatcttcaactgtttttccaaagtgaatgaaccaacttgaacttccagtagcagtaattgagagtccgttgctcacagtctcactctcatctgctgttgtcatttttaccatttcagtgggtgtttagtagtatgttattgtagcagtatttttcacatctttgatcacaaatgaggcccaacaccttttcattatttgtttactggccatttgaatgtattcctttgtaagtggttgtttaattcatttgctcattttttattgggtcgtttgcctttttcttcctggtttttaagaatccttatataccctgaacacgtgctttttgatggttacacatgttacaaaatcttctatgttcttgcttatcttcccttctctttgtctttgatgaatgttcagtcttcatattctaggatttttcagtgttggtttaagatgatccaagtgacctttaaaaactctaatttgtttccttgcctgaatgaaccaatatttaaatatgctaattgtagtcctgaattacttgattgctgagagcttggcagaccttctcttcaaggcaatagcagtcccaatgacatacatttgaagagcacttttatcattttcacaattaggtcctccatacagcctggaatttttaagtcattatgattctatttggctctccaacaaatagatcctgcagtatatattatcttgttttctataattcccaactgtgtgccatcctgtgccaccttatggtgctgttatatatatatatgaggttcatgtggcatatgtcccatcttcccaactgggctgaaagctccttgacatcagaggatccataaatgcatctttatatctcccatggtgctttgtatcaaataagcatgagaaaggggataatattcagggtctctgaatatttaacccttcaaaagaaaaaaaaaactagttttaaaagacatgagatgcttggatattattttaaggattaaattggttgttgcagtgctaatgtagaattgatgattatccaaaccacatttcaatgaataagtataattacctgccctttccaaaccttgctaatgaacatcccacttgacttccacatccttgtctattctacggaatggcccctggtagagatattgatggaagccaagggggagcacagataattcagaacatggataaactactttgtctttcttcttgaatgtcacaaattcaatatatatttatgttcatttgcttctcaggtagaaatgagtcctctggaaaatgcaattgaagtgctagaaaataagaatcagcagctgaagactctgattagtcagtgtcagacaagacagatgcagaatattaatcccctgactatgtgcctgaatggagttatagatgctgcagttaatggtggcgtttccaggtatcaagaggtaaggattaggtattgttgtttcagagaaagttttcaattgtgacttcttagggtttcatgaatcttttttcagactatgtacccatatcagcacgcaaacatagggctgcgattgacacagagtcctttgttaaatagagcaaacatacagtcatttgtaattgcccagtaactccattttcccaacatgttatatttggataataaaaatgtgtgtgtgtgtgttcattcttgcatgaataaaagtagaaaggacattaggactgtttaataaatatccgtctaaaataatttctctaagcaaagaagttcatgggcatagaaaagtctgatctgggctgggctcagtggctcacacctgtaatcccagcactttggtttgagaccagcttgagcaacataggaagatcttatctcttatttaaaaaaaaaaaaaaaaaaaaaaaaaaagataagaccgatcttgcttagatgatactttaagtggacctttcatctgctctcttaaacagaaagatataataccctggaaggtaaggccaccatctaggtcacactgaatcttaaggcagtttgttttaggatacaagccatatagcttactgatttgggcttgttctttattttagcaagggtacttattgtacaatcactgatcttcctttaacaattctttccttatgttcccattctgaccaaccacctacactagtaatcagcccatctgtcccaaaatgtggtttgtaatggtgtcatttccataaagatgccaggtctttaaaaacaacttgtctttgacttgccttgtactccactaaagtagactgattctcctttcccttactaggcattctttgtcaaagaatatatcttaagtcaccctgaagatggggagaaaattgcacgattaagagagctgatgcttgagcaggtaagggaagcagaagccaacccccttctattttgcctggatatgtgcttgcttacctagagccccctctgcatggtttcctgcatcagtggtctaacagaagctggcaagcaagggtgacagattcctgtaatatatcccagcttgctaatttctacttcttcttcccactccgatgcaaaaattaatttaacaatgagtagactatggcagccagttacaggttgagtatcctttatccaaaatacttgggaccataagtgtttcagattttgaaatatttgcatatacataagagatatcttgggggagggacccaagtcaaataacaaaatttattatttcatatatatcttatacacatagcctgaaggtcattttatataatattttaataattttgtgcatgaagtttcgactgcaacccatcacgtgaggttgggtgtggaattttccacttgtgggatgttggcattcaaaaggcttcaaattttggaggatttctgattttcagtttttgtattagggatgttcaacctgtgaaacaaacaacttcatgtggtctcttaaaacattctttgaatgttctcttcctagagacttgctgtaggcttgatgccaactttttttttttttttttttttttttttaagacggagtctccctctgtcacccaggctggagtgcagtggcatgatctctgctcactgcaagctccgcctcctgggttcacgccattctcctgcctcagcctcccaagtagctgggaccacaagtgcccgccaccacacctggctaattttttttgcatttttagtagagacggggtttcactgtgttagccaggatggtctcgatctcctgaccttgtgatccacccgcctcagcctcccaaagtgctgggattacaggcgtgagccaccgcgcctggccgatgccaacttttcactcaaaattctgtgctcagaaaagttcaggccaactccaaatatgaggcatgaatgaaatttttacttaagcattgtaataaggaagtgggcaatcagtagatcttgctttaaagcagtgtcatattttgcaaagtaaacctataggttacatgatatggacaaaactacatacaactcatcattttctacccccagagaagcgtggtttatttatttggaaccatcaagtacaaagaactggaatgagtaatctgttgcctactgtgtccctattgatagcctgaaatggtttgaaaacctctgaggtaggagacatggttggaagcctgtgttaaacaggaaataaagacatttgcttcctgtgaaaagtggaatatgtgtgatgaaacatgacaaaggcatttctttctacccaataatgccaaattaataagtaaagcatgctctttggattagaaaatgaggtcgtgtctggttttcatccatcttttatgctctgtaggcttagtccacaaaacctaatactacagggagagaggtggccacagaagagagagaagaattacttgaagctgatctgtaaggaaataaagaataagtcaagttctcaatgtgactctgggtgtttgtagatactagaagtgagcagttgaggtcatccattacttaggattatgcaatgactttaaccttcattgatttttaaagatctgtgttttacctcttatgaatggttcactccaccccaggactgtatctgctggattcagcctgactgaattatttccccagaattaaatggtagctcagggtcaagaagactgccaagaaaaataaaaccagggaacctttatttcttctacgtcctgcttatgttcctgaaaccttgtggaaagagccatggcctagaaaatgtgagatctctgttataagacaagcagtgcacgtgactgtcaatgtgcccttggccaagtctcatcatctctgtggggaggtggactggagagggcaccatccttctctggacctctgcaaagtagttcagataaactctctagaggacagagacatgcaccaccccagtgctccttccaggacagacttactctgcctcagctgcaggaaatgtggctctcaacagacatctccagctgtcaggcccttcagggattgcctccactgcagagagccacttggcccaaggttgctaccttctcagtggtgcacatcccatactgaggaagcaatagaaagcctggccatttgggaccaacacaggacaactttgacagaccattaaaggtccagaggttgaggtaggagtatcatctgacaccaggagttcaagactagcctgggcaacatagcaagaccccatctctacaaaaacctaaaaactagctgggtgtggtggtgcatgcctgtaggcccagctacttgggaggctgaggtgggaggatcaccttagcccaggagttcgaggttgcagtgagctatgatcacaccactgcattccttcctgggcagcagagtgagactctgtctctaaaaagattaaaatacagataaatttttaagaacattccagaggtcccttgggtttggcagtagctgacaggactgctgtgcagctcaacttcttttcttgtcaagtccggcttctgtccctccccctgacaggcatcaatcccaaggtacaccctgataaacattatgaaatccatgctggagtctacttcccagagaacccaacttgcaacattctgtgaacaaaagggaagtcacccaacgctagtgtttaaaatggagaagactgggggcctctgcgtttagatccacctcctacatcccttccatgtcctcatcacagatgtagcctctccctttatgcctcatacacactgcactccaagtgtgcctttcaaaggcatccttgatatttgttatgcaaatatgctggcagtgggcagcatccagagccccgtcccttagggaaggtgctggatgccccaacccgccagggtcagtcctgtttgacctgagctttcaacctaaaatcttcacgagctgcaaagattaaaaatagcaacaataacaacaaaaccttgtggtgatataggattcgttttcctcccagtctatggaatttgtccttttgaccatgttagcatggggggcatttttaaaatacaaaagacagctgctgctcgaatcaaaggaatcacacactgttgatggttgcacaaaggaaggttgaatgtttaccttcatctcttcggatcctcactgcaggaaagttttttaagtaggacctgctctctcgttgaattataagtgaatatgaataatgttttttgggatttttttcttttttcttttttttttctttttggagacagagtctagctctgtcacctaggctgaaatgcagtggcatgatcttggctcactacaacctccacctcccggattcaagcaatcctcctgcctcagccactcgagtagttggaactacaggcacgtgccaccacacctggctaatttttgtatttttagtagagacagcgtttcactgtgttgtccaggctggtcttgaactcctgaccttgtgatcaacccgccttggcctcccaaagtgctgggattacaggcgtgagccaccgcgcctggccaggaataatctttttaaacaaaaacaagaagcatggaaactgtcatagaattcctttttgttttgttttttccatcctccctggcagattctgaaagtctgtgggagggatggatgagcacagaggaacctagtgggagagggaaatgtggggggagagggtgccatgcaaagaagagatctttaagggagaattgccggccctcttaacagtgagcagcacatgcccctattccttctccaccctggggagagaaggaaggggccaaaaggacacataactgttacgaggcattataattatagatctaaaatacatgggaaagaagcctgggggagtaggaaaattaagtctgaaatcagaaccaagttctaatccccatttgtcttttatccatgcaggatttttcagatcctcagtttttcttcacctgtaaagtgacagctgttcctaccttgtcagaggcagaggattagcaataatgcaagcgaaatgcgtagtaaagtgctcggcccatagcaggcacttagtgagaggtagtcattgatgtgaggttttttccttatgttgtgaattaaggcacagattctggaatttggtttggccgtgcatgagaagtttgtacctcaagatatgagaccccttcacaaaaagctggttgaccaattctttgtgatgaagtcgagcttagggatacaggtatgtatacttaggtgtccatggcggggcagcctgatcactgccgtttgcttgttaaagggatgatgatgtatccaatagtgacatcttgtggtttttctaccaaactgcactgttttaccagggagccctcaaatacaattgccttgtctgctatttgcgaggctttccttttgggaaaacacaaatgtaagtgagggaaagccaaataatactggaacttgctttaatagctccctatgtgaagacttgatggcaattaggatgtgtgcctagtatgctaacctgtctcataagttattttgcccaaatcattactgtaatgagatatttcctttactacatctttaggagttctctgcttgtatgcaagccagtcctgtccattttcctaatggaagccctcgtgtgtgtagaaactcagcacctgcttctgtgagcccagatggtaccagggtaattcctagacgcaggtaagtcatattccaaattatcttacaatttggcctcacccgcaagctgatctggaatggttctctcattctttatggcacaatttgtcaaatacgctatttcttaatgaaataactaacccgcgaggcagctgcagacctctgccaccagtaaaacagcaacagcatgagaaataaataaactcaaacatttgattatattgaggcaaacaggagaaaacaaaacggaatgtattttcccccctttggtttcatagcattctagcacatgataaagtacaatttggagactgagttaatgaccttttttttccccctgaaacagcccgttaagttacccagctgtcaaccgatattcttcctcctcactgtcctcacaagcttctgctgaagtaagcaatattacagggcaatcagaaagctctgatgaagtctttaacatgcaggtacttaattagctttttgtctggttgtgtttattccttttctgtctcaatcatgagtgtttctgttcattctgctgtgctgatgaacagaccaacaagcaagaacttggcttaaggacaaacctttaaacactcttcttgctttatgggtctctagagtctacaaagacgtttctcttaaaactgccccatcgctttaagacgacatcagcaagcgatggaaaagcctaggcacgctgcacaaggttcagctctgagacctgccccaagttccttctgcagtccaggactctcagagtgtgttgccactcactagctgcctcttagcttgcctttttttttttttttttttttttttttttttagcgagtctcactctgtctcccagtctggagtgcagtggtgcgatcttggctcactgcaacctccgcctcccgggctcaggcagttttcgtgcctcagcctcgtgagtagctgggattacaggtgtgtaccaccacgcccgactaatttttgtatttttagtagagacggggtttcactatgttggccaggttggtctcgaactcctgacctcaagtgatctgcccaatttggcctcccaaagtgctgggattacaggcatgagctactgcgcccggcccctcttagcattccaaaatggctttttttttctttaagaagacatgatttggctaggtgcagtggctcatgcctgtaatcccaacactttgggaggccgaggtgagcgaatcaccttgagatctggagttcgagaccatcctggccagcatggtgaaaccccgtctctatcaaaaatacaaaaattagccgggcatggtggcgcatgcctgtaatcccagctactcgggaggctgaggcaggagaatcgcttgaacctgggaggaggaggttgcagtgagccgagagcatgtcactgcactccagcctgggcaacaaagcgagactgtgtctcaaagaaaaaagaaaaaaagacatgatttgagggtctgttttaaaattatctttacttatgtacatatcagaaagtttccaaaggtattttttttatacaagaaaaatgtagtttttagggattttagagccagtataactcctgcaagcaaacattttatttaaacactactaatatggcatttatgatagttcagtaagactaagctgaaattttcctcaccactatctttggaaaggagacataacacttatttccaaattcatgctttgaacatacttgtacagataacaagaaggcatattttatgccttttagacgcactcgcctgtttttgggccctaggctggaagtcattctacttatacctcaatgaaggaatgcactgctaactggtacgaagtcacagtgtatagctgaatctaacacgaaggcattcctttggcaggagtcaaaatctcagacttttcattaattcatgcagacttctttgtcaatctaagttattaagattttctatattgttaaacggactttttgttgctaatttgaaaaaaagttgatgattttgtttcaaatacgtcagtgtcgtgggaagcctttaatcagggtatgataatagctccctgtgtgtttccagccaagtccatctacctcaagcttgagttctactcactcggcttcacctaatgtgacaagttctgctccatcgagtgccagaggtcagtgccagagtgtggggaagactgagggtgcccagagaaccttctagtcctgggaactgtggccagctgccacacgttcaggctctcgcctccaaacaggtgcagcaccactaccatgctgatgatcctctctctccttctcttcccagcttctcctttgttgtctgacaaacacaaacattcccgagaaaactcttgcctgtcaccaagagagagaccatgcagtgccatctatccaacacctgtggagccttcgcaggtactccttgtagggtagagaaactagaaaacaaggacaattctggaattgcttacctatctctgcagaaacacgcggtagctgccaaaagcaagcagctgggcagtgtcagaccaatccagctggtgaagattgcacctctgttttctgcccatggttagaaatttctgcctgagccatctttttttttttttctttgagacaggatctcgctgtcacccaggctagagtgcagtggcacaatcctggctcactgcaacctccacctcctgggttcaagcaattctcctgtctcagcctcccgagtagttgggattataggtgcccaccaccacacatggctaatttttgtatttataatagaaatggggttttgccatgttggccaggctggtctcgaactcctgacctcaggtgatccacctgccttggcctcccaaagtgctgggattacaggcatgagccaccactcccggccctgagccatatttctgatagggacacatggtagttgcttggcagtgatgctaaaagggaaatgggaagtttaccctccttgatctatttcattgctgcttcttaaacattatgcaaagtagttgggtgaataaagtgcctgtgtttgcatgccctgtgtatgtaacagaagtctgggggaacctcttaaactaggaaaatacccttgaagagaagcattctcctgcccagcagtctttgcctttgcctagacctatttaaaagagctgcaatcgattcctatctgggtacccatgagtataggagcaatttgtttgcctttgccattcttgaatgcatgagaaaagagcggttcagtcctcagcctttccctgtcaactgctcatgcgagtaagggagcttggccctcaccccctgcctgaacttggttttgaagtgatccctgtttttctgagagcagaggcttgggctcagcccttgggcacttcaggagccttgaagggtggtttcaaagttgaagattcatgggtagccctgagttttaaagatttgggaatagtttaggagcagagaaaaatagttatttctactccagctaatttctgtttttctacaccatcctggcagaagtctgtagccacatccggaagtggatgagagagagtgggatttggcttcattggtttgtctttgctgattgtgtgatcctcccgaaagtcccagggtaccgcctctgcacaacgctgatgtcttgcagaaattatatctgagtgcatttggctggactagctatttccctttgtcacttgatgatgctgcaagggaatttctcagtttgttctgctccaggagaacttcttgtcagcatgggcaactctgaaagccttctctgattagcctcccaagttttctggttttagtaaaattggaagcagtatatatgttgctaaatttcaatagtgtgcactgccgtagtacatctacttttaaggacttggtaccttctatttaatatattaggtaaaaccatgtaaaactggcatttttataagttaaaaattgtagactatcaattatttcatatattttttacctaataaatgatttttaacatgcaggggttaaatttcactcactagtgattttttgaactaatatttctcctttaattcttatttctgttttatatcaccactgtagcatttgtatttacaaagaactccacacaggccaggtgtggtggctcatgcctgtaatcccagcgctttgggattggccaaggttggaaggactgcttgagcccaggcattcaagaccagcctgggcaatatagtgagattccatctctaaaaagaaaagaaaaaaaaagaacttcatagcacaactgctatttactatttattttttacattttattatgaacatttaccatttatatttaaaatataatacaaacttttccaacactcttttctttctcaaaacctaaggctcttcccacccccttttacttaaatataattaaattatttgttcctaggctcatcatatcacacaaaaattattttgaacaaaaagttttactgaggagataatcgtctcattttctgaaaggtttcacatgcccgtatatcacatcataaaaatcaacccttgtaactttgcagaggatgctgtttaatcatattggagacggggccttgccacgcagtgacccaaatctctctgcacctgaaaaaggtaaggccagccccatggtcagtcctggaatgtgtaagggcttgttttatcctcatgttctccagtcttctgtgtgtctgtgtggaaagcagtgctctagctctttaatgatcaggactagtatgctctttaagggattaatgaaagacagttattcatgatcattcttcaaaagctgttttcctataagattttaacagcagaatctgagcaagataggaacgcctatgtttaatggctttttgttatcatccagtgagtcacccaggcaatgcctcctcttcctgaagcaaagttgccaattaggctccttgttcagcacaatgaaaatagcttcacccggatcgattcggtggtcccatccttcgtctcccttacaaagctcattcagccaactcatgtgttgtttgttgtgactcagatacggctcttgtacaattaaataccatttaagaattgcaatccagtgcataatggagtgtgccctgcctcaaggtcacacaaaatgagaaccaaacacatggacagcagtaaatagccaattaggatcagtctgcaacacggcagaagatgaagagcagattaaacacgatttcctcagctacggggtcggggcttgcagcaagtcacccattcacctctctcagggtcaagcctcaaaaataagagcagttccccaggccaataaatcaagagtcgttaatgaaatagtctgggaaagtgccttttaattgccctcattaagaagtaaactattgtcatttgggtacactgctacattagaactttccttgggagatggaaattagtgaagtcttaggcaaaattattttaaaacacaaatttagctttaatgttacaagtcacatgttcatctttgtcagtagaactaaggaatgtggtatttttctcaccccttctactaaagaaaaccacgatgcaaatttaaaagaatagagaaaaagaattttaagagtggtaactccatcccattaagtgaaaatggtcgagtggtaaaatgttgaaattctcaacatgcccaccagatggcagtgtctgtacagggagtgagtcactggaacccagatttgctgttgtaaacctcattgcatagtggctatttacaaccagcgtgtcctgcccttattcctgccaggattgccccatattcctgcatcttatcgaagcacagagcagacaaattacaaaataagaatgacactgtccatattccaaatcattttttaaggacatatttcagtgtaattcattgatttcagaaagagttatcaatgagataatattgcatggctgttctttcccaagaattctgccaaatagttaaaatattagtatgtcattgccttctccatttttaggtgtcacttgtccagaaatgtctactaaaagccaagttttaaaatagcccagtgactacatcttccatctgttatccagcatctaaacacatttgtaattctcagcaagttttacaccccagtgtaaagatttgtagttccctttgacagcattaagggaaataaagagacttgttagcgcccagttaaatggtaactataactgttaggcagccaattaaataaaggtttagtattcaagaagtttcctgttttgtttttcatccagttaagtttttcattctggataattctgactttcttctaagatctcaagcattggaagggcaaagctggaccgtgtgtttttagctgtgttattcccttccagctgtgaaccccacccctagcagctggagcctggacagtgggaaggaagccaagaacatgtcggatagtgggaaacttatctctccccctgtccctccaagacccacacagactggtgggtatttgaagaatttgaatgatcacttttataaaataacttttattgactactccagtttgtcctgaattcctgagagaaaggtaggcgtttgatttctgggataaaaaccttagtagctgcataattccttgacaattgtctccctctttcctgaacttctattacacggggtcaaacagtggtctgttccaagtaagcctctcggacagattttatagagtgctctttaccaagccaccattctcaaattcggggaggcaccctaaccttggtaggccactagcatcttctctaaccttcactttgaaccacttcattcttatcaacctccgctaactcagctactttcttcagtcttattcaggactgatgccaaagtttccagttgcctctaaatagccattgactaacagttacgctccataagcttatcagagtcattaactttgtatccatagttatctgttgctttgagaggtctttatgcaaggactatatttcgcaaagggttgattcagggtaccgcatcccctcaggtggtcgtttaagcagcaaaatcttggccaggtgttttggcttatgcctgtaataccagcattttgggagaccaaggtgagtggatcacttgaactcacaagtttgggaccagcctgggcagcatgacaaaaccccgtctctacaaaaaatataaaaattagccaggtgtggtggtacacacctgtagtcccagctacttgggaggatggcttgagcccagaagtcagaggttgcagtgaaccaagatggcaccactgcacttcagcctgggccaaataaggtagttcacacctgtaatcccagcactttgggaggccaaggcaggcagatcacttgagcccaggagttttgagagaagcctgtacaacatggcaaaaccccatctctacaaaaaaaaatgcaaaaattagccaggcatggtggcacacacctctagtcctagctagttgggaggcttaggtgggagaattgcttgagcccaggaagcagaggttgcagtgagccaagattgagccactgcactctagcctgggcaacaaagtgagaccttgccacaaaacacaataaactatgtgccacctagtttactctatacttgtcaaagccaaaagtcaagtcaccaataatttttgagagacatatgaggtcttcaaagaaaacaagaaataactttaagcttattgatcacctgcattagtatatcagtatgtgtacagaggcctaaaacttatcggccaaactatttgtatctcattcacgatgtacatatattcaggcagtctccaatttaaacctggttgtgtccctaaagttgagaacctgaaaagcattttttaaggaataatattgatgcaaatatgctgtggttgcaggggccaccatggtggtgtcagcaactgcctgagtcaggaggaagagggtcctagggaacaatcaactttctaccaccgttaaggcaggaacatagttctccgtcaggatcagcttctccatacagatgtgattttcttccataatcagcacccacgatcaacaggataggagaactaaggctggtattagaatgtgacacgtgctgacagcatgccccagcattcaagagtgcaagagagaggctgcacactaccagtgtgatcatggagcactctcactgaccccttaggacccagagcacacagatgaccttacccctcccaagttaactggcagggctgccatcccttctgcactgattgctctcatggtctgttcttatgtcatcatctgtggtcactgttgtggggctctgtaactgtctttctttcttacagcctttcagtagttgtgagttgcaaacctcactgtgacagctgggagagtagcagctaatcacagagcgacatacccagagttcaccgaaacgtctctgtggaattgagaaatgtggctgactctcaccctgttgactgtgtcacgccagcctttaccatacagggctatgctttagagagctggatttgctatacaagcatgcacacaggaacagtgctatcacacatgctgtgttccaggtgtaggacttgaaaatctagtgagaaaaagcaaacagttcactcttcttggccacgatgatgaaatccatagagacccaccaccaggggataatgggaagacctgagtacaagcattaggggaagaaatggaaaaccatgcacctgttgtatggccatggccaagggttttctacctatttggggagtactggggttgtttggggggagctgattaaatatgttcccgtagacctgttccaggctgctggggtggccatggtgttcccattggtgctcacgccaaagtcaacagctgttccccaagaactgctccctagcatctcacacctaaaagcaccttatgagacagatcaagcagtgcagaagcacctggactttggggaaacggaaaggacattggatcagtttgggaacctgtcaatagtcaaagcatcatatatgccatgataacttttcactgatgctcccatatcttggcagtgccaccctttgtgagaacccattctagacaggcatcatttagcttctcccccatcctcaccaccccctttgcttagaaggtccttatgcactggatcatctgtttgggtttgtaacacagagggcatgtgcagatagtcaatcgtctggtttttcttaattgaaatgttatctctctccccattgacagcttcaccagcaagacacacgacatcagtatccccctcgcctgccgggcgatctccattgaaggtaaaggcccttctttcgactgaggctagagactggcccagttttctttttctctaagactcatcccagatatatcaaaaggtgctttaatttgcagggaccaggcaaagaacttatcaatcagggataggggaagctggttgagaaaaacaacactggactttcccttctgggtgcctcctgcacaaacgcagccatttgtttttcgattattagcctcattctccaaatggtagcagtgagaacttgcagactgaagtcagtgcatatactgaattaggaaaggaatgtggtcctaatgtacctcctaggaaactttcagcctggccttttagtttaaggtacatcaaacacacacacacacacttagattgagaaacatcagtatcaagatctactaaatattctgtgtctttttgcctttatcgtcagccaaacccattttgtcaaagccaaacctaacattctctgttaatattttataccaagtttctcatttacattagaaatacatacttgatcatgaaaaacaaggcagtaatatggatttaaaagatttctagggaacaaactggaaagctgtaaaggtcagacattcgaattggtttgtagacatgggctatttaacatctttaaacataaaaaatccctcatgaagataaagaataatatttagtcttatccaaattgaatcagaccggcttcaaggattgtcagtacgtgagagattggtgttcagaactgctgcaccagaggcaaatatgaagtgtgtcgaaagaatgattttgtacctgagtgacttaggatttacacgctccatgtcctttgtgtgatgagctagttctagctaatgtgcaaaagacaaattagcctctacaaacacataggggcaggttgcgatccagtgcatctgtggtgctaacgatagttgctgatagaaattgagaaacgggaaaacaacccgcctccccccgcaaaatggagaaaattgaaagaagtgtgattcccttgcattgccagaatttctgacgtagaaattcgcgggtaagtgcaagtgatttgctcgttttgttctcattctgtaatgcagctgttattatgaagtacctgtgacagcattcactctggaagtcatagcctgtcacctcgatgtgatagaaaggaaagcaacatggcttttccgcacttttacatttgcccttactcacacagagctcccacacgttgctatggaattatcatctgtatttttcaacttaaattttgttgggtagtaagaaaataagtcttaagagattaattcttaaacattaaaaagaacccaagagctaaaaatgtttgaatagctataaaatagtcttagcaagctggtatatactgtctctcagcagacctgtgtacatttttactggccatatgcagttcgaagccatgtctttatatgtagggtttgaaggaagagaacatagatcgaacatttgtgttatacctcctgggttacattagggggcacactgctaccatgttactagccttgcagtgtgctgccttaactgataagagtttagtggggttttgggttttttttttaccccagccagccatcaaactgtgggtctaaccctacagcgaagactgagctgacctgccatattttgaatttcaggtctaacttttgacagaggtagcagtgaattgggaactcttaattggccttaatgttaggctcctactaaatgacaggatgtgtatctaccagcgttattttgtttacaaagagaaaccaaagtcaagttagcttaagaagatagcatttctcaaagtgtataccatagaacactagttttccaggacattatgtaataagcgggggagaaaaggtctatagtcaagtaagtttggaaaacactggactgaacaaaattatttgtattcctttattctaagccttgaaaatgcgaatatgttttgaatatacacaaggagtatacagtgtgcagcatttcccagcggaaccctcttttcacagagcatctatcttaggactcgttttccttgggatactagttgggaaagtaacaaactcagatgccaaatggggccagacagctgacacaaatgaaggaggccgggtgtagtccccacgtggcatagtggggactggcaaagtgaaaagggacagcccttctcagcttttaaagattatctctattaagagaatgtgtgccattgtggccagaactcctagttctttatgaactgccagaattctggagtttcatgtgaaatttgaaatgttaaaaattaactaaattaggtttttaaaaaactgctgaggaaacagctcacatcacaggctacagccccgagggctgccagttcgccagttcagctcaggagtctggagtctggagtgatggctggagaaatcaggtgcagaacctcgggtgcctctgctcctcctcctgagctctctgggtcttctgagctgagtgtgctcagcggccctggctcctggcctgcagcatgccctgctgagctgggaaagtgaatagcgcccccaaaggttttatggcgtttttaggtttttggggtttttggccagttccctctcttccaaactataggactaatgtgtgcctccagattatcttggtggatacctttatttattttttgagacagggtctcattgtgttgcccaggctggagtgcactggtggctccacggctcactgcagtctcaacctcccaaggttcaggtgatcctcccagaggaactgggattacaggcatgagccaccacgcccagctaaccctttggatttttagtagaaatggggttttgccatgttgcccaggctggtctcaagctcctggcctcaagtgatccctgcatcggccttctaaagtattgggattacaggcgtgagccaccatgcccagctcctttctcctctatctgaaaatgataaggagtaaactgggcggtgaactgaactcgaggactggtggccctcgcagataaacgtctggtgtgcattttcagtgctacaaaggacaacactcaaatttgagtgtgagtgtattcgtctgctcgggcttccctcacaaaataccacaaactgggtggcttagacactgggaatgtattttctcaattctggcaggtagaagtccaggatcaatgcgtggcagccttggtttccccgaggcctccctcctgggcttgcagaccgcccttcctgcaaggtctgtgtgtgtcgcattcctgacgtctccctgtgtgtccaaatgtctcttataaggacaccagtcagcttggattaggatccaccataatggccttttaccttaatcacctccttaaaggctgcatctcctgctgcagccggctttgggggtgctgggggccggggcctccgcgtcggggcgtacatttcagcgcatctgcgttcacgactcaatgctgtgtctccctctcgtttccttctccccggagcagggctctgtgcagtctttcaccccctctccagtggagtaccactcgccaggactcatctccaactcccctgtcttgtcgggcagctacagcagtgggatttcttctctcagccggtgcagcacgtcggaaacctcaggctttgaaaatcaggtgaatgaacagtcggcccccctgccggtgccagtgccggtgcccgtgccgagctacggcggggaggagccagtgcgcaaggagagcaagactccgcccccgtacagcgtctacgagcggactctgcggcgccccgtcccgctacctcacagcctctccatccccgtcacgtcggagccgcccgcgctgccccccaagcctctggcagcgcgatccagccacctggagaatggggcccggaggactgaccccggcccgcggcccaggcccctgccccgcaaggtctctcagttataagtcacttttctatgtacctgcgatgcattctttgcccgtttacaaaataagaagtatgatgagaagacatttagtgtaggcactttaataacttactcagctccttcgatgaatggaattaaaacttgcttattaaatatcatgttgcacaatattaaaagttgctgatctaaaacgccagatgttaaatgaagtatggctgaatttcattaaaacgtttctcatttggaagtggtaaatagtgataaagactccttttgtacctttttatgttcacttttttttatatagtttaatcttaaaaccaatacgatattgtcaaacgatacaatgtgtgacaatgttgtatcgtttttactgaatacttgatacttggagaaagcttattaagtcagtgcacatcctaacacagtggtccttattttagaagacttctgtaaataaggcaaggtttatcagtgcagatcatcagaattaaagttcaagcaggcgagcaagacagtatacttaaggggttgcaaagcttgggactggaaattgttttgttcttgaaacaaaatacttctttaaggttgcttttgctgtttgactgctgtctacattcgtaaaattctattttgtgaattggtagctaaatcccttactaccctgacaccgtggtatctactgtatttcttttcaaggtgcaatttgcttcagagttccaatcagctagattaagcaagaggctccagaagaaatgtttacttgaattttgcgcttcctttcttgatagtttcctatataaaatttgtcattgaacaagagcaaatgctgaagtattaatgaggcacaaatgactgtgccccattagcaagaattcaggaatcaatacagacagtattaaattaatagcttaagtgaagaaaaaaaaaacttagtgaaaatgtattagcacgattaaatggcaaaaggacttataaaaggcaagggcattaactttcagtcctgcacaaaataaaaaattcctcacgactctccacttttaccagtggagtttgtcttagctgacctgtcgtctttctcttgaaggaggattgctgtagacttctctagcttgaatattgcaacatagcatcttaggtctagatagggatgctaatgccagttgtagaagtgtgaaaaaagcaccttgtatgtagtaatgtattttatatctttgttttttcttttactgactgtttataacactcaattgacaatagatatgaactgtattttaaatcatactgttaaatattttccctcttttgttgggaagctcattttagtttaaccatgtttgttttgttggtagcttacctggaaggcagtgaccacttttttatattctcttaatgaaaccattcagcaggtatatgctgttgaggctggttatagaggttttctataataaatgttcaagtatttttgtatataactggttaattttaataagagataccattatgtgtaaaaaaaagtaaaaataaacgcaaacagttgttgatgcagtatgattgttataattatgccaaatactttacgtatggaaaaagaatatttgtacatatgtgcttttaacaattctgccatattgactttacaattttgaatgtcggaaaaattaatatatgttaaatatttatgtttagtgaaagtgttcataattgagaaaaggaacatatgcattttagctttgtatcttgcaagttttgcagtcagaaattttttgaactagcttttgcttttgataacacttcgtgtttgtaaccacattcatatatatatacatatatatgtgaagctccatatttctgttgctttaaagaagtaaaaccttccatttaaataagatgacatgcataagataacaaagcttccttgatttccttttcctgtgtaatttaatagatttgttgactagtgcttgggcacattataaatcagtgttatttgctcttggagccattttttaaaaaaaattttggcagtgagcagttgaatttatcttgaatttatcatgtgtgtgtatttctgaagcagctacatagcagaacattttaagagattctgttagcccacatgttcatgttggttgctgctgaatggtaaatattaaataaaattaccagattaatctt

SEQ ID NO: 36697 - DNA, 31506 bp, Homo sapiens
cggttctttccggaaattatgactgcagctgttttcactccgctgtgactcagagcgctccgggctgcaggagaggaaggtaggggaccaagctaccggtgcagggcctggatccaacccctgctctggaagactgagagctccacattctagctccctttccccagtccccaaatttgtaggggctccttgaattgcacgccccatgggtggaggatttcatcctgatgtatgatccccaggaaggttcctgcaagtttggcagtttaggggaatcttttggaggttgaaggagggatttagccatctcctaatctcaaggcccttcttcctactttccttctcttttactttactttttttcccgctttctttctttgatatagacaattgatgttttctcagtttcaggatagtgtaagctgaggaaatgaggctgtaagcctcatctactccaatcagttgcagcccctaagcccttctctatagaaatgtaagagaccgacgcagtctcttctgtaaatacgtggacattggaaatctaggactgaatggaaaggttaaatcaatctctgattttatccaagccccacttcttaccccaaatctcctccttgtctggttccgagttctccacttcacccctgccacaggccgcaggggtgtgtgtggccggtggtgccacccagctcccctcccaccctcctagctgctgagcggctggtgctgggactctgcattcctgaagcagctacctggctaggccggaagccttgtattctcccagctgcctcagattcatggctttcagcttggtggccagtctctacctaagccttgcaagttgcctttctgaagtgccatcctgagagacagaactaattctgacccaaactaattttgtttgtactgggaagagtgggggcaagggtgcagaatagcaagttttcctcaacggaggatttgttctgagcttagaatcaggaagcgaaggctatttccttgtaggggtgccctttgcgtctctctctcttttactctagccaccttggtgagtattgcccagcctgagagcttctctttcagctgttttactcctgtgtgagtctcctgctttaggctctctgcttaatgtgttattagaaattcttccctcccccagcccagcctgttctaccagagaacttgcccaggtcagaggtctgcgtagaagcccttttctgagcatcctctcctctcctcacacctgccactgtcctctgcgttgctgtcgaattgtgagtcattttgccacactcagtttttatccaatttctcaaaataaaaacagatatggaatgaaaagcctgatttattggtgctgtttagtgggggtgcaaatgtaggctatgtgcctatataatatttaaatatattagaatatcttggatggatacaaacaaatatactcgtatcttttaattttgggtcccaaaagaaaagccacaaggtaaatggcctgtggcaggagtccatcttgaatcacacagcttctcacatgcagcgcgtctctgaatgccatgatccaaagtgaatggtggcagaggtttattgattaacagtaacaacaataatagggacaatagtgatgtctgtcatcattgattaaatgcctcctatggcccatgtgctattgtagggacttcacatgtattaattcacatacgatgtgtggatattatactactcattttggaaagaaaatactgaggctcagagggattagtgacacctactccatatgcccaaggagtggtgaattaaatacacttttgagaaagtggaattggtatttgaaccagcctcagggtgtttcagagatttcctgtttagtagataccagtgaatcttacaccttccccacctgggactgccatttaaaaggacccttatgactgaaatctttgtctccttttttttaaaggttccaacttcctaactccaacattaaccctttgaatgtattcttatgccagagaaaggcacataaagtactggtgtttgaacagataacttccaacatgtcctctgtttgtgatatgtcttttctgcagaaatcttgcatcaccatggtgcacttctgtggcctactcaccctccaccgggagccaggtaagcctaatttgtgactcttacttgccattgaatctttggcacctatcacaaggcttgatctacaaggaggcaatctattgaagcttgatgaacttgaactctggtctatctccagtgccgctgaagagtatctctgtgagcgtgaacatttacgagtttgtggctggtgtgtctgcaactttgaactacgagaatgaggagaaagttcctttggaggccttctttgtgttccccatggatgaagactctgctgtttacagctttgaggccttggtggatgggaagaaaattgtagcagaattacaagacaagatgaaggtagtagagattacctcctcccttcttattacattacctcctcccttcttatttccttaatgcatactctttatgatctctactaaatgtaccttcacaaaacatgctgatgttgaaagctctttcttccactcttttctaactgccatttttctaaaatcatttggggaaagaaatcaatcagaggcattcagagtatagctgtgattagacaagaccaatcacacagtcgctctgcactgctcgtctctttttcagccatgtcaccttggatgttccctttctttcccatccctcgccctgtgcttctcaggcccgcaccaactatgagaaagccatctcccagggccaccaggccttcttattggagggggacagcagctccagggatgtcttctcttgcaatgtgggtaacctccaacctgggtcgaaggcggcagtcaccctgaagtatgtgcaggagctgcctctggaagcagatggggctctgcgctttgtgctcccagctgtcctgaatcctagataccagttctctggtgagtacctctcccctttgaattctagtggtgggtgacataaatggggaaattttcttaaggttgagagtgtcataaaaagtgttggcaaggaaaacagaactaaggtcatcttttatagggtcgtctaaggacagttgccttaatgtgaagactcctatagtccctgtggaggacctgccctacacactcagcatggtcgccaccatagattcccagcatggcattgagaaggtccaatccaactgccccttgagtcctaccgagtacctaggagaggacaagacttctgctcaggtagttaatgagagaatactgctattgtcagtacctctgttgcttgagtcttgacttggtccccaaccagttcttcccaagtggtaacccagagggggtcccacatgctccttgcatatcgtcatttaatctccagagccttctctccagcctcacctctgttcctagtcatgctgtcttatggaggaggactgcgccctaacctcagccccaagaagcaagaagttatgattctaatgtggctcctttacctgtcctccactcaggtttccctggctgctggacacaagtttgatcgggacgtggaactcctgatttactacaatgaggtgcatacccccagcgtggttttggagatggggatgcctaacatgaagccaggtattttctttcttcctttgtagtcatcccctaaggggcaactccctgtcttggaattactgtcgaattactctcttttctttccttccctccaggggtggttaatacatgtgaaacactgaaatagtttacactatgtcatgcaaaaatggttaggtttaatgactgtcatgtgatatgtcttgtaggcaaatttaagtagatcagtagataattgggcaaaagccaggaacagataatttacaagagaaaacatggccagtttataaacatgtggcaatgatcagtcttgacagacatccaaataatcatgtgacattttcacctttcaaattatcaacgatttccaaatctgatgcctcatgctttaaaaggttttcttaaggttgtgagtgtgctaaaaagtgaactaacctttcgaggataaatttggccatatgtgttaaatcaatgttaactttggtaatttcacttttagaaatcttgcctaaggaagtaaatccatatataagtaaaaatatgcactgagatgtcccccaccattttaataatatcgagtattagtaagcaatcaaaatgtctcttattggctaaatttgctatgctaggtatacttcatgagttaatatgcagctactaaaatagtgtatattgacagattgaagtaattggacaaatgacctccaaagaatgttacgtaaaagaaaagtaagttatagacagattaccactataaaatactctgtgctttaggaaaaacattttaaaacacaggaagaatgcaagtagtcattgtgattagattgactaagtttaattcttaattaagaaagttcttaatttcttttttatctaatacataatttctattgattgattcatcacagctacatgcagtctcaactgaagtttttttctcttttcgagatataatatatgtaacaaaattgaccattttaactgtttttaagtgtacagttctgtggtcttcaggacattcaccttgtacaaccatcaccacccttcatctccaaaacttttttgttttgccctagcttcttaatttctaagactaagtttagcttcttaataactttagtttcttagtttcttttaatgtttattacttttgaaattttccttaatgtacatgcactctttcttggaatttaaattggtgtaacccatgtcagtttgctgtgttcttggggccttcctgggctgccatgcttctgagtttcggtgacacaggactggagtgctattgccacttctgaagcatttacacatggtggaatggacatgtccttggtgacaatcatattcaaagtgggacggcttggcttaggctcttgtttttacaattatagctgttgtcaagaaaattccctgtagttgtttttctacagagtaccctactctctcattgttaatgtttgcttccaaagtagcttcatacttgagctcacaaattgaactttttagttttccctcacttgttcaaccactcttcctcagggcaagctctccatgctaaggtcattcaaggggctcccagcttccaccagatttgctgtaaccatctcctcttccacgaagctccatgctctgtctttgtacgttagttatctgctttttcctttccttatggtgactatttccttgggtgtccatgaaatattcccataacagtgacctacgtgtcagttaagattatttcaaaggactgttttcaccagagaaagttccataatgttggatctcaaaaggtaaggattgagatctcagtccctgtttttctaagaagttcccctggcccctatgcagattttctcatctagtccccatgaccaggtctgaaggccaaggggggacatcagggacagtctttacagtcttgtgaatcccttccagcaggactgctcaagtcttgcttcccaggtcgtatatttagtcaagatgacttgctgttctcatccacacaaggaagcgaatgacagctttaagcggcagcttgtctcactgaaaccattcagagttctgccaaatgaaacctacagatatatgacaaaaacacagtatgttatttgttttacagacttagaacagatgtacttacgatattaagaacatgtttttctaaaattaaatttataatttaatttaaaaattgtataaaaataaaatttacaaataattttataatattggttattatgggtttaatctgagttgagccctaaactgagttccttaagtacattatattacttaactcttacaatcaagcttgttcaactcatggtctgtgggctgcatgtggcccaggacagctttgaatgcagaccaacacaaatttgtaaactttcttaaaacattatgaaattattttgtgattttttttttagctcatcagctattgttagtgttaatgtattttatgtgtggcccaagacaattcttcttcttatatgaccctgggaagccaaaagattggataccccggcttaaaataatcttgacgtaggtgttactaccttgacttttcagaggaagacatgaggctagcaagcagaggagctaaagtttgaaatgcctcatttgaaaacaaagaagctgagactcatggaggtgaaaataatttgagccaggctaaaattatagtagataatccacatataacgcttacaattcatctggcattgttgtaaacaggttaaatatgttaccccatatcatactcatgccaccctttctgactcctcaatatagcaccagctccatttaaaccagctgtctctgagaatggaaaggaatcttgctcatcacaaaagctcctcctccatcgtatatccagacatctggattgtgtaaatgttattttttgaactagtgtcctatcatatatttgatgggcaacacccatcttatttagaagccagtttggtgtctggcatatcctatggagaagaaattaaactgagccagattctattgtcataccaaatcccaggactactgagaatataaatctatgatcctggaactgcttcttaaaaatgggataaaggaatttaattatatagcctcttatattttctgtaaagctggagttaacctagccattctcattgcatctctatctcaatactagcatttcaattcctgtatcagccctcacttgcttctaaaaatagtcacagctgtggctttgacaacatggccagatagactgggctcctgtggtcacccccacaccattgtttggatgatgataatagaatccaacatgtgtctcagtgtttccctttcttctggggactatcagcgagttattcacacccaaagcagacagacttaccttggtgggtataatacttatactctcaacacttgtaaattgtcaacctaaaaattgtccatgtgagtatcacttttttcaaagctgtaattaaagacttaaggcccatgtgatacatttcccatttatttgatttgaagaaaaggtttgattctgcagataaacttgtctgattcttttggcaaatgctggaacattttaacctaatgtatttcattcatttgcctagctgccaggaaactagtaatcagtgacaatgttttaactattgcttgtgtctactaacttctatcctctttcttctctttcatatctgttctgtttttgtctgtcttatatatttataactcaccttgaccccattgcaagcagttatggtacatgaatcatcacagtgttttagatttgagttttcctagctcttaattgaattcactaccattgattcttaggtactaggattcttgagttcctttttgtcttacagtggctttatcctttctgaacaggtcatttgatgggagatccatctgcaatggtgagtttctatccaaatatcccagaagatcaaccatcaaatacctgtggagagtttatctttctcatggaccgctcgggaagtatgcagagccccatgagtagccaggatacatctcagctgcgaatacaggcagccaaggtaaagctagtttctttcctcttctgggtcacatgctcaagtgaggatgaatctgaggggttaaataagggtctatctggagcctgagagagcagcacgaccaccctgaggctagccttggaatgtaagaaggcacaaggtgggggatggcccacatcctcaagagtcgattgacagggcccatgtgttttggcgagcctctctcactctgtctcttcatactctcttaccttcaggaaacactgattttgctgctgaagagtttacctataggctgttatttcaacatctatggatttggctcttcctatgaggcatgctttccgtaagtttctggaaagacaatagggagtacaaaacgagactttaaagaaagggactaaattgttaaaggggttactgcggagttgactttggcattgggggtttcggataagactctcttttaatgggggtttctcaattcagggactctatactgggcaaggttaagtaaccctcatgtaactgggtgtgtttgtttttctcagggagagtgtgaagtacactcagcaaacaatggaggaggctctggggagagtgaagcttatgcaggccgacctagggggcactgaaatcttggcaccactccagaacatttacaggggaccctccatcccaggccaccccctacaggtaagaagtggaacagagctaacagaagagacaggaagtgtgaaatctctaagaatctatgcccctgagcttcatgcagtatgttgaaatatagtttgcaattcacagtcttctatcatatagtaaacagaaaaaaaaaagatgatgcatttgtcttcttccttaactccatgcgatggacactggaaggccttttatggagtgccacaataactgagatgcagctaggaggggaggtgctaaaaattcccagggttctgaacagatcatgtgagaatgtggtgccagcgactgaaacattagggatttcatgcctctttgaagaggcaccagagcctctgcaatgaaataggtggatttttcaagggcaaattctggtttcttaaaaagaacttgacaaagacctgatgaacattttctttctttgtatagctttttgtctttacagatggagaagttacagacacgtttagtgtaattaaagaagttaggatcaacagacagaaacacaggtaggaagaaaatgtgatttccgggtgattggtgctgagtagtgacacacagactctagtgctacatgatgccggtgttgaccttccttcaagaggaccaaatgatttcagaatttagttttagcagctgaaaatttatttctccctgtaaacgttaaaaacagttttccaaataacatcaacaacacagcaaaaccattgtttcttattctttctaaactacaacgaacacaagaattgaatagtaagatgttaattttttttactataaacatttttagagaagtaaaacatgctgaaaactacacaaattataagcatacaactggactcattatcacagtgaatgcactgtgtgatcgccacataggtaaaaactggaatggtcgtaggcctctccatctgtacccttttccatcatgtcctattccctgtcactacacactaaaactttcctgacttacaataccatgggttatttatgcttgtttttgaatgaaaataaataagttatacagtatgcttttgtttctgtgtatattatttctttcctttcagcagtgtgttgagagattcatatacattttgagtatagccatagttcattttcattgatgtatagtattccacaaaatgactatgccataatttatatattgattttaatgctgttggacttcgatttggctgttaaaaatgatgctgctgtgaacagttttgtattcttgtacatgtattgttttgcacacacgtgtatatgcatacatacctatttatatacgtagatttttctctgagtagacagaattgtggagtttctagggaatgccaaacatttttccaaatgattgtactaatttaattcattaaattgtaggagtgttccaatcgcctaatttcctatccaaaacatgatattgtttgtctttaaattttagttttgtgtgtgtgtcgtggtgtcttatggttttttttttttttcttgagatggagtctcgctctttcgcccaggccggactgcagtggcgctatctcggctccctgccatctccgcctcctgggttcacgccattctcccgcctcagcctcccaagtagctgggactgcaggtgcccaccaccgcgcccagctaatttttttgtatgtttagtagagatggggtttcaccgtgttagccaggatggtctcgatctcctgacctcttgatctgcccgccttggcctctcaaagtgctgggattacaggcgtgagccaccgtgccaggccccttattatggttttaacttacattttcctgctgatgaatgaagtttagcaccacttcatatttacccgccagttggatgtcctcttttgtgatgtgctttcaagtctttttcctgttacttatttatttctattagattgattttcttattgatctatatagttcattctgtagtctggatacaagctctttgttgactgtatgttctagaaatactctatagtttgctcttagcttcaaaatgtatttgagtaatagttgttaattttaatgtagtttgatatttttcagtcttttcctttatggttagtgttttctgtgtcctgttaaaaagtctttccctatccaaagtttcgtatttttgtaatgtggatatcaaattgaccctattccatttatggaaaagtttgtccttttctcagtaatgcacagtgtcatctctgtcatcaataagcacctgtatacatgtacattgtttctgggtcctctgttccattgcattggtctattcatctagacgtgtgctagaactacaccatataaattagtacaggttcatgataaatcttggtttccaatagtgataagtcctcaattttgttcatttcataaccaagactgtcttgattacacttgactcttagtatttgtattttagcattagcttgtcagtttttaccaaaaaaggaaacctattggtatattggctagaactgcattgactagatctatttaagcaggacttactatttactatattgagcattccagtctatttacatagtatatcctttcatttactttggtcttttctgatttctcgaagtgtttgtttccaacattttattaagaaaccttaaacatatagagatcttgcaaaaatacaacaatgggggctggccgcagtgattgaagtcctgtaatcccagcactttgggaggccgaggcaggcagaccacgaggtcaggagtttgagaccaacctggccaacatggtgaaaccctgtctctactaaaaatacaaaaattagccagggcatggtagtgtgtgcctgtaatcccagctatcaggaggctgaagcaggagaattgcttgaacccaggaggcagaggttgcagtgagccgagatcacaccgctgcactccagcctgggtgacagagcaagaatccttcttgaaaaaaaaaaaagaacaatggacaccatataaccttcacccgggtctaccagttgtcaaccttttaccacatttgtttcagctatgttttttgtctgaaatatttgagggcaaaccacagatgtcataacccttcatatataaacacttatgcactcatctatgaacaagaacattctgctacatcacaatacaactattaaattcaagacatttaaagttgagataacacattatctaaatgcaggccatatttgtcaatttttcattatgttctttttattaagttctgggatgcatgtgcagaacatgcaggtttgttacataggtatacatgtgccatggtggtttgctgcacccatcaacccatcatctgcattagatatttctaattctatccctcccctagccccccaccccctgacaggccccagtgagtgatgttcccctctatgtgtccatgtgttctcattgttcaactcccacatataagtgagaacatgcagtgtttggttttctgttcctgtgttagtttgctgagaatgatggtttccaacttcatccgtgtccctgcaaaggacatgaactcatccttttttatggctgcatagtattccatggtgcatatgtgccacattttctttatccagtctatcattgatgggcatttgggttggttccaagtctttactattgtgacagtgctgcaataaacatatgtgtgcatgtgtctttatagtagaatgatttataatcatttgggtatatatccagtaatgggattgctgggtcaaatgatatttctggttctagatccttgaggtatccccacactgtcttccacaatggttgaactaatttacactcccacaaacagtgtaaaaggtttcctatttctccacatcctctccagcatctgttgtttcctgactttttaatgatcaccattttaactggcgtgagatggtatctcattgtggttttgatttgcatttctctaatgaccagtgatgaggagctttttttcatgtttgttggccacataaatgtcttcttttggaaagtgtctgttcatatcctctgcccactttttgatggggttgtttgtttttttcttgtaaatttgtaagttctttgtagattctggacattaaccctttgtaagatggatagattgcaaaaattttctcccattttgtagattccctgttcactgtaatgatagtttcttttgctgtgcagaagttctttcgtttagttagatcccatttgtcaattttgacttttgttgccattgcttttggtgttttagtcatgaagtatttgcccatgcctatgtcctgaatggtattgcctaggttttcttctagggtttttatggttttaggtcttatgtttaagtctttaatccatcttgagttaatttttgtaaaaggtttaaggaagggatccagtttcagttttctgcatatggctagctggttttcccaacaccatttattaaataggaaatcctttctccattacttgtttttgtcaggtttgtcaaagattagatggttgtagatgtgtgtcattatttctgaggcctctgttctgtaccattggtctatatatctgttttggtaccagtaccatgccgttttggttactgtagccttgtagtatagtttgaagccaggtagcgtgatgcctccagctttattctttttgcttaggattgtcttggctatatgggctcttttttggttccatatgaaatttaaagtagttttttctaattctgtgaagaaagtcaatggtagcttgatggcagtatggccattttcacaatattgattcttcctatccatgagcatggaatgtttttctatttgtttgtgtcctctcttatttccttgaacggtggtttttagttctccttgaagaggtccttcacatccgttgtaagttgtattcataggtatttcattcctttgtagcaattgtaaacgggagttctctcatcatttggctctctgtttgtctattattggtgtataggaatgtttgtatttttgcacattgattttctatcctaagactttactaaagttgcttatcagcttaaacagattttgggctgagacgataaggttttctaaatagacaataatgtcatctgcaaacagagagaatttgacttcctctcttcctatttgaataccctttatttctttctcttgcctgattgccctggccagaacttccaatactatgttgaataggagtggtgagagagggcatccttgtcttgtgcccgttttcaaagggaatgcttccagcttttacccattcagtgtgatattggctgtgggtttgtcataaatagctcttattattttgagatatgttccatcaatacctagtttattgagagttcttagcacaaagggtgttgaattttatcgagggccttttctgcatctgttgagacaatcatgtgggttttgtcattggttctgtttatgtgatggttacatttattgatttgcatatgttgaactagccttgcctcccagggatgaagctgacttgatcatggtggataagctttttgatgtgccgctggattcggtttgctagtattttattgaggattttcacatccatgttcatcacggatattggccttaaattttctttttttgttgtgtctcagccaggttttggtattaagatgatgctggcttcataaaatgagttagggaggattccctctttttcttttgtttggaatagtttcagaaggaatggtaccagctcctctttgtacctctggtagaattcagctgtgaatcctcctggtcctgggcttcttttggttggtagactattaattactgcctcaatttcggaacttgttattggtctattcagggattcgacttcttcctggtttagtcttggggtggggggtgtatgtgtccaggaatttatccatttcttctagattttctagtttatttgcatacagctgtttatagtattctgtgatggtagtttgtatttctgtgggatcagtggtgatactccctttatcacttttattgtgtctatttgattcttctctcttttcttctttattagtctggatagcagtctattttgttaatcttttcaaaaagccagctcctggattcattgattttttgaagggttttttctgtttctatctccttcagttctgccctgatcttagttatttcttttcttctgctagcttttgaatgtgtttgctcttgcttctctagttctatttaattgtgatgttagggtgtcgattttagatctttcctgctttgttctgtgggcatttagtgctataaatttccctctaaacagtgctttagctgtgtcccagaaatttggtgcattgtgtctttgttctcattagtttcaaagaacttatttatttctgccttaactttgttatttacccagtggtcattcaggagcagttgttcagtttccatgtagttgtgcggttttgaatgactttcttaatcctgagttctaatttgattgcaccgtggtctgagagacagtttgttatgatttccattattttgcatttgctgaggagtgttttacttccaattatgtggtcaattttagagtaagtgtgatgtggtgctgagaagaatgtatattctgttgattaggggcagagagttctgtggatgtctattagcttcacttggtccagagctgagttcaagtcctgaatatatttgttagttttttgtctcattgatctgtctaatattgaaagtggggtgttaaagtctcccactattattgtgtgggagtctaagtctttttgtaggtctctaagaatttgctttgtgaatctgtgtgctcctatattgggtgcatatatatttaggatagttagctcttcttgttgcattaatccctttaccattatgtaatgcccttctttgtcgttttttatcaaaaagcccttgaagaaatagtttttagtgaatattgtttttagtgaaagcaataaataaaaatcaatatttgagtgttacgtctgttccttactattgggctgttatttattcttggcattttcaacagacagaactggcaaatgtttttaaaaaattctgaaatttttacttatgcccctgcttcaaaggtagcagtgtagcattcttcctcttttctccaattctgtatttatgtcttcttttctacagtgagataaacctagcttccagcaaaatcagtaaacatactcatttcttcaatctacctataagtagtccacccttatccatcaggtataccttccaagactcttagtgggcgcctgaaactgtggatactataccaaaccgtatatgtaccaatttttttatacatacatacttatgatgaaatttaatttataaattataaatatctatctgatacctgaggctgctactaagtgattaacggtaatacagatagcatggagatgctggataaagaggattcatgtccagggtgggattgagcagcatggcataagatttcatcatgcgactcagaatgggatgcaatttaaaatgtatgaattgtctatttttggaatttttttatttaatatgtttggactgcagtggaccgcacataactgaaactatagaatgtaaaactgcagataagggaagccttctgtacacacaaaatctctctgtaatattttataattctctgtgtagagggcttcatgcatttttttattaaattgtttccctaggtgtttgatgctactttaaatagtattttttaataattttatttactggatgtttatttccatatagaaatgaattttaatagcttgttttaccttgacttgtatttaatgatgttaattaatttagatattaattaaattatatatttgcagactcttttagatattctatgaagaatcacatttgcaaaaaatatcagttttatttttcttattttttaaaattttctctttttcttatttttttttaaaaaattttcttcccttctggattagcctggagagaacctctaacagaaatctgaatcaaaatgatcatatccttattttattctggacctcaaagggaacatttcaactttgcacgattaagtatggtgtttgctgtaagggtttccctttttttgtagttatcctttctatgattaaggaaattcccttttatttctgttttgagggttcttttctctcttttctttcttttgttttgaataattaatgattgttaaatttcatcaaatgtattttatgcatctgtttagatgaatgtgtgattttatcctttattcttttaaagtgtgaattctaatgataattcttaaatgttagaccaaccttgaatttctggaataaacccaaagtagttgtgatgtattaatctctttcatatattttttcattcagttggataatacttttttcaggattttgaatctattttcatgggaaatattgacatatattgtcttatcttgttaggttttgatatcaattttatgctagtatcataaaatgagctgtgaaggttgccttttttccttgctccaaaaggttttctttcataaatatttattagaatttgccagcaaagctctcttggcctggatttttttgagaaagtttttgttttgaactattcatattttatgtgttcttattttttataaaagtttgtatattttattgaagttctttgcatgaaattgtccatgatattgcctaataatgttattaaattttgtagaatatatagcgatattacctcttctttcctaatgttggttatttgtgccttttctattaatatttctttccttgcactggatatttatcaattttaataataatttcaaaacaccagcacctttgggtttgttggtactttctatcatataagtgttttctatttcattaatatctgctcgaatctatctttattattttctttcttttacattccttgggttcattggccatccttttttaacatcttgagacagatgcttgatagttgatttttagactttcttttctaatgtgtatattcagagctatagatctaagcacatctgtagctgaattttaaatatggatatgacatttgccattgtcatccacttaatattttccaattatcattatgatttcttttttaagcttgtataattcacaagtacagtgcctaatttcccaatattagaggattttctatttttgttagttgtcaaagaaaaaattatagaaattagatgttcctctagatgatgtcttccctctgagaggattcattcttttcattctttgcttctgaatggtcgctggatagactgggaacagataatgttaatccagtcagggtctgatgaacttcagtcgcggtgatggctggtctatttctgattcacctctacctctgggatgtagtcctttagggttttatcctaaattcttagttgtttacaagaacactttggctgtggaaagtgcaaattgatattttgttcctcccgcctgcgtgtaaccacttaggttttaagtcatctgcttttgtacttggcacttgcttcaaagggtcaaggaacatcagatgctgggctcaattctcttggcttctctcttctcccaggtcttggcctatagatttttatcttggtagacctttgatgttttcaaacaaattattgtaaatattgtatacagctttcctagttctttgctggcttgaaacaatttacagtggcattgctgtgagcagaactttcctagggtgttatattttaagtcagaagtcattgatttaagttacagttcttctgcttgcctgcagaagatgaatcagctcatctctccatgccttagtttcctcacatgaaaattagaaacctaatagtactcactttacagatttattgttatggttaaaagagtatacttagggaaagtattaggaactgtgctagataaaaagtaagtgctatataaaattttgctattattgtaatattttaatttttattatcatccacatgcagcactgtcgtgagttctagttagtcatcaatatatttttgttgttgttgtttgattgtttagagaccgggtctgtcactttgttgcctaggctgctcttgaactcctggcactggcttcccaaagtgtgagccaccacacccagccaatattgtttagttttgattttatacaaaagaccttaaaaatataacagcactttataacataggctacaattcaaagatcatgttagaaatttaaaggttgtgatatcaagatgctgtcaggctatagtatttaggaagtattgttacacgtaggtccagttagaagtctgttcctgagtcttacaagcgtagagcattgatcctaatgctgatgccactagacttggggatgatggctcacactaagaaagactgatacataaaccaaaattgcagggtattaatttacaatgaaaactctgtctgtcatgccttccaaaagcgcctgtgctagtactaccaatgtattctttgtttatatataattctatttgggaaatcgcattatgtttaagaagttacttggtgcacatggactaaggcagggcaagaactctccatttagaagtgcaggaggcacacttcctttctctaagaatagtcttgctaggggagatatggtaccagcacatcattaggtaggaactggtgttagtttctatctttctgttagtttgccagagagatcttgcagtaagacagatcagtgctccagtgacattgctatcatttagtagttgcatgatcttggaaagatttcttaaatttcctgggcctccatttcttatctgcaaagtgaagcagaagcctgccttttaggggtcttgtgatgattaaattgcatcattgatttaaggcatttttatacctcctaaaatatagaatatgctcagtaaatggtagctgttacacttttggtcaagaaagtagactatttccttatgtatttttggccattatgtattaattttatattttcactgtttaatgccttcctctaacctctgtcctgttacaattgcaggtgtttctcatttggtattggagaaggcacctccaccagcctaataaaaggtattgcccgggcatcagggggcacctcagaatttatcacaggcaaagacaggatgcagtccaaggtgagggacagactgactgtgtctgtctggaggtggcaatccagaccaaagtggaacggggtggggaacactgtgtaagggcaggggtagcaactttcctccaggatacctgttcctatatccccaaggccttaggctgtatacttagtcaggctacttttggcctcatgaaatagaagcccactgtagtatctggaaatatgacatctggtcccagtagctgcaagctcagagacaagatgctgacagggatctgggcctttgcatttaagaccagacacagacaaactaagagctttgactgtcaagactgagattctaggtctgcgctttagaacctcttttgtactacatgcatcctccatgcaaaagatacaaagaaaaggagaaggaataatcatgatatgtctaatggatcggaagaggtagtaaattgctattccatttcatctttctgcaaaaggagaagacccctctggtggtatttcttttttttttttttttttttttttctgagacggagtctcgctctgtcgcccaggctggagtgcagtggcgggatctcggctcactgcaagctccgcctcccgggttcacgccattctcctgcctcagcctcctgagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctctggtggtatttctaagctcctctttcccagtaggtgccacctttatctaatccccttctccaagggtctcgttactcaaacattttctttatttacatttacgttactaaatatttcagctttggcttattcatatgcaaagcttcttcatatataaagcccatctcctagaatagtattgaggagtaggcatgacatgtattatgtatcacatctgatacataataaatgtccagttaattgtagctgccattgtctgtatcatttgtgtttattctgttctcttccccacattaggctctcaggactctgaaacgctctctgcagcctgtggtagaggatgtctctctgagctggcatttgcctcctggtctgtctgctaaaatgctttccccagaacagactgtcatctttaggggtcagagattaatcagctatgcccagctgaccgggaggatgccagtgagttcccattcttatttgttcctctagtcaaagagctaccacatgaccattccactaaagctggtaggtggatttcaatctcagccagagacggcacttgccaagtatagctagcctacttccttcccatcatttcaggtctccggtttcctaggctacctgattcttcatcagatattttcatacattgttttgggtacctgcccctgttctgatccttccatggatgatcagaacattacatgttccgtcatttctactcatctctaatttgcaggcagcagagacaacaggagaagtatgcctcaaatatacactccagggcaagacttttgaggataaggtgacatttcctctacaacccaagcctgatgtcaagtgagaattcagttttcccttccttccttccttccttccttccttccttccttccttccttccttccttccttcattccctccctccctccctccctccctccctccttccttccttctttcctctgccatctttggggattagatttcttctcttaattctgggctccattgtaattgttttcctacaatcattttttatttctaaaccacccaagtcttctctctccccttatctgactttatcttaactcttctattcctaacttttaggagccctgagaaactggtatatggatgtctttccctacatttcagtacttttttttttttcctttcagcctcaccattcaccgccttgctgccaagtccttgctccagaccaaggacatgggcctcagggagactccagcaagtgataaaaaagatgcattgaaccttagccttgagtctggtgtcataagctccttcacagctttcattgctatcaataaggagctcaacaagccggttcaggggcctctggctcatagggacgtcccaaggccaattctgttgggtgcttctgccccattgaagataaaatgccaatcaggtaatgagttttattccattcaaactcatatagaataaaagattctgactatctgagcacattatttaaaggaaagggctgtgaaatgttctcaaattgctttgttttccttatacctccacatctaggatttctggttagtgttaaatttttctgtcccagggaactagaatgcatcccattggcaaggagatttaaaataatccaagagaaaacaaaaaacaaacattaaaatgtagaaagtgcaggtaaaccctgagtaaccaaactgcctaatctgaagctgatttatcttttttattgagatataattcaaatatcatacaattcacccatttaaagtgtacagtccaatgggttttagtatgttcacagagttgtgcaaccattgattgccacaatcaattttagagcattttcatcacctaagaaataaacttcataactattaacagacatttcccatttctctccctgaccccacctatcttctcctccactcccctctccaccagtcccagtaatcacttacctactttctatctctatacatttgcctatcctgtctttatatatttgttctggacttattttccttctttgtttttgagacagggtctcactctgttgccgaggctggagtgcagtggcacaatcatggcttactgcagcctcaacctctcaggctcaagcaatcctcccacctcagcctcctgagtggctgggactacaggtgcatgccaccatgcccagctaatttttttgtatttttcgtagagatggggttttgccattttatccaggctgtggctggcttatttcacttgacataatgttctccaagttcatctatgttgttgcaaataacagaattttgttcttttttatggctgaataatgttacattgtgtatatatagtacattttcatcattcattcatccactgatggatacctaggttgattccatgacttggctattgtgaatagtgctgatatctctttgatattactgatttcttttcttttgggtatatatccagcagtgggattgctggatcatatagtacctccatttttaacattttaaggagccacagttttccacaatggctatactaatttacattctcaccatggtgtgcaagcattcccttttccccatatcctcaccagtacttgttatcttttgtctttttgatgatagccattctgacaggtatgaggtgatatctcatcgtggttttgatttgcaatttcctgatgattggtaatgctgaacattttttcatatacctattggccatttgtatgtcttcttttgagaagtgtctactcaagtcttttgtccatttttaaataaggttatttgctttcttggttttgagttaaattccttctgtactttgtatatattaaacccttatcagatgtttggtttgcaaatattttctcccattccgtaggttgtttcttcaccctgttgattgttttctttgctatacacaagaggtaacctcgtttatctattttttgcttttgtagcctgtgcttgtgaggtcatatccaaaaatcattgcccagaccaatgtcatagatattttcccttatgttttcttctagttgtttcacagtttcacctcttacacttaagcctttagttcatttgagttggtttttctatgtgatgagagataagggtctaatgttattctttcatatgtgtgtatccagttttcccaatgccatttattaaagtgactgtcttttacctattgtgttcttagcacttttgtcaaaaattagttggctgtaaatgtgtggatttatttctgggctctccatttctgttgcattggtcagtgtctgtttttatgcaagtaccatgctgttttggttactatagctttgtagtatattttgaagtcagatagtatgatgcctccagcattttgtttgtgtgtgtgtgtgtgtgtgtgtgtgtgtgtgttttctcaaggttactttgactatgtttttataattccatacaaatttacgattttttaatgctgtgaaggttgtctttgatattttcataggtattgcattgaatctgtaaattgctttgggtattatggccattttagcaatatttattcttccaatccaagaacatgagatatctttacatttatttgtgtcttcttcaatttccttcatcaatgtcttacaattttcagtatagagatgttttacctcctcagttaaatttattcctaaatgttttaattattttgtagccattgcaaatgagattgttttcttgatttctgtttgagagagcttgctgtttgtgtatagaaacactaatgacttttgtatgttgattttatgtccttcaactttgctgagtttgtttattctatttaacaggtgttttttttttggtagagtctttagggttttctatgtttaagatcatgtcatctgcaaacaggtgtagtttaacttcctcttttccaatctagattctttttatttatttctcttgcctaattgcactggctaggacttccagtactatattgaatagaagtggtgaaagtcagcatccttgtcttgtttctgattttagaggaaatgctttcaacttttccctcttcaatatgatattaggtgtgagtttgccataattgtctttattatgttgaggtaccttacatctatacctattttgttgagagtttttatcatgatgttgaatttgtttaatactttttctgcatctattgaaatgatcatgtttttgtccttttttatgttagcgtgatccatgtttatcaatttatgtttattgaaccaacttttcatctcttggatgaatcacatttgataatgatgcatgatcattttaacgtacttctgaatgtggtttgctaatattttgttgaggattgtgcatctatgttaatcaaggatattggcctgtaactttacttttgttgttgtatctggttttggtgtcagggtaatgctaggaagcttgtttttagggtaacactagagagcttgatggaagcaagctgacatataggaaaaaaagtagagaagtcaagaacttagtagtccagatgaggtcaaagatcaggtaaaacagaaatctctaacttagaaaactgaaaaaatcagatattatattttaaaactaggaatttttaaatttttttttttgagtcaggatctcactctgctgcccaggttggagtgcagtagtgtgattgtagttcactgcagcctcgatctcttgggctaaagtgattctcccacctcagcctcctgagtaggtaggactctagacatgcaccaccatgcctggctaatttttaattttcatattatttagaaatgaggtctcactacattgcctaggctggtctcaaacttctggccttgcgtgatccttctgcctgggactctaggcacatgtcaccgtgcccagataatttttaaaactttttataaagatggggtcttgctactttgtccaggctggtagcaagtttgtaggctcaagtgatcttcccacctcagcctcctgaagtgttaggattacaggcatgaatctctgtgcccagcttcaatttattttctatgagtggaacaattctgcataataacaaggtcttcatggcttgggaggaagtggcagaagtagaatgaagtggaagtcattggatttgatgaagttgaagaagctttgcattagggtattttataggctatctacatgggtgatgaaatctcaagatgatggtaggccttttaatggagtggaagtctatggtctagttttcagatactttaatgaatgatcggaaataacaaagagattggaagtagacaatagtgacgacatgtggaaggtaaaccgcatttaatgatctggatgcagcatcagggactgaagaggttgccaaccctacctccctacttgaagtgtggtacattgagcaacaaccatttgagagtgatggagggagaatagttttttgggaggataaattcagttttaagttgagacttagctggcagaagcctcctgtagtaaaactaaagatgcaggaaaaattgtttagcatgtgccaggggttccagaggacacagtagaaggagagctcagagggtgagggtttgcgcaggaggtgggcatatgagagaaaaatagcacagtaagggtggtgactgaagccagtgtggatgggggggtatgtatcttgaattgtcacagtcctttgcccactgcagagagcagggagtgccactgtcttaatgtttggattttttcaggttttcgaaaggccttacactctgaccgtcctccttctgcatctcagcccagaggggaacttatgtgttataaggccaagacattccagatggacgattacagtctctgtgggttgataagtcacaaggaccagcacagtccaggtgagtacctttataggaacattttctcaacaatgtttttctgtcacatatacaggactaggcaagctaaaagcttgtagttacagctatgacaagagatgcatgtttctcgaagggaccccccatgcattggaaaagattcattcctccacccacagaaccagcctggaaacttaccatgcagatgaggcaggcctcggttcacccctgcaatctatagggactgacaaactagccttcaatgttctgctgcctgtggctttctttacccaggagttcatctgtttgaaaagcactgggcagaaggtcagatttgttccgcccctatgtttcccagggtcagcctagctaggttcattaggatatcatataggaccttgaaacctgctatcccagtggagtctagggtgacccctagtcgaacaaacccccttggccatctcagctcacacagcttgcctgcgggctgccctcgccccccagcagagccctgctgccaccatctgtgagcccctgttccactggtcatcctttcacaagtagggtttgaagaccgatcttctggatgttgtctgatgactttctttctattgcattcttgctatggcctgtctctgaatttagcagccctaaattcaagtgtgctgaggtgccgatagctccacaatttctcattcttctcttttctttctcctcaaaggctttggagagaatcaccttgtgcagctgatttaccaccaaaatgcaaatggttcctgggatctgaatgaagatctagccaagatcctaggtatgagtttggaagaaataatggctgcacagcctgccgaggtaagattcaatggaaaaaggagtatgtatgtttttgagagagaggtcatcattgagaattgaggtgattcaggacctacctgaggaaggaaaatatagggggtcatagactaaattaatttgtaataaatagaggctgaaggtttttccagtcatgttagagcagaaagatcaagggattaatggggaagctagtaggaattgatggggttttttttgctggtggatgacaaagggaaagcaaaaatcctcttccactttaatcgtattccctgccaatcatcttggttatgtaactaatacttagtgagcaattactctgtgccaagcactgtgctaagcagttaatattcatgagcttatttatttcacacattaatttaataaggtagatcccatttgtgttgctgtttatagatgaagaaactgaagttcagggaggtctaaaaatgtgtctgagtttacctagcccatcagtggcagagccagattcagttctaagagtatctgtcttgagaacccccaataataacctcattattgctcctcttcataccgatgaaagtggtccagacattggcaaaagttaactgaagtcaggataggtaaagtgttgttactaggaaccacctagttgtttcagatgtatttaaatatgctgataaggataaattgcattccagaatttcaaggtaacttacaaaatcttctaacgctcattgagaagttgttaggcatgagacaggtgcaaaaagcctgaaggacaaatatcattctaaactttcaaaatgtggaaggagatcaaataaatttcagatattctgcaattccactgtccaatacagtatccactagtcacatgtggctattgtgcctttgaaacgtggctaatacaaatgaggaactgaatttttaattcaatagaggtgtgctatggtgggaaatacatactaattgcaaagacttttataaaaaggaataaaacatttcatcaataattatttttatattgattgcatgttaaaatgatgactttttaatagattgggttaaataaaatatatcagtaaaataattatacctcttttactttttaaaatttggctaccagaaaatttaaaattacatatgtttctagcattatatttttattggaaaatgctgttctagaaaagtaattaagatgataattcatacacacttggaagaggatacagggattattagatgcactgggaacaaaaaacttcagactgacatttccttctttggaatggtaaccaggccaatgaatcaagtgaaccaacagacctggtatatctgaatttcagtaaggaatttgattttttttttaatgatgagaacatggaccaagtacaaattagttgaaaacctatggcgctgaatgatgaattgatttcaaacatgaaacagatttttagacccaccaggctctgaattctctggaggtccacagtttcaatgaagatttagatgaagataaagaccaagactttcctatttgtagatgacaaaactgggagataaactatcagtcaaaagaatcaggatcccaaaaaacctctgaacaatgagttgcaacttttcattaaaaaaaaagaaaaacaacatagtaggaataaaagctaagtactgttttgggttccaaattcccaactctacaggtagagaagagagcatttgcacatgaaaatcagaggttttagatgactacaactgtgtgaatcagaatatttaactaagaaatggaggacaacagggttacctgaaatgggctgtgattgtagaattctataagtacatttacctccagatagaccatttaaggagatatatttttaaaatcattacgctgtttgtttttagactaggagaacaagcgtggggatgcttactgctttgacataagcagtcctcttaaggaagaaatggaggaattgagaattctaatctgaaataagaccactcagagaggacatgatagccatttccaagttttaaaagtcatgatataaaataggaatttcccttgatctcctgactctgaaagctgaagctgggagcagtgagcgaaaactcatgggagacaattttctgctgcatggctgagattttctattgagaaataagagaatataactagagtcagaatatttggcctttagtctcacttctgtcgtttgctagacagctaagtttgagcaaatcattttgttaatacttctatatgaaatcagttttctttcttaaaaatgtttattgatattttttcatgatttctttggtgggggggtataagggttacaattaaaaaaaacttatgaaggttctttataaactataaagcagttttgcctgtgtttctcttactagagctggccttgtcttaggggtttccagaaccgtcctggtggttacactggatttaaaacttaggattttctatttcgagactcaatggattgctgccctgaggtttaaggcctggcattatgccttgcaagtagtatctggaggtaaagagagaccaggtaactccatctagtgacatttagaaggatgctaagtgaggagggagtgaagctttttgcatccttttgagggacttcctgtgccaactggagctctctatctactgtgcagcttgtggattcctcaggctgggccaccatcctggccgtgatctggctgcacagcaatggtaaggacttgaagtgtgaatgggagcttctggaaaggaaggccgtggcctggatgcgtgcccatgcaggtaggagcacaatcctaaggcctgtctccttccccttccctggcctggcggaaggtgaccacaagagagtcccattgtcacctgcctccaccatcctgcttcagatctttactaatctttctgctagttcttttcttgggaggacaagggtgaaatattaaattggggacaaggtaggtgggtgagtagggagggagagggacacaaatggggagtgtgaactgtgagaaggacaagtggcattgattctccttactgtctcagtaccaagctgagtagaagactagacttggtgcgtgttctcctggctgtttgttatctcactgcagctgagtgtatctggggccagagaagattcaaggagaatctgggtagcaagaaaagaaaaagcagggatattgaggacagataaaagcacaactcagggtagatgatctgggaggtttggaggagcctctaattgcaatccttcatccctgcttcttgtttttcctcaccacaggctccaccatgccttcggttgtgaaagctgctattactttcctgaagtcatctgtggatcctgctatctttgccttttgaagataccatccagaaaaagaagtgcctttaatttgctactgtcatttcctctagtatcacttttgctgtgatgatgtgttcttgtgtattataactctttattttttgccataaaagtaaaggatgcttactccacttcgcttctctgctccaggttcactttggatatgatctttcttttcccaacatatgccctcagaaaagtgacagtggtcccagaacctattccctttcttgagggagttcaaaacattcataggcagtaatgttcctcccagggtttccagggaaacaacatgaaaaacaggtgacatgaactacagactaaagattgcagcatttatgttagagaatgcttgaattagagaattttctgcattatctttgtctgttcactttctatcttatatacttatcagggccatactggtaagcttgcgtaggaggagttagagggaagttgaaagccaacatctggatcaatgtaatgtcaagatcacaaagacagagactgcaggggtccactgtgagaggtgacactgttggggaccttcctgattcattcttcttgggctttgctagcctgtacaacctacatgtcttttcttccactgcctgaaagacttgggttgaactataactgttggagagagatgttcctctttaatcatgaaacaccttaagaagtctataatgcaatccttagtcctaccctgaacctatgtgtcctctaagtcaggccctgatctagtgcagtaaagggaagggtgggcttaatgggagctttgcctgggacctgaacctggagcacttaccgcattaggaagaaaggagctccccgtaatcgttcctgacccttgtgtctcatataccctatcctggtggaaatgaccctatttgatatgctgtcccttaaaataacttgtatcaatattaaaatgactatttctaccctttgatgagt

SEQ ID NO: 36698 - DNA, 171801 bp, Homo sapiens; identical to SEQ ID NO: 36446

SEQ ID NO: 36699 - DNA, 188699 bp, Homo sapiens
aattggaagcaaatgacatcacagcaggtcagagaaaaagggttgagcggcaggcacccagagtagtaggtctttggcattaggagcttgagcccagacggccctagcagggaccccagcgcccgagagaccatgcagaggtcgcctctggaaaaggccagcgttgtctccaaactttttttcaggtgagaaggtggccaaccgagcttcggaaagacacgtgcccacgaaagaggagggcgtgtgtatgggttgggtttggggtaaaggaataagcagtttttaaaaagatgcgctatcattcattgttttgaaagaaaatgtgggtattgtagaataaaacagaaagcattaagaagagatggaagaatgaactgaagctgattgaatagagagccacatctacttgcaactgaaaagttagaatctcaagactcaagtacgctactatgcacttgttttatttcatttttctaagaaactaaaaatacttgttaataagtacctaagtatggtttattggttttcccccttcatgccttggacacttgattgtcttcttggcacatacaggtgccatgcctgcatatagtaagtgctcagaaaacatttcttgactgaattcagccaacaaaaattttggggtaggtagaaaatatatgcttaaagtatttattgttatgagactggatatatctagtatttgtcacaggtaaatgattcttcaaaaattgaaagcaaatttgttgaaatatttattttgaaaaaagttacttcacaagctataaattttaaaagccataggaatagataccgaagttatatccaactgacatttaataaattgtattcatagcctaatgtgatgagccacagaagcttgcaaactttaatgagattttttaaaatagcatctaagttcggaatcttaggcaaagtgttgttagatgtagcacttcatatttgaagtgttctttggatattgcatctactttgttcctgttattatactggtgtgaatgaatgaataggtactgctctctcttgggacattacttgacacataattacccaatgaataagcatactgaggtatcaaaaaagtcaaatatgttataaatagctcatatatgtgtgtaggggggaaggaatttagctttcacatctctcttatgtttagttctctgcatgtgcagttaatcctggaactccggtgctaaggagagactgttggcccttgaaggagagctcctccctgtggatgagagagaaggactttactctttggaattatctttttgtgttgatgttatccaccttttgttactccacctataaaatcggcttatctattgatctgttttcctagtccttataaagtcaaaatgttaattggcataaattatagactttttttagcagagaactttgaggaacctaaatgccaaccagtctaaaaatgcagttttcagaagaatgaatatttcatggatagttctaaatactaatgaactttaaaatagcttactattgatctgtcaaagtgggtttttatataattttctttttacaaatcacctgacacatttaatataggttaaaaaatgctatcaggctggtttgcaaagaaaatgtattacaaaggctgctaagtgtgttaagagcatactcatttctgttctccaaaatatttcataaggtgctttaagaataggtatgtttttaaaagttaagttcctactatttataggaactgacaatcacctaaaataccaatgattacaaacttccttctggccttctggactgcaattctaaaagtgtaaaaaacatattttctgcattaagttaggcagtattgcttagttttcaaagtggtaggctttggagtcagattattttgattcagatcctacatctactgtttagtagctctgttgcctgaggcaggtcccttaacatctctgtgtgtgacttgacctttaaaatttggagactgtcataggggttaatcccttgagaaaatgaatgtgaaaagttagcctaatgttaactgctattattatggattaccatattttcacattcatcacagtacatgcaccttgttaatataagatgctcaattcatctttgagtataattttgtgactctcaatctggatatgcaatgagtgggcctgtatgagaatttaatttatgaaaaattgtgtttcacatggccttaccagatatacaggaaacacgtcacatgtttctattgtatgttgttaaatgccttagaatttaactttctgaataggatcccttcagtttgagagtcataaaagagtaaaattattatggtatgagttatagattgtattgaatatctctttatatgtctaggttttgtcattggaaaaccaaaaagtttggaaaaaaaatctaagttatttcttactttcttaattttgtgtggatttcacatcaagtataaaatttgaagaacatctgaactatcataatccatatatatatataaaataaacataatctaagagagaatttcaccatgaaaaattcaggtagttcatgactatcagagcaaacaagtacattaaattgaaacttttatgaaaataacatttatgaaataggaagctatttttaaactagaagtgatatattagcatataatttataattcatatacaagtgggattgatttataaatggtcaccaacagagattgtgctatttaatttgggaaaattttttaaatttacattttctcacaacttttaaggtagttattcagtttgttcctctctgtctcttctctcatgccctgaatttttcatatttcgtttagttgtaagagtgtatatcaaaccgtgtgtcacatgacataacttgaattttcgtcgtgatatctgtgctatgtctaggtctatactgaggaactgtgggaaccccacagaatccaagtatacagtgccactgatttcttacaagggatgtggggtctcctgtaaactctgcagttagtctcaagtaagaccaaagagtaaaatattgttaggatctaaggtggaaattcagcaaagaatcacatagtctaagtctcgagtttaacagtaagataatttgagatacttttgtaattattaaacacaaagtaatgagagattttaaaacaaacaaatacacctgaatttatatatcagaataggtatggtggttcaaaatagctatctaataaaaaccacactcctattctaaacatttgcctttgatcaaaataattttgggtctcttattatgaaattgcctttctaaataatacataaatttcttctcataagtatatattagccacattattttattgttattgttttatattcatagcttgctttagattaaaaattatattacccagactggtctcttggacttgcttccaagtgacttttgactgtatcacaaaatcaaattcactctgaaaatataaagatttttcatcataatttcctttgttaacagccaagtgctacctaattttaggtgttttcattaaaaaaaaatgcattgcaaactttaaagacaattcttttgtttgtttgtttttaaaagacagagtctcactctgttgcccaggctagagtgcagtgacacaatcataactcactgcaacctccacctcctgggctcaagtgagccttccatcttgcctcacgagtagctgggtcttcaggtgtacaggtgtgtaccaccatgcctggctaactttttttttttttaagttatatagagacagtatctcactatgttgcccaggctgctcttggagctcctggcctcaagttatcctcccactcagtctcccaaagtgctgggattacaggcgtaagccacctcaccctgtcagcctaaagacagtgcttaatgaagagaaatataagtgctttgagcaatggaagtataattaaaattatactatgaaagatttataaagatgaccattttgaatgggaccacacttatttggttatataaattatgatacactattaaaaattcatcatgatgattttgtatttacattttatttacatgtttgcaatttgtgaggaaagctaaaattatggctaagccataaatatttttgcagtttgttgagggtgtttgtaaaagtgttgccaaggaagaccagttggctacccaaacaagggtttagtctaggtctgatcaatacatacacattatctcaggtttgtctatcagaaaaaccttaggttatccaaatcaaaataaaatagatgcataaaacaaaggccaatatgtgttgaacaattatattgtgatatacaactgccaagcattcccgattaccatgactccatttagtcagtccatgggcaaatgccatcaatgaggacagcccagggtttccatattctctcttggctttacatcctataggaattggaggggcccacctctgggataggagcccttctgtcttgaacaatgttgtctgaacactaacaaatgttgactttctacaccagtccctcaatagtcttttctatttatccttttgctgaccatgttttgttattacacagttgagatttttcagctgggaatctgtgttaattttgtattaattttgattagcttaactctcagagttctaaaagtacctcctgtacctgatatatgacaaaaattataattacatttatttatatataaaatatctttgtatatgtaaaatatctttgtatatataattatataattgtttcttttaattttgcaaattttaaaaagttctcctttgttttgaagtttattcctatagttttttatatgctagttaaattattaatcacttgattcaagtaatattcttatatacttataaggaatagtgtagttttaatatttaattccttgctaaagagagaagtggaatctatttttcttagctacttcatcaatattttatgtttgatgtgacagtcaaaatatccctcagagctaactgttacactagggaaatcacggttttccagttttccatttatgtgttatgggagggagtggaacttagtgtaataatattcaatacataaatgttaacacttgtttaaaggtccttgagtgagtactgctataaaatgcattattattgctagtgtcatttcacaagagcctataatttcagtgtgatagagctacaatataagtatagtattgcaaaaccatcaggaagggtgttaactatttagcatgcagttatgtgttggttgtcaaaacgttaaaaacatctctgactcagcagcaattttggcaattttgatcctgaggcatctgtgtagggcatcttcctggagaaaaacctctgagatgcaatgaggtcaaaaggggaaaacagactatgataaagatcaagttgtttggagatcttgtagaaagattaatttacaaatatgtcaagtgcattatcatggaggaaaacattgctatttctgttggttctcttcagagctctagaatcaatttaccacatagttgtttcagtgtgaaattagcattacagagtggctttacggctttactgtagggcattgtgtcagcaaagagcttaggcttcttttagcaagaagcttgtaaaaatttaatttactcttagattgcttgatgtagagaattacattcctacagagctctgaaaaatcttttttcagagtttttcacagctgtattcaagttgcaaggcttgtcaactttgctatttttctgtgcagctctgttaacttattattatcttttgacataaattatgattccaaattgtaaagctctggatgtcagggccttttctaatttgtttagtatgatattcagaccatttcaagactcttccgtggaacaatttaataaagatttttttgtgatgttaatgagttcatggtgatcaaccctagagacctgtgtctattgtagatcgatgacattcaacagtcctgcagtgctggcatcattttgataaaaaggggtcaaagcaagtgggactgtgggcagatttttaatgcttagaacaattattccatcgaagttttcttgtgtcccttctgccttagcctttgtaggatagcatgcttgctaatttcttgctcatggggtaaggaaatgaagatttttgctaggtccgtaggattattaggactactcaggcctgaagctatgcctggatatagccagaaaactctcccatagcttgctccaaggagctgagatacagcagtacttcctttgtaggtcatgattctgggtaacctggaagatgacctcattcatattctgtattctatgtgagacgttaagaaggtagaggtggccaagaaggaaattgttgctgcctttatggaacaaattatctgaaacccagctttctcgagggcttcattgaagtactcaactggggcacttaacccagtctaaggctggtcaaggaaggcttgctgggggaagtgtcttttgtattcacacctaaaggaggttattcaattagaattatccaaagagggtagggatgggctaggaaaaatttaaacaggtagtgtggaggactgacaggataagtaagcatggcaccttcaaaatatcctgagaagttccctatgacgggaacataaaatatgtgacagagatttgtgggagatgggtctggaaactctagcaggggccagatcgtaagggggctttgtaggctttgtaggctttgtttgggctttatcatactggaagtgaaaagccatggcttttaaacaggagagggacataatcagttcatatactgttgcagttttgtaaaagaaaagatgagctgaaagagtggccatggtggaggtgggtggggtgggggggagggggcggggagagagagagagagagagagatttgaaagacatttaggaggtaaaatcaactggtttggtaatcaattagtagttgaaggtgaaggaaagagaagagttaaggataacatctatatttgttgatttggataatagaggggacagtggtgctgcttattgaatgagaaaatttaatcggagaagaaggcatggagcaggagtgcagacctatgtgactctacttctctcaaaaccagaaacggaaatgatgtatatggctcagggttaggtaatatggttatttgaaaatgtattaaagtgatttagagcttagtcttaggtaagagatataagatgtctgaggtgacagttttataaatatgtagagtgcccacttgtttggccttattgtggcatagtgtgacctgagagtgttaggaagaagcagctgagttctagggacagtactggttaaattctacttagaaattatacttagaactctcctatataacctgctaactgatgtctgaacctcctgataacttcactcctttaggcagtgcttttcacatcacgggacacaacatatgagagatcatagaaattcaatgtggtatgaaaatctgcttgggacttcagatattgtctccagtgattgaataaaaataggagctcacctactatgatgaggtttctgtgtgtgttaaaagaaggttttcattacttttgaaaaggttatgtatccttgttttatgttaaaactttgagctttgttaaatatgcagagttctctttcttagcatggactacagaggtgcaactacctcctacctgacttcacatctactcccaaatgcctagtgaaggcttaataatttcaaaaagggactctagaatttcatttgataccagtcagacaaatgtgtgaaaattaagcataataggcagaatcccaggggtactgacagctgtattaagaggtgattcaagggctaaaccttagagtccagcattggttatgggtgtgacaagaaaatgaagcctatgttggctgggattagcaaccacagttctagaggaagcaaggtggagaaactatatagggggctccctttgtacgttttatttattttaaacatctctataaactctagaaattaaaacaacaataccaacacaaaagcatcactttttcgaccaaagaccattgctatacttttttgtgtaaagggctagatagtaaatattttcagctttgtgggccacataagtctctgcaatagacaatatgcaaacaaataagcatggctgtgtttcaattaaactttattatgaacattaaaatttgaatttcatataacttttacatgttgcaaaatattctttatttaaattctattgcaatatgctttaaaagatacagtttttagtctttcttagtttaaaataaaatctagaaaaaattttaagtcttctataactttttttcggtaactgaataattttaaaagtaagtgaaacatttagacatgcaaaatggacttttcagaagaagaaaatggtagcttaacagttattagattattgtccagaataatttttgacttataagtctctgttgaccatttcattgcctctttttttggaatatgcatcttttaatgtgtccttcaaggcaaaggctctatcttatctatcttgtgtcttgcattttcccagggcaatgtttttcacaatttttttaaaaaacaatactgtaatcaattttcaaataaaattttccatgggaccgcagtgtatacaaatagcagtgacaataaaagataataactctcccataaatacaaagaaacagttaacctagtgctctaaagtaaaggctacagtgattttgtataacatttatatgtaattttcttgatcctacatggttgtgtttttcacagtgttatgtttctgaaatcgagatgccttttataattgatgtcaaaagaaacttgtcagccacaaggcccaggaataagttgtaatatgggaacttagcaatacataaaggtatatatactcctgtgacctcagctgaattatttgcattggttgcatcccacaaggttgactcttaaataaatttagtttgttgcttgaaatttcttgggataaattactttgtgatgtagttttgaaaaaaaaacaggtaatatttagtctgaagtttgtctgacatactaagcaatgtaattaaagtagaagtcgcctaagctcagcactttattatgccttgaaattatactgcctgtcctacaggtgaaggtgttatgaatgcagtttgtcactgtaactctattcatagctctgaaaggctgagagtgactcagaagaatatttttgctctgaatatgaagaacgcttagactaaaactttaattacgatgctgaagaagaaagtggtaggtgattgcatgaataagtatgtaatattgttaatttctaaaaactgtgtatagttaatgtagtgcttctttttggaaaggctattgttaaattgatggtaaattctataaccaatatcaccttaaagcaagtacgcatgataaagtattataaaaccatgataatatcatatgtggcttattattgttccctgagtgttgtacaactctgttatgctgtgatgaaacctcatgcaaacaggtatgtcaaagatatgatgggctgttaactgagcttggcccacatatggtgtagtgacatgctcactaatgcagtgcagagataaccaataacagatcataacaggtttaaatatgtgcaaggagatgtcagcagaagctttcctacatagtgaatactaaacaagcctgacagcccaggatcatgttcggatcaatctagtgtgctaaaattaacatatagtcctacatttgagaatgtgtgattttcttggttcctgtctataaaataatattttaaaatacatacatttcaaatcagaagttggtgaattcactgaaatatttctagagaacactaggtattggggctcatagtgtgaaaaccactgacttaattcttcccccatcttggttgttcctgatcttcccttgtgtccccattccagccatttgtatccttagaaaatgatctcatattctacttcatctttatcttcattgtcaactgtcaggtagcaatatatgatggaagaagcatgtactttggaatcagacagacctggctggaatcctaactctgtcacttattaacaatgtgatcttaggcaatttacttaatctctctgaacctcagctactctcgtcagtacaatgagttatccttatctttacatggcacagtattattatgatatcaaaaattcattgagtatttactctgcatattagtcaaggttctccagagaagtagaaccaatgatacacacacacacacacacacacacacacacacacacacacacaatttattataaggaattgacttacatgattatgatggctaacaagtccaaaatctgcagtatgggtcagctggcaggaaacccaggagagtcaatgttccagtttgagtctgaaggcagtctgttggggaatttcgtccttctctgggaggccagcctttttgttctatacaggccttcaaccgattggatgaagttcacctttattagtgagggcaatctgctttaaccaaagtttactgatttaaatgttaatctcatccaaaaacacccacccagttgacacataaaattaaccatcactctctgtaagcactttctatgcattaagtgatagcaaataatgccagacatagggcgtctttaataaatggtaagcactgttatcagcaacaacaggattattataattagcaccttttcatctttctgtctgggctctgagaaagtacctctcttctctaaatttatccctcctttcctatgaattagacccagtgctttctctgaattatgaaggtcacactcctacaaatgccccttcccaattgcacatctgtcggctttctttgccattgacttttatctctagcttttaaatttacaggcatatgtcagttaacaatgggaatgcgttctgggtaatatgtccttaggcaattttatcgttgtgagaatactatagagtatacctacacaagcctagatgtcgtatagcctactacacacctaggcaatatgacatagtcttttgcttctaggctacaaacctgtacggcttgttactatactgaatactgcaggcagttgtgacacagtggtatttgcatatcggaacatgtctaaacacagaaaaggtgcactaaaaatactatgtagtgatctcatgggaccaccattgtatatgcagtctgctgtagactgaaatgtcatgcagtgcataactgtatcttaaatactcaaagtatcacctttgtttgtttgtccccttgtgtgcatcatcctaacgtggaatttctctgttgattagggccagcgtattagtttgctagggctaccataacaaaataccacaaatttggtggcttaaataacaggaatttattatcttatggttttgaagactagaagtacaagatcaaggtgttggcaggtttttcttctaagggccatgaggaagagtctattccatgcctttcccctaccttctggtggtttgctagaaatccttggcattccttgacttacagaggcatcaccctgatctctgttttcatcttcacatggcattctccctgtgagcctgtctctgtgtccaaacttctttactattaatataaggacaccagtcatattggattagggtctactttagtgacctcattggaatgttattacctctgtaaagatcctatctctaaataaggtcacatccttaggtaccgggggttaggactcaaacatacctttttttggggaaacacaattcaacctataacaattgataacactctttaggagcagaatgcgatatggaagtaatttgagaccataaagtatatacatgtagggagttaatctatgaaacctattgaaagccatatatacctcatgtatagtggtccataaatagcatggagacattgcagaggatgttaagtgatatgatacaggaacaatccaagaaggtcataagaaaaaggaccttttgctcttgagaggactgaagaatgactttccatttatgaaattttggtacatgtccactaaaaataggatgaaggccaaacttaggaagaatattttgataatggagaaggttgcatataaaaacattttattgaggacaattaaataatgttggctggaagttttaggatgatcatctttaggactcagaaaaagagaagaaacattattaaagaattgtccctgaacaagtataggcaccctcacatttgcattgcatttactatagaattgaaaaatgttttgaccttttttttttggcttttaatatatttgaccaagagtaacagctaagcaatacctatttgcaatcagtgtcatcatgtgggctccaaacatatcatgtttgtgtaattaattgattgacccattaatttgttcaatttctgctctgttccaggcactgaacaacatgatggagataaaagataaatattacacctgccttgtcctcaagaagttagtcttctgagggaaagaaattagcaaacaaattgtaatctcagttatgtgccatgttccatgctgggcacaggggatacagtagtttaaaaaaaacacaagatctataaggtgtttcttcttgtggaccttacagtctagggtgcttggaaacatggggcgttggcagacaagtaaatacacattttgtggtaaaggctcaggtagaagaagtacaggatagaatagagcacaccatggggaattaatctagacttcagagaggctcacacatacataatttatgtgtgactatttcaatgcatttgaggtttcttggaaatagaggttaggttttattttaaggaagttaccattttttttttcagtgtgatgtggttgaaccaaagaatgccatgcccagtgatggtaataggataatctttttaaaaattaagagccacctaataaatcaatagtttcattcagcgggagctcctgcagagttcaaaaagaagagaatctggcacagcgtttcctttaaagttcattttcctagagtgtgaatggaagcaagagattataacattttgaggtcaaaaaaattctgaaatgcctataaaaattattttctccaaattatcatcatttgtgcttttaatgacctgattgcaaagatgaacattttgaattcttaaattgcttattaggattggttaatgaatcaattatctattactgtatgttttgctattggaaaaaatagcaacttaagtgttttgcagacctttacttaggtatatgttgcttttatgaaaaaaaagatgtaaatattaagtaaaagggatttaaagcaaggcttttgaggtagagtcttattaattccttggtaaaccttgagccaattgttgtctatgttctctgcctctgtcttgctccttccttctgggattcactgtgggaatgcgggattgttaatctggggatgctgtccaatcctgcctctctcaagctttgctattgatctccctcccagtgataataaagcttgaagaaaatgaaagtagcgttagtattggtcctcaaactcaagaacaggatgaaacttaaatcttgagtcatacaattgtgtctacatactgctccccaaaaagagaagtaaagaagatgctaactttcccttttaatttgcagtacttagcaatttgttttcttgagggttaagtaataacagtggaagaaaaaagggttaaaatgccaccaagaacccaattccatgtttagtttgaaagtgggaaatcagctgccactgggaagtctgaatccaatgccatgatgttctttgaatccttctgagaaataatcatgtgtagccataacatacctgtataacagagcagagaacataaacaaatgaaggtgaagggaagattaagacagaagagaaaaattccagaatcgactgatcatttttatctgtttagatgatttcaggcagaatcctagagaccaactttatcacaactgaattttaaaaatcaccagctttgtcattgtgatgcagcatcagtttcagtattatccttggagtattaattcttaatcatcttcatcttagaacatttttgaggtcacttctagtctctatttcaccagtgaagaaacaaaaatccccaaactatatcaggtggaattacacagtattttttttttaattttggggaaagtcgattcaaggcagtaacttgcaagctagtgttagaaaggatttaataaatagtggtttttctgtacacatagtgagaggtcattacatcatttggttgttgaaagtcataaggatgtctagcatgcgctttgcctgtagtggttcatgccaggcagattcctgactcctataacccagagcttatcagagcatttatgtccccaaagagaaatgtcacctccatctttcaataaacactttagcaaagaaaaatcaagtactttaattccaaatcttgagttaattccagaataacaatgatggctcggaaaaatatgggtatttctgtcaaaggacagagaaacctagtagagagtatttactttgggtcctagtgatggtatctgaacaagctaggtgaacaaagagcctcaataagggattttgaggtctagaaaaagagaggaaataccaaataaatggaataattataaaataaataccagcaaagttaaatcaatatatcatgtgggagatatccttatatcactcatgtgatttctattttgttcctatattaggccaaggagaggtggaacttgttttcctttttccctctcagctacgaatggacatacttaaaactgtttctctgcttctgttctctaaaatgtgattgtctaacagtaaccgtgatgacgttttgacagttgcacaagtttctttctttaagctttaaaaatgccagccagtaacccagtggcatttctactataaaatcttaaggccaatccatttccccttttccttattttcttggtttcaaatatatttttattgccaatggaaataaaaatcctaaattagagagcaatggcatcccttgtcttgtgaataaagagctcctaaatgtgaacttatacaggatgcagcaatttatagggtagttaatcattcttctttctagccagttgttccagctacagttttgtggctcttgttagtggcttcattcccagatagaataaaaatcaaaccaaaatcctggaaaggcactctgaggatgcttctctaaagtagatgggcatcaactataaatcacaatgctttgtttcctctgttatgtttcaagatgggtgggattttttttgtagcattacttattattgcctctcaagtgcttgagtctttgaaatccaagtcatgtgagtgaattagatacagctgttagaagtggcctttcaatgccaatggtacacattccttggtttctttacgatactattgctcttacaacttttatctgaagtcataaattcatagttgtcccagaagttaagttccttgcttctagaggacagaaaacaaacaatttacacaactcatggtgcatgtcaccagtccttagatctcatgaaatatgcatgaaatcttaaatcacttgctgtagccacccagccattgacatatttgaaagactttagtgtatcaaagtcactataatgaaaattttgatttcaccagttctaggagtgaaaaatcaaatgtttagtaaaactttctaaaattaacactgacagttgatttctgtatactgttgttcttaataatagctttattgagatataattcatattcaaaacaacttacccatttaaagcatacaatccaatgattttttagtatcttcaaagagttgcctatcaccataaccaattttagaacactttcatcactgtaaaaagaaactccattcctattagcagtcattccttattccaaatccccctgctcgccctagacaactacaaatgtactttccatctctatagatttgcctgttctggaaattttatgtaaatagaacaaagtgttcttttgtgactggcttatttcacttagcattttttttcaaagattcatccctgttgtagcgtgtatcagtgcatcattcttttttatttttttagagacagggccttgctctgttgcccaggttggaatgtgcagtggcatgatcatgggtcactatagctttgaagtcataggcgaaagcggtcctcccacctcagtctcccgagtagctgagactacaggcttgcaccacatgactgtctaatttataattttctttagagacagggtcttgttatgttgtctaggctgctctcaaactccagggctcaagtggtcctcctcccacagcatcctaaagtgctgggattataggtgtgagccacagcacctggcttgcatcattctttttattgttgaataatatcccacttgtaagaatatgtattttatttatcctttccccagttaatagatatttcgattgttcctaattcttgtctattataaataatggtgctatgaacatttgtgtacaagtttttgtgcagacatccattttcctttcttttgggcatatacctacgagtgtaatggatgggccatatagtaactttatgtttaatattttgaggatttttcaaactgttttccaaagtggctgcatcattttaaattccttccaccattgtgtgagtgtttcaatttctccacatatttgcaacacttactattatctactcttaaaaattacagccatcctactgggcatgaagtggtatttcattgtgagttttttttttctttttctttttttctttttttgctaatgtttgtggattttcttttcattttcttgatggtgtcctttgaagcacaaaagtatttaattttgataatttccaatttattttttgttattgctgtttgtgcttctggtgttgtatctaagtgtatgctactttaaaaaattagttgtaatatggcaaattggatacatgtgtaggctttggtgtcacaatcctaattttaaaattctgactctgcccttgacaaattaactaattaagcttccttagcctcagtttctcaactgtaagttggagatattaccaagacctacctcttgaattgttgtggggatcagatgaaataatgtatgtgaaatatttagaattatgcaagtctgtggtaatgaatactaatgttagctatcattattgttataatcccaataataaattctggtgctttgaaaattaaaccaaagccaagcagttgatatgaagaagcatgtaataatgtacagacataatgctttatagacaacattgaatttggctctcatgaacatcaggaatagtggtcatggtagttattatctccagcaggaactgtagctgagagatcttcagagctttttccaaggcgatatcactgggaaataatagagacaaggttacaagctagggctgtgttttcttcttaaaatctttagttcagtttttttcaataacagatttgtagtaggcatcaggtgactggggattcgtattcttcaagttgaaatattaccttgttgagaaagaaaccatgtgtgagacaaccatgttgagaaagaaaaagtgattttatagaaaattaatattgatagtgagcattatatgaaaatcatgaagttagaacatatttggccagaaaatttacattaatagttacccatagcaattaatgcattataattacacataccttttctttaatgaaaaagaattctttccttccaaagttatgcatgctattgttaaacattagagaatatagagaagcaaaaaagaaaatatcttttttgatattttcttaacatacgtctgttcctaataatgtttatagtttagaagcattgcatgaaatgggtagatcaattttctatttaatgtttggattcattaggtacgaagttagcaaattaatttccattagggtgcctgtatggttgtaaatcctggacctgcagaagatttttcagtattggtttgtagtcttttgtttagcagcaaataattagttctccagagcttctgaaattaattgaccactttaatggtgtttacctacctagagaaagaaaaagaacttctccaagtcccttggtaaaattaagcctcatgaacaattaactcaaatatacacaaggcttgtctttagcgagcatatactccctaaagttgattaagctgaccaagtgattactgcttataaattcaccattttatggagaagaagcaaacactgctaaataccttgtggaatcagaggaggggaaattagtaacttgaccccaatactgcgattttaaattgaattcttgaagcctacaagttttacacaggactttagagagctggatagtatcactttgtcaagtcctacttttactatgattctttgagaaaaatacatctgactaaataactctgaatctaaattggataaaataaatgtgacattcaaaatgttatttatgattttagaaaaatatccttatagacactagatgagttttagtctcaaatcaatcctccctatcatagtcacttatcaaaataactaaagcaaagtggtagagctgtgctctagaagtttgggatttatgatcacaatcttttccaatgagtcccctctttcctctgcctgtcttcaacatttgtttttttttttttttggttaggactatccagattgtgtggcctatttcaaactcatggcaaatacattggatgatcagaaattttctaatgtatttgaatttgtctacacaaactagagtaattgctattaattcctcaagtgttaattatttcatgcaaaaaggaaaaaggctattagtctttaagtgtattagtatgtcaatatttgggagaagtgtcatgcaattagtggtttgaatttcctattttattttattgcattttattttatttgcctagtcaaataaaaagtaatgttaaatacatggaagcatgattgttttctacactaaaaatcattttgacttgaaaagatctgatatccatgaccttcatctgaagttttggcagatgaaaatgtcagatgcgtcttttggattaataaaaggcaaaagtcagatcgaaaaatgagtataagctttaattatatgactttaggaggatatgttatgaaaatcaaagctttaatagtgattataattggcaagttctttttttataaggaattacaagtcactctatacaaaaattggaatttttgtcctaagaaatgaaatttactatagtttcatctgtgtgtgtgtgtgtgtgtgtgtgtgtgtgtgtttaaaaaatcaagtgatagggcttttcctcaataaaatctgaaatctcttatagttaagtgaacagaacagtgtatctaggatgctagacttttttttcaaagttagtttaaaacttatacatagtaaaatctgtatgccttagggatctctgtttgctatcccatagtgaatgattaattagtttctgttagaaatagtcagaactaggctgggtgtggtggtggctcatgcctgtaattccaggactttgggaggccaaggcaggaggatctcttaagcccaggaatttgcaaccagcttgggcaggctggtgagatcctatctctacaaaaacaaacaaacaaacaaaggacaataagaaagaaagaaatagccagagctttgaacaaaatttctaagtagaccaatgtaaaagtctgtcgtcaatatgtagtggctatgaatggaggttatgaatgaaagagaaggataagatgaactagaggtgagaggggaagacagcaggcccaagtgaaaggcagagccgagtttattgctttttggttattccaggtgtgtctgctttgtctcatgaaacacctggatgatcactgatttctagtggaagaaatgctgaaaagtccttactgtgcatttaaacattctaggtttaatatactcagggtttttcaaaagaaagggtggctggagttttgcactaactaatatttcataaagtgtctaagtatagatgtctggtttttttttgtatttctaagactggcttgaggtaggcatggagaattctttgatgggacataattttcttcctttctttttttttttttttttttttttttgagacggagttttgctcttgttgcccaggctggagtgcaatggcacaatctcggctcactgcaacctccgcctcccaggttcaagcaattctcccacctcagcctcccgcgtagctgggattacaggcatgtgcccccatgcctggctaattttttttgtatttttagtagagatggggtttctccatgttggtcaggctggtctcgaactccttacctcaggtgatccacccacctcggcctcccaaagtgctgggattacaggcgtgagccaccgcgcctggcctgatgggacatatttttcattcaattttattgatttaacctcacaaaataaaatatttccttaagatgactctgtggtcattgttgggcagcataagcttaatggattttagttatcataatttaccttaaacccaatttgtatttcaggatataaatagaggtttattgtagtgaatcttccaggaaatactaagtgatactaataattatagatggtgaacttaagtctttatattactgaatttgtttggtttgatgatgctaggctatggcattcttgctaatcaaaacgatgtgtcatggtgtaacataacttattaaaatgggcacagataacacaggaagctttttataaaagcagctcacaaattgtgttactttgaactgaactggccatttatgggaaaggtcactgggttgtaaataaggaccaaaagagttacgtttatattttttaaaagagattgaggagatttatttttacatttcttgaaaatgccttattttggtatggtattgacagatagtgaaattctgctcatttgtaaatatagtgtcatattttaataatttcaaacatattgaaaatgcagaatttattaatagtgggagcacattttcctttttactaaatgttctacaggttcttttctttccatccacacacagtgccattaccctcattctaagcctttcaaacatctggcagtaagtgatctgctgcacttagctctttccagctgagctgatttttaaattttcagaaaatttgtgagctaattgttaaacatggccattattaaaaattaaattatttcaacttataattaaataaattatattaaaacaaaagtattaaaaactcaaaagttggctgggcgcactggctcacgtctgtaatcccagcactttgggagaccgaggcaggtggattgcctgaagtcaggggttcgagaccaacctgaccaacatggagaaaccctgtctctactaaaaatataaaaaaatagccgggcatggtggtgcatgcctgtaatcccagctactcaggaggctgaggcaggagaattgcttgaacccaggaggtggaggttgtggtgagctgagattgcgccattgcgctccagcctgggcaacaagagtgaaactctgtctcaaaaaaaaaaaaaaaaaaaaaaaagaaacaaaaaaaaaaaaaaaacaaaaagcaaacaaacaaaaaaacaaaaattatcacttcctaattattttgcattttactattatctatgctattaacgttatttgccttcattgtatttgaaaggtggactatattctattgcactttcattgtactatattctaatatgcaactgtgtatcccttcccaactctgtgttcaatgactttatatttggttgctttaaaatgatgacgatgagagtatttatatcatagaaattggcaaatgccgtaagtcagtttttgtttttgtttttgttttccggagaggggattgttaaatatttgcctgcatgcaacaccactacatgcagtctgctatcttttgttcttcctgctttcaggctcctctcccagctgtctgtctagcacaacccagcataccaaattttcttaaatagggaaagttgaacatggtaaaagaatgaatgaagtcaaaagaatgtggaaagacctaggctttgccatttagtaaagtttagcatctctaagcctccatctctttatcaataaaattgagcaatgatcccttttagttctacccatttaagaagattttcaaatgaaaaccacaacctgctcatgtttatgaaggcactttggaaagcgctaaatacacgggtttttattagtagtaaacacttacttcacctttttcacttcttgactttagtttacaagggctcataatctaaattatatcataaattgctgtcccagatttttttacagcctaattgccacctgtatgttcgactttccttctgttctttatgttagatactgggatagtatgcaccaggtgggtgtgccatcactttctcagatgatgtccactgaagaccttgcatgatcatggcattcattttcctgctgtattcagactggcctcaactattttctttattgctctccaggaaaaattacaaatgaatcagactgggcaatgaagggtaaacctaattatcgctctttgttaaagacagctcttgttaaaatgcggatattgcaaattaatggaaaaaatatgacatagtaaaccatactcacttattaatatcttagtaaggaataattgatgaagttacttaaccttagagccctaattcagttaagttttaatgaaggacaagttgtagagatatcgagaacccagggcaggtgcctactgaagaagttccagaccaaggaagtataaagaaggacctgggtgggagcagtgagattggatatgagggccactggcaaagttttgccccagaacagtgtcaaaatgtttgcatttggcatagccctttctctttttgttctgaatggctttgctagaatatcttttctataatgaatttatcctgcttctcagatattgctaaagcactcccttttgaattttggtgctttaacatgcattttgatacattaccaaataaggtctgaatgacacaaattttagaactctccagagaaaagaaagatgctgagggaaaaagcataggtttgggactcactaaatcccagttcaattcctttctttaataaatatattcaattttacctgagaaagctctcgtgctctcgaattttatttagaaatttctctttgtacatgattgatttcacaatccttcttctgcctcctcttctactttcttctttctagattttcctatctttatgaagattattctgccttatcctcaacagttagaaacaatatttttgaaaatcactacggtatcctgcatagtgatttcccatgccaactttactaatttccattataaattattatttattgatgcctagagggcagatgagtgtagctgctatggagtgaggagacaaaacataagaaagttatgatcctaccctcaggtaatgattcagacatgataattaagtcaacaaattgatagaaactaatcactaactctctggctatagtcattctttcaatgaatagctcattactgagtatgcatgctacagtaacaaaattatataaggctgttgattaaatgttgattaagtgcatgtcttattcagagtttttttatatttgaaatggaagaggctggacttcagtaatttgctataaactgctagtatatgattatttgggggcagttattttttaaagaataatttaaatatggaatgtttagcagtttgttttttccctgggaaaaaccatactattattccctcccaatccctttgacaaagtgacagtcacattagttcagagatattgatgttttatacaggtgtagcctgtaagagatgaagcctggtatttatagaaattgacttattttattctcatatttacatgtgcataattttccatatgccagaaaagttgaatagtatcagattccaaatctgtatggagaccaaatcaagtgaatatctgttcctcctctctttattttagctggaccagaccaattttgaggaaaggatacagacagcgcctggaattgtcagacatataccaaatcccttctgttgattctgctgacaatctatctgaaaaattggaaaggtatgttcatgtacattgtttagttgaagagagaaattcatattattaattatttagagaagagaaagcaaacatattataagtttaattcttatatttaaaaataggagccaagtatggtggctaatgcctgtaatcccaactatttgggaggccaagatgagaggattgcttgagaccaggagtttgataccagcctgggcaacatagcaagatgttatctctacacaaaataaaaaagttagctgggaatggtagtgcatgcttgtattcccagctactcaggaggctgaagcaggagggttacttgagcccaggagtttgaggttgcagtgagctatgattgtgccactgcactccagcttgggtgacacagcaaaaccctctctctctaaaaaaaaaaaaaaaaaggaacatctcattttcacactgaaatgttgactgaaatcattaaacaataaaatcataaaagaaaaataatcagtttcctaagaaatgattttttttcctgaaaaatacacatttggtttcagagaatttgtcttattagagaccatgagatggattttgtgaaaactaaagtaacaccattatgaagtaaatcgtgtatatttgctttcaaaacctttatatttgaatacaaatgtactccctgggaagtcttaaggtaatggctactggttatcaaacaaatgtaaaaattgtatatttttgagtacctgttacatgccaggtagaatatctcctctcagccactctgagtggaaagcatcattatctctattttacagaaaagcaaactgaggctcagagagataatatactttgccagttaatgaatgatggagccatgattccagctgaggtctgtattgccttgctctctaggaatggtagtcccccccataaagaatctctcagtttcctttccaatcaaaaggttaggatccttttgattgccagtgacagaaacccaatttactagcttaagtaaataaaaggaacgaatttattggctcatgaagcctgaactatgtgaagacctaggtggagaactggccttaggaactcaatgggaccaaggactcaaatgccacctggtggcatttgccttatgctggttttattttctcagaccggaccagctttctacataaagtgggtccctggttagaactctttgctcctatctttaaggaccacgaaagaaggagccctttgtccttggctaaatgtgaaaaatcccagagactcttgagtcatagtgcttaccccttgggccactcatagtctagaatgaactaggctgagtctcgtgccaacagcacaggcctgatgccagataaaagggtgagtgaagggggataaaaaataagacatagctactaaattattgcaccaaagtaaaaacattgagttgacttgcaatttgtttcttttaattaaattcatttcctttttttggcattttgaaggcaaagtaagatattaaactttatttttattgattttattcaaagaattaagctagtgggagtagcagattcacacttctaagatcaagggccagcttctattattgaacacttggtgtgtgcaaatgccatgaggtagggatactttgttttgttttttattttttattgggttcgatctcttttgtttatgatgtatccccaagtgcctagaatagggcctggcatatggtatatactcaataaatatttgttgaatgaatccatgatggaatgtgaaatggctagcattacatagaaacctgtagcattgctggagagataaaatatataaacataatccattgcaggtatattgacaagttcaaaataatataatgggtattgaatatctaaatgtttgttgttgttgttgctgttgtttttgagacagagtcttgctctgttgcccaggctggagtgtaatggtgcaattttggctcactgcaaacttcgtctcctgggttcaagtgattctcctgcctcagcctctcgagtagctgggtttacaggcactcgccacaatgcctggctaatttttgtattttagtagatgtggagtttcgccatgttggccaggctggtcttgaactcctgacctcaagtgatctgcccaccttggcctcccaaaatgctgggattataggtgtgagccactatgcccagctttgaatatctaagttttaattggatgctgagggaatgattaatcagagtagggctgggttaattgaaaaatgtgatacatttgtatttatggccagatagagaacatgaatctgaatttgcagaattatctggcttaacatttttttctttccagttttcactgtatcccccatgttgattcaatttaaaaaatatacctattttacttcaattcaacaatgctatgccagtacaaacccatacgttctattatttttgttttgttttgtttttgtatctccaccctgttacttcttttcttataaaattggtatttgaaatttattgaaatattttggaagagtgacataccatttttggtactttgtacctctgcacccttgggaagtgaccctggcttcacatttcataactgccttgtgaccatggccctcaagtggttgccagatggttgaagaacattaacctatctggctcaattttgtgaccatggattgaatcctctacataactgcagtgtgcaaaccacacatccgttccaagattgtagtcaggatatgaactttttaagaataaaacttcttcccttctgatctgggcctggtatgtggtcctactagaaccacatcacctactcttggtgctaacaatttgtggcaccaagttgttcaagtttcacccattaaagaaattccccgaccttgccttctcctcaggtaactaccccattctattttttctttcatagctaacattctctgctctcctggtctctctacttcactttcatttacatctcagctcctgaagtatggtttccaccatgttcctaaaactacattgcccagggtcactagagacctcttatgaaatataacaacacctttctacattacttccgtgtggaccactttttcacattgaacccattttgttggtttatgtacacaccccttccttggctttcccatctgatccatttctcctttgatggagaaggtgagtctgctccatatttagcttcttactctgagtaaccaaatgttatggatgggaggttagctctgtgtgtgagagaaaggtggagaagcatgtggggagggaaatagatgggaaaaggtaattaggctttatagaagggctctcattagcaagcttctaggggatgccaagatccatgcttagagattgccaggcttgtcttcaaatctcagctgtgtattactcctttatgttttttgtttgtttgtgttgtttgtttttgagacagagtctcgctgtgtcacccaggctggagtgtagtggtgtgatctcagctcactgcaaactctgcctcctgggttcaagcgaatctcagtctcctgagtagctgggactacaggcatgcaccaccaggcctggctaatttttgtagagacggggttttgctatgctggccaggctggtcttgaactcctgacctcaagtgatctgcccgccttggcctcccaaagtgttgggattagtggcgtgagccactgccccggcctattactcctttagagtgatttagagccatgtttacttatggtaacttgacagtaatgggaataaccactgatgaaacgtaaagcctttgtctaattgtttacctagttcttccttgtggttcatgaaatttttcatctctgtacagtttgaaaattaagatgataatatttagagatattttattcctttgtgaagagaaaaaaggctttcattaacagaaatcagtggcaataacttaataaatacaatcagctggtgttcctatagtatttaaaagaaaacagaaagtttactagatttcagccagttttcagactatttaatgtctattcttactataatagaaaatatataatttgatcttgttctcatttttcaaagacctttaatacatgattttagtagttgaaaatgaagtttaatgatagtttatgcctctacttttaaaaacaaagtctaacagatttttctcatgttaaatcacagaaaaagccacctgacattttaacttgtttttgatttgacagtgaaatcttataaatctgccacagttctaaaccaataaagatcaaggtataagggaaaaatgtagaatgtttgtgtgtttattttttccaccttgttctaagcacagcaatgagcattcgtaaaagccttactttatttgtccacccttttcattgttttttagaagcccaacacttttctttaacacatacaatgtggccttttcatgaaatcaattccctgcacagtgatatatggcagagcattgaattctgccaaatatctggctgagtgtttggtgttgtatggtctccatgagattttgtctctataatacttgggttaatctccttggatatacttgtgtgaatcaaactatgttaagggaaataggacaactaaaatatttgcacatgcaacttattggtcccactttttattcttttgcagagaatgggatagagagctggcttcaaagaaaaatcctaaactcattaatgcccttcggcgatgttttttctggagatttatgttctatggaatctttttatatttaggggtaaggatctcatttgtacattcattatgtatcacataactatattcatttttgtgattatgaaaagactacgaaatctggtgaataggtgtaaaaatataaaggatgaatccaactccaaacactaagaaaccacctaaaactctagtaaggataagtaaaaatcctttggaactaaaatgtcctggaacacgggtggcaatttacaatctcaatgggctcagcaaaataaattgcttgcttaaaaaattattttctgttatgattccaaatcacattatcttactagtacatgagattactggtgcctttattttgctgtattcaacaggagagtgtcaggagacaatgtcagcagaattaggtcaaatgcagctaattacatatatgaatgtttgtaatattttgaaatcatatctgcatggtgaattgtttcaaagaaaaacactaaaaatttaaagtatagcagctttaaatactaaataaataatactaaaaatttaaagttctcttgcaatatattttcttaatatcttacatctcatcagtgtgaaaagttgcacatctgaaaatccaggctttgtggtgtttaagtgccttgtatgttccccagttgctgtccaatgtgactctgatttattattttctacatcatgaaagcattatttgaatccttggttgtaacctataaaaggagacagattcaagacttgtttaatcttcttgttaaagctgtgcacaatatttgctttggggcgtttacttatcatatggattgacttgtgtttatattggtctttatgcctcagggagttaaacagtgtctcccagagaaatgccatttgtgttacattgcttgaaaaatttcagttcatacacccccatgaaaaatacatttaaaacttatcttaacaaagatgagtacacttaggcccagaatgttctctaatgctcttgataatttcctagaagaaatttttctgacttttgaaataatagatccataatatatattcttatggaaatctgaaaccatttgggcatttgggggtaaaaagtattttattagtaaatttaaatgaggtagctggataattaaattacttttaagttacctttgagatgatttttctcaatcagagcaccacccagagctttgagaaacaattttattcacagcttctgattctatttgatgtaatttttagaaaataagttttgctggttgctttgaatcagggtatggagtacagttcactctgatcctatcatataaatcatgtaagtatataacattttcaataagtgattgttggattgaagtgaatgatatttcaagtaattgttatgtcatggccaagatttcagtgaaactcaaaatttctcctggttgtgttctccattgcatgctgcttctattgattaacctaagcactactgagtagaagctggaagaggggtctaattagaaggcccctttctatgctctgcttggcttgtaaaataatttatttctctagatcccaccaacatagtagtttcatgtatgcaaaaacacccacctaaatgtcaaagtttgtatgatacatggacatatctatagaattttttttggtctggtgcatgccaaaaaataaacatgatatagaagaatttaatatttattgagtacctaatctgttccagttcaatatgaaggtctttatgcagattattttacttaattttcctagtaactccatggagcaaaaattatctctaatttatataacaggaagttgagcgtgaggcaaattaagtaactttcccaaagttacacatatggtaagtttgagagatatcccagtctctttagctccaaagcctttgaccctttcaccataccagattatgattgctattaatatataattataattataatgattgtatttaggtactcaacagaatggtgactctagtaaccagccttggttctgctgagcttctctgcgtcttctcaggagacacaggctacagagcttgaaggctgaggattcttccagggtcacttcaggggcaaatctgaaactttcttcaggacaggaatcaacgagatcttctcacttacttatacctgggggaggaactgtatgaaatccacccaagaaccagtcatgctaagggccaaacctatagacaaaaaaagggataggagaatggagtatgtatggagaaagactaaattgttcttaaacttctcaagcttaaaaatatcccagcaaaagagatcgtaaaagcccttcatggcgtattaattatccatgcatgggggtgagtggaaaggtactcctgagcccgaggctacagctttggaactagcagcacctttgaaggggaaagcgtgtttccatcatctcaactcctactgataaccaatggaatattggtgagtaaaggatcctgggggaagaagcagctgaaatgtgtaggtgagaaggcagagagaagaatatttatattgggaatggcacaagtgtgatgaggctgcaggtttttcacccttgtcatagagaaaaaaccacgctgacaccatgcagttttaaatagtgagaaatttgcaaattgttagatcttaaataatttagataaacatagtggccatttagattattgcagttttttcaggatatctgatctcttgatttcattctttttgtctcttataagaataaaagggggggagaaaatttagccattatagtatttctctacattttctctgtccttttacataacttacaccagtgccttcctatttatggtattatttatgggtatttcttcttttctttcactgagcaaggataaatgagccagggattcttgaaactactgtaacacttctcttagaaatagatggtcatactttcagaatctctacacattcttagtccctctaaacaatgatagttgtggcataaaaatatttgcttggtttcaggactgatagagaaaagtactataaaatttgctgttaactgtgaaaggttaaaaaaaaggaggtgccatcatgaaggagctaatctttctgaagtactgctgtagttttaaatattattagctatgacttctcaccattaactatgcacttgctttttcttcatctgactcagcagccagatagatgcaacattgtctttaacatttaagactcctagcaagtccgggcacgggggctcacacctgtaatcccagcactttgggaggccgaggtgggcaaatcacaaggtcaggagtttgagaccagcctggccaatatggtgaaaccctgtctctactaaaagtacaaaaatcagccaggtgtggtggcgtggtggcgggcacctgtggtcccagctacttgggaggctgaggcaggagaatagcttgaacctgggaggcagaggttgcagtgagctgagatcgcaccactgcactccagcctgggtgacagagcgagactccatctcaaaaaaaaaaaaaaaaaaaaagactcctagcatggaagagaaactggctgttgaaaacctgaatgtgagagtcagtcaaggatagtttgagggaagccaagtagaggaagctctcacaagcagattggtgagagaatatgattatacaatgcatttattatgataagaaattcacaagcattcattcaaaatactcttgattcctaggcagctctgggcatatttccaccaacaaattgaggcatatgtcagtgcagcctaggtcagactaccttttttcattaaacctcacaaaattaaaggacatacaggagaagtcctggtactcatgttgcagactacagtctatatggcaaaggaggatctctgtcccttatgtttggatgaaaacattgggtaggcatttgaatacaagcctactgctaatatggggctaaggtctttggccccctaaaggtttgctgaaatattactgacaggaggcagattgataagaggaaaagcacataaatgtatttgacatgtatacatgggagccttcaggatgaagacctaccctctcagtgcagtatggaagcttgtataccatcttgaggttacagaaagaatgggggtttggatctttgtaaaacaggtttcagtggcaagacaggttatgagaaggagaaaggaagagacttgggtagcaaagggggtcttgttttgtaggtaaatcgttggcagcccacagagaaaatagatggagaatgtttcttttcagaccttggcaggtgtcagattctcagttaatctctcctagatttgaaaaaaaaaaaaaaggtctagaaagggagagcctggctgcactaacacattttctacagatgcaaatttctcccacaaaatacagctttgcaggtccacttctatctgctgggcctgtggcaaccatttcaaaatatgtgaatgaaatatatgtgggggtaaactatttttatttacttccctaaagaagggatggtgttctctcgggaattctgtgcatagagagcctgtggcttaggcactttgatttatgtatatctcttcctgtgattggctatctagggactgctatctccagcaaatcttctaaatgtctgccatgtagaattcctttctcatctttctgtctcacccccttatctagctgcttctctaaccctagagtgacactgcactccccacaatctcctatgtcctgaatattttaccccatcctaaactccatctctaacacagatgcactttcttgtgctgcctactgcattgtacatcttccccttagttcccatgatgcaactctgccctaccccagaaaatgtaatttaattggtctgggataaaacctgggacactatcattcttgaaatattccccaagcgattctaattatatagccaaagttgagaactatttgtagacaggcatcagcatgatcacttaatgatttgacttttgctagatctaaggtgaggaaattggagagtggtatccataggaagaactgtttagtttaattttttttttattttttcttctaaaaaaaaatccaacaacgagatacatgtgcggaacatgcaggtttgttacataggtataatgtgccatggtagtttgttgcacctattgacccatcctctaagttccctcccctactccttacttcccaacaggccctggtgtatgttgttcccctctctgggtccacctgttctcaatgttcaactcccttttacgagtgagaacacatggtgtttgattttctgttcctgtgttaatttgctgaggatgatagtttccagcttcatccacgtccctgcaaaggacatgatctcattcctttttatggctgcatagtattccatgatgtatatgtaccacattttctttatccagtctgtcattgatgggcatttgggttggttccatgtctttgctattgtaaatagttctgcagtaaacatatatgtccatgtgtctttatagtagaatgatttatattactttgggtatatacccagtaatgagattgctgggtcaaatggcatttctggttctagatacttgaggaatcgccacactgtcttccacaatggttgaactaatttacactcccactaacagtgtaaaagcgttcctatttctccacagcctcaccagcatctattgtttcctaacattttaataactgctattctgactggcatgagatggtatctcattgtggttttgatttgcatttatctgatgatcagtgatgctgagatttttaaaatatgtttgttggccatgtaaatgtcttttgtgaagtgtctgttcatatcctttgcccaccttaatagggttttttttttcttgtgaatttgtttaagtgccttgtaaattctggaaattagatctttgtcagatggatagattgcaaaaattttctcccattttgtaggttgcctgttcactctgatgataggttcttttgctgtgcagaagctctttagtttaattagatccaatttgtcaattttggctttttttgcaattgcttttggcattttcctcgtgaagtctttgcccgtgcctatgtcctgaatggtattgcgtaggttttcttctagggtttttatagttttgggttttacatttaagtctttaatacatcttgagttaatttttgtataaggtataaggaaggggtccagtttcagttttatgcataatggctaggcagttttcccaccaccatttactgaataggagatcttttcctcattgcttgtttttgtcagatttgtcgaagatcagatggttgtagatgtgtggtgttatttctgaggtctctgttctgcaccattggtctatatgtctgttatcgtaccagtcccatgctgttttggttaccgtagccttgtagtatattttgaagtctggtagcgtgatgcctccagctttgttctttttgcttaggattgtcttggctatatggagtcttctttgattccatatgaaatttaaaataatttttttttattctgtgaagaatgtcaatggtagtttgatgggaatagcattgaaattataaattactttgggcagtatagccatgttcacaatattgattctttctatccgtaaggacgacactttttccatttgtttgtgttctctcttatttccttgagcagtggtttgtagttctccttaaagaggtctttcacatcctttgttagctgtgttcctaggtattttgttctctttgtagtgattgtgaatgggaattcattcttgatttgcctctctgctgcctgttgttggtgtaaacaaaattcatttcttgttcttatttgtgaaattttggaaccaaatctattttcaaattagaaattgcttgtgataatggttttgcaacttagactggatatgagacgatgagatattagttctttcattcctttgtaggaatatggtgcatcttgcattattttagctaactagtgtcctttaatgactaatgaatatgacatggtgaaacaaagtaaaatatatatgatgcactaagtatgcattgtttccaaaggttcagcattttttttttgttaactctgctgggatctgctttatgcactgataacataacttattttatgatcttaagcaaataaaaacacttatctggacctcagtttccttaactgtacaactgagggaaactgtatagtatagctatagtacagtataccatctttaccgtcacttccatcttttaaattatgtgtatataagatagggcctagataaatggtatttatcttaaattacagtgatactagcttataacttaatttgctaggtcatgttgaactgataacaatgtgtgaactgatgagcaactgagaagtaaccaggttgtgttataacagtttgtttttgatttagggttatcagtgagggtggcggtggggaggggactttggagtctaactgtctagttcaaatattagtttttgtttatttttatttttaatttttgtgggtacatagtagatgtatatatttatggggtacatgtgatgttttcatataggcatgcaatgtgaaataagcacatcatagagaatggggtatccatcccctcaaacacttatcttttgagttaccaacaatccaatgacactctttaagttatcaaatcacagttttgccagctactagccatgtgattttgggtaggttacttaaattctcttcatctcaatttcattattgtaaagtggagataatgatagcacattttttctttttcttttttcttttattttttattattatactttaagttgtgtgatacatgtgcagaatgtgcaggtttgttacataggtatcaacaactctataaaacatgttctatccaggaaaagaaactatcatcagagtgaacaggcaacttacggaatgggagaaaatgtttgcaatctagatggcgattgcaatggcggttcgctgcatccatcagcccatcatctacattaggtatttctcctaatgctatccctccccttgctccccaccccctcacaggcccctgtgtgtgatgttcccctccctgtgtccatgtgttctcattgttcaactcccacttatgagtgagaacatgtggtgtttggttttctgttcttgtgttagtttgctgagaatgatggtttccagcttcatccatgttcctgcaaggacatgaactcatccttttttatggctgtatagtattccatggtatatatgtgccacattttctttatccagtctatcattggtggacatttgggttggttccaagtctttgctattgtgaacgctgcagcaatgaacatacataagcatatgtctttctagtcaaataagttataatcctttgggtatgtacccagtaatgggattgctgggtcaaatggtatttctggttctagattcttgaggaatcgccacactgtcttccacaatggttgaattaatttacactcccaccaacagtgtagaagcattcctatttctccacatccgctccagcatctgttgtttcctgactttttaatgatcaccattctaactggtgtgagatggtatctcattgtggttttgatttgcatttctctaatgactagtgatgatgagcttcttttcatgtttgttggctgcataaatgtcttcttttgagaagtgtctgttcatatcctttccccactttttgatggggttgtttttttcctgtaaatttgtttaagttccttgtagattttggatattagccctttgtcaggtggatagattgcaaacattttctcccattctgtaagttgcctgttcactctgatgatagtttcttttgctggatagaacatgttttatagagttgttgtgagaattaaatgcattaagcacatagaatagattctggtacatagcaagtgctctctctatatatggaactctatatgtagttggtgcaaaagtaattgtggttttcaccattgaaagtaatggcaaagaccatcattaccttttcaccaatttaaatatatggaaggaatatatatataaaacctatatatatatgtcacatatatgtctctaacccattattataatatataatacaatatatattataattataattgtatataacatatgttatataataatatagtaatatttattctaaataaatatataatactataaataatataataatttatatatatgattataatatataataggctatattatatattattaacatatacatatgtgtatatatatgtctttcatagacttaaatatatagagcaataataggttagaaaatagcaaacatgtatatataaacatatatacatatagaaaacatatataaaaacatatatatatatatatatatgtgtgttttctgcctttcatttttagagacagggtctcatcatgttgcccaggctggtctcaaactcctgggctcaagtgatcctactgctttggactcccgaagtgctgggatttcagacatgagacactgcacccagtccagtccctgtctttttaaatagactctctacctaagtgcacaaatactcattatttacatttagttatttctgtatatatgctataagcaaatcttgtagcaccagtttgatttttataaggcacaagaatatattttactaatgctttaaaatggcagctagattctagtattactttagaaattaaaattaatattttaacacatctttcattattgtgttatctgaaccaaacctattattgctgctatttcagcaaatccaggggctttttcttataaaatatgaagaatatagcttagatttctagtgaagatgttaccagtaataattaataaaatcagtaagcactaaaaggaaaataccaaaactaaagcattttgaattagtcattgaatctaaaagaaaggtagatttttttctgagattctgttctaggtgtggtatatgtgtatttttgcaaaaactataaacaattgtggcaaaatgaaggaaatatttaaaaacaaacctcttaattcttcagtggattaagcgtgaatatgtttttattttctatgatgaatatggaaaaattcatttccttagcaatttgtatgagcccaaaaactattgtcagactctgctgtatcaaaatagacaaaaaattgacactcacttttaccctgccaaaagcaaaatcttaaacttttgctttagtatataagccagcattcattgtatcctatgatgggttctgagtgtaggtgtatttgctttcttccattttttgtatgcatgttttctttttatttattattgtaagttgtatgaaatttttatccaaatttttattttcttctgattaataatcagaataatcagataattactggtaaatttgatgttaatccttccagctttttcccatgggaatttatacttaataaaggggagaagtcatcattacataatgtgcatattaatctgcttctccctttaatgtgttgtgaatgcctttccatgtcattagatgtttttctacctagttactttcatgaatcatatggctgtaccatgatttatttaatcagttcctcatcattgagtatgtaaattgcctccatttttttattactataaaaggtccttcagtacacacccctttaaaagctgactcttagaaggtgttcttgactctctacctaagtgtaaaaatacaaataaattgctttccagaaaaggtgcactactattttactttcctgatactaaactatgaaaattcagtcctaacaatagatatttaaataaagttttaaaaatgccaagtgaaaaagagcatattattattttcatttgcattacttttggttcctggtgagtttaatctgtttttgtatattaattatgcatttatatttctttttgtgtgtgtgaattgcctttcatgttctttgtgtgtttttattttgttgtatttgtctctttcttgatatatgagagaatattttccctagcctgtcaattgccttgtaattttgtttctagtgagtttttttttttttttttacaattaaaagctttaatttttgaaaattttgctggcaaatctatatatctttttctttgttttctgctttgacattattcttttataaaggcccatgccacccaaatattatgtaagcatgcatctatgtttttattacttcatcttttacatttaaatatctactctatttagaattcattgtgatgcatgtatgaggtagaaatctaatttcaaaaagatgagtatccagtttgtccatcatttattgcatgatctctttctccactgaattaaaatgccgtattttataatatattaaagtattacatgtgcttggacatgttcctggacttttgagataaatcagtctatttctttgtcatgtcacatattattatggctttatgatttaatatccagtaatgtaaaccctctgacacattattcttattcctcaaatgtttttgatgagttttcttccaaatgaaatttataatcattttattcattgattcaacaaatatttgttgaatggatattctgtgcttggtattgtgcatggtattaggattgttgcaaaaattgagactgacagtccctactcttacggtgctaaaaattcacttccaaaaaaatctttaaatgttgatgaagattgcactaatcttataaaataacttggaggggaatgtaatctttgcaacattaagttcttcattttagaaagttttaagactctccatttatttgagacttttaaaatatgtcccaataatgttttgtgagatgtatattttaagatatatatcttattgctattacattgtatcttttgttatattgttactatgaatgggatactcatttaattagatgtcatttttggtatatagaaatctattttcttagcatagtcattttttaaacctcgatctattaaattcttgattcatttacatttgttacacaatcatattctatgctgataatacttcttgcttctttccaatatttgtacctcgatcatttttcttgttgagttgtattagctagaagttctagaaaaatgttaaatggtagtaatagctagtattctgttttttcctgactctaaatgtaatgcatctagacttttataattatggcattgattgtaacattttgaggaagaaatcctttttcaggttaataatgtatctttatattcaagtttattaagaacatttattggaaacatattgaaattttatcagattccttttcagttgttactgagataatcataggttcttctgtattcttttaattaatttctcaaaattaaactgtcctattattcttggaataacgacatataaagtactgtatatttaaaagaagttaaaatgataatggtgattttattaagtgacctcacacaatagaaaacagtgtagccttagaagttttccaagtgaccattctacttagaaacaaccctgctttgggatcagaactgtaatttttaaagtaaagttttctgggtttaattcatttagtgtaattacaagcatgagttcaggtttctatttttttcacctgaactttccttcatggtttgaatatctagaaaaagcagactttcctatctctagactaaacatttgatcctatcttaggtatgcattacaattttttaaccataaatggttaaagaatttagactcatctacaataactttgaagctctggtcttgaagaacatgtgagaaatgagatataactcctagaagatataggagacatttttagtcttccaaattttccctgggaggctgatctaaattgagtcacaaaattgttcccaccaggaatgcaatcacttgagctgttttctaatctgagcccctctacccagatgatcttctgaactcatactgttcagactttcatccttctgagtagaaaacagccatagtcatggcaggatgagggctaggacaattacccaaggaattcttggcctctgccatgggactctgcagactcagatcatataatcagagatgttagcactggaggggacatcacaattagctttctccacctcttagtttatcagtgaggaaaactgtccagagcgcggaagagactaaaataacacagccaatgtaggtaatgtgctggataagaatttggaattcacgattttgaattcagtgtttatttcaccatcacgctggcttacacgttggtatcaggcttcttctattattgaagtgagccattaagtgaattccatcttgatttgtgtctgatacagagtaataaactattttattaaatatccaaataattatacattcctccttcttacatgcaagcctaagtttgcttgtactatttcatgtggtagcaaatcaggacgcttcttgtgtctctgaaaatactctgagtaatggagtacagtcagctttcttgtaccaagaatatagggactatgtttctcccagtcattctggggataatttttgtgaaggattgcacttcataggttaagctaggtatcagttaccagtgttttttccaaataaaaaaaaaatcaggtgatatctgtaaatggttccattgtaaatattaaagaacatgatgcttaaaacagattagggaaaactatagaaggggtggggtttcggagtgctaattttgtccttgaatggtaacagctccatgtggtggtgaggtttatgttggtttgctgtttgcagatgatcttattattagaatttttcataccgaaaataaactgcattttagtttgtaaacatgcccttccagagtaatgctaccagttctttgtgaaatagctactgttgttcaaaggatgactatgtcctcttcggttgaggaaagatgacaacaaactcagtaatgacatgtaaaataggtattacaaaccaggtatggtggcatgagcctgtaatcccagctacttgagaggctaaagcaggaggatctgttgatctatggatttgaggctgtagtgtgttgtgatggcacctatgaatagcccttgcactccagcccaagcaacaaagcaagactgtctctgaatttttgttttgttttgttttttgtttttttttttttgagacagagtcttgctctgtcacccaggctgaagtgcagtggcgcgatctccactcactgcaagctccgcctcctgggttcacgccattctcctgcctcagcctcccgagtagctaggactacaggcgcccgcctccacgcccagctaaattttttgtatttttagtagagacgaggtttcactgtgttagccaggacggtcttgatctcctgaccttgtgatcctcctgcctcggcctcccaaagtgctgggattacaggcgtgagccaccgcgcccggcccctgtctctgaattttttaaaaaggcattccactcaaattaatacacattttaattgtgttttgttgtaaattacaactgaataaaaattcagcaaataagtctgttgtggtagggaaaagtctattgtgatctggaaaatataatggagaaatccagtggaagagattttatttcacattactcaaaataaaaaaatcttatacaagtctttacacttgtaacttgaaaaattctgtgctaaaatttagcttggttgctaaaatatttctctttttttctcagaagcttctttttagcatcctatagacacaagttactttttaaaatatttgcatacttgctttgcaatgtattgtttatcagtagttctatattctttgagatagtctatccagtctttctgtatttatcgtatgtctgtatagatatatattagcagataaatgagttctgaaaggggagaaatgtgattatgctaatcatgatataaagaattgactttataagcagtgttcacaggtcatacctttcccgttactgtcttacagtgaacaagaaatgatgctttgtctggtatgcatggtaaataatgccccttgctctctgcttcatgatcacatgtgatacttctaacatagatagcacatgtaaatccagtggccttgactgcaactcaagagagcattttggccaagtacaaacccactagtcatgaaaaaaaaaaaaaaaccaaatcaaagtaaattgatggtattgacatttgtctatgaaaaacaacataatatagaacaattctggggtaaaatattgatctaaaataattttaaggattaaatattgccattgtaagcatactatgagcaattatgtttgtaatgcagatatatttataattttaaatccaagatttaccttaattgtacattttcctaatttaaaaaagttattttgaaaaaaaaatcctcgaatctagagaaaggttggcaaatacatatggaactttgtaaaaaacatccagggcagcactttcactgattgcagtagcttaggagtgaaaaacaacacaactgctccaatgtatggcaatgggcaaatatcccgatttattcacagggtggcatgttaggcagtgcttagaataaatgagttggttatacaagtatcaatagggataaatgtgaaaaacacagtgttaagtttttaaaaagttgtaaaaagcacagtaggatgttatttatataaaatttaaaaacctcaaaaaccattcttctttgatatatattctaaagatgaacatatatgtaatagaagtacaaaacatacataaaataatatacactatgcagtcatttgtgtacttacttttcaaaaatatttcagtagatatagcaaacagttaacatgtaatatttggataggaggttggcaattttctttttagcacctgcctgtctgctatcattcaaactcacatttaaaatgtggctatgtgagatgagagaactataatattccaggtttgtgattagtttggaaactttttaaaagtttgaatgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttatatttaaagttaatattgttatgtgtgaatttgatcctgtcattatgatgttagctggtgattttgctcattagttgatgcagtttcttcctagtctcgatggtctttacattttggcatgattttgcagtggctggtactggttgttcctttccaggtttagcgcttccttcaggagctcttttagggcaggcctggtggtgacaaaatctctcagcatttgcttgtctataaagtattttatttctccttcacttatgaagcttagtttggctggatatctctcagaccacagtgcaatcaaactagaactcaggattaagaatctcactcaaagccgctcaactacatggaaactgaacaacctgctcctgaatgactactgggtacataacgaaatgaagacagaaataaagatgttctttgaaaccaacgagaacaaagacaccacataccagaatctctgggatgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccaatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcatagaattggaaaaaactactttaaagttcatatggaaccaaaaaagagcccgcatcgccaagtcaatcgtaagccaaaagaacaaagctggaggcatcacgctacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggtattaccattcaggacataggcgtgggcaaggacttcatgtccaaaacaccaaaagcaatggcaacaaaagccaaaattgacaaatgggatctaattaaactaaagagcttctgcaaagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacactactcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaataggaaagacttggaaccaacccaaatgtccaacaatgatagactggattaagaaaatgtggcacatatacaccatggaatactatacagccataaaaaatgatgagttcatgtcctttgtagagacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttagagtataaaaaaaaaaaaaaaaaaagtttgaatgttttcttgcattcagagccttggttgacatagttaattaaaaataaaacattgtatataaagcacagaatgagcagctacacaaagctgctcaatcaatgacagctctatatgggttagggtttcttgtggggatgacattgatgtagaaagcatggtcatctattgagaatgatggggctggaggtattggatacttgaggtttagaaaatacattgtagaaaatggacaaaaacccctcaaattaagggatgaggcagaataatgcttggcaataccaggggtaggctgcagtctttcttggaaatatatattttaaatggaaccaattatcatagcatcatttcctctcagggttaccctctgatccctattttactaaatcgttataaaacaaaatgaggaattatgtgtccttcccttttgaagccaatgtaacaagatgggtaagaattagacctcctgagttcaaaatccctggattcagatctattcctgtatattcaggagaagtggtaataaattcgatggacaatttggtttagtagtcgattgaggaccctgatgaggtatatttgggaaaacataacttccgctctctctcattgactcacgggcctttgaggagtccaggagtcattggaatctggcctgaggttgaggctgctggcaaaactccttccccaaagtccattcctattgctgactgagaagggactagcattggaagtggctgattttaaataccgctagtgctggtgtgctcctccctcccattcccagctctgctttgtgtagttgccttgagaagctaagttcattctgaaaataatgccattgcacaaaacacttttgaaagttctagtttgaaattacatcaggtcacttggtctgtgtggcctcagtttcttcatctgccatgtgaaaataataatgcctactctgtagcaaagaaagtctctatagtaaacaaaaaaaaagcctactctgatactgaaagttgttatgaaaaataaaaaagggaaatgctttagaaactgttaagtgctatgtagatgttactaattaacaaaccatttcagaaactatactttttattttatggccactattcactgtttaacttaaaatacctcatatgtaaacttgtctcccactgttgctataacaaatcccaagtcttatttcaaagtaccaagatattgaaaatagtgctaagagtttcacatatggtatgaccctctatataaactcattttaagtctcctctaaagatgaaaagtcttgtgttgaaattctcagggtattttatgagaaataaatgaaatttaatttctctgtttttccccttttgtaggaagtcaccaaagcagtacagcctctcttactgggaagaatcatagcttcctatgacccggataacaaggaggaacgctctatcgcgatttatctaggcataggcttatgccttctctttattgtgaggacactgctcctacacccagccatttttggccttcatcacattggaatgcagatgagaatagctatgtttagtttgatttataagaaggtaatacttccttgcacaggccccatggcacatatattctgtatcgtacatgttttaatgtcataaattaggtagtgagctggtacaagtaagggataaatgctgaaattaatttaatatgcctattaaataaatggcaggaataattaatgctcttaattatccttgataatttaattgacttaaactgataattattgagtatcttctgtaaactgcctctgttgtagttttttttttctcctaatcatgttatcatttttttggaatccatggtttcctgttaagatgactcacacagcctacataaaagtaattgacaaaatatcatcttatagtaaaatgccacatatctttatgttcagcaagaagagtataatatatgattgttaatgataacccaaacaacaaaagatttcaccttaactggttgtcataagtagtagtatccaccgccttattttgagttggatttttatcatcctatgagccctacaaatttaaagtttttggaacagcacgtgcattgaacccataagaacctactctgcttttctgcatgtattgtccagacaagagaccaaattgccgaggcatcatttaggtgaattctaattaacatttagctaccttacaaccacaattcaaggttgtttcaaaggcatgtgcttgcatcatcctgattcactaccatgtgttactaacttggatctgcaaagtcattataaaaagctgttttgatggacttatttggatattgctttacccttcttctctcttttcttttatcaatgtaaaaacattatatgttaaatacttggcttttaagagcatagatctgaaatctgcctctagcaaataacccataacacttctaagatatacctgcaaggtcaattgtgttgtaaaaccttgataaccatactttattgttcaaaaaagccttttatgaaggcagaagttaaaaaaaaaaaacaaaaaaaacagagtccacagttatcacctcagctacaatctcatcagttcacaagtaccagcaaaacatgtgataagtcaacaaatgttttatttcaatctgaacattttacgtaagtgaagactttgttagatatcatttggaatgtggaatctacacagttggcatatcagagaaggttgaattcagtttaataaatgtttatagaaagtgcttgttatcataatgataatagctcaggatgtgcatgacaagcttttaagcgattgggtacactatctcatttgatcttctgcacaactattaatggtaggtactattatccctatcttatggataagtaaactaagatttaaaaagtacagaacatggtgtgaacactgcttcaaaatttctaaaataggtaaatcacgatctctaaactggagggttgtccaaccactagggacaatagagtactgatatttagtggtcagactgtaatgcgggaagagacaggcatgggctaaacgggtgtagagatcaaataaggggcaggttagtttgtaaacatgtccatatgtaacatttagcacaaatacaggatataggtgctttcagacccagctgcattgataaaaagttaggtggtattgtatctgtcttcctttctcaatgttgcatatctgtgttcttgcccagtttgcttcatctctctagccacacttattggcctacaatggcatcatcaccaaagaaggcaatcccatctccgtgtggctttggtttgctccctaaagtaaaccttgtgtttacttttcccaggtctcatgctttcccatatctgacctgttttgtcctcatggccaggatatgtgggacctttcctacaatgttccaaagtttgtaatagagctcttctctgctttgttccaaattctgcaacattttactttaaataatgaatttaaatacaaacaaacttgagctttgcctatacttttcaagaatgcagagataactaaattaataaaaatattcattgagtccttactgtgcacacagctctatgttaagccttgtgcagaactcaaagtcactcgagattaagcctgttactaagttatgtgcaatttagctcagtggatttcccccacttcatattgctctgataatgttttggaattaactgccttgattccttcttttctctgcttgtctatacactatttattattctacaccatctcaaattctaactcctcaagaaaatccttccagatgatttttctaaccaggagttttaacttccttttaactaccctattactttctacttccttaactcatctatcatattatatttagttatttatatactaggtcgccttgaagaagggattgtgttttcataaatcttaataatccctgaggcatcaagtacagtgatttgcatttactaaatgctcaacaaatatgtgagggattcacttgaaactaatattagataattcccagtcaaagtgatctaatagcaaatcaattcttcagttttataggcaaagtatgactctggttttccataatcataattaatttgtcaactttataattttaattaagtaaatttaattggtagataaataagtagataaaaaataatttacctgcttaactacgtttcatatagcattgcatttttctttgtaaaatttaagaattttgtattaataaacttttttacaaaagtattaattattcagttattcatcatatacttttattgacttaaaagtaattttattcaaaagagttagtataggactacatgaaaaattcaaggccaaggcttaatttcaaatttcactgcctttggctctatcttttaaaacaaaacaaaaaactcccgcacaatatcaatgggtatttaagtataatatcattctcattgtgaggagaaaaaataattatttctgcctagatgctgggaaataaaacaactagaagcatgccagtataatattgactgttgaaagaaacatttatgaacctgagaagatagtaagctagatgaatagaatataattttcattacctttacttaataatgaatgcataataactgaattagtcatattataattttacttataatatatttgtattttgtttgttgaaattatctaactttccatttttcttttagactttaaagctgtcaagccgtgttctagataaaataagtattggacaacttgttagtctcctttccaacaacctgaacaaatttgatgaagtatgtacctattgatttaatcttttaggcactattgttataaattatacaactggaaaggcggagttttcctgggtcagataatagtaattagtggttaagtcttgctcagctctagcttccctattctggaaactaagaaaggtcaattgtatagcagagcaccattctggggtctggtagaaccacccaactcaaaggcaccttagcctgttgttaataagatttttcaaaacttaattcttatcagaccttgcttctttttaaaactttaaatctgttatgtactttggccagatatgatacctgagcaattcttgttctgggttgtcttatgtgaaaaataaattcaaggtccttgggacagataatgtgttttatttatctttgcatatccattacttaaaacagcattggacccacagctggtacaaaattaattactgttgaattgagcaaatatttattctaaatgtctctgtcaaatgacagagtgtggttgtgtggattaagtccctggagagagttctttgttctctcatgttctatgctgtggttcttgctttatgcaaaaagaagtaagttacttaaaacctggacatgatacttaagatgtccaatcttgattccactgaataaaaatatgcttaaaaatgcactgacttgaaatttgttttttgggaaaaccgattctatgtgtagaatgtttaagcacattgctatgtgctccatgtaatgattacctagattttagtgtgctcagaaccacgaagtgtttgatcatataagctccttttacttgctttctttcatatatgattgttagtttctaggggtggaagatacaatgacacctgtttttgctgtgcttttattttccagggacttgcattggcacatttcgtgtggatcgctcctttgcaagtggcactcctcatggggctaatctgggagttgttacaggcgtctgccttctgtggacttggtttcctgatagtccttgccctttttcaggctgggctagggagaatgatgatgaagtacaggtagcaacctattttcataacttgaaagttttaaaaattatgttttcaaaaagcccactttagtaaaaccaggactgctctatgcatagaacagtgatcttcagtgtcattaaattttttttttttttttttttttgagacagagtctagatctgtcacccaggctggagtgcagtggcacgatcttggctcactgcactgcaacttctgcctcccaggctcaagcaattctcctgcctcagcctccggagtagctgggattagaggcgcatgccaccacacccagctaatttttgtattttagtagagacagggtttcaccaggttgcccaggctggtctcgaatgcctgacctcaggtgatccgcccacctcggcctcccaaagtactgatattacaggcatgagctaccgcgcccggcctaaaaaatactttttaagatggtgtaaatattactttctgtatcaatggtacattttttacttgtcagtctctagaatttctttataaatatgttgattcagttcatttttgtagattataaaacaggtaaaaaaggataaaacatttatgtgaattaaagggaatacctaatttttgtgtagagtttattagcttttactactctggtttatggatcatcacaccagagccttagttactttgtgttacagaataactaatatgagtgaatgaatgacttacacaagtcactgcttaggataaagggcttgagtttgtcagctagagtatgacagaaagtatctaagttttggagtcaaatagcactttgtttgaatcccagattgcatgcttactagttatgtgaccttagtcaagccacttcacctcactgagtctttgcttttttcatctctaaaatagagatacccaccgctcataggctgtcataagggatagagatagcatatggaatgagtctgtacagcgtctggcacataggaggcatttaccaaacagtagttattatttttgttaccatctatttgataataaaataatgcccatctgttgaataaaagaaatatgacttaaaaccttgagcagttcttaatagataatttgacttgtttttactattagattgattgattgattgattgattgatttacagagatcagagagctgggaagatcagtgaaagacttgtgattacctcagaaatgattgaaaatatccaatctgttaaggcatactgctgggaagaagcaatggaaaaaatgattgaaaacttaagacagtaagttgttccaataatttcaatattgttagtaattctgtccttaattttttaaaaatatgtttatcatggtagacttccacctcatatttgatgtttgtgacaatcaaatgattgcatttaagttctgtcaatattcatgcattagttgcacaaattcactttcatgggctgtagttttatgtagttggtccagggtgttattttatgctgcaagtatattatactgatacgttattaaagaatttcctacatatgttcactgctgctcaatacatttatttcgttaaaacaattatcaagatactgaaggctgattggtaactcacatggaactgggagagtatacaattctgaaccaaatagatgattctctattattatatcttaatttatgtgttatggtatattaaacatgaaaaaaattgtatttggttagaatatgtttgctcttccttaactcgggaatgacatagggtaatattcacagattgggttcctataaatcctccacttgaagtgaagtcagttcaagtaatgaaagctacctcctgagatagaatcagtacttggcacctatctctagtgttctttcacctcatataacctttcactgattagtaaagattatatccaacaaagaaagtacagcacagactgagatatgattactgagataaatttgggcaaaatataaactacagcatttctgtagcaatgagaccatttttcttcagttgagctccatgttctacaaacttcaatcaaaaaaggttctaggagactcagtgaaagttgatacactgttcaaggaacaaataatttcagcacatgggaatttcacagggaaaaatatactaaaaagagaggtaccattttggatggtgtcaatatgggttatgaggaattcaggctgctgagtccagtgtacaatggaaactgagctgcaggtgtgtgattgtaacaacaaaagaaatgctgaaatattaagtcctttgccatgtaaatagaaaaagagtatttatttcccaaacattattgctcacctgtttttgttatgcctttcaagataaatccaggaaaggaattgcattttctttccagaaaacaagttcttgggggaattgttcaattggtagatgttgtttttctcattaacaagtgagtgctccatcacacttgctgagtgctccatcacacttgctctctgcattactcctctgcctgcaaacacatatatagcaagggtgatgacaaggatatcagagggtctggttttctcaaactcatgataaactcatggctgggtcattcttggtgctgattttactttgttttttgttgttattgttccctcttcctcaaaagatgaaatctatccctcttacttggaatttctctttgatatatagcgaatgtttggttgtaacctgtataatctggcatgaaattgtcactcgaaaaggctagaagtgttgacataaatatgggacagcaagagttgctcctactcaagagagcaaatataatgttctggaagagattggcagaattcacatcaaaggagtgattacttcagcctgggccactgttgtactggtcaaaaggctgtgcaaagctctctgaaaatccactcttttattgctctttagtaataaagtcactttcaattttaaaaataacaaactgatatatttttatgactcataaaatgttagcaattatattatggagaatctactttctgggtgattcttacaaatgttcttggatctatttttttttcttatagtacctattcttcccatttttctcagctctagttaatatatttcaacaacagttcaacaaatttaacatttttataaaaagtgtttcctatcattttataaataccagcctagtccatgttattccttttcttgttgaggagaaaggacacacattgtaaattcaaatatagacctctactgtgctatttaatcttggtaacaactccacaaaggagatgacatgttttccttctatagaggtagattctgtaaagttagagggaagagtgacttgcttaagatggcataagctgtaactggcagaaccaggattcaaagccaggtgggatgccaaaatcataatctgtcttcagtgtcaagttactgaaattggtaaacattagacctaaatagacggaattgcaatccgggttgggcacattaaactccattttcttcatcaatgtgctcagattacattttacttttcaggctaaaaatggaaaaaaagagtccctcttagttctgcacttgagaatgagaatagcttttctgaattatacaaggaagaagaactaatgcccaaatgccaggtacccacatgcactatgccatggcacagctgttgccccctttcaccagagccctctctctgtatcctggttgacctttccttgggcaagagctgggtggggaggatcacaagtgactccaatttggatggcttcgggaagactgggaccgagctgaaggcagtgttgtcctctgcactccctgttttctgtctgctggagcactgaagcctcacatatgtattaaaaaaataatttccatttgcatttcagactagaagattgaacgtatagtgtaatgtgattgcaaataattatattgaaatgagacagagaggatgtagtatctactgtcataatttttcaaaacccacctgcaacttgaattaaaagaaccacttgggtttttttttttgtttcaaacgcaaatcctggaaacctactgagactcattcagtcagtatctctaagaggcaagcttgagactgtatatttaaaaagcatctcaggtgatttttacacatgctaaggcttaagaaccacttctctgtagcttatatgttattttcaatgttcctcaaagccaagttagaatttccaaagtgttaagaatccattagacaatcacagaattgtctttttcctttataaatcttgcaatgttgttctcatttccatacttaattacttaaaacaccaaccaaccaacaagcaaaaaatgattagtctaactaatattacaagttaataatgaagtaaaggtttaaaaataatgtcataataatgttaataacaaattattaattataatttaaaaataatatttataatttaaaaataatatttacaagtactacaagcaaaacactggtactttcattgttatcttttcatataaggtaactgaggcccagagagattaaataacatgcccaaggtcacacaggtcatatgatgtggagccaggttaaaaatataggcagaaagactctagagaccatgctcagatcttccattccaagatccctgatatttgaaaaataaaataacatcctgaattttattgttattgttttttatagaacagaactgaaactgactcggaaggcagcctatgtgagatacttcaatagctcagccttcttcttctcagggttctttgtggtgtttttatctgtgcttccctatgcactaatcaaaggaatcatcctccggaaaatattcaccaccatctcattctgcattgttctgcgcatggcggtcactcggcaatttccctgggctgtacaaacatggtatgactctcttggagcaataaacaaaatacaggtaatgtaccataatgctgcattatatactatgatttaaataatcagtcaatagatcagttctaatgaactttgcaaaaatgtgcgaaaagatagaaaaagaaatttccttcactaggaagttataaaagttgccagctaatactaggaatgttcaccttaaacttttcctagcatttctctggacagtatgatggatgagagtggcattttatgccaaattaccttaaaatcccaataatactgatgtagctagcagctttgagaaattctaaagttttcaagtgataagactcaatttatacaaagctaattggataaacttgtatatgattaagaagcaaataaatacttattatgcttttttgctgtttatttaaatatttaacccagaaaataagtcactgtgacagaaataaaaatgagagagaagggtgagccactcttaggtagttctggcattatttaatctaggccagaggttgcaaatggtgtcccatagaactaattttggctcctagacctgtcttatttaacctttcatttaaaaaatttgtattggttgccagcaattaaaaattgggagatgtctcacacacacacacacataaacacacacactcatgtgtgcagcctcttttgaagaattggaataactagtcaactgcgtcctccttttccacaagctgtgacagctccctgctcacagagcacctgccctctcctgttcatcatgctctcttctcagtcccattccttcattatatcacctatttggtcctgagactaagtgagtttgagatctgtgatttagacaaagtggtgaatctagctctgaatcatagtaagtagctctgggaatcatcttgtcttctgttagcccattgagagagaaatagagagagagagagagagaaagaaagaagaagaaacagatctggggagagtcactgaatgggagcatagagacagagaaacagatctagaaaaccaaactgggagaaaatgagagaaaccaaaagagaggtagagaggagcagagaagaaaatgaagaagcaaggcaaggaccaggctttttcattatttcttatggccaagacttcagtatgcgtggacttaattcttccttatgctcctaccttccctagggaaactgatttggagtctctaatagagcccttcttttagaatcacagtttgatgccttaaaactagttatataccttcacatgcttccttaacccacagaagtgatgctaatgaggcccttaataaggagcgtgctattaagatgaagacattcattttttttctccgtccaatgttggattaaggcacattagtgggtaattcagggttgctttgtaaattcatcactaaggttagcatgtaatagtacaaggaagaatcagttgtatgttaaatctaatgtataaaaagttttataaaatatcatatgtttagagagtatatttcaaatatgatgaatcctagtgcttggcaaattaactttagaacactaataaaattattttattaagaaataattactatttcattattaaaattcatatataagatgtagcacaatgagagtataaagtagatgtaataatgcattaatgctattctgattctataatatgtttttgctctcttttataaataggatttcttacaaaagcaagaatataagacattggaatataacttaacgactacagaagtagtgatggagaatgtaacagccttctgggaggaggtcagaatttttaaaaaattgtttgctctaaacacctaactgttttcttctttgtgaatatggatttcatcctaatggcgaataaaattagaatgatgatataactggtagaactggaaggaggatcactcacttattttctagattaagaagtagaggaatggccaggtgctcatggttgtaatcccagcactttgggagaccaaggcgggtggatcacctgaggtcaggagttcaagaccagcctggccaacatggtaaaacccggtctctactaaaaatacaaaaaattaactgggcatggtggcagatgctgtagtcccagctgctcgggaggctgaggcaggagaatcacttgaacctgggaggcggaggttgcagtgagctaagatcacgccactgcactccagcctgggcaacaaggcgagactctgtctgaaaaagaaaaaaaaataaaaataaaaataaaaagaagtggaggaatattaaatgcaatataaaagctttttttatttttaagtcatacaatttgtttcacataacagatcaggaaataatacagagatcataagttttggagctgggtttgaatcctggctctgccatttactttctgtgtaatctaagtcaagttactgaactttgtgggccctctggctctccatgtgtaaaatggagaatattaatatttaccttgcaagtttgttgtgaagactgaaggagagaatttaggtaaaacattcatcagagtaccatgcacacagttgttcctcaataaacattagcttctctgattgcaagttccagtctaaagtgctttatatataccagccaataaaaggatgcgagagagatataccagtgtattgttttctaccattttaaacctattttcatccactgttacaaattctatcatactgctccacataaaaaatattatcaatgatttttagtctctgaagtgcaatatttgattattgagcacacctgttgaagttttagtttcttctcacttacatgggttgtgtaaaggtaggaggtataaaaccagtgtcctaggtctaaatctttcttaatgtcatactttggattcattgatataagtaacttgagcaccagcgcttcattttacttcattttttaaagatatagtaagagtaattcccatctgcctagcaaaattgttttgtagaaaagtttgtggatcagatttattttactttgattttaggaatttcaagtgtcttcgtcggcatgaaggaaaaatatgcagtttgacattttctactactttcaggtcattattttcctactctggtgcaaaaaccctcaattcctgtctcactccatctaatcaaataggtagcatgcttgagcccttactatgtgccaggcactaggataagcactttatatgttttgtcccaattaattctcacagcatttctatgacctaaataaaattaatattttcatttcaccaataataaaatggaggcttcaaaaagtttagggacttggctcagctcacacaactggcaaggactgaaaatggattttagtcccaaatgtcataggctagagccctttcactaaactgttgtcttccatctggtggcatcctcttcctccagtctttgtcacctaaactctgggcaccccttgatggcatttacttatgatggtgatgcttgttaaacttcctgtttgcgacttcaacgtccatataaatgagtcttccaatactgtacttagaacttatattttgtagtgacttctttaaaagctttctctcttagtcatatcctgagttttgttagcacctggacttaccttactttggaaatgttgcactctgaaatctctttctcagcttggaatttcctaatcttccaactgtttgagtcttttaattctacatttactgcctttccatttcatcaggatttctagtctctttaattcttccttttgaactcctcctgatttaacctctgcttattcgaagaacaataattttattctctcagctgcactctcaattcccttttccttttggtgatttttctttttcctacagaacacttactttatcagttttggagaaggaagtgctatctgggtaacagtagtgctatctgttgactctagtcaactgtaagttttatacatttattgtttaaaccttatatgggtctataatccttcttgggaaatcctttcatttgtctttaatttcctttaccatttccctaaaggctattccagatttttatcacattcacaaaattcccgtcttttctcaggatctgttcacccccagtagatagccttgtctcccacaatacatggagaaaatagaggccaccgtcatatttgaatgtttccaacttctctcttcacctttggaattatctttttcttcttttgtgtctaagagaaagatgtatacttcttcttacccttgtctgaactactctattttgcttcatcttctcagaacaggggaccagcaattattcttcctccagaagcttcaacatcttttgtcaactgactccttctcatgtttaaatattttcaagttaaacaatttctttcctgactttcgctcacgcaacctcatgcccaaaaccttatcactcttcttccctttgctgtcaaggctgttctcacttcttcactttttgtggacttctccccactacaacatagattctgctatcaccaatctattaaaactgttatactcttgtggaatttatcatttaatttagcttcagtgaaccgttctttccagattattttggcctcagaccatgacttctaagtctgccgtgcttgccacttaagtgatgatgggccagtgggtccccacctaggcctctgtgttagtctgttttcatgttgctgataaagacatacccaagaatgggcaatttacagaagaaaggggtttgagggactcacagttccatgtgactggggaggcctcacaatcatggtggatgatgaaaggcatgtctcacatggaggcagataagagcatagaacttgtgcagggaaacttccctttattaaaccaccaggtcttgtgagacttcttcactatcacgagaataggatgggcaagaccctcccccatgattcaattatctcccactgggtccctcccacaacacatgggaattatgggagctataattcaagatgagatttgggtgaggacatagccaaaccatatcagcctccttctggctttttatgttctccgtgggtgacctctctcaggctcaagtgataaccaatgtgctgatgactctcaaatgcgcatctctggcttcagtttcttccttgaacttcatacatatgtttccaaatttcctgcgtgtacctcaaggttcttgttcatcacttcccaagcttcataaacgcactcattttagtgtattctctgtctcctttgatagcatccctgagaggcaagtccctggtgagttatatacaactcctcccttgctccaaacctgagagtaagtaacattcctattaacatattaggaagctgaggcttagacagtttaagtaactcaagcatggttacacaactagctagggcagagctaaaatgtcaggctaggcttctgtgactccaaagccctttctcacttagcatatcatcacttatttttttttttaatcacatatatgatttttttttctttaagagatagaatcttgctctatcacgtgggctggagtgcagtggcacaatcatagctcactgtaaccttgaacttgggctcaagtgatcctcctgccttagcctactgagtagctagggctacagacacacaccaccatgcctagctaattttattttattttattttattttttgagacagagtctcactctgtcacccaggctggagtgcagtggtgcgatcttggctcactggaacctctgctgcccgggttcaagcgattctcctgcctcagcctcctgagtagctgggattacaggtgcctgccactgtgcccagctaatttttgtatttttagtagagacggggtttcaccatcttggccaggcttgtcttgaactcctgacctcgtgatccactcgcctcggcctcccaaagtgctgggattacaggtgtgagccaccacgcctggccacctacctaatttttaatttttttgtagagacagggtctcactacgttgcccaggctggtcttgaactcctgttctcaaacaatcctcctgcctcggacaccccaagtgcagggattacaggcatgagtcattgcagctgacctgtatatatgatttttagtatatgtaaatatacatatttattaaatgtaaatataaatataaatgtgtggagtgatatccattgaaatgttaaacatagttctcagtggtacaactacaggtgatttctcttttcttatttctggttttctgtgttttccaaatttcttgaaatgtgtcttctgtaatcagaaataaaagttattagtaacaacagtcttccactggtacaagtgcttattggataaaagtcccacttctaagcatgatactcacaacttttaggttaatagcctttgtcaccttgccatatacatctgatccagccactcacaccattcctgagatatattttgttcctttgtgcctaaatcattgtgcatgcagatccatcttcctggaacacctataaccatttcttagtcctgtgaaatcctacttacatccttcatagcctagcatgtatgtcatttatttggtcaagggtgagttggttgttctcttgaatgtactgccatatgacgtggtgtgatttcaattgtagcaccaagctcattgcaatattaattcgtttgtcattctcccatgtaggatgtttgaagtagtttctaacacagagattatactcaataaatatttattagataaataaatgaataagggaataacaaatgcctttgtctcattttaaaatactttcattgttagctacccatataataaaaaactaaaagcagtagttttcaagcatgattgtttatgtatgccttaaaagaattttgaaaacctatgtacccctgacacacttttaagttaacttataaatttttcaacatagttttaagtggtggcaaatgatgtagtttcttgtgtattttaaactgcttaagtatgctatacatggatttcttcaaaaccctgaagctgcagtttcagtgcattcaatttatggaaaagaaattaatttataaaattggttcttattgtcaagtcaatcagctaaatataacttgctttctgtcaggaaaagtctgactttaaaatacagataagtaataactattattaattaattaaattattaaaattaaaataattaaataatttgttaattaaaatgccttattcccctacttatttctgcaatttgactctaagaatagataggacatgtagattgccttaggtttgaaatctgggtgaaataagatactgcctccttcagtatttctgcctttgcttttatgggagcctctttcaagaaaaagtcattctctcatggtccctttgtttgagtcccagaggttttcctactccagaaagtgcaacgtagtgagactagtactatactcccttgcatggtaagtgagaaggctgtctgtataaaatgagggaaggactcatgagagggaagtaggtcaggagaaatgataggttctcaggcaggttaattttaggaaagagtgaatagagtcccttaaaacaaggtgcatctgcttcctcctgatcaatctttaggactgtttactttgatttgaagaccactatgctaaagcttcccacgggggcaatagtgaggcaaggaatttttaaaagggaattacttcttcgtagctacttttgtgaaatgaattcatttgaattatctggcaatctcttcatatttatattcaacaataattacttaaagaaatgctttgagcttctcagaggagggtgctaccagtgtgatggagtagaattcagatttgggtagtgactttaaagctgtgtgactttagtcatttaactgctgagtcacagtctacagctttgaaagaggaggattataaaatctatctcatgttaatgctgaagattaaataatagtgtttatgtaccccgcttataggagaagagggtgtgtgtgtgtgtgtgtgtgtgtgtgtgtgtatgtgtatgtatacatgtatgtattcagtctttactgaaattaaaaaatctttaacttgataatgggcaaatatcttagttttagatcatgtcctctagaaaccgtatgctatataattatgtactataaagtaataatgtatacagtgtaatggatcatgggccatgtgcttttcaaactaattgtacataaaacaagcatctattgaaaatatctgacaaactcatcttttatttttgatgtgtgtgtgtgtgtgtgtgtgtttttttaacagggatttggggaattatttgagaaagcaaaacaaaacaataacaatagaaaaacttctaatggtgatgacagcctcttcttcagtaatttctcacttcttggtactcctgtcctgaaagatattaatttcaagatagaaagaggacagttgttggcggttgctggatccactggagcaggcaaggtagttcttttgttcttcactattaagaacttaatttggtgtccatgtctctttttttttctagtttgtagtgctggaaggtatttttggagaaattcttacatgagcattaggagaatgtatgggtgtagtgtcttgtataatagaaattgttccactgataatttactctagttttttatttcctcatattattttcagtggctttttcttccacatctttatattttgcaccacattcaacactgtatcttgcacatggcgagcattcaataactttattgaataaacaaatcatccattttatccattcttaaccagaacagacattttttcagagctggtccaggaaaatcatgacttacattttgccttagtaaccacataaacaaaaggtctccatttttgttaacattacaattttcagaatagatttagatttgcttatgatatattataaggaaaaattatttagtgggatagttttttgaggaaatacataggaatgttaatttattcagtggtcatcctcttctccatatcccaccctaagaacaacttaacctggcatatttggagatacatctgaaaaaatagtagattagaaagaaaaaacagcaaaaggaccaaaactttattgtcaggagaagactttgtagtgatcttcaagaatataacccattgtgtagataatggtaaaaacttgctctcttttaactattgaggaaataaatttaaagacatgaaagaatcaaattagagatgagaaagagctttctagtattagaatgggctaaagggcaataggtatttgcttcagaagtctataaaatggttccttgttcccatttgattgtcattttagctgtggtactttgtagaaatgtgagaaaaagtttagtggtctcttgaagcttttcaaaatactttctagaattataccgaataatctaagacaaacagaaaaagaaagagaggaaggaagaaagaaggaaatgaggaagaaaggaagtaggaggaaggaaggaaggaaagaaggaaggaagtaagagggaagcagtgctgctgctgtaggtaaaaatgttaatgaaaatagaaattaagaaagactcctgaaaggcaattatttatcaatatctaagatgaggagaaccatattttgaagaattgaatatgagacttgggaaacaaaatgccacaaaaaatttccactcaataaatttggtgtcaggctgggtgcagtggctcacacttgtaatcctagcacttttggaggcagaggcaggtgaattgcttgagtccaggagtttgagaccagcgtgggcaacatggcaaaccccacctctacaaaaaacacaaacaaaagaaaatagctgggtgtggtggtgtgtgcctgtagtcccagctacttgggaggctgaggtgggaggatcacctgagcctgagaagtggaggctgcagtgagccatgattgcaccactgtaccctagcctaggtgataggctcaaaaaaaaaaaaaattggtgtttgcaatgctaataatacaatttggttgtttctctctccagttgttttcctacatacgaaacagcttttaaaacaaaatagctggaattgtgcattttttcttacaaaaacattttctttcttaaaatgttattatttttcttttatatcttgtatattattactagcagtgttcactattaaaaaattatactataggaggggctgatactaaataagttagcaatggtctaaacaaggatgtttatttatgaaaaggtagtaattgtgtttcatagaatttttaaaattaattctgcgtatgtcttcaagatcaattctatgatagatgtgcaaaaatagctttggaattacaaattccaagacttactggcaattaaatttcaggcagttttattaaaattgatgagcagataattactggctgacagtgcagttatagcttatgaaaagcagctatgaaggcagagttagaggaaggcagtggtcccttgggaatatttaaacacttctgagaaacggagtttactaactcaatctaggaggctgccttttagtagtattaggaatggaacactttatagttttttttggacaaaagatctagctaaaatataagattgaataattgaaaatattaacattttaagttaaatcttacccactcaatacaatttggtaatttgtatcagaagcttaaaagataacctaatagttcttctacttctataacttacccaaatatgtttgcagagatcttatgtaaagctcttcattataacactgctttcaggagccaaaaattgggtgggggagccccataaatgttgaataataggggtttgattagataaattttggtgtagttctataatggcgtgttattcagccaataaaaggtttgttaaagaatgactgtgacggatgtatatgatatactcttaagtgaataaagagttacaaaatgttatgtacaagttacaaaatgtatgtacattatgatccatttttcataaaatcatatgtatgtatatatgtgtgtctggaaggataaatttatcaagttgttatctctgaaattttgggtatattttatatttctagattttctgttactttgttactttactgataaagtaataacgttgttgacttttgtcactctcccctattaataatcatctaggctgcaaaaggatcatgtcttctttatttttatattccaaggactgtcaacaagtgcctagcacttgacaggtatattatagaaatttaactgaatatctttaggaaatagatttttgtttgtagttgttctagtctacattaaatgtcttgcgcttatgaaacttccttgaattattttagtgaagcaatattagtatagaattttgcatcactggatgcccttgactgaaagctggcttatggcatctcaccagtgtgtggggagtttcagtccttctgttgtctgcatcacagctgaagcagtgctgttgctgacaattcctgacaccaccttgtctctattattgatcattgcctcactatggtactgagttttagcttattcttgtaataactgggactcatatgtatagaataagctattagctcacgtttttgcttgctttttatacagaatacatgtctgcaaatagttttatcaatattttggaattttgggagatatgaagttaaaaacatcattgaatatatatatatacacacacacatatatatatgacactatacatgatttattttatttaatttttaaaattttattctttttagagattaggtcttactctgtcacccaggctgaacttcagtggtgtgatcatagctcactgtaaccttgaactcctgggctcaattgacctttccgcttcagcctcccaaagtgctgggtttataggcatgagccactgtgtctggtccaatatgcatatatatatttttaacctggattatcagagctatattgtgtttaggtttataaagctgtactatgtgaaaatatcacttctaggtttaattttgtacaaaggaattttatatagaaatgaggtaattcagattttttcccatgtaataagaattgtaaaatttactgaaacaaacatcaaaaagatatctgttacatgaccttcctttcttttgaatatatttcaggtgatattatttattaaaatttaaaaatgaaaattaaaatatataaaaagttgaaaattattcctttctttactgtctctcatctgtccattttccattctcctgcattccctcatccaaccaaggtagccaatccaggtaactttttttagtatcttcccagagatgtttctctctatatatataatcaatatacattttttattattccccacctctctttttatgtaacaatatgcagagttttgcttcttgcttttcccactatcttggacaactttccatattcaaagcacagaggacttgcacatatgttcagactgctgaatatttctgtctctcccctgccattcatatgttgaaatcctaattcccaaggtgatggtattgcagggtggggcctttgggaggtgattagtccatgagggtgaagtctttagtaaatgagattagtgtctttataaaagaaaccttagagagaccctcacaccttagagagaccctcacccctttctgccatgtgagaacacagcaggaagacagctggctatccaggattcaggagtctcttagcagacccaaatctgctggcaccttgatcttggacttcccagcctccagaactgtgagaaataaattcctgttgtttataagccacacagttcatggtattttgttatagcagcctgaacaaggacacacacacacacacacacacatgcacacacatttaaatagatgcatagtattctatcatatggatggatattctatgatataatgaatcactattgattgacatttgggttgtttccaatattttgttaacacaaagaacaacactacaaataactttatatacatatcatttagcacatctgcaattgtatcagtaggcttcctataagtggtcaagcatttgtgtacttgtgattttggtagatgttgtcaaatgtccttccctgaaatttgtaccaattcgtactcatgccatacactctaaatagagtgctgatttccccacagcattactaacagatgatattatctaatttaaaaagtttctcatcttatagggaaaatagtatgtcaatgtattcttaacttgcatttcttttattataagtagtgtaaaatatcatttcaacttatacacaggaggaatttctctctatataaagtgatcctagaatcataatgaaaaatatcaccaactcattaggaaaatgtacaaaggattgaatagatatctcatcaaaaataaaaatataagtggcctttaaacattgaaaggtaacatttgaacaaagacttgcaggaggtgagggattagggaatgcagactctgggaagagtcttccaagtagcaggtgaagcaagtgcaaagctttcagatgggactgactatacctgtctggtttgaagaacagtaaggaggtcactgaggctggcatagagtaagacagggagggtagaatactgtcagagaagtaatcggcggtggaggtagggggtaaaccataaagtgctcgtaaagactaaggcttatttctctgggtgagattagaggccactggagagttttaaacagaagtaacagggccactttggctaatgtttttaggctattctgtagggagacaagggaggaagcaaggagatgagttaggagtctattgtgccagttcaggcaagtgatgatggtggcttgatccaggtagtagtggaagtagtatagtaggaagtgatcagattcaggacatgctttgaaggaagatccaataggattaatggataagttgaacaatggcatatgagaaaagtcacagaggagtcaaagatgattccaagctttctggactgagtaactggaaggataaatgtgccgtttactagaaagataatgggagaaacaggttttggatggagcttggtttgggaatattaagtttgaaatgcctatttgacatccaaatagagatgttagttggatgtacaagtctagtttcaaggaagagggggctggtagtgtgaagatggggctggataagattctaaaggaaagagggttgataagaagagaaaggggtgtaggggttagcctaagggcattctaagtattagaggttaaggaggtgggtgaagaaaacccaataaaataaaagtctgagaagacaaagctagtgaatgaatgtggtatcccggaacccaactgatgtcaagcagaagggtgttatcaactaggtcaaatgctcattcatcaagtaagatgaaactgttataattaaccggtgtcttctgaaatacggagataactcgtgacttaatgaaagcaatagtagagaaggtcaaacttgaccagaatgaaattagaaagaataagaggaaagaaaagaccaaatacagacaaccattgatgccttattcttttgatatactcctggagtccacttgctaatacaattgacccttaaacaatacaggcttgaactgcatgggtccacttatttgtgaattttttttcagttaatacattggaaaatttttggggttttttgacaatttgaaaaaactcacaaactgtctagcctagaaataccgagaaaattaagaaaaagtaagatatgccatgaatgcataaaatatatgtagacactagcctattttatcatttgctactataaaatatacacaatctattataaaaagttaaaatttatcaaaacttaacacacactaacacctaccctacctggcaccattcacagtaaagagaaatgtaaataaacataaaaatgtagtattaaaccataatggcataaaactaattgtagtacatatggtactactgtaataatttggaagccacttcctgttgctattacggtaagctcaagcattgtggatagccatttaaaacaccacgtgatgctaatcatctccgtgtgagcagttctctctccagtaaattgcatattgcagtaaaaagtgatctctagtggttctcgcatatttttcatcatgtttagtgcaatgccataaaccttgaataacatcaagcaatccatacaaagtgccactagtgatgcacggaaaagttgtaacagtacaagaaaaaagttgagttgcttggtatttaccatatattgaggtctgcagctacagttgcctgcaatttcgagataaatgaacccagtataaagactgttgtaacaaaagaaaagaaaatgtgaaaccatcagtgcagctatgccagcaggtgtgaagtcttgcactttttgcaaaatacaaaatatgaaatatgtgttaattgactgtttatgttatctgtaaggtttccactcaacaataggctattagtagttaagtttttgtggagtcaaaaattatacgtggatttttgactatacagtgggttggcacccctaaccttcatgttgataaagggtcaatggtatattatttaatttttttgtatttatattcataaataagattaaatctatatttccaagtaatctctataagattttgttattaatattactattatttttgagacagagtcttactgtcaccaggctggagcacagtggtgcgatctcggctcactgcaacctctgcctcccgggctcaagcaattctcctgcctcaccctcccaagtagctgggactacaggcacgcacaaccacactcagctaatttttgtatttttagtagagacggggtttcaccatgttggccaggatggtattgatctcttgacctcatgatctgcctgcctcggcctcccaaagtgttgggattacaggcatgagccactgtgcacagccattaatattattgttacccaataaaaaaaatttggaaacttgtcttcttttcccctgattctgtttaaatagcactggagttacctgttttgaattttttttccaagcggtcccttatgagttttctctatgttttatttgtttcatttctttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctgtttcatttcttatatcgtatttttgcaactcctttattgatacttttcttcctgattaggtttctactaaaaccaaacaagctttccatgaattagcttttagatttacttattagtttaactgttctgttgtattgtaactcattaatttataattttatctttattaattattctatttttcttcgcttttttgttgtttttctagtttttgagttagatgtttgacgcttttttaaaaagctgtgcattttcctctgggtaatactttagctgtatattatgtattctgatatatagtgtttccattacattgttttctagaaaatctgtagctttgatttatatttgtttcctctttgacctaagatatcctaagggaaaatttaacattttccagaaagaaaacaaattttctttgttttccaagaatgttgttcaaattatttctactgcttggaatttttatcatttttgtgtatccagtaaatagtcaatatttgtacttgctctctgaccacataaaagaatatattcgtgtagtttctattaatagattagagttcaattcagatattaaatgtacatcattattcatgatatttaggtcttctacatcttcacttatcttttttctacttgctttgccattaacagataaagttgaattaaaggcttctactacatacatttctccctgttattccttataggttctgtaatttttgcttcaagaatattgctttttaaatttaatatatagatacttataattacactctagcattataaagagccttttctttttcattgaatgtatttgggcctgcatatgtctaacatgaaaattatagtcctttttttgtttctttgtttgtatttacagttttaagttccattttcaacctttatgcactctttgctttaggtgtgtctcttttagttagcataaagttaggtttgtctttaatttcacctgaagtcttttcctcttaatagatgggttaagccaactgaaaaataaaactgacttatatacttttatttcaagtatgtcctccacaaatattttttgaatagattagcttatatactttggaatttgttaaaaaaagatttttataaaaaataattgtggtgaaatgtacataacataaaatttatcattttgaccatttttaagggcatagctctgtggcataaagtatactcacatagttgtgcaactatcacctccttttgatttttttttactaattttgtaaatttgtttcatctgagctgtcttattatgttttgttttatgtttttctttcctttattatgaagtcactgtattgtctgtaggctatatgtatctgtgagtgtgtgtgtatatgtgtgtattatggtttttaaaaaagtctatatttgttttccagtggctatacttaatactaataactttatgttaaatttttcattctatgtgactctagttcactaatatgagctctgataaaatcagtgctttttcgaggttaggagatcaagaccatcctggctaacacagtgaaactccgtctctactaaaaatacaaaaaattagccagacgtgatggcgggtgcccgtagtcccagctactcgggaggctgaggcaggagaatggcgtgaacccaggaggcagaacttgcagtgagccgagatcgcgccactgcactctagcctgggtgacagagtgagactctgtctctaaataaataaataaataaataaataaataaataaaatcagtgctttttcttcctctgctacctcctttccttctactcagttttagtcagtagtattatcttttttcagatttatctttgtattgttaaatctgcttatgcttctattactttatttattagctttaaatgataccttttgactttcagcttttcttaataaagcaatcagcaaatttcctttacactccacacttataccccatttcctttgtttgtttatttggtttttacttctaacttttcttattgtcaggacatataacatatttaaactttgtttttcaactcgaattctgccattagttttaatttttgttcacagttatataaatctttgttcactgatagtccttttgtactatcatctcttaaatgactttatactccaagaaaggctcatgggaacaatattacctgaatatgtctctattacttaatctgtacctaataatatgaaggtaatctactttgtaggatttctgtgaagattaaataaattaatatagttaaagcacatagaacagcactcgacacagagtgagcacttggcaactgttagctgttactaacctttcccattcttcctccaaacctattccaactatctgaatcatgtgccccttctctgtgaacctctatcataatacttgtcacactgtattgtaattgtctcttttactttcccttgtatcttttgtgcatagcagagtacctgaaacaggaagtattttaaatattttgaatcaaatgagttaatagaatctttacaaataagaatatacacttctgcttaggatgataattggaggcaagtgaatcctgagcgtgatttgataatgacctaataatgatgggttttatttccagacttcacttctaatggtgattatgggagaactggagccttcagagggtaaaattaagcacagtggaagaatttcattctgttctcagttttcctggattatgcctggcaccattaaagaaaatatcatctttggtgtttcctatgatgaatatagatacagaagcgtcatcaaagcatgccaactagaagaggtaagaaactatgtgaaaactttttgattatgcatatgaacccttcacactacccaaattatatatttggctccatattcaatcggttagtctacatatatttatgtttcctctatgggtaagctactgtgaatggatcaattaataaaacacatgacctatgctttaagaagcttgcaaacacatgaaataaatgcaatttattttttaaataatgggttcatttgatcacaataaatgcattttatgaaatggtgagaattttgttcactcattagtgagacaaacgtcctcaatggttatttatatggcatgcatataagtgatatgtggtatctttttaaaagataccacaaaatatgcatctttaaaaatatactccaaaaattattaagattattttaataattttaataatactatagcctaatggaatgagcattgatctgccagcagagaattagaggggtaaaattgtgaagatattgtatccctggctttgaacaaataccatataacttctagtgactgcaattctttgatgcagaggcaaaatgaagatgatgtcattactcatttcacaacaatattggagaatgagctaattatctgaaaattacatgaagtattccaagagaaaccagtatatggatcttgtgctgttcactatgtaaattgtgtgatggtgggttcagtagttattgctgtaaatgttagggcagggaatatgttactatgaagtttattgacagtatactccaaatagtgtttgtgattcaaaagcaatatctttgatagttggcatttgcaattcctttatataatcttttatgaaaaaaattgcagagaaagtaaaatgtagcttaaaatacagtatccaaaaaaatggaaaagggcaaaccgtggattagatagaaatggcaattcttataaaaagggttgcatgcttacatgaatggctttccatgtatatactcagtcattcaacagttttttttttagagccccattcttattttttatacactttgagagcataatgaaaagaaaagctacctgcaaaagttttggacttacctcaaagaggatatacttcattcctcaaaaggccttcttccaggaatagtatttcataacctggaggttggaaaaatctggatttgttacaaaaaaatctgagtgtttctagcggacacagatatttgtctaggaggggactaggttgtagcagtggtagtgccttacaagataaatcatgggctttatttacttacgagtggaaaagttgcggaaggtgccttacagactttttttttgcgttaagtatgtgttttcccataggaattaatttataaatggtggtttgatttcctcaagtcaacctttaaaagtatatttagccaaaatatagcttaaatatattactagtaataaatttagtactgtgggtctctcattctcaaaatgagcatttactaatttctgaacactgtgctaggtcctgggaataccaaattgaataagacatagtctatttttctgaagggtttatagcagagtcccctgtgttaataatgaaggagtgtgtggtatgtgaatcatatatcaatagggttgttaaaaataatgaaaaaaggagaagaggaagaacatcttttttttttctgattgcacgggcagccttaaaattatttttgaagtgtacaattcagtgtttttttagcatattcacagggttgtattatcatcaccatatttttggcctcttgaaaagaaatcctgtgcctattagcatccaattaccgttcctttgtagctaagtctcccccattccagctttaaacaatcacccatctactttctgtctctataaatttgtctcttttggacatttcacataaatgaaataatataatagggttttttgtgcctaaataagcttctaaagaagaataaggtaaggaatcatcattcagcaaatatttattaagacttgctttattttatacagtgtactaggagctggagatgaaaatatgtgtagaacatgaatcatatacttcgggaatttgtggactagtgggaaagattgacatatcaataacaaatcgaattagtgatgtaatagaggcatttttacaggagtaaaatgaggtagcatggactctatctgggtctgaataatgtgaggagtaacctccttacacaaagaggcacaaggctaatgtcctctgatggaatgattcaccatgcaattctaagggtgacaagaatgaaagttagggccttgaagaaatattttgattaagagctgccaataaagtagagtaaagattagattgatgtgaagaagtgggagattaatgagtaaatggtcactggcttgttgagaagattaaatgagatgtacatgtaatgtacctaacacaacgtcttgtacaaagtagccattcagtagagactagcttgtattatctccctttgaggtaaagaaaactgttagaaatagtatttctactactgatagtatttcttctacttatgcctccctttgaggtgaagaatactgttagaaaacatgacataggagaaatacccctgagagacagttcttattagtgactactgtgcagaaaagatggaggttggtgtaattaaggagaaggaaagccatgaagccaaagtattatgaaaaagcatcaatatgaattttcatgttgacaaagtggtataaaagataattataaagatggtcacttataaatacggtagttctgtgtgacacaatttacagaagttggtatatcgtgtggaagaaaacagcataagatcctgaaggtttgaactgtgggcacattggctccatgctcaggaaatggcaatggggttgggaagtgattccactttatgtccctttcagacacataaaaattacttgtgtgagtatcttatgccagacactattcactgtgtagtgagcatggtgggtatgaaatgacaactttattgtctttcctgtcaaagaacttgtaggctggttgggggaaagagaccatttcaatatgaagtgctgagctagaggtacccttagggcactacagaagcctagctgatggcttttagcctggctagacagttcaggatctctaaaagcaggtgccttgaaggctgagtcaaatacaaaaatgtattttggacagaggaaattgtatgaacagaaacacagaacatgaaactacttggttggtgcagggtatcatcagcatagaaccagacagaaccagagtgtaaataagccagaaggccatgtcatggaggccttgtataccagtctcaggaatttggttgtggagagctttcatcaggggaatgatgtaatcagcttggaaatgtagatatatcactgactgtgatagtgaggagcagaattaaggtggacgtgattagaagctttgtgaatagcagaaagaacatagattttgaaagctggcagacgtaggttactgaagaaagttacttaaccttgctatgtctttagttttatcctctgcaatatggggataatactgcctattttgtagagtcttgtggattcttctggcatatataatagaaaataaaacagctattattattattgttgatggtactatttgctatatctgactacaaggagaaagactaataggaaaccatttcaggaatccagatatggtcatgatggacaggaagagacaagagttacatagaggaattctgggaagataagaaatgtcatttttatgtactgtttgcatccatcagacaaggcatcaggaaaaatgatccttcaggaaagagtgattttttttcttcaagaaattagaagaggggagaaattggtttaagattaaggactccatgcataagagaaactgggagggaagacaggtagaaatgctatggggttaggaaggaagaatgcagaggtggattacttagaattgagacatctgatcaagacagagggatcacagcttttgctaacaaagtactagtggaggatgccactaggtgaggtttaataaataattgttgacaataagttccatttaaaaaataaacaatttatgcttcttctttgcctaagtgtcaaataaaacattcagatttttatttcaaagtatccctgagtccctgttcccttttttgtcctgctgacttttggaactgatttaggcttccttagtcatctcataatagaaaaaatcagccaggtatttcctacatttcttgtattttaaaaaaatgtaatggatgtaatgaattttaagcaaatgtaatgaatacaataagtaacttagtatatgctgttttcttctctatgctgaatgtttcatacatgttattttctatacaactacatggtcaattccttgaaaatatcaactccaaaatctttattttggtatactccacgtagcacattgagagagttttaaactcttgttggatgactgtttcaaaagtgttttgaagtaggcatgtcagttgcaaaaagtttgctcagcaaatgttgttctgtctcacagtctcagacattgagcagatgattacatgacagcacgtgattgctgggagtaacagacaaaagtaactgaaagtgctcggttatcttgacagtcaaaatcaaaagtgtcccctattttcagtgacctaagagtttctttttgtgtttttggtattgttgttaaataagtgttctcacctttgaaaaggtcaataagaattcaatacagtataatgtctgtgtgccaaatgaaggtgccccttatttttaagtgtggaggagttttgatcataagaacttgaaatacctacagaatccttgatggttaagcagctggtgccagcacaagaatccctcaatatgttctctatgaagccccgatcaccaaatgcaaacattcatgattcagtatattttcatcttgactgccaaagttgatctgtttcttaatatattacatctagacttggaactggagatgagaacagaatattatcttcctcatttttgtgtttttgttcaactctaatgtctgcaaagcacttgcgtatgtaatgatgctcagtgtcataggagcaggcaggtaagtgtaaatttgtctggataggagaaagcatgcacaacatatttcacatagttttctgatttcagtttgtttttgcaaattattcactcagtgagatagcttaaagacgttatcacagggaaaggcatggagatagttctgtgttgatagaaaacttgtaatgtacagccatgagtgagaagtcaggttcagattcttcaccttcagtcctcctctttcataaacagctccatgtcctattttacatatcctactttaaaacgagattatagaagaatgaatttctaggcaaagtgacacttattttaaaatactattacgtatccctgtgcccattaacttatcctaccatttttcttcccctgtgtccaaaccacctttagaatctcctaaatatttgtagctattgtaaacagcactggagactttgctagtttaaaaggagaaatcaacgcaattaagccctagttaatttacttatcccttatgagattataattgtattttgttattaaaagggggacagagtacactgttctcttgcctttttaatttccagactaccacttctcctgcacttgacaataccgcagtctaccacgtagtcccatggctgacaggaggagaattctaggcaggccagtgtttgagtagtgagtaattggactgtctttacccagcaactcactgttttgtaaatgtacctgagtttggagaagtaattggcttttataaggggtgcggggtggagggttggggtggggagagtgagaaggaggtcagagctttaggatatataattggtctccacaaagttgttgtgatacttttggaaccacgtaatggtcttcattaactaagtgtctgtcatgacagccattacatatgcattataataaaaatttatttacagtgtaagttgaagaaggtaaaatctggatgtagtttctaaactctgcttggcagttttcatatttaagccactagaagaaaaaaattgggagggaagctgagaagaatttactgaaagaaaaaaatacttgggagggaaattggcaagaagtatgaaaaagcttgggagggaagtaagcaaataaatgagttaatgactgttctggaaaataaactctatcatgcagatatcacatgactgattaaatttgaatttgacctcctgctttccaggtctggtaaaaactaacctgtaagaacttgaaacttagcctttgaatggtcaatccaccactgtaggagaatttatgaatgttcagttgagagaactgaaaataaagaagtaccataggaattaacatttgcattcagtagccaagatataatggacatctgaaacaggtatttgaggccaggcgtggtgtctcatgcctgtaataatagcactttgggaggccgaggtgggtggatcacaggaggccaggagttcaagaccagcctactaaaacacacacacacacacacacacacacacacacacacactagccaggcgtggtggtgcacgtttgtagtccaagctacttgggaggctgaggcatgagaatagcttgaacccagaaggcggaggttgctgtgagctgagattgcgccactgcactctagcctgggtgacagagtgagactctgtctcaaaaataaaataaaacatatatttgaaacacattgaattatgtcccttaaacaagaataaacatcactaaatgactgtaccttgaactacctgtaattttctcctgataggtaattaagcttcaaagtactgacacttatttactgtaatatgaagcaataacttaaaaaaaaaaaaaaactattgaaccagaaccaaacaggaatgccatagcattttgtaaactaaactgctatttcatttcatttgagccctggaacttgaaaataaatgctagctaacatctgtgaacagaacatacccatcagtactgtgctaagcacctttcatgaactggtcattaaatcctcactttccatttatttagtgacaacttcacccagagtttgcagtcaaagtgaaaatgtgctgaattccaaaagtgtgagctaggttttagaagttaatcacaattctggaacaaattactagcttaacaaatgagagttcttatgtctctaaaaccaaaatagccctaagtctgtccctcccagtaagatttgggccagtcaatggaacagtaatatacaaatataattacagctgtctaggagcaaactatcctatgaatagataataaaattaagacacttaagccatgttttcatattaaaacacaaagtaaaaaatcattgttttccaaagataaaagccatactgtatcatgacatatatatgcccgatgtttcgaccctcttgaagaattgagattctcgactctacactcttagcgttttctatattgaacagatgtttaatttaaggaggtcaagagaaatcttacacttattttttaatggtaccttagacatagaaggaacctcagaaatctctggctgaatatttccatctgcagatgatcatgtcattaggcttctgactctatagccatagaaaaatattcatgaagacctttcaggaagggaatgttggtatttctaaaaattgagtacaagtattctctagacaaaacagctcttgaaatggcagattgtattcccattattatatttcagaatcaagacattaatacctactttttatttaccaggtttagttatccttgaattagattttataaattaaagaaatagatttcaataaatatttgttgagttcctagtatggaaacatcgtgtttggcaccagggatgttgcctgcaagtataacaggagttcgtatttgtaatgagtttatgatttacagatatttggggggcaaagatatcattcggtaaatacttatgagtgcaaactttgaactagggactgggccaaactctaggaacatatttgatgacagagacacaatccctgtcctcaaggagctttcattctagtagagaagatgaaaaccagtacagtttggtaagttagatgatattggttaatgtagggttcttatgtaagtctagagaagtagcatttaatctgttcttagaaggtcaggaaagatttccctggaggaagtgacatttaagctgagagaggatggataaacaggagtcatctgagtgaacaacagggagaacattccagaaagagaacaaaatgtacgaggcctgatgccaagagagaacattcattgcattggggaactatagtcacttctgtgtggctgggatgtagaatgaaatgagcctggacccaagagagcactttgccctttggggaagctgtaggtattacagtaaggttggagtctggaaagaaaggggtatattgtgagatctgaattgggagaggacagttatatccagacctttatatgctccagtaagaagactgaactttacactgggggccatgggactcactgaatggcattaaatttgagagtggtcatatgaccagatttgcattttacaaagattgtcattgactgcaacatgaagtatggagtattggaggagcggtaaggctggtggcagggagataatttaggaggctttaggtgagggatgataatgacttgccaggtaggaaggagtaaatttcttctcagtggataattagaagattgaatggatggacttggtcactatttggtatagaaggggaaaaaagatgtcaaagatgatgccaatttttaaaaataatttaacatttatttttaaatattttttcagccttattaaggtataatggacaacaattgtaggtatatgtcatttacaacatgatgttttgatttatgtatacattgtgaaatgactgccatagtcaagctcattaacatatccatcactcacataattaacattttgtgtgtatgcagtgagaacatcaggctctactctcttagcaattttcaagtatagattacatttgttaccaactatagtggccacactatacaatagagctccaggacttattcatcctgcctaactaaaactttgtactctttgaccaacatcttcccattcgtctctcctccccatgccaagtttccatcttggtcagttgggtggatagtagtactatctgccgaggcaggttggtagggtgaaaacaatgtgttcccttttggaaatgctgaggtgaccagggaacttccaagggaatctgtctggatctagagcttagaagagatgtttgggctggaaacagacatcaggtattcttcagtatatgggttgtaaatgaagtcacaggagtgggtgatatcaccaatggtgagtgtagtataagaagactggactgaggacagatttccaaggaatttcaatacttaagaggtacgcagagaaaagaggggctgtgaaggacaccaaggaggagactaagagccaggagggaaaactttcaagagagtattgcattatggaagggaagaagagagaacattttaaatgatacgcaatgctcaataatggtatccgctttggagaggccaagtaagattcctaagtacccattggatcaaggtccttaatcttacaaaaacttatgcaaatcaataataaagagatgataacccgataatcaaaaatagacaaggcatataagaagaaaatgaattaaaaatattcaaagcattcaacatatacaaatgcgctcaatctgatatataatgaaagaaaagtaaattaaaacaacaatgggcatgactaaataacagtatgagggagcctgaggagaaggagcatttgaaatttcagtacagaagagaaaaggggtgacttatagaaaaaggagacagaaaccatagaacatgtttggaggataagactcaaacaggtagtggggacccttttctagagtaggatgaaaacaggtaatgtgtgtggatgcaaatatgaggtaggatgtaatgggaagttgagcgaattcatatttagtcattcattcaaaaatacttaattgagttactgctgtgtggcaagcatcattctacaaacagagggcacagtgataagcaagccagtttgtactctcgtgtaacttacattctactttgagaagacagattataaataggttaaaaagtcaataatatgatgtttcagcatcaacaataaaaaattagggtgatatatagagtgccagggaaagtgctttcatggacctcttcattctctcctctcctggtgtcataagctactccttcatccatgctgccatttctcttggtttacggttccagtatagtactcatcacattattactatagagccatccaccttatgaaggtgaaggtgtccatctccttacttaaaaaaaaaaaaaacaaacaaaaaaacaaaaaacccgaaaaacaaaaaaagaggcagaaagacagaaggtcctccactaactttcacgtgccatgtaaccagcgaaatccaattattttacagcattctagctatagaagagtttgggaagcgtagtgcttagtgttctagcctttgtagcacaggaaagggcctggaaggaaaggaattgtgtcttccgcagttgcttttctttatggggaagtgctatagcccaaacaatattttaggaattttcatctattgtcaatatgcaaactggaaggggataatgaaaatgttgtggttagaagtttatgaaatattgttattcacattttaaagtaaaaagagggaatgtttaagagacttgtttaagatcacatgtctcataattggtgggaccagcaatacaatccaaatctaactacttatctttttgctatgccctattagtgttcatattagaaaagaaattctatctcagacactaatgatttgttctttggacaccaatgactttaagttaaaacttcatactagttaatttaattatggtgtagcagtattattaaactatcaagactataaattttctatttgtaaaggagattatgataccaaagattagtgaactaatgatattgagaattctatgacataattttgaaaaatatttgcaggatatttatttttgtgtaaatgatgctttcaagctaccataatcctaagtaagtgtatatttgggaaaaccacctattctaacacacttgaaatttaaataagtcaggaaatttttttccagatcttctcccaaattatcttcatctttttcctctccccttgggaaagaatctcttcatgcctcataatatcaaatttaaactatggaagtccaggtggtggacagtcagcaaaggggaagatgagaagcttgtgttataaagccagctcttgtcagaataaggatctggtaggaacttcagaagtgatgggtaggtaagtatgaaggccaggtcctaagatctaaattacaaagcagaagacttacttaccagggagctggaaaacatgttaggaaatccagagcaggaacagatttcaagatagcacaataatatagcagtgaagtactgagaaaagagtttttttcacgggttggatttattctagcattttaggcagcatttgggcatttctaagtggtcagacttagaggagatagttaaggaattagcagctgctaaatgccaattcttagaccagttgaatcaaaatcatctaaaaagctttcagaaaccagactttttaagggccatttgagagactctcaaatctggaatccagaaatctatagctagatgagtttaaggtagagccagaataagaaaaataaaatagtttgtttgtttcaggtatcttttccaatattatttccgaacctaccccaaacaccttaaatcactgcattctatagccattcttttaaaaatgcttgagttattagttttcaaaaacaaatacaaatctgcacacatacagaaataaacattaaagagacataaagatattaaacagagttacatatacttacaacttcatacatatatattatatataaaactgaatattaagtgtttgatattagtgacaaaatctgtaacatccattatattagtgctttttgtactttttgttgggtgtagtaaaaattgcattcgaatttgagttttctgctatatatttggtcagttcctatcagtgaaggaaaaacctttttttattattttattgtttttttattttttgagacggagtcctgctctgttgtccaggctggagtgcagtggcatgatcttggctcactccaacctctgcctcccgggttcaagcgattctcctgcctcagcctcctgagtagctgggactacaggcacctgccaccaggtccagctaatttttgtatttttagtagaaatggggttttgccatgttggccaagttggtctggaactcctgacctcaggtgatctgcctggcttggcctcccaaagtgctggaattacaggtgtaagtcaccacgcctggcccctttttattttttaagctgattgaagattcttagttctcatgctttctagtggtgattaatctttagccaatatttctatatacagttattagtaatcatgtttgacttaggtcaacaaacaatctttcctaaaaaaacagaaccccaattttaatttctgaattatttagtatctattttctgctgtggaagttgaattatgttgatagatatcatacagggccatgtaacactctcagatacacgttcacatgtatagtagctgtatacaaaaatgttacttcattctctctctctttataatactcttggctctcttacgttctctcacacactctactcttcccttcctctgttctttctacttgttccctctgctcctaccacacttattccccccttgtccattttccttgtgcataaagcacaagtgcttagtaattatcaaatattaataacaatgacactaaccacccaatgatttagtgttaatgacatgctttattgaatggcattacctctaaagttcatgtttcctttacccaaccaagcttcttaccctcctcccttaccacaagcatctatattgtcaaggttgttataaagagtaataagccagccattaaaaaagggtttatggtattttcctatctacaaagtcacaggaagctcaaatgtactcagtaaatattgcaaaattacacaggaccattaaatgtaacactccaccctttctctctctctctctctctcttgctctctctctctctttctgtcaatatagcaacaccctatatcattgccctttgtatgtgcaaatcagagttaataagctttatattagcaattactccttaacaacttctggtttgtttggtccagttgaataatgtaagcacttaaaaaaatgaaattataaacatttatgtgaaaagtgcatatatcacattggatatgttgttatgcactccttaataataaagtaagttaatctttattgcacacttattataatattactttgaccctctctagtactctttatctaagtattctcaagtgctttacaatctcaaacagacccaatgtgttgtatacacagaatcctttgaagctgacatttgcctttctgaccagcttgttgtaaaggaaatcagccaaaaaacaagtatctagatgagtagctcaaacattagtacacatagtaatcacaggtcaaaatgcagatagattaccctgtccaaattctcctgagtaagagtaggtgaaacatttttaaataagctccccaggtgattctgaaattggtccaaggaccacatattaagaactaatgatccaaacaatttgactttttattgtagattaaaccatgctgagaaaattattaaaaattgaaatggcagtggaggatggtttgaaagaaaggtttttcagggccctttcaacaataaaattaattgaacacaatattaaaactctatatttgatttaagactaaggttttcattgtttttaaatctcagtaatttttatgtaacaggtcaattcatacccagcatcttaattccaatgaatgatttcccacaacaatttttgtggataactccaagggaactcgaaggaagttgtagtatgaacaaagagaagtagaatttgtccctgtgtgtaaggcttctctgataagcagcacaggctctcatactgctttttaaaaaaattatgatagcatcaagtggaattaattttttttagattatactttcatggaagggaagatctactgtgaaggctggaaaaccaacacccttaagataaatatattaccagatttgagcgctcttagtaatcagcaaagataaatgtttaacagtgcatacaaaatgaagtgttttatgttaaatcaaatagagaaagccaaacactaataatgtggttacaaatgaacaataaattaggtaatcagaacaggtacagacattaatagcaggatattggtattattaatgtattttgttttaaaataatgaacttaattacaattctcctcatcctaccccactattttattttattccagattcagcagcttcatattatgtctctgaaacacttattattaaagttatccaaatgtacacatttctctttatataaatgtttcagtccagaaaaggaggccaaatacattagctcagaacatcaaatcttctcagatgtgggaatcttttattttcacacttttaaaggtaatctgtatttctagcgtctattatagacagaaaactttcatatgacaacattcctattttcttaactgccttgataggggcgaagacaaattctaagtaggactttttaccccattcttcttaccatcattctttcacaaaacccccagctttagacaatcgctattatgaatttgacatgtactattccaatccattcccataaatttacacccatatatacatatagttatctatgaacaatatttagtagcttttttgtgtgtggctttaaaatttacataaattgtataatttgtgcacattcttctttaatttgccttcttggctacggttatctttttgagatctagctatgctgctggtatgtagaattctatttcattcttttttcattgttgttttgtacccataacgtgtcacattttatttataccttctgttcctgatggacatttagattcttccaggattttactcaatactgcaatgaaaatctttgaatttttctcttttgcacatattcaagagacttttctgacatatatatctataggtgaattgtgtagtcatatgatacatacacacattttaaatttcactagatactgccaatttgccctttgaaatagccatacaatttatagtaccaccagccacttatgaaagttcccatttcctcaaatctttgaaagttcttattataaacagacatattaattcttgccattctgatttgtaaatcagaatctctattgttctacctctagttctaatttggaattccccaattacttgtaagatgctatatattttcatgtttgttagtcattctgatttcatatcctttaccaattatctttttggtaagttattgtggtggccatgagatgtgccttacagaggccttgctagagggaatgtgattgaatgagagccccagatgctgtgtattaaaatcctgcactgagtttgtctcaagatttcttgcacgtgaatgaatgagtacagctgggatactaaagcagatgtgtatttgggagatatgagacttctttagtggctgatttttggctcataaatgactttgccaaaccttccttagactgctcagtgttctaacatcttccatccagccttctacccttctttcctttactaggggattgaatttacattgaggtctcatagccttctctgcctctctccttatttccttttatacaaatatttcccctaataaatccatgcacatttaataccattttgctatttgcaacctgcaggtcctggactaacacagttctatacattgcattaccattctctagagtgggatcttttgttgtagagagttttaaaatttttatgtagtcacttttatccatatttttctttatggtttatatttttgtgtcttctctttaacacatcttttctagcagaattcataaatatattattctatattgccaaaagtttgaaagttgcaatcattagaattaatttttgtatattgtgtaagttaagaatctaattttattgtttttcattggaaagccatttgtcccaagataattttttagtagtccctccttcccctattgtcattctgacatattttttctaggttccgatctatgcatgtgtttctttatggaagagttggccctttgtatctttgagtttcaaatccatggattcaatcaaccacagatagaaaatatttagaaaagcgtcagaattgaacatgtacatacattttgcttgtcattattccctaaacaatatagtataacaactatttatgtaggatttacattgtattaggtattgtaagtaatctagagatgatttaaagtatacaggaagatgtgcatatgttacatgcaaatactaccccatttatataagggtcttgagcattcatggattttggtatccacagagagtcctggaaccaattccccacagatgccaaggcacaactgtatttattctatcatctacttgtttaatctcacatcagtatctacttttgaaataacaataactttattatttaactttttttattacttaggattagagaatttcctctggtgaggcatcatagtgtctcaagctggccataaagacaagtgagggctaggatcggtaagactgggcagaggaagatacaacagatctcctatgcatgaagcaaaagtgcagctcagaagccagctctttcattaagttgtcctctataccctcactagattgtaagctcttgaaatgagaggctataccttaattgtctctgttatctaaaatacttccactcactgcttggaacatattgcctgcaataattaagcttgccctggctcccaaagcatagagcaaatcacactcctccccttgcctttgagaagctcacagtcttcgaaggtagagatatgtgaacagataagaaaatggatgacaggagaacagaaacgcatgactgtcagagaagtcattggagactttacagaggaaattaaatttttattgatcttgaaagagtttgccagatgaagtagaggacaggcattttagacaaagggaacaggaaatgtgaaaacacaaagtgatggaagtcatggtgagtttggagaactataaaacttcaatgtggctgaagggtaaggtggatatagaggagtgctgggaggtgaggctgaagaaataagctaggaaatgtctttttatgccattttttaaagtttggactttattctgaagttcacatggatccaatattttttgttttgtgttgttttaagcagaagcgtgacatgatcagcttgaatgatgaacaacttgaattgtttaaagtggatcacacagtctactgttttacagttattctttgaccaagatattctttattaactgaggaaaaaaagggctttcctgaattttgcagtcatgggatatatgataagcattcttgatttatcatcttcaatcctgttacataacataataaccattgttattacctttagcaatgctttcctcagtattatctaatggcctataaaatgtgactttcatttgcaaatacagtacatctaacaagaacttaccacagctgctatgcaaaataccaatacaattgacccttggacaatgtgggggttaggggtgctgattccccatgcagttgaacatgttacataacataatacataaccattgttattatgtaacaggattgaaaatgataaatctttggaaagtggggcaaatgaattcttatgaattccatatcttccacatgtgttttacttttttgataagaagtagtaacctagttcagaaagaaaataatcatccccttttacttatgcaggataccaagtctatcttagcaccataatagtgaatgataggaatcaagctctatgaatacattcacatgtacatatatatggctatataggacacatgcatgcacatatacatatatacacttgcatatatgtgtatatacatgtacatatatgcatgtatattcaattgtatatgtgtatatagccaagttattgtacagttgacctttgaacaacacgggtttgaactatgcaggtccacttacacgtattttttttttccgtttctgacacccctaaggcaacaaggccaactcctccccttgctcttcctcctcagctgactcaacatgaaaactatgaggacgaagacctttatgaagattcacctccacttaatgaatagtacatacatttctttttccccatggttttcttaataacattttcttttctctagcttgctttattgtaataatatagtatataatacatataacataccaagtatgtgttaattgactgcttatgttatcagtaaggcttctggtcaacagtagactattgctagttaagtttctggtagttacaagttatatgtgggtgttcgactgcatggggagtcagcaccccaaccctcatgttgtccaagggcgttgtccaagggtcagttgtaattggtattttggatagcagctgtggtaaattctggttagatgtactatatttataaatgaaactcacattttataggccattaaatattattgaggagagcatttctaagggtaaaatcttgtctaatgcttgaaacatcttcattttcctgtcagtttagatctttttgaagtaattctgaaaatctctcttttaagctaaatttaacacaaccaaatagccaaatatttaagttccactaatgaagatatctaaatttctgttaaaaatttaagatatatgttaaacccttctaatataactcttctctcagtcaaacttttttttttaacagttgctttgcttcttctttcaaagtcatacttcaacaaagttgctattgaatatgtctgactaaacatgttagctatatgataagatggctggataagagataaatatagaaaatgtagctttttttctacttgcaataaccctttaggaattaaaatggaaaactaataactatttgattcataatagtagcaaaccgtaaaatatttagacataaatctactaagaaatttataagacatatatggagaaaattcaattgaataaaccgttattgaagtatataaaataagatctggatgaatagaaagatcataatttttaataaaattttgcatcttaaaaagtgaaccctctccaaatatatgcacatttaataaaattataaatacatcccaatgaggttggttttgaaattttgttaattggaacttaaatttcacctaagaagaaaaaataaagaatagttaagagtgcatgctttgtagacaaattgccttagttagaatcctggctctatcatctattagctatgttatctttgggataacattcatcttttcttatagatatgcttaaaacagtgcctgacatatagtaagcacaaatatccattagctattcttcttattatttatgttattagtattgttaatatttgttattatatggaagactaaatgaccaaagagagtcaagaaatttatgaataagatttatgcgttgttagatattagagccattaaaaaaaaaaaaaccaaagtgccaaaaaacctagcacagtgttaatacaggaataaaaaaatggatcagaggaaccaaacagaaaagccagaaatggatcttaggaaacatgagaatatgatatatgatagatgctaaatgaattcagtataaaaatattaatgtaataaatcatgcttgctattcaagtaaaagaaaatgaggttagattcatgtctcataccaaatataaccataaattataccttgattaaattttttaattaaaaagcaataatatttgaaaagaaatataggatactcaatgtataacctgaaggttgggtagtacttttcaacaaatataggaatttttcacttgaaatactagaagaaaaaaagatagcaaacaaatacaggaattccaatttcaagcagatataatgatttcatgaaatgttaactgtgcacatgatagatggtctatggatagtgcaaaagaaaaagagaaaagaaaaaatgttttttaacatatgcagcaaaaaaggtttttaacatctattacatacaaataaaaatgaatgtataacacagacttcaataaaaataggcatttcacaggagaacaattcagatggccagtatttacaatttcataggtattaaggaaaatacaaattaaaatggcaaattagcaaaaattgaggtgtgattatattaatatctgttggtggtggtgattatggggaaaagggtactttcaaaacttgctaatataaatataattcttttggttgttttgtaaaggaacctgacaatatcttttaaaaataaagaaaacgcatacttttgacctagccatcccattcatgagggtatgtcttagaaaaataagatcacaaaatcatagagatttatgtgcaatgatattattggtaggtcatttttatgaggaggggtgtggatagtaaatgccagggtaaatcacatagcatctaataaacgtatttatgaactacaaaagcttacactttcagtctagtctagtccagactgcaaataaatgtgagcaagtgaattcaagcacagaagtgcttgaaggcaggtttcataaatctactttcttacagtatcctgatattgacttatcgagacagttactgtggggttgattattaaaatatttatgtatctaggtatttttcattcagtagtatgttattcaattagcaacaagtgtggggatttaaagatattcttgtttgtttttactgctgaaacatattctagtggaaatttcgaataaacgattagtcatcctaaaagcaagatacattttctcagaaaagacaaggtaaagaacttgtatatcctccctcaattcgtttataaggtaataagatgaataaaaatatcatagtacaatttagcattgtaaaataaaattaattggtcatctctagtgtggtcgtgcttggaaggtgaaagaagccaagatcttgtctgggaatatcatgtctaccttgacctcacccttaagaatcctagcctttagtttaaaatcacatggctacatacataccaacttcaacaatagtacatctggcaaggtcatgcaaacctgggacttgagcttctgattctaagtccagtgctttttgtgtacatcatctcttgtacataccttatgatgatatgctaataaaagctacgtgatcaggccttaaaaatctgctttttttttgtaatggtagaatggggcatattatcacatcaggtaaacactctattcaaggataaatggaaatgaatgtcatatatagatcattgataaatatctcattacaaaattatgagagttaccaatgtttgagtgtatattatgggccagccctttatattaaattacttcaaatttttacaactgttaaaggaagatattattatacccattttatagatggacaagttagggccagaaaagacttcctcaaagctgttagtccagtaatggagacagggctagaaaacaggtcattttgctctttgactaatgttactactcatgttttgtattttgtttaaagttttattttattttgctttatttattttttgagacaagatcttactctgtcacccaggctggagtgcaatggagtgatcacggttcattgcagccttgacctcctgggctcaagcgatcctcccacctctcaatctccagagtagctaggactactacaggtgtgtgccaccatacctggctaaattttgcattttttgtggggacagggtttcactatgttgcccaggctggtcttgaactcctgggctccagcgattcacctgccttgacctcccaaagtgccagtatcacaggcttgagccaccatgtccagccaagttttattttagaattaaaaaaaattccacttggattgttacattttatctcattgctttatatttatagaattactttataaatgccactttcttaattttcatagttagcactctttatgaaacataaactattatttgacccaggtttttgttagaggaattgagtcagagagctgttaagtaactgagatttcacaataagccagacagaccagggttcaaattctgggtctcacattatccaattcaatattccagctttgttacttattgagcaaccactacaagcacagtttacatgacatctgatagctctcaaaatgaattttacaaacataattcagatttcaactcagcagtgactcaggagaaaggacacttggatgcatttctttatggcatttttcccagggtacacgcaacctggaagatctcccaagtatgggggaaggtttcaccctgaggaatcccattccctctaatctgggacaagggggaggagagtactgtctcttatcagccatctccccagggaggcctgggccctcctggaatgcataccatggcttactgactcaaagtgttgaaaagaccaggcattgggacacacaacactactcttaaaataaaaaaagaatcagagtagcttgtggttataattgaaatggacagagtaacatggtaccaagaaactattagcaattccttccctaaatccctcattttcttaaagcattttctccttttcctcaacaagctttaagttggatttgaagaatgataagactaaaaggagggctgtttctggtctttggaggaatttgatattccattcgatctgagtgtgcaaagcctgagttcacatgaactcttctgatctctttctctaatattttttcaccttattcatatgggaaagaaggaggggaatactttagttccattctccctcctcctatttccttgacttgtttaaaatataaatgttatagacacctaagatagaaatttgactgaaacagcctcttaattattgtcttaaaaaattggtataatgaaattgcatttgtagtctttggacatttaaatccagaagggatattttctttttcttttttaaaaatttaattcaatagtttttgggctacaggtggtttttggttacatggataagtgctttagtggtgatttctgagattttgatatacccatcacctgagcagtgtgcactgtacccaatatgtagtcttttatcccccccccgctccacccttcctttatcgtccccaaagcacattatataattattatgcctttgcagcctcattggttagctcccacttgtaagtgagaacatgcgatatttggttttccattcctgagttacttcatttagaataaattgtctctagctccattcaagttgctgcaaaggccattatttcattccgttttttggctgaatagtattccatagtgtatatatgccacattttctttatccacttgttgattgataggcatttaggttggacccatattttcgcaattatgaattgtactgctgtaaacatgagtgtgctttttttttttccatataatgacttcttttcctttgggtagatacccagcagtgggactgctggatcgaatggtagttctccttttagttctttaaggaatctccatactgttttccacagtggttgtactagtttacaaccccaccagcagtgtaaaactgttccattttcagcacatccatgccaacatctattattttttgactttttaattgtggctattcttgcaggagtaagatggtatctcattgtggttttaatttgcatttccctgataatcagtgatgttgagcattttttcctgtgtttgttatttgtttgtatatcttgagaattatctattctgtcctttgcccactttttgatggaattatttgtttttttttcttgctgatttgtttgagttccttgtagatcctggatactagtcctttatcggatgcatagtttatgaatattctttcccactctgtaggttgtctgtttaccatgctaattatttattttgctgtgcaaaagcttttcagtttaattatttcccatctatttatttttgtttctgttttatttgcttttgggatcttagtcatgaactttttacctaaaccaatgactataagagtttttccaatgttatcttctagaatgcttatgttttctggtcttagatttaagtctttgattcatcttgagttaatttttgtataaggtgagcattgaggatccagtttcattcttctacgtgtggcttgccagttttcccagcaccatttattagatagggtatcctgtccccactttatgtttttgtatgctttgtcaaagatcagttgactttaagtatttggctttatttctgggttctctattctgttccattgtctacttgcctatttgtgtaccagtaccaggctgttttagtaactatagccttgtagtataatttgaagtcgggtaatatgatgcctccagatttgttctttttgcttagtattcctttagctatgtgggctcttttttagttccctatgaattttaggatttttttctagttctgtgaagaattatgatgatattttgatgggaattgtattgaatttgtagattgcttttggcagtatggtcattttcatagtattgattctacccatccatgagcatgggatgtgtttccatttgtttgtgtcacctgtgatttctttgagcagcattttgtagttttccttgtagagatctttaacctccttggttaagtatattttcatgtattttagttttttttttttgtttgttttgttttgttttgttttgtttttgcagctgttgtaaaagggattgagttcttgatttgattctcagcttggttgttgtcagcagggacattttctaaagtatagactgtagttccttatcttctatctgtttcttactgtccccttcagtattcttgtccttttttcccgctattatctttttgaccttttaatatatagatatctacttctacttctgacaatttttgcttctccaattttctttctttttctcctctgcacacatttatttattttcttctatgtacttctttatttttaacttaatatttgattaacttcccttccctgtctcttttccttctttccataaatcttcattaattgcctgcactgagctaggattctatactctctaaatcaataatctattttctatagtcaactgtgttataatcgtactgtcaagataactacttatttttaatacttaaaaatattttgaaattttaaccaatttaattaatacaatgttgagttcaaatttgaaaaaaacaatggaaaactgtaataattctagcaacctcctgctttttaataatgtattagaaaatttgcctctttttcaaaagcctacagtgaatctattcatacaaggcaaaagcaaaccattctcttcattctctttttttctccaaaagatttaagtgttttttgtttgtttgttttgttttgttttttagatattgagtcttgctctgtcatccaggctgcagtgcagtggtgtgatcatagctcgctatagcctcgaattcctgggttcaagcaatcctcctccctcaccctcctgagtagctggggctacaggtgcatgctaccatgcccagctaatttaaaaggaaaaaaattgtgtagagatgggtcttgctatgttgcccaggctggtctcaaacttccaatctcaagcatttctcccacccagcatcctgaagtgctgagattataagtgagccactatgcccaaccagatttagtttttaaaaagagaatacgatttgaaaaaggaaaaatgtgaggcaggagagaagaaatacacacacgagctgttttgtaattgctgtaaaactgaaatcttcagcctcactaaaggagcacttgcatgaacacctctaaattaccttattaccttctaaattaggtgtgaagtctaacttctaaattatgagtgaaatccactgcaattcttgttatttggatggaatcctaggtatgtggtccagttcatgagttgaacaaaagcatgctcatttaggccaggtagaaagaaataaagacctatgttttacatgtctcataaccactgaaggtccttctcataagcagtgcttatgggtattaacgacctctctatattttacttctccagtgcctaagtagccgagtccactgagtcctgctacatctcctccaacatgtcagcatttttttcacaggccttttgttactctagatcagaaatgttgatagcaacagttccttgagggcagcagctagcatgatgccagccaacaggaaccaccaaatggttcttaatataaattactacttattaatctatttactttgtgcatttggagttttgcatgtaaagtcctatttatgtccatatggtagataaatggaacaaatgaataacagaagtaaccattttgatactttagatatagataatattggattatttctggattgtgaaagaagaaggaagaagcatatggaagagaagttttagtagaggggaggaaggaggaggtggaaacgaatgtacaaggatgggaggagaaaagggagagagacttttttttttttaaggcgagagtttactacctatctaactcttcgcattcttgaagtctcagaccaaatcccatcggtttgaaagcctctagggtattctatctattgtatacttctgttatgtacaaaattaatttgccaattaattgtgaactgttttataaactatcttaaaatggttagttaaatctttgggatagtatttagctttctccaggattatgacttaccttctaaattagacatacaatgcctaggagtcaaggactattttgcataaattccagtcttcttttacaatgcctagaatgattgttaccacagaaatattcattacctgggagaaaggatgacaggaggggcagaatgaatggagagaggtcgtgagaatgaggtgctgaggatggacgaggaagaaagctgttttagttgggaggataggtgacagaagcatggaaaggaattgccttggacccatggaagcccagtgaagatacttagatcctgcaggggtgtgaataatgttcttttagtttctcttcttaggaggtttgttcattttgggagatttcttttgaaaagagtgaacttaaattggagaaaagtacattttagtatgttgataacatttgaatttgtaaaatggacctatggatgatctacacatatttatatacccataaatatacacatattttaatttttggtattttataattattatttaatgatcattcatgacattttaaaaattacagaaaaatttacatctaaaatttcagcaatgttgtttttgaccaactaaataaattgcatttgaaataatggagatgcaatgttcaaaatttcaactgtggttaaagcaatagtgtgatatatgattacattagaaggaagatgtgcctttcaaattcagattgagcatactaaaagtgactctctaattttctatttttggtaataggacatctccaagtttgcagagaaagacaatatagttcttggagaaggtggaatcacactgagtggaggtcaacgagcaagaatttctttagcaaggtgaataactaattattggtctagcaagcatttgctgtaaatgtcattcatgtaaaaaaattacagacatttctctattgctttatattctgtttctggaattgaaaaaatcctggggttttatggctagtgggttaagaatcacatttaagaactataaataatggtatagtatccagatttggtagagattatggttactcagaatctgtgcccgtatcttggtgtcagtgtatttgtttgcctcatagtatagtttactacaaatggaaaactctaggattctgcataatactggacagagaagatgtaaatatctgttagttccatcatagaccctgccactccaatgtacacaccagctttaggcttcttggtatagataaacatacattttcaaaatttttcatcataattttcataacaaaataggaaggcaaatgatgtcacttggcttaaaatctataatatttaaaataaacaggacaaatgcattaacattgttgggggaggaggtcccttagtagaaacactcttggtccaagcattttaaagctgtcaaagagatgtaaatatagataatgtatgtcaaggagagagctttgtggttaaactgtaactttcagtttaaacaattattggtgactctgatgtcaaatgtttctcaagctttatctgaacaaaattcttctcactttgttgccaaagtcgttaacaagaaatcacattgactcattgatgttttggctcctttcccttactttctgttgctttccaaaagctgagacaggaaactaaccctaactgagcacctgcaattgcctggtagtattctagtcatgtgtgtacttttgtgtgtatgtaatccccttacagctctgcaaagtaagaattgttctccctgctttacagaagagatcataagataattgaggctgttagatgttaacttgccaaaagccatacaggaaaatggtagagtcacagtttgaaccaggtccttttgattctttacattaaaccatgctttgatcttggaaatacactgtaaggcaataaatcaatagatacggataattcacaggcttctaaataaatggaagttgattgtttttatctgtgagccaaagtaagacttattctaagaattccacaaatttagataagatagagtatatggcttctagacatccaacatagaactgagtttgtgttatcagtttaagatttggttttgctgtaaggtgcacacactttgaggaactaaaaataattgtctgttcttattctgatcagaatgtgtaatgtgttgtccagttttggatgatgaatttcttatttctaatctcataagaaacttgtcatagatgtgagggagagaattaagaacagagtgtggggaagaaactgtgtacattttgatgggatccattatgtagctcttgcatactgtcttcaaaaataagttacactataaaggttgttttagacttttaaagttttgccattggtttttaaaaaaatttttaaattggctttaaaaatttcttaattgtgtgctgaatacaattttctttattacagaagtaccaacaattacatgtataaacagagaatcctatgtacttgagatataagtaaggttactatcaatcacacctgaaaaatttaaatgttatgaagaaattatctcatttctattaatatgggaactgtgtcttcatctttattactgttctaaggtcaactcaatgtagattttacttgcttatggtttcatattttagctaaatagtaaaataatatggatatacattttgttgtgacttactcatactttccttatttggaacttttatgaatatgatatagagactgaaactacaaggaacaaaatgcaatatcaattatacagttgtggcagcactgctatcaatttgttgatagtggttaacacttagaaaaacattttaaaaataatttcacataagtaatgtaatttattagctgtctctgacattttacagtttggaatagtttattttctttttggtgtcctcaccaaaacccaacatcttcaagggcaggaactgtataatttttgccattgtattttgagcacatagcatggtacttgcctctaaatagatactattgttaaaatattttttaaggtaatattttaaagtgtatgctatggtacagttcagtttgtgacttttgctagtttatgccacttacagttagcaaaatcacttcagcagttcttggaatgttgtgaaaagtgataaaaatcttctgcaacttattcctttattcctcatttaaaataatctaccatagtaaaaacatgtataaaagtgctacttctgcaccacttttgagaatagtgttatttcagtgaatcgatgtggtgaccatattgtaatgcatgtagtgaactgtttaaggcaaatcatctacactagatgaccaggaaatagagaggaaatgtaatttaatttccattttctttttagagcagtatacaaagatgctgatttgtatttattagactctccttttggatacctagatgttttaacagaaaaagaaatatttgaaaggtatgttctttgaataccttacttataatgctcatgctaaaataaaagaaagacagactgtcccatcatagattgcattttacctcttgagaaatatgttcaccattgttggtatggcagaatgtagcatggtattaactcaaatctgatctgccctactgggccaggattcaagattacttccattaaaaccttttctcaccgcctcatgctaaaccagtttctctcattgctatactgttatagcaattgctatctatgtagtttttgcagtatcattgccttgtgatatatattactttaattattattatacttaacatttttatttactttttgtgttagtattttattctgtcttctccttagatagtaaccttcttaagaaaatatatatgctaagtgttttactggtttaatatgcttagactactcatctacctcaatacttccttggagatctcctcctcagtcacacagagctcaggacttatatttccttggaactcctgttagggtccaatgtacatgaaattccctagacagacagacagtcagttatatggcttgatttcaaagtttcaaaatgatttaatggactatcaagtagtttattaggagaacagttattatactcttctaaaaataaagactttaagcaataaagatgtatatgtatataaaatggctgggttattcctagaagtacctttcttagaatttagttaaatttaatatccaagatactatcttttcaaccctgagattgtgaaaagtaacttctatcaatataaactttactacatttgtattgtgttagtgtgttacagtataatctagaacaatgtgtctttctatatgatatatgacattttaatgcctaaaaaaactgatatgtcttagatgattctagtcaggatttacttctagaatagattaaaattctatttgaggagagtcaaattaattatcgaattctcagttgttattattgctgttttatttttagtgaaacagattagtcttaatgtaaacacttgagaaataaattgatggtcaacctaaaatgtaaaaaagaaattaatagaaaatttaaagagcaacaaagctctgacatttaaaagaaatgaagtacaaatctctagggaccttaaagatcatctaataatttcctcattttctagataaataaactgagagaccccgaggataaatgatttgctcaaagtcaaatatctacttaatataggaaatttaatttcattctcagtctgttaacatgcaacttttcaatatagcatgttatttcatgctatcagaattcacaaggtaccaatttaattactacagagtacttatagaatcatttaaaatataataaaattgtatgatagagattatatgcaataaaacattaacaaaatgctaaaatacgagacatattgcaataaagtatttataaaattgatatttatatgtttttatatcttaaagctgtgtctgtaaactgatggctaacaaaactaggattttggtcacttctaaaatggaacatttaaagaaagctgacaaaatattaattttgcatgaaggtagcagctatttttatgggacattttcagaactccaaaatctacagccagactttagctcaaaactcatgggatgtgattctttcgaccaatttagtgcagaaagaagaaattcaatcctaactgagaccttacaccgtttctcattagaaggagatgctcctgtctcctggacagaaacaaaaaaacaatcttttaaacagactggagagtttggggaaaaaaggaagaattctattctcaatccaatcaactctatacgaaaattttccattgtgcaaaagactcccttacaaatgaatggcatcgaagaggattctgatgagcctttagagagaaggctgtccttagtaccagattctgagcagggagaggcgatactgcctcgcatcagcgtgatcagcactggccccacgcttcaggcacgaaggaggcagtctgtcctgaacctgatgacacactcagttaaccaaggtcagaacattcaccgaaagacaacagcatccacacgaaaagtgtcactggcccctcaggcaaacttgactgaactggatatatattcaagaaggttatctcaagaaactggcttggaaataagtgaagaaattaacgaagaagacttaaaggtaggtatacatcgcttgggggtatttcaccccacagaatgcaattgagtagaatgcaatatgtagcatgtaacaaaatttactaaaatcataggattaggataaggtgtatcttaaaactcagaaagtatgaagttcattaattatacaagcaacgttaaaatgtaaaataacaaatgatttctttttgcaatggacatatctcttcccataaaatgggaaaggatttagtttttggtcctctactaagccagtgataactgtgactataagttagaaagcatttgctttattaccatcttgaaccctctgtgggaagaggtgcagtataaataactgtataaataaatagtagctttcattatttatagctcgcaaaataatctgtatggaagtagcatatataaggtatataaacatttagcctcttgataggactaactcacattctggtttgtatatcagtcttgcctgaatttagctagtgtgggcttttttttatcttgtgagtttgctttatacattgggtttctgaaaagatttcttttagagaatgtatataagcttaacatgtactagtgccaatcttcagacagaaattttgttctattaggttttaagaataaaagcattttatttttaaaacaggaaataatataaaaaggagagtttttgttgttttagtagaaaacttaatgccttggatgaaatgagccatgggcagggttgtaatgaattgatatgtttaatagtatagatcatttgtgaataatatgacctttgacaagacacaagccattaacatctgtaggcagaagtttccttctttgtaaaatgagggaataaaatagatccctaaagtgtgtaattttagtatttctaaactttatgaaggtttcctaaatgataattcatctatatagtgtttttttgtgtgtttgtttgtttgtttgtttgagatggagtctcgctctgtcacctaggctggagtgcaatggtgcaacctcggctcactgcaacctctgcctcctgggttcaagctaatctcctgcctcagcctcctgagtagctgagattacaggcatgcaccaccatgccgagctaatttttgtatttttagtagagaaggggtttcatcatgttgaccaggctggtcttgaactcctgaccttgtgatccacccacctcagcctcccaaagtgctggtattacaggcgtgtgccaccacgtccagcctgagccactgcgcccagcccatctatatagtttaatatcaatctaaatgaatttctcagtcctgagcctaaaaatttagttgtaaagaatgatatccttgactaataatagtttctattaatggattgcatctagtgctaggtggcatatatttagtccccacaactaccctggaaggtatttaaaatttttcacatttgcagataaggaaactaaagttcagagttcggcaacatgcttgaattcaagcagctcctaggatgttaatggtggaggttgggttcaaatccagatctgtctgactcaaaaaatgcatactcctaaccagtgcactatatcccaattccataggagcccttctttgtgattcatagcactttcccatgagttttgttgattttgtgagaaacaaaactctttttcctttggactgtctggaatctctctttttcaaatttttgaaatgtatttctatgccaaaagacaaagatttctagaggaatatgcctaggatgagaattatgtaatttaaatcacagctggaaagagagaaagtcctaagttactaagaaatgttcaaacacaaatgagctttcagtctattggaagacctttatagctagaagtatactgaactgtacttgtccatggacccctgaagaaacaggttaaatcaaagagagttctgggaaacttcatttagatggtatcattcatttgataaaaggtatgccactgttaagcctttaatggtaaaattgtccaataataatacagttatataatcagtgatacatttttagaattttgaaaaattacgatgtttctcatttttaataaagctgtgttgctccagtagacattattctggctatagaatgacatcatacatggcatttataatgatttatatttgttaaaatacacttagattcaagtaatactattcttttattttcatatattaaaaataaaaccacaatggtggcatgaaactgtactgtcttattgtaatagccataattcttttattcaggagtgcttttttgatgatatggagagcataccagcagtgactacatggaacacataccttcgatatattactgtccacaagagcttaatttttgtgctaatttggtgcttagtaatttttctggcagaggtaagaatgttctattgtaaagtattactggatttaaagttaaattaagatagtttggggatgtatacatatatatgcacacacataaatatgtatatatacacatgtatacatgtataagtatgcatatatacacacatatatcactatatgtatatatgtatatattacatatatttgtgattttacagtatataatggtatagattcatatagttcttagcttctgaaaaatcaacaagtagaaccactactgatattttattatttcatattacatataaaatatatttaaatacaaatataagaagagtttttaatagatttttaataataaaggttaagagattcgaaagctcaaagtagaaggcttttatttggattgaaattaaacaattagaatcactgttgatattttattatttcatattacatataaaatatatttaaatataaagataagagtttttaatagattttataataaatgttaagagattaaaaaactgaaaatagaaggcttttatttggattgaaattaaaggccaggcatggtggttcatgcctgtaatcccagaattttaggagactgagtggggaggattgcttgagcccaggggtcaagaccagcctgggcaacacagtgagacaccgtatctacaaaataattaaaaaattagctgggcatggtggtgtgtgcctgtatgctaccattaactaaggaggctgaggtgggagaatcgcttgagcctgggaggtcaaggctgccctgaactgtgattgtgccattgcattccagcctgggtgccagagagagaccctatctctaaataaataaataagtaaataaataaacagcaacaacaaaaacactcaaagcaaatctgtactaaattttgaattcattctgagaggtgacagcatgctggcagtcctggcagccctcgctcactctcagggcctccttgaccttgacgcccactctggctgtgcgtgaggagcccttcagccctcccctgcactgtgggagcccctttctgggctggccaaggccagagccggctccctcagcttgcggggaggtgtggagggagaggcgctgggggaactggggctgcgggtgccttgtgggccagcgcgagttctgggtgggtgtgggctgggcaggccccgcactcggagcagccggccggccccgcgagccccaggcagtgaggggcttagcacctgggccagcagctgctgtactcgatttctcactgggccttagctgcctccctgcggggcagggctcgggacctgcagcctgccatgcctgagcctccccccaacctgccgctgcagtgggctcctgcgtggcccaagcctcctgacgagcaccgccccctgctccacggcacccagtcccatagaccgcccaagggctgaggagtgtgggtgcagggcgcagggctggcaggcagctccacctgcagccccagtgcgggatccactgggtgaagccagctgggcttctgagtctggtggggacttggaggatctttatgtctagctaagggattgtaaatacaccaatcagcactctgtatctagctcaaggtttgtaaacacaccaatcagcaccctgtgtctagctcagggtttgtgaatgcaccaatcagcactctgtatctagttaatctggtggagacttggagaacctttatgtctagctaagggattgtaaatataccaatgtgcactctgtatctagctcaaggtttgtaaatacaccaatcagcactctctgtctagctcagggtttgtaaatacaccaatggacactttgtatctagctaatctagtgaggaggtggagaacttttgtgtctagctcagggattgtaaacgcaccaatcagcaccctgtcaaaacggaccaatcagctctctgtaaaaccaatctgctgtctgtaaaatggaccaatcagcaggatgtgggtggggccagataagagaataaaagcaggctgcctgagccagaagtggcaacctgctggggtctgtagaagctttgttcttttgttctttgcaataaattttgctactgctcactttttgggtccgcattgcgtttatgagctgtgacactcactgggaaggtctgcagcttcactcctgaagccagcgagatcacgaacccaccagaagaaagaaactcctaacacatccgaacatcagaaggaacaaactcaggacacgcggcctttaagaactataacactcactgcaagggtccttggcttcattctcgaagtcagtgagaccaagaacccaccaattccggacacaatttgactgcagaaaatggatgtccaaccctgtggtttccctgggccacattggaagaagaaaggagttgtcttgggccacacataaaatacacttactatagcagatgagctaaagaaaagaaaaaagtccatgcgtaatctttgtgatatgtgccaccaccaataagcaaaattgttctcttattcaaaaggttggacacagctgctctagatattttattattaaatatgcaggcaattactgtttaaatgaagatttcctcacagaatgagattaaaagtatatattagtggcttagcattcattttagacaaccattttagagattcaaatcacacacttgcttacagaaattttgttgtcttcaatgtccccattgtggtttctttaccaagcctctactgttcttcacatcaccaagttaaaaaaaaaaaaggggcgggggggcagaatgaaaattgcatggtaggccacaagttcagatcctcatcgacacaagaggtgcctgaagcagtggatgaggcttttctatggatcatgagcagccacataaatgcttaaaagggcctggcagggagcatcagtgggtgatgtggctgggaggctgaatggagagcatttgttcttcagttatctatagaaggcagctgtcactcagcaccagctaagggcttcccatgagggaactggggatcaggtttcccagatctttttatgtaacaggataagacagagatccagctttttttgggtaattatttcctattttaaaatacgggtagttgattaaataaaaacaaacgaatgaacaccatatgggcacaacaaaacacatctgtggcttggattcagcttgtgaatgattactgcagatatttattctagaggacacccctgggtatgtcctaatataaaacctaaatctaaactcaagtcccatgctaccttcagagaataaatgacccagaaaaagaaccacctctcctaaggaagtataaatttgtaaataactgagacccaaacttacaactgtacatttttcttattgttgggctgttgctaacctcaattaagaaggcttgatgatatttgtaaagtgtcatcactccaccatggtccagtaacatctgatcactccaccatggtccagtaacatctgaatggtcaagaaatatctaaacgtatgtaccaaaaatttgtgtatactactgtaccaataaaccatttgtttccatttgatctctgagtgtggtaatacatgttatttgccctgctgttgtaaataaacaaaccaaatggaggcttgatgcaagatgcagtgtagcatagtgccaactctggactccgactactcagggtgtaaattctaactctgttctattaacaccatgaaactgagcaagttagttaaaactcgctgggcccattttctcatttatacaatggagattttaatagtacagctacataggccattttgtggtttaaaatacatcatgattatgaaacacttaatgtagggcttgctacataatgagcaaggtttgttgctgttatcattaatatccttaattctcattattataaaacttgagatagtatgaggtgaacaagttcataacagcaatataatgaaaattttaataattccttttatactttaacaaaaatacgagattgggtaatttattatttttacatgagtaataaatattgcattaaaatatatttaaaatttaccacattaatgtctgccagtcatgccaaatgaccaacatgaatgtgaataaaactcagtctgtgcccatttaatcttaaccaaccctttataattgttaatgatttgaacctctgccttgaaagatcacattacttgattgtcttcaacttatctgaatgtggtagtgatttctgtaaatttataggacctttgtctcatgcagctccatggagttgaacttatgcacctttaaaatggtatatacttaattaattaagtgttgatctgcttcacatgtgtataatattattagctcactaaaccaagaaaacagtggtcctttagggaaagaaactaaattacaacagagaatataaataccatataaatatctattatttattgaactgtcacaattattgcaaaaaattaccttttagtggacaaaacaattgatattgcccttttctggaaaagaaataatgtaatatatgatgaatagttttggccagtatcctctagaccttgccagttaactggctctcaaaattttgaataataaaaacttggtgatagtagaaaaatagtaattttttaaaagtatgtgcacaattatacaactaaacaattcattcaccagtgttcacaattctattgccttctttgaatcaaaatttacatagtttttcttttagactaagctcctttatgataccagtgtgcccatttctcattaccattgaaatgtctcatgagcatgtcacattctggtacaactgctaatccaggatgacagtttagttcttttaaatccaattgagagccttctactcatgaccagagaacctaaagaaaggttaagatacatttattccttggtgtaagtgatttgtctatttttagttttcctaagggtcatatttcaatttagatttttttttataggttaggtaaaataggcttcccttttgcaatatgaaatatgtagtcttttaaaaaatttcttcaaagctattaaactgaaaaaaaattaatttggtctattcagtttgttagcacttaccattttggaaagagagtgactctacttttgtatttggtaacattttccctactacagggcagtatcttttgtaagttcttagatattagcaccaaataaataggcaaaaaaaatctattatgttaattcttagaacccctgcttggcagtgcatcattgactagatggagaagaaatgaaaataatacattaggaagcagtttcctggttcttttgaaaacaactagagagtcttgttgttgactggaatatctgaagatcctgtttaatgctttcattctatgattgttaagaatatgtcatagaactgctgtatcctgtttctttatgtcttcccttctgtttgttgattagaaatccctgagtggctttacattattagtacagtagatatgtagtatattcccataataccactgctgctattgactaatagtaataattttagggcagctttatgacagttggtttatgttttagggtgtcatttgacttgtgaagcattgaaatctgggtattaagcacactgttttctatgtggtatggaatgattcttaaagccctgagaaaatggaaaataaaaatatttttcctttttaccataatcacctatgactgtcactctatcataaactgcataaactttataacctcaaaacattttggaaatgaaatgacagaacttgcttactcaattgcttctatatacaccaaatatttttttaaagtattatgttaagtccttgaaaatattttgttctactcaatagaagcagtttaggttggtagttctatgtggaaaccgtgaggaaataattttatattatgatgactagaccagtctttgaacatcactttggttattgttccattagtaaatattataattatttctgagatttactcaccttcaaagaatgttggcaatgccagcattattaacactcctctagttagaacaaagaggaaatgtaataacaaaacataataatagccaaataaagagtgacttagaatgtacacccttatctaggatcctgagtaattcgattattcttaggaaatacacttttgtgctagaacaaagacttttgaaatagctaatttctgggtttcttttcattttgaattaacttgaatttcaaggaaacaagggtagtttttacagatacagtgcatagaagctctgtgtacaatgaagaaaagtaggaaagtgagaaaaatgccattagatttttcatcgttatactatctgatatgtgaatttaactaaaacttatatacctcattatagtacttcctaatgtaatttcttaatttaagtgttccccataaggtttttttttatataaacttaagtactgttaaatatttaaggcaaattcaggtataaaataagacttgttgatatcttattccaagcatatttgtttctctcctatttatttttattctgtgttcatttccaaaattgttttactcacaactgtttgttttttctgtttcattctgtggtaaaggtatcatttggctaattgtataatttcagtgtcatttctaatattccaattgtgatagtatcaacacaagattaaatttctctacatggtttatgagaatggaatgccaaattgaaatagaacagagcacagatgatctaaatataaaaagaactacaaaaatcacagttgtttaaaaaggttttttgtttgtttatatatggtgcagaacatttgttccttagccaaatgtttccaccttgagaaagctatagagattctatgtagtcctagtaccaataatatgttttaacctgaatgtaccttatctttattcataaactgtgactttttacactgctgaaacttttttttttaagacaatctcactctgtcgtccagtctggagtgcagcagtggtgtgatcttggctcactgcaacctctaccttctgtgttcaagcaattctggtgcctcggccacctgagtagttgggatcacaggtgtacaccaccaggcctggctaatagtttttgatatttctagtagagatgagttttgccacattggccaggctggcctgaaactcctggcctcaagtgatctgcctgccttggcctcccaaagtgttggtattacaagtgtgagccactgtgcctggcctgaaactcataattcatttccattaatattaatctcaccttttccaataattaattgatttcacaagtattagtcccctataatcattgaatggctaataaaattatttatagcaaacagattaattatctgccagcagtctgagattagtttctttaaaaaatgtttattatttaaaacattcagctgtgatcttggctttcttgtgaggttcaatagtttctattgagtaaaggagagaaatggcagagaatttacttcagtgaaatttgaattccattaacttaatgtggtctcatcacaaataatagtacttagaacacctagtacagctgctggacccaggaacacaaagcaaaggaagatgaaattgtgtgtaccttgatattggtacacacatcaaatggtgtgatgtgaatttagatgtgggcatgggaggaataggtgaagatgttagaaaaaaaatcaactgtgtcttgttccattccaggtggctgcttctttggttgtgctgtggctccttggaaagtgagtattccatgtcctattgtgtagattgtgttttatttctgttgattaaatattgtaatccactatgtttgtatgtattgtaatccactttgtttcatttctcccaagcattatggtagtggaaagataaggttttttgtttaaatgatgaccattagttgggtgaggtgacacattcctgtagtcctagctcctccacaggctgacgcaggaggatcacttgagcccaggagttcagggctgtagtgttgtatcattgtgagtagccaccgcactccagcctggacaatatagtgagatcctatatctaaaataaaataaaataaaatgaataaattgtgagcatgtgcagctcctgcagtttctaaagaatatagttctgttcagtttctgtgaaacacaataaaaatatttgaaataacattacatatttagggttttcttcaaattttttaatttaataaagaacaactcaatctctatcaatagtgagaaaacatatctattttcttgcaataatagtatgattttgaggttaagggtgcatgctcttctaatgcaaaatattgtatttatttagactcaagtttagttccatttacatgtattggaaattcagtaagtaactttggctgccaaataacgatttcctatttgctttacagcactcctcttcaagacaaagggaatagtactcatagtagaaataacagctatgcagtgattatcaccagcaccagttcgtattatgtgttttacatttacgtgggagtagccgacactttgcttgctatgggattcttcagaggtctaccactggtgcatactctaatcacagtgtcgaaaattttacaccacaaaatgttacattctgttcttcaagcacctatgtcaaccctcaacacgttgaaagcaggtactttactaggtctaagaaatgaaactgctgatccaccatcaatagggcctgtggttttgttggttttctaatggcagtgctggcttttgcacagaggcatgtgccctttgttgaacctccatttgactggcatgcacatgtctcagatattataggttatcatatattgttgctcctaatatttctgtgttagataattagagtagcttggtttgtaagaatgtgatgttggtgggactgtagcagaacaagaaggcccttatgggtcagtcatacctctcttttcaaatatttggtctagctctcttctgggcatcttgttgccaatatatagtattgctcaaaagggcaggagatttgaagtgatcaaggaaaatatattttttctattgattaagtcttttgatggggtagaataatctaatttcatgtaactgctcaaagttatatggtagggggatcccaaatgtattttaaaactatttttatatcatcatatttgaagtaatagaaagtcagagtagcagaataaaggtactaaaaattttaaaaactaataaggtactttgaaagaaatcaattatgttgattcctcattaaacaaatttgcacttaaagactgaggttaataaggatttccccaagttttttcatagcaacctgtgagcactttctctgttgaggcatttatggtatgaaaagatgagtaaggcacagttcttgccctggagaaggtcacaggtgagaggaggagttgacacagaaacatttgatataaagcaaggaataaattccaagactaaaattttcagaaatctaaaaaactcaagataagaaaaacccattatattttctgggtaacaaaatttcagtgttattaacatgtaggaagatcttgatatttattctgaagcccatgtgtgttgctgaaatattgccgcatttgcatatactcatcaccatcctctgttttggagctaagaattttagactcaagatgtctaattaagttgatccattgattttattttttatggaaatctgagacccacagaaggcaggggatttgcccacatttctagaagagtcagacatgagcgatgaggcacagtggaaagaacatgagcattgcctgagctctgagttggcgctataagagcagtgatcatgggcaagtgactcttctgagccttggcctcctcacctgttaagtgaagaaaagaatatttcagaagatctttgtgagaatgaaacaaggcaatttacttgcctgctacatagccaatgggaaatcaatataagttccccgtggttcccttctgtggggttttgttcccacagagggtgcactggccattccacttcttcttttccaagctcctcattccctttaacgctgttcatagttggttccaaaccatttgaaatataataagcaccaggatggttttttctttccaccaaagcaaatttcattttctaaacactgtttataaatatcaatggctattttttcaatttttgattatcatgaaaatatacaaatatgtttaattaaatatgctaaagaatgtattaataaatatgtattaaataattcctacatataaggcctttttgcttggggtatgggtgatacaaaataaatgtggcatgaacccactgacctctagcaatttataacctagaaaaagagttatgatatgtttataagttcctgtgatataagacatgcatatagtcattataacagaggtgcaaacaagatgtatcaagtatgtccagaggaggaagagattaatcccagctggaggaaacactgatgctttcttgcagcaggggcatttgagttgagaaagggaggaaacatagattttgacaatgagagctgaggggaaaggggtttcaggtggagggaaccgcatgtggaaagcagggaggtaggaaagtgtagagtgtgtttaaagaatagaccagtttggctgaaacaggatatttgagcagaggaagcttgtactaggtaggtgggttgaggccaaattatgcaaggcattaaatattaaactaggaattttggactttatcctgcagtttatggggggtaaatgataagattcaatatcactttatttgtacagtattatgttacattttatctaattgtttgtttaattcctgtctagacaatgaattcctcaagggcaaggagcatggcttattcacctcagtaatttcagtgcctagcattgtgcctggtacaaagtggacacttgtatataaccttttttaattgaagcaacaagttgtcaaccttacaaatgtgaatccgtgattcagatgacaggttgaaatgtagattgtctgcgaagagggcagaaagagagtatgacaaaggaggacaagacagtggggcaggcagggagagagagcagccagggtttcggtagaggtatgtcaaaaaggtatggaagtcagaggagaaggagacccctatgttatagaatacaaatggaagggaaatgatgacaacagtaagttgtcattaaatgcaaggttgcaaaagtaagattgtaaagcaggatgagtacccacctattcctgacataatttatagtaaaagctatttcagagaaattggtcgttacttgaatcttacaagaatctgaaacttttaaaaaggtttaaaagtaaaagacaataacttgaacacataattatttagaatgtttggaaagaaacaaaaatttctaagtctatctgattctatttgctaattcttatttgggttctgaatgcgtctactgtgatccaaacttagtattgaatatattgatatatctttaaaaaattagtgttttttgaggaatttgtcatcttgtatattataggtgggattcttaatagattctccaaagatatagcaattttggatgaccttctgcctcttaccatatttgacttcatccaggtatgtaaaaataagtaccgttaagtatgtctgtattattaaaaaaacaataacaaaagcaaatgtgattttgttttcattttttatttgattgagggttgaagtcctgtctattgcattaattttgtaattatccaaagccttcaaaatagacataagtttagtaaattcaataataagtcagaactgcttacctggcccaaacctgaggcaatcccacatttagatgtaatagctgtctacttgggagtgatttgagaggcacaaaggaccatctttcccaaaatcactggccacaaagtgtgacattttggcattggcatcactatttgatggaagccaacctccccccaaaaggcctgtattagaatgaagatggattccctgggtgggttacacttgaaactagcctcacccatgaacactttggcacagattagctagcccattcccccacagtaaggaccataaggaagggacagaagcaaagataagttttagaacaaaagagaggggaaagaaaaaatctagggttttatgagggctgtccctgagtgatagatgtgaataggcctccagggcaggctggctcagaggctgactctttgggttggggtgactgattggtggtgaggatggagaagaaaaggggagtggaggaggtgaaagtgaccttgggacattaggtctccataagtgacaggatttaaggagtgttgtaagctgtggttgttggaccaggtttaagcacagcttcctgagcttcctgactggtttaggtcaagctccagagagcaaatgccacagtctcagtgatctccttggagaaacagttggaataggatgttgcccatgttgggatgagtcattgtccgctcttgctctttccctacccctgcaaaataataatactgtatttgattgaacatataaaacaaaagaaggattatcacataagtatgtatatataaccaacattggcaggtgcagaaaaaccagactgtcagtttgcctcatctgaaatgattgacacaaacaaatatatttactgtcccaagtgaactttggcattttggatatccttcagttgttctgtttaaagatataacttagaagcagctgatggaatatttaaatccatgcgttgaattcatgcattcaaagaaacatgtcctgagtcactaaatgctgacatttgtttttcatgttaagagtgtaaataactggtcccaaatataatattattacatcagataaaaactggaatgtgaacctcttaacttgattgtgaaagtatttgccaatggtgcctcttgataattatttgaggctcacttcagaactcctctggaagggttaatttttaaatagtcattttataaattaacatttttgacatatgtgatggctctcaaattttttcttttatgccagtttgaatcatttctgctcaatttttttttttaattgggatggagtctcactctgttgcccaggctggagtgcagtgatgcaatcttggctgactgcaacctccacctcctcggttcaagcgattctctcgcatcagcctccagagtagctgggattacaggcgcgcaccaccatgcctggataatttttgtattattactagagatggggtttcaccacgttggccaggctggtcttgaactcctgaactcctgacctcaagtgatccacctgcctcagcctcttaaagagctggaattataggtgtgagccactgcaccaggccctgttcaacttttaatgctaagattcatttgttgttgtttcacaagtgattaggcagaggtcttttatattaatttacccattttatttgtaagagagtctcatattaaggaagcataatatatgacaatccaaatacagtacaaatttggttaattttgattttgttaaataattaatcacaggggtccttcaaattgtgagctcctctggttatacttatgttttacctctggttatacttaatttcaaacaaatgaaatttcattctattcatgatatttcagaagcagatctgttgcacaaaataaagcatacctataaattttctttttttaaaaaaaagtctctgttcactctattttctattatttttctctttttaaaatttgaattttattgtggcaagtccacttaacatgagatttaccctcttaacagatttttatgtgtaaaatacaatattgttcaccatgggtaaatgttgcacagcagatctctggaacttattcattttgcactactgaaattttatacctgttgattagtatctccccatttccctctctcccctgtcctgttacccatggttctgttctttgcttctttgagtttgagtattttgatacctcatgtaatcttcattctattttctaactttgacaatgttctgacaaatttgctttccggattggagcactgtatagtgaaaattgaaaatcttggttattttctacagattcccactattttaccttgagcagacacttatcttgaagggtctcagatttgtcacttgtagaatggggaatataaacctgataatggtccctttcagttctaaagttatatcagttgaaaatacatgtgtcacttatggtaacgggtagagaactggctcactgaacagcatatggatattataaagtggttttttttaatcctttctgcagacagttactttatactttattcaaatggattattgtgaagtacatgttagcggactttgtaccttttaaaaatgtatgtatttggtgtaatgtagaaatatagaaatttattaagtatgatttatttcaatgttaagcatgagaaaatatgctccgaaaggttagatagcttgcctaaatgacaagcttgtatttcaagcagaactttctgaatcaaaagactccaagacgaatgcccagctttcaaaaactgtctaaccaaaataaatcctaagattcaccttcatactaaaattatttaaaaatagtttattttaaattaatattcacttaaaatgtatttatcatgcaatactttaaagtgtctgggaaatgaaaatatccaaagatcaaagaacaccatgttttcaaacttcaaaaatgttatcagtgacctaaacaatttttaaaattttcatagagcctatgaaaaatgtacttgcaaatggctactttctgactaggaatagaatggggagagtatttagtccaacaatgatagactggattaagaaaatgtggcacatatacaccatggaacactatgcagccataaaaaatgatgagttcatgtcctttgtagggacatggatgaaattggaaaacatcattctcagtaaactatcgcaagaacaaaaaaccaaacaccgcatattctcactcataggtgggaattgaacaatgagatcacatggacacaggaaggggaatatcacactctggggactgttgtggggtggggggaggggggagggatagcactgggagatatacctaatgctagatgacgagttagtgggtgcagtgcaccagcatggcacatgtatacatatgtaactaacctgcacaatgtgcacatgtaccctaaaacttaaagtataataaaaaaaataaaaaaaagtttgaggtgtttaaagtatgcaaaaaaaaaaaaagaaataaatcactgacacactttgtccactttgcaatgtgaaaatgtttactcaccaacatgttttctttgatcttacagttgttattaattgtgattggagctatagcagttgtcgcagttttacaaccctacatctttgttgcaacagtgccagtgatagtggcttttattatgttgagagcatatttcctccaaacctcacagcaactcaaacaactggaatctgaaggtatgacagtgaatgtgcgatactcatcttgtaaaaaagctataagagctatttgagattctttattgttaatctacttaaaaaaaattctgcttttaaacttttacatcatataacaataatttttttctacatgcatgtgtatataaaaggaaactatattacaaagtacacatggattttttttcttaattaatgaccatgtgacttcattttggttttaaaataggtatatagaatcttaccacagttggtgtacaggacattcatttataataaacttatatcagtcaaattaaacaaggatagtgctgctattactaaaggtttctctgggttcccaaatgatacttgaccaaatttgtccctttggcttgttgtcttcagacaccctttcttcatgtgttggagctgccatttcgtgtgcccccaaactctacttgagctgttagggaatcacattttgcagtgacagccttagtgtgggtgcattttcaggcaatactttttcagtatatttctgctttgtagattattagctaaatcaagtcacataaacttccttaatttagatacttgaaaaaattgtcttaaaagaaaatttttttagtaagaattaatttagaattagccagaaaactcccagtggtagccaagaaagaggaataaatattggtggtaattttttaagttcccatctctggtagccaagtaaaaaaagagggtaactcattaataaaataacaaatcatatctattcaaagaatggcaccagtgtgaaaaaaagctttttaaccaatgacatttgtgatatgattattctaatttagtctttttcaggtacaagatattatgaaattacattttgtgtttatgttatttgcaatgttttctatggaaatatttcacaggcaggagtccaattttcactcatcttgttacaagcttaaaaggactatggacacttcgtgccttcggacggcagccttactttgaaactctgttccacaaagctctgaatttacatactgccaactggttcttgtacctgtcaacactgcgctggttccaaatgagaatagaaatgatttttgtcatcttcttcattgctgttaccttcatttccattttaacaacaggtactatgaactcattaactttagctaagcatttaagtaaaaaattttcaatgaataaaatgctgcattctataggttatcaatttttgatatctttagagtttagtaattaacaaatttgttggtttattattgaacaagtgatttctttgaatttccattgttttattgttaaacaaataatttccttgaaatcggatatatatatatatatgtatatatatatatatatatatatatatatacatatatatatatagtattatccctgttttcacagttttaaaaaccgatgcacacagattgtcagatagcaattctgtgattgaaggggaaatatgtcacctcttcatactcatattggtgaagggtcctagcttcaaaattaatagattcctaaagaggggaaatgaaacatccgcatttacacacacacacacacacacacacacagagttcctcttgtcggtaagttttgttttttttaaatctctactagataaaatttgttatctaattgtgagttttacacaaagaaaaactgtcacagaaaagaaagacagtgtcacatttttcaaaagaaaaagaagaaaagaaagtgccatgtttttcaaatacaaatgttctggattgattttaggatctttagtgaaaaacaaagtatttcataataagtaaaataaaaatctatgtaggtaaatttgtttctctaatttaagaatttgaatttctgagtatttatgataagtgttgaaataacttcttatatgtgacagtgaatactggcagagcaaatgccaaatcaatgccaaatctgtaggatcatttgattgtaggaacagaattctactcaaaccgaaagcaggcatttgctggagttacagaaaggcctcatggaacaccgagaaggtggtgccattcgactcttaaagaagctgcaacaggcacaagagagtcagctgcagctcttcttcttgagtctatatctgtcctgggtccattcctttttgtggttgcttcattcctttctctctctgaagactggtttttctggtctaccagggctatgccacattgactttatgtagtgtctccattctggcctcctgaatttacaggagagttcctctgtacaaactcaaagtcctggagagaacagaaaacagcttccttttggctcaggggtccaactgcagtctactctgctgctatgaggatagtgggttcaccacctttgttgttctctcagctagggcagtgggaaatgactctatgaaaggaatatacatgggcaggcaaatgtactaatcctcatcagtactgtaattttaagcaactttaaaaaattcttttaagttatttgaaaataagatcaaagaaggctgaattacataaatgaagatttgttaacaattaattcaaaccaatataacacatgctataacatggttgagtgtgattgagtcttgatttattaggggcaataatcaaaacatttaacaatcattatagtacagaacttaccaatcaaatcagatgctcagccggagtggatgttggccacccagctattattatccctggctcaattggtcttcagctgtgttaacttgcaaacattaattaactatctaagcccctcattttcctcaagtgtaaatagacacaataatattacctattccataggtgtggggtgaatagtaaatgtaataatttgtccaaaacacttagtatagtgcctggtccatggtaaatactaaataaatgttatctgacttattattaaaattttatcttctcagcttaaccttcagaacagtaatatattggggtctagataaatcttgcctatatgaaaataatttaatactacatgcagatatatgctgtgtatattatgccttctgttagaggaattgcagaaacaaaaatttcaattaataataagatgaattatttctcccaattgtagaatcttttgacaattttatcatgcattacagatgtaagaactcttgattgggacttgatagtctaactttataataatttaagaacattcctcttagagaatttctatggccataatactgaacacatgaattttaattagctgtcctctttagccctaaaaaaaaaattactgtaatttaacacttaagtgttgttcttcccaggtacagtaatctttttttttttttttttttttttttgcatagagggtaatcttttctctttccaaatggcagaactgttagttttctgactgtccggtgaaattctaagtccacttacttcccaatagcatgcaattagcaaaggtcctccttgcaaaggcacagaacacacctaaacatcttgcagatgctgtttggacactcttcccctgcttttggtctctttgtaaagcagctcatctggatacaggatctcttttccccattgcccattctaatatatgttaccgttattacttatagaataatagtagaagagacaaatatggtacctacccattaccaacaacacctccaataccagtaacattttttaaaaagggcaacactttcctaatattcaatcgctctttgatttaaaatcctggttgaatacttactatatgcagagcattattctattagtagatgctgtgatgaactgagatttaaaaattgttaaaattagcataaaattgaaatgtaaatttaatgtgatatgtgccctaggagaagtgtgaataaagtcgttcacagaagagagaaataacatgaggttcatttacgtcttttgtgcatctataggagaaggagaaggaagagttggtattatcctgactttagccatgaatatcatgagtacattgcagtgggctgtaaactccagcatagatgtggatagcttggtaagtcttatcatctttttaacttttatgaaaaaaattcagacaagtaacaaagtatgagtaatagcatgaggaagaactatataccgtatattgagcttaagaaataaaacattacagataaattgagggtcactgtgtatctgtcattaaatccttatctcttctttccttctcatagatagccactatgaagatctaatactgcagtgagcattctttcacctgtttccttattcaggattttctaggagaaatacctaggggttgtattgctgggtcataggattcacccatgcttaactgagtggtgccaaattgtcctcaagtctgttgtactgatatatatccccatcaagagagtacaagaattctcatagctatgtatcttcaacaacacttggtgtctggtagatgtgaagtgattactaaaaatatagggaagctgcatacataattattggcttttgctgttctcttacattaatttcttattcatgttgattactcatttgtcacctagttttttcttccttaattaaattgtaggaatttatgaattatggattgatcatcagctctatacatttcaaacataatccctcagtcagtggcttggcttatagagtcttttgatgaaaagaagcttttaagtttaataaagttcaatttattgtcttttcctttatgttttgtgcttttggtatcttgattaagaactccttccttatattgggttctcaaatttagcagcataacattttcatactattatttaaatttttttcacattatttagtgatagcacctttcttattcctaaagtgtttatcattgccttctgtctttctgcttgataaatattgccacacatttgtatactttattagtgtgtacaaagaccacattttagttgtgttatttctcttgttttggttttctagaatgcagagccattaatattatagtaatgcttatgtgctaataccatatcaggggcacaaatcccattgcagcgggactgagaaattaaaggaaatgatgcacatttactcatttttgtttaaaaaatcaaatgcatatttttcaatcagactatatggttggtctggatagcttcatcattgaatttttaaagtatttttgtactactgtatttaaaattattcattcaccactgcttttgtagatggtttagaaacccaagttaggaatgactgtgcaacactattattatactctttttaaaattatactttttgcttaagtttctttccttgttctctgagacagtgttcatgttcccaaaccacacacatttattcagctataaaatttgtatgatcaactcctgtcagaacaaacatcattataaaaaatatctccaggaaaaagaaaacccttttaatgctctcttctggttcatgtgtcttcttattttctttaagcattttcataacccattgagctgtaatttaattggaacatgatttatactaaagttggtttctttacctttaacttttttttttagtttgatcagctctctttagcttctgtagttcggtctttaattccattccagtatgcttttggagttgggtctcataaatgtatagaaatgtttctgttgggaaacagcaggagaatattaaataaatattgtgcttacatctatttaattctttgcccaactttctacaactttgactttacatttaagctcctcatgcacttacatgtttctttacctaaaaatatcttttcaccatgggtgtgtacaattcctttgtccttgctgtattaattttcttggtttacatagtagcctctacacattgatgtcaaaacctctgtttggtgcatttctactctgcgtgttcaatctccatgaaagtttctgtaaggtattttcattcctctagtttttcacatgtgcatcctggctttgtgacctgtgctttgatatcgtgcctttcatcttgtggcattgaaggatctttgcaaggacctattgtgttataatacagtctatgaaaaatatcaatatttgcatttgatcacatttaaaaaaatcacattcttttgtttgaatatcaaagctaatatgtgagtgatttccctgccaaatagcacaagtagcctttcctgggtgtttatgggcatttatctggttaatgattcccatcatagtgctgtcacccatgccattgctaaacttatacagtaacttttttgttttcacctcagcatatgttgagagtaggaaatagataggactatgccctcaaattttacgtttatatgatgttaatcctaaaggtccttgtgacttctgaagtaaaaactcagtgttgtcattttacttactgaattgttagctgagtttagagttgagtttacaatggagtaaacaaggtgtttagtttgatgtatgcttttagtctttcagaaaaaaatgtttatacttggaaagaatagtttatttacccatctggcctagtttagacaaaaacacagagtcaaatgtcaacagaattctgaagttataaaaatgacagtgtggctttttttttttttaaccttccacctggtgcttatgcccaagtgcctagctttctttagctctcaactaataaaggtaatgtttagataacatttaacgttaagttgcattgtgtttatgatcacatatctcaaatattggtacacgaaactgtacaacaaccttttttattagattttcctacgaaattccttattatattccctaagatagctttttcccaccttcttcttccttctcccttctcaggtgctccaataattccaacccctgcagccagtgactttattatatctttttttaaaaatctaaaaaaaaaaattgatgcaaccaggaagaattttctcatttctctccaccagttgtaccagcctactgcacctctcctcatgcaccaccttctgcctgtgttcttgctcctatattcaggagcaagtaatatgcaatacctccctctttgtgggatctttctcattagcataaaaatactttcccttgatctccagctactaccccatttctttgacctacatatagcaaaatatttgagaaaggaccactttccatcttttcctcaatctacttccatttttttctcaatccactttcatttcattgttctcctcaacccattctttccacaacctacttcattttatttccatcagccccataactcaggatcaacatcttgccagagccaatttccttgtctcccttaacagctccagcagtatttatgccatggacaaattattcttcttgtgatactttctctcttgcttccatgacactactcccacttcattttctttctacctctctggctcttccttggtcccttttcctggccccttctctctttcagatctctaaacatcagctatatctcagccctgttctactgacactctctagctgttattttctaaacccatgtttcagaaaccatatcttgatgaatcttggaaggccgaggcaggcgaattacttgaggtcgggagtttgagaccagcctggccaacgtggtgaaaccccatctctcctaaaaatacaaaaattacctggccgtggtggcatgcacccagctacttgagaggctgaggcacaagaatcgcttgaacctgggaggtggaggtttcagtgagccgagatcctgccactgcactccagcctgagcaatagaggagactccgtctcacacacacacacacacacacacacacaaagaaaataaaccatctcttgatgaatcataaatttgtgtctctagtttagacctctatcctgctctctaaatgatgtatccaactatcatcttgacaccatcatatgttcataaaacataattatagaatatctttcagtaggcttgacattttaaggcatgagtttccgttcagtatctccttaaaatatacccagggtctcaggagactattcaaacaggacaaagcttctattctacttactaatgtgtctggccctatttggcaggttggataaaaagtcatctgaacattgtcactttatgaataatatagtttaatagtttgtgaatcacccctgcaatttaaaaaatagtaaaattatcagaatctaatttaataattcctattggaacaccccatgttaggggatttccagttatttcaattgatatctcaatgttttaaagattgtttatttctattactaattcactctttattttaacataaattgtggctatctatctctattcatttcaattatatttctcataccattctatagatggggtgaaaagaaaagtgttaattttttaaaactccatacctcaaatactatatgaatttatagttgttattgctaaagcaattatcttacatcttttcctccaaaacaaagttatgtgctggtttattttctttgtactcataagatgccttccatttttagtaacataagtcttgtctttctcctattcttagctacttaagcattatgtagcttaaataagcactaaagattcctatctgtatgaaaaaataaagattaaataaataagatctagaaagggtgacaaggtgatgcttcaaaatgaaccataccaagccatctagcgattgataaattactcacactcataatcacattgttggaaagaagccattgacaattcagtttgtttcacaactgtctatcacatagtgagcacaactaaaagactactttttgtcttttactgcttgttttgttgatcaagtgactgattgtacaatgaccaacaagaagtctgatgtgtagagaaaaggggaacctggcttttctgccttactcctgatgcctaattctgagcatgtgaatattattctgtttctttaattctccaagtgaagcagcagataaaccatccttgtttccattagctgtctaccctgttcaactgtgtgtttctaataacataagaataagaaagccaccagggtgagcagggaaggcaatgagtctgcaaggcttgtggatagatttctgttagtgaggctctagaaagttcttccaagattgatgcaatctgagaagagttttctgtcaatacaaactccctgggtttctcctttgtccttttactgcctgtgtttgttttgggttccagtaaagatcaagtgactgattgtaccatgaccaacaagaagcctgatgtgtggagaaaaggggaacctggcttttctgcattactcctaatgcctaattttcttgtactgaaagtagtttttgctgtaagaatctgaggggaggagtcatttcttcaatttttttttttggtctccttttaatggtttcttgatcatgtctatccttatttttctgttttcacaaatttttgtggtatattttcctctcatgacctctgtctcaagacttctttccatccatctcttctcatttcatcctgtagagtgtctgtggtaagagccctgcattctactctggccttgccatgtgtggccttgggcaagtcctagcctccttgagggtcttatttttctcatttgtaaaatgaaacagtttgatgagaagttttctaaggttccttcaagctttgacaatctctctcttctggatctttttcccatgaaaaatttcaactcttgattagcatgtaggcagggattattccacatccttataggaatcacatttctgctactgtccctgaatgctagagtccattgattaagttattcactgctgcaattgtcagagctgatcaaagaactctgaaccagtgtgttactagaactaacaaagaaaatgccattatgatgttctagagtcttgaattagtagaagaggtttaataagaaccctaagggattgctagaatgttaaaaacaaacaaacaaaaaaaaaggttgaaaagtttagaaaattcactggtctttgtgcccatcattttacttccagggtttagataatctcatttttgcaatgaaggaatggattagatcacaagttctcatcctagtagcacatgcagaatctttataaaaacacagagtagccaggtgcggtggctcatgcctgtaatcccagcactttgagagcctggggcaggtggatcacttgagaataggagttgaagaccaagctggtcaacatggcaaaaccctgtatctactaaaaattcaaaaattagccaggcatgatggcacatgcctcccagctactggggaggctgaggcaggagaatcgattgaacccgggagatggaggttgcagggagctgagatagctccactgcactccagcctggtgacagggtgagactccatcacaaacaaaacaaaacaaaagaaagcaaaaacacagattactcagggtccactaagaccagtgaagtcagttctcttggtagggggcagggtgactgagcatgatgtttgtaattttaaaagtgctccaggtgattctagcgtgtatcaagcaagacttgtgaaccactgaactacatgctaagactcattttagctctgattttctgtgagtcatagcagagggctcagcaaactttttctataaatgctaagatagtaaatattttcagctttgtgggctgtatcgtctttatgacaactcaactcagtctttgtagagaaaagcagctgtacataatatgtaaactaatgggagtagctagatgtgtcctgtgggccatagttttgctgactcctggtctatgtcatagaatttccttttgaattgatggaccaccagcaaatgatttttgtcctgtatcaatcaatgatacatacataaatctctacaagacatgtaaaggatgaggcttaatgacagagtactttggggaagacataatattgcaaaattaagatgcttagagaaaaatcatattaaaatagtgaaaactgtgagaaggtattttgatttgttgttttggattcctctttttgcaaattcttttgaaatattttcagtggaagctacatagatccaattgtattcaccaagctagattgtaattaagctccagagtaagtaatagatttgatgagtgatgtccaaccttttacatggaagagtaagtttgagtcttcctttgcccattgacacacttagtaccatgtttaccaaagttcttagttattgaaatgggcaccagcatattttgaaacgttggtgttaacttgggatatgccttttgtcatgttgcaaatagattttgtttctgttttgtgaagatcaccatctctgtcacttctgatagaaaaagtgacactgacttctcaagtgatttgacacaggttaaaatatgtaaaccatttctgtagagagcaagctgtaataatatactaaagggctaggtttatagtataatataaataactcatttatgctgttaataatttatagcaacatggcatttgactgactttttatgtgctctagtcatgtaagtaatagatgtggaaacatagaccagagtttcaagaacatgttttgggcagagtctgttttcttgctattatctcttaagtttatgttcatggcctaaagattatgctaatggatctgccttggtcttgggtgtcaggtctgtgttagcgagtattgaaaagcatagtttttgcctactgggaaggatttatgatttaaaagccctaaatctccccttttatgtacttcatacttagaaaatttttcctgtaaactgtgtgacttttttacattgtgccagttttctagatgactctcgtcatatttatttcttgcaatccttctataactatcagttatgaagtctctttatagtgttgccagccaggtctcaggtgtgtgaaatgtattttctattatggattttggggtatgatggcacatagtttgggtgttaatgcctaatcttgatgtactggcttctgaacaaccaaaaggatgaaaggaaatagaacaaatatttttgtgagggagaggagtctggcttcttgacttactctagaaaaagcctgtaagcctcctcttccctccttgtcacacaaagtgacaaagaaaatcaagaattgttttcttcttggcttaaatgcatcccttataaagtaaggctgagatcaggctgtgaagctatctttttgtcaagactgtcataattccaaaacactttgttcttctaatgcttaggttagtaactttaaacatttttataaagatagtgaggtccagttttaaggattgaccccttctcaaggggctcagaagaggttttggagaataataaaattaaataatgaaaccaataatttaaaccagatcatgatccttaagaaaaaatcccatcaaatttgggctaaactctaatatacagaggtctgcacaacttatgtcaagtattcttccccacaaatgaagaatggggttcattgtgtcattggttgggtctcattttggcttcatcttctatttctcaaagtctaagaaaagtgctcctacggaagtgggtgttggctatcatgagactttgctgctggcaggccagcttgctgctctagacagagatatccctcgatcctccttggacaactgttttctgtgcacaggaagcagcaggctggggttaaggagtttgccaatccagtcattctgataattgctgaatatgaatttctatccagcacaatctaggtagctacaatggcacagtagtttttatgtatcaggtgaaaatgtttaataggcactctaaatgagagaaaaggttaagtgaggttaaaagctcaatgaaaacaaatagatgagactaaaaatagttcaataggttgtaacttccatctcatccaaacagcaatgaatattttgaggctgaggcgctgaggggtaaaattgcagcctggactacttgctaatgtagacctacagcactgtcattcttactgcacagacactgctttctgcataggaggtagaataatgaattcatttattattaacaaagatttattaagtgactgcatggtgctaaccactagatggggagggatgttttgaactgtccattgtttgactataacaaggaacgctttgaacgaggttactatcataggcagaatttgtttaacatgaagcctatgagacataagccacaggtcctctcacgtgcaggaactcctttgaaggccctatacttaattttatatgcatagtttggatttggattcttttttttttaagagttccccaaattacttaagcttcaggctccacaaaacctggatctacccctggtagcagctatgaatctttgactatgaaattaagtgtacaagaaatatgactttactttttctgtgattgagtttattttctatttgagcacgcattccactgagtgaaagaaataatatcattgaattcagagattttgctgggttctaagtggagtttacagaatgccatgatattaggaattaaggagtgtgttgccctacatcatcttttgtccgtgctcactgtctctgaggcactgatgttcctatgtgacctagaggggcatggtccaggtagatggagtctgtccttgttctcactgtgagctctcgcttgctgacccttcttcagtttcttccatgcccctgaggggtaaaaagattcaaatctgaagctatatcaagccatctgtgcatagacattccaagcaaccatgttcactctactgctcccatgtcatgcaaggcacaggaagcttcactatggcatgagtatttcctgggctttgccttggaattgaggcacgggcctcctttgttctaaaattccccaaatctacttgaggatagaaccaggatttggttgcaaggcagaacttttcttagaggacctggtatctaaaccctcttgttacccccatttatggaccccatttatggggtgaggagagtgactgcttctaatccatcataatttttgtctatggctactgtttttgcatagacactatgttttgagtccttaggctttggcttttggcgcttaatggccaatattcacatggctcaaaattttcaaatgatccatatctgacttgagtttcaaaagtcagtttttgaaacttaaatgatcagaattgatttgttctgctctggttctgatgtggcctctccttccagaggtactggaggtagaatatccaaggtggaaagcccacgactacaaggaattggttagtaattcataatgttagctgtccacatctattcagtaatggcatttcagtggctgcacaactgaccatggtgaaagtgtctgcacaagccactttttcttcctgtcagaaaatgttctcacccactgaattgaatgactgtctgctcatatgctgtgaatgagtgcccagtcttaagattaaatcacacgttcttggctatgcatatttgggcatgctgtggggagttataataggctgtcttagagtcacattaagcagctagacagacaatgagttggaaagttacattttctaaatttgattggtacattccatttgtcacatttgacattagaagttctggattcaccctctatggtgagcttcactaatggagaatgtaatttgcaatgctcaaacacaagtcctaaacagaaaacattgtatgttacattccagtgctaccaaaatagtggttttgaaagtccttattttctaatactactatgtgtaattttgagtcatttagatagcaacagttaaatgttttatagattgtttggaagtattaaaatgtgaaggatttttgttatatagtgtctttcctatcttgcttaataaaatataagtttagaattgtgtatagaattaacatgcaaaaatatcaagtctcaactttatacagttaatctacatttgtgtatacccttcaattatttcaagagagggatactattcttatgcaggataaatacaataagatattttaaatgaattttaactacatctctggcagtttcatctcaatagtagttgtaattttatctcccagaccttattatagactagcagctctctatgaaaattagtgacagtgtgagtgtattttaattcaaagttaatcaagaatgactgagtcaagagttagctacccctgaaagtaactcataattcagaatttaaaatattacatgtggaacaatcatgactatatgccttttactttctctatcattatttaggttgtgggctttgggtccttttcacatccgttaacagtgggcttgacttcaaaggattattttcttgaatcttgaataattgctgaagacaatttgaagatattttcaagatgaaggaaactgaagcacagaatcactagagtgaaaaaagaacttcacaaacagtgcaggcttgatcaatggcatgggaaaacaggcaatacagttagaattgctaagatggaattttaacgttcaattaaggatctatctctaaactcctctgctttatccaccaatcattccatattaaagatgaagaattgttcccatttcaccttttgataaggaaaaatagaaataacagaagcaaatacacttttgcccacatttttttccaaaaagaataatttttgaagtctaaacgtttggtgtaaataagatgatgtgttaatattgtaaaggaaagctagttaagtttttgactgaataaagccagcatcaataattactagtaagactaaaaataagagcagtaaaattgtgtctaatcagctactaatatctgggaaggattgagccacaggatcaaagatggtatcttttaaaaatagaagttgagtgaattcggtcttcaaattctttctttttattcatttatatttatttactcattagtatattcattcctttattcatgtattgttcaaatatatattgggtacttattatatgccaagttgtttttaaaatcacattccaaattcccgtaagtcataattattcagagatgtatgttttttttaaaaaaaattgaacacctttaaaaattatcaagtccttttatttctgtatgcattaaagataaactttactaaatgttacatgaatagatttataaagcagataaatatttaatttcaaatataacccttatatgcaattatattttccttagcactaaaaatgaatatttaagtaatttatattaaaagtgtaattatttaactgcagatgtatgccaatgacttaaattgtttaaagattatagcaaagttgtttaaaattgtctaatcatgaagagttcacttaaccacctggttgacacataaaattatagttagttactaaggtagttcgagagaaagagaagaatcttcagtagtggttttgaggtgtggtacattttattataatataccggttatacagcattgtgcagtgctgctcatagtagaaataaattttctctttgatgtcatctattcccttgtgtggcttacataactgagaattaggtgatcacaaaaataaacaggcctatacagagcccatttatataagtcctggttatttctcttcagttaaacttttaattatatccaattatttcctgttagttcattgaaaagcccgacaaataaccaagtgacaaatagcaagtgttgcattttacaagttattttttaggaagcatcaaactaattgtgaaattgtctgccattcttaaaaacaaaaatgttgttatttttatttcagatgcgatctgtgagccgagtctttaagttcattgacatgccaacagaaggtaaacctaccaagtcaaccaaaccatacaagaatggccaactctcgaaagttatgattattgagaattcacacgtgaagaaagatgacatctggccctcagggggccaaatgactgtcaaagatctcacagcaaaatacacagaaggtggaaatgccatattagagaacatttccttctcaataagtcctggccagagggtgagatttgaacactgcttgctttgttagactgtgttcagtaagtgaatcccagtagcctgaagcaatgtgttagcagaatctatttgtaacattattattgtacagtagaatcaatattaaacacacatgttttattatatggagtcattatttttaatatgaaatttaatttgcagagtcctgaacctatataatgggtttattttaaatgtgattgtacttgcagaatatctaattaattgctaggttaataactaaagaagccattaaataaatcaaaattgtaacatgttttagatttcccatcttgaaaatgtcttccaaaaatatcttattgctgactccatctattgtcttaaattttatctaagttccattctgccaaacaagtgatactttttttctagcttttttcagtttgtttgttttgtttttctttgaagttttaattcagacatagattattttttcccagttatttactatatttattaagcatgagtaattgacattattttgaaatccttcttatggatcccagcactgggctgaacacatagaaggaacttaatatatactgatttctggaattgattcttggagacagggatggtcattatccatatacttcaggctccataaacatatttcttaattgccttcaaatccctattctggactgctctataaatctagacaagagtattatatattttgattgatattttttagataaaataaaagggagctgaaaactgaattgcaaactgaattttaaaactttatctctctgtggttaattgcaaacacagatacaaaaatatagagagagatacagttagtaaagatgttaggtcaccgttactaacactgacatagaaacagttttgctcatgagtttcagaatatatgagtttgattttgcccatggattttagaatatttgataaacatttaatgcattgtacaaattctgtgaaaacatatatataggatgtgcgaaaagtccctgtgtatcatgtgaaatggcttaaaacagaacaccataggtattcatatcagtgaataccataggtagctgaaagtgttttttcctggggtcgccaagatgaatgccaaaagtgatatcattattataaacaatagccagaataggttggtataaacctggtagaaagccttgataaattgactttctctcctcctgacatcctgccacccctttgctttgctgatgctcatttgtccactaaattaaactcaagcaagccctagtaaagtaatagaatttgtggagtcctcattagtataggaagtttccctgatgtgagattagtaattagagatgtagcaaaatgagaaagaagtaatatgcttagatatttcattttctctgaacctgtatatacaaaataggccatgcgtgttcagtaactattcactgcaaggcactctctaggtactttgggggaattggaaattactcacataaggctatggattgtgccatttgtcaaaagacaaaatgacaacaaatttagtttaaagacctcagtcagctttattttctattctagatttggacagtccttcatttcacaaattggagtaagtgttccaataagttgagcaaaggagcttggctttatagacccaaaaaaagggccaaaggaagcagaaacaaagaacaataagagaattggtcatttcaaagttacttttcttgaaaggtggggacaaggagacagaataatagaaaagtcactgattggttaacattggattaagaattaaaacagaggaaactttaagattgaagtttgaaactgacttgtttgggaaatcaggctgtcttctttcttgatttcttagaaggccggataacaactgagttttgctttggtgaacatgggtgactccatttttacttttagtctggtctgttgaggcctcgtgagagagcttaatctaaaacaatgacttcctataatttttgtttgacacatccaaagagggactctaatatttattgagagcttatcatatcttaagtactgtttaaacacttttatttgctattacatttgatcttattataactctaaaggcagaaatgattgcttttattttccacaatggaggaaactgaggttcaattaagtgagtaaggaagcagggatcttaaacccagataccattgctcctctttaaaggtggaagaacagaaaacatggggcaggggaagagagaaagtttctgtcccaggacatgataatctaaaagggaaaacgtaagatccactgaaacctgaggcagatttattgtggcaataacaaagcttaagtttcacagaccttcatttgcctgagccaactttgaaggccatgtatctaattttgtttttataattctataatctttattcttgaaaagagccctccctccaaatttacaagctttgggcccccaaaatccttgaaatgcccttgaataagagatatccaggtaaatgctatgggaattcagaggaggaagcagttagtatcagttggcggagagttaggctattaagagaaggttttatataggaagtggcatttagaatgaagctttgagaactgagctgtgtatttgaacaagtaaaggtggtgttgcagaattttgctccttagttctattaaaaacccgggttcttgtcacatgatccggaaaatttaggcacacagatacattgaagcatgagtagagcaggattttattgggcaaaaaggaaaaaaagaaaactcagcaaatcgagatggagtcttgctcacagattgaatcccaggccaccacaaaggaactgaagagatcgggcttctcccctgcataaggtgcaaattccccatggctccacccacttccccttagtgtgcatgtggggctccagtccacggtgggcatgcccagacaagccttgggcaggttccctcatctgtgcaaaagcatctgatgtaaacacttgaggggtggttcggagattctctgggacccttttattttcttatctgcctaggcatttggctgtctcagtgggtgggaaagggtgctccaggcaaagggcataacatgaggcaaagggcatgcacagaaaacagtgactggttcagtcaggttgggggatgccaaaggaagtaatgggagacaagattggagcaagatagataagagattgtggattttttttcttttttatctatataaatacagagacagggtctcactatgttgcccaggctggtctcaaactcctggcctcaagtgatcctcccacctcatcctcccaaagtgctaggattacaggcatgaggcactgtgcccaacctccaattttggattttgagagctaaagcaatatagtcgaaaactcagataatccaggtagattttgctattaggtgctatttggttcctggtacagagctaaaacccttggaatttcctaagtgataagagctacaggagcatcttttgttatatgtttccccccctagttcctgaaatagctctagagaaatacaggtgaataacatcctttgttattcatatcaagcccctatcaaccataccccagtttctatttatgaagtggcttttgggaagtccctaaagacaggagtggggaaaggctggttgtcagggggatgggttgaaactttcatcttccccccttgacctccagggagggatgagtggctgaaaattgtgtaaaatcaacaatggccagtgatttaatcaaccatgcctatgtaatgaagccacccgataagccttaactggaactttttggagagcctccaggctggtgaagacattgaggtgctcagaaggtggtattccagagagagcacagaatctctgttccccttcccacattcattttgctatgcatctctcccatctggctgttcttgagaggtatccgtttataataaactggtaacctagtaagtaaactgttaccctgagttctgtgagccattctagcaaattatcaaacctaaagagttcatggatacgtgcaatttacagatgcacagtcagaagcacagatgacaatctgggcttgccattggcatttgaagtgtgttgggaggcagtcttacaggaatgagcccttatcctgtggggtctatgctaataacagacagttgtcagcattgcttggtgtcgaaaacccacattgttggtgtcagaagtattgtcagtaggatagggaaaacagtttgttttctttttttagtggtctttggtcatctttaagagcagggcttctcaaagtgtggtccttgaaccagcatcacctgtaccacgtaagaacttatgagaaatgttcattcttgggccccaacaaagaattaaaaattctgagggtgtgaacggggtctgagtttcagcacaacttcccgaccatgctgatgcattcttgcccaagcatgaaagccctcccttgtttaagaaggccattagggccgggtgtggtggctcatgcttgtaatcgagcactttgagaggacatagtgggaggatcacttgagccctggagttctagacaagcctgggcaacatggcaaaatgctgtctccacaaaaatcacaaaaattaggtgggcgtgtgttgtgtgcctataggcccagctacttaggagactgaggcaggaggatcgcttgagcccaggagattaaggctgcagcgagctgtgatggcaccactacagcctggatgacagagtgagacactgtctcaaaaaaaaaaaagaaaaagaaaaagaaaaaagaaaggaaaatgaaaaagaacgccattaggtataaaggagcaatggtaaaagaccagttgcaaaaggttagggaatgggtggttactgaaataagaagctatgtagaacactagtgttggtggcaggaagtagaaagcaagagcactgctctgtgggggatggtcatagcaaatgcaatatggaggcatttgcctctgcactgaggagaaaactatcttttccaagataggaggaaaggagataagtggaattaaagagaacctttgagcacagagttgggaaactgaaggtatttgtgttgtgctccctcaatcttttaattcaactataagctaaacccatgaaacttgagtagtttcagttatctgacttttttcttctcttttgatacagtgttggctattctgggtcttttgcctctctttatgtacttaagaatcagtttgccaatgtatgcaaaataactggctgggattttgattgtgattggcttgaatctatagatggagttgggaaggactgacatcttgacaatgttgaagcttcctattcatcattatgaaatatttctccatttgtttgattctttgatttcttttatcagaatttagttttcctcatatagtcttttaaaatattttgttatattttgttcaagtattttgtttttgaggaatgccaatgtaaatggtattgtgattttaatttcaaattccaatttttcattgctgttatataggaaaatgattttttttgcatgttagccttatatctttcaactttgctataatcaattattgatagtttcaaggattttttggtcaattattttgaatcttctacatagattatcatcatctgaacttagttttatttcttccttcccaatctgtatacctttatctccttttcttatttcattagctaggacttccagtatgatgttgaaagtagtggtgagaggggatatcttggtcttgttcttgatcttagtgggaaaacttcaagtttcttatcattaagtatgattttagctggagggtttttgtagaagttttttttttttaagttgaagaagtctccttctatttttagtttgctgatttttaaaaagaatcaggaatgggtgttaaattttgtgaaatgcttttctgcaactattgatttgagcactttatttttcttctttggcttgttgatgtgaagtacattaattgatttttgaatgctgaatcaaccttttgtacctgagattaatcccgtttggttgtggtatataattatttgtatacatgttgagttcgatttgctaatactttttgagaatttttgcattggtgttcatgaaaaaatattggtgtgtagttttttgtgacatctttatctgcttatggttttaaggtaatgctggcctcatagcatgagttagggagtatttcctctacttttacatttgagaagagattgcagagaattagtaaaattcctactttaaatattttgtggaattcaccagtgaacccatctggacctggtgctttctgttttggaaggtcattaattattttaaaatagatataggcctattcagattacctattttttctcatgcgagttttagcagattgtctttcaaggaattggtctatttcatttaggttatcaaatatgtcaacgtagagttattcatagtattcttttattatccttttaatgtgcaagggatctgtagtgatgtccccttttttgttttattgatattagcaatttgtgtcacatcttttattttgctttgttagccaggctagagatatctctatttttgatgtttttgatgaaccaactttttgttttattgattttctctgttgatttcgtgatttcaatttcatgatttttaaattatgcttacatttgatttaatttgatcttcttttgctagttatccaaggtggaagcttatattgttaagatccttttgcattcttatgcattcaatgatgtaaatttccctctaagcactgctttttctgcatctcacaaatattcatgagttgtattttcatgttcatttagtttgaaatatttttaaatttctcttgatatttctcttttgacccatgtgttacttagaagtgtgttgtttaatcaccatttttaaaaattttctagctatctttctgttattgatttctagtttaattccattgtggtctgagagcatatattgtataattttaatttttataaaatttgttaaggtgtgatttatggcccagaatgtggtctatcttggtgaatgttccatgtaagctttggaagactgtgtattctgctatatttgaatgaggtagtctatagacatcaattatgtccagttgattgatggtgctgttgaattcaactatgtccttactgattttccacctgctagatctgtccattctttgcagagggacactgaagtctccaactctagtagtgaatattctatttcttgttacagttttatcaacttctgcttcatgtcttttgatgctttgttgctagaaacatacacatgaagaattggtatgtcttttggagcatgacccatttatcctcatataatgcccctcattatttcctcgccctgatgtctgttctctctgaaagaaatatagcctctccaggtctcttttggttggtgttaaaatgacttaactttctttatcccccttacttttagtttatatgtggttttaaatttaaagtgggtttcttgtagacagcaaatagttcagagttgtttttcgatccactttgacaatctttgtcttttaattggtatatttggactattgatattttaagtgattattgatatagttagataaacatctactatatttattactgttttctgtctgttacactacttgttctttgtttatatttttattgtctactctttttctttccattgtggttttaatcgagcattttatatgtttccattttcttttcttagcatagtaattcttctttaaaaaaacattttttagtggttgcccctagagtttgcaatatacatttacaactaatctaagtccattttcaaataatactaaataatttcatgtgtagtgcaagtaccttttaataataaaacactcccagttccaccttccagtctcttgtattatagctataatttagttcacttacatatatgggtatacctaagtatatacattatcatatttatgattgaatatattgatgaaattattttgaaaaaactgttatcgttaaatcaattaagagtaagaaaaatagttctaattttattataaaatgaaataccttcatttattcattctctaatacactttctttctttatgtagatccaagtttctgacctgtataattttccttttctctcttcagcttctttgaacatttcttaccagccagacctactgacaacaattttccccaatttttgtttgtctgatagagactttatttcttcttgacttttgaagaataattccacagggcacagaactctagattggtgatttcttcccctcaaacccttaaatatttcattccactgccttcttgcttgcattgtttctgagaagttagatataattcttatctttgcctttctataggtaagatgttttttcctctggcttctatcaagattttttctttatgaacatgatatgcctttctttttgaacatgatatgcctttctttttgaacatgatatgcctttgtgtcggattttttttggcattattctgcttggttttctctgagtttcttggatatgtggtatggtatctgacactaatttggaaaaattctcagtcattattgcttcaaatatttcttctgttcttttttttcctttattctccttctggtattcccattacatgtatgttacagtttttgtagtcatcccgctgttttggatattctgtttttttcagtttttttttccttcgcatttcagtgttggaagtttctattgacatattctcaacctcagagattctttcttcagctgtgttcagtctaccaatgagtccatcaaaggcattttacatttttattacagaatttttgacctatagaatttcttttgattccatctttgaatctccatttctcttctgcttttcatctgttcttgcatgttgcctactttttccatgaaaacctttagctttttttttttttctttttgaggtggagtctcactgttgcccaggctggagtgcagtggtgtgatcttggctcactgcaacctctgcctcctgggttcaagtgattctcctcctcagcctcccaagtagctgggattacaggtgcctgccaccatgcctgagtaatttttgtatttttagtagagatggggttttatcatgttggccaggcgggtcttgaactcctaacctcaagtgatctgcccaccttagcctcccaaattgctgggattataggtgtgagccaccatgccctgcctttagcatgttaatcatagttgttttaaattcctgatctgttaattccaacatccctgtcatatctgactgtggttctgatgcttgctctgtgttttcaaatggtgtttttttttttttgccttttagtaagccttgtaattttttattgaaaggtggacatgatgtgctgggtaaaaggaactgtagtaaataggcctttagtaatgtactggtaggtgtagcagagggtgagggaagtattctgtagtcctatgattaggttttagtcttttagtgagcctgtgcgcctgcagcttggaagcacttgtgaagtgttttttcaccccttttggtgggacatagtgactagtgtgagcgggagttgagtatttcccttcccctaggtcagttaggctctgaaaaaaccctgataggttaggcatggtaaaatagtctcttttgagggcaggcattgttataagaatagaatgctctggggccaggtgcggtggctcacgcctgtaatccccgcactttgggaggctaaggcaggtggatcacctgaggtcaggagttcgagaccagcctggccaacatggtgaaaccccgtctctactaaaaatacaaaaatcagccaggtgtggtggcacacacctataatcccagctactcaggaggctgaggcaggagaactgcttgaacccagtaagtggaggttacagtgacccaagattgtgccactgcagtctagtctgggtgacagagcaagactccgtctcaaaaaaaaaagaatgctctggcatatttgaaaatggttacttttccctttttttctctgatcttcactgtgagaacctggtaagcatcctataggcaaaattcataaaagtatagaagtcggccagtgacttggacccacttggaattttcttgctctcacatcatgcacactgaatctccagcaatttttcacttacagtttaggttttcctaccctactactggttctctcagaggtttctgcttattggtttctgttttgtaagttgtgattctctgtacctaactgcctgtctcccattttggggggcagtggtttgccctgtgacctcacttctctgacagatctaagaaaagttgtttatttttcagtgtgctctgctttttacttgttacgatgaagccaaccactttcagaatttctacaaaccagatcagaatctggaagtcctgtttttttattttttttatccctttgtttagcatgttacctatcttaacacattttaaataagtgaatgcatagcttatatctacttctaggttatatgcttccttagaataggaattgattcttaaaatgtcgttctgctcacgcctgtaattccagcactttgggaggccaaggcaggcggatcacttggggtcaggagttcaagaccagcctggtcaacatggtaaaaccctgtgcctgcaaaaaatacaaaaattagctgggcatggtggtggccatctgtaatcccagctactagggaagctaaggcatgagaatcacttgaacctgggaggtggaggttgcagtgagctgagatcgcgccactgcactccagcctgggtgacaagagcaaaactccatctcataaataaataaataaataaataaataaataataaaaataaaaaaataaaataaaacaaaaattttattctgagcagtctctgaagaatataaattctactgccttgcctttagaacttataacagcatctcgcaaactatcacaagatgctccaaacatacttcttatgtgctgaattaagaagtcaactcaaatttagtatactagtaatatttttggatatcccaaaacactgccagctcagctttaggctgcccttcttgggggggaaaaaagcagttgaaatttaggacttaagtgggcatctcgtttaatttttaatggatttctatgttgttggttatggtgaagaggtgaaaagaataaatattctgtgcagaaaaattattcagtcttcatgtgaaaacactttgtccatagcaattactttatgaaaaagatgtggtattactttctttgctcttaactgagacctttaatttaaagaacctatactttacaagtttttattttcaatgcatgaaaaatgtagcagctatttcacaacctttacttttaaaatccatttttctttttaatctcaaatagttttttcttaaaaccttttgactttttatctaaattgtaatagccagagcaccttcccacaactagaatatctcatcctttttgtcttttctttttcctctcaaaatgcctactgggaacttaatttggagtcagattcttcatgataaatctggacttaatcaaaattcctcatatggtatattgtatatatcacagtactggatagtcctctgattaaatagatatttgatagtactttaaggtctatacttttggatgaacttaactgctttctccatttgtagtctcttgaaaatacagaaatttcagaaataatttataagaatatcaaggattcaaatcatatcagcacaaacacctaaatacttgtttgctttgttaaacacatatcccattttctatcttgataaacattggtgtaaagtagttgaatcattcagtgggtataagcagcatattctcaatactatgtttcattaataattaatagagatatatgaacacataaaagattcaattataatcaccttgtggatctaaatttcagttgacttgtcatcttgatttctggagaccacaaggtaatgaaaaataattacaagagtcttccatctgttgcagtattaaaatggcgagtaagacaccctgaaaggaaatgttctattcatggtacaatgcaattacagctagcaccaaattcaacactgtttaactttcaacatattattttgatttatcttgatccaacattctcagggaggaggtgcattgaagttattagaaaacactgacttagatttagggtatgtcttaaaagcttatttgcgggaagtactctagccttattcaacagatcactgagaagcctggaaaaacaaatcccggaaactaattattatgtgccagttatataaacaagaagactttgttgggtacaaaccagtgattccttgcctttgaaaaatgtgtcagatatcatgcattaccagcagttcaatgatataaggaaaccagagtaatagctaaaacctttaaagctaaaccaaagatttacaaattgcctcttcatccagtctttcccaacctaaaaactgagttctctaaaaattttagtatttttttctgaagaaaagggaacatggacatttatctaatcctcattagaaatctgactaatgataacaaggatttagacctcaagcacttcttaccaaaattcttgatatgaccttatagcaaattactttcacctgttgaactttcctttcttttattcccctgtacctcacctgcactgggcatattcaagttgcttatacaacactttactattgtgttagaaaaatcatgacacatgatgaatgtgtttgtgcaacatgagctgattcataaatgaaaatgtgcattgaaattccacaatattttaaaattaggagtttatctagcaattgaacaaaattgattaaatccattatttgttagatcagctaaattacataagttcattcatctgctcataaatccatccattcttccatctggctatcccttagtcaattcaaataaatatttatggggcactttgggtaagccaggtgctaagaattcaatgcaaaacaagatagactcccctgtccttgttgaacttatatttttggtacaaacaaaagcaataatcaagaaaaaataaaaaaagtactgattgtgattaataatatgaagaaattcaacagagtattgtacttaacatttgattgatctgattttctcagttgtctgagaacaaacatttgtgaaaatctcattgtagagttcttacgatggatagggggtcaactgtgtcattattgcttatcagcttatcccaaagacctagtttattaccagattgcaaatagtgttcaataaattattcttattaagggttgttatgtactctaaaacatttattgtggtcccttcactggttctggtttacaaacttacttttctatgatgacatagtatagaaattgagagtgaatatttagaagttcatttttattatatatttttgaagtattgatatgtagtgaattagaaatttaaaaagaaaacaaaactgtccttcactacagattgaaaagcattatactaaaagaccatttgctcagttatagtatataaaggccaaatgacttaaaaacaaattatgtaaggagaaggaaacaaccatttattcagtgccactaactgtcagccagttttttcagtggtcagttaatgactgcagtagtgttctaccttgctcaaagcaccctcctcaagttctggcatctaagctgacatcagaacacagagttggggctctctgtgggtcacctctagcacttgatctcctcatgcagtgcatggtgctctcacgtctatgctatgttcttatggtctttaggtaacaagaataattttctttcttttccttactatacattttgctttctgaaattcccttctcgccaatccaggtgaatgtcagaatgtgatttgacaactgtccaaagtactcattcactgaggagtggtaaggccttcgcccaacctgccttctctgggaatatactgctgcctgaacatatcattgtttattgccaggcttgaacttcaccaaattaatttattagggtcaacatctaaatattagaactatttcagattaatttttaagtcgtatccactttgggtactagatcaaattgcaggtctctgcttctggcttgagcctatgtttagagatgatgtgcatgaagacactctttgcttttcctttatgcaaaatgggcattttcaatctttttgtcattagtaaaggtcagtgataaaggaagtctgcatcaggggtccaattccttatggccagtttctctattctgttccaaggttgtttgtctccatatatcaacattggtcaggattgaaagtgtgcaacaaggtttgaatgaataagtgaaaatcttccactggtgacaggataaaatattccaatggtttttattgaagtacaatactgaattatgtttatggcatggtacctatatgtcacagaagtgatcccatcacttttaccttataggtgggcctcttgggaagaactggatcagggaagagtactttgttatcagcttttttgagactactgaacactgaaggagaaatccagatcgatggtgtgtcttgggattcaataactttgcaacagtggaggaaagcctttggagtgataccacaggtgagcaaaaggacttagccagaaaaaaggcaactaaattatattttttactgctatttgatacttgtactcaagaaattcatattactctgcaaaatatatttgttatgcattgctgtcttttttctccagtgcagttttctcataggcagaaaagatgtctctaaaagtttggaattctcaaattctggttattgaaatgttcatagctttgatagtgtttttcagaagaccaaatttacagtgggagccttgggcttttgttttttaacagctcttttttgttcctgcttcagtggcctgacctccaagttagcaatcgccaggttgagaaatgctttgcgagacataacagatgctcctgaaataacaaacacttggaatcatgaggtagtggaattgaaaatagaaagtgtagtgattgttttttgttatttggatgggatgaacaatgtcagattagtctgtaactatttttttttaatgtcactctgatttggtcacaaaggatctctagtctcattgccttagtatcattctacgaattagaatgtgttactgtgtaagagcacttcttgtatatgagagaaatagcaacagttccagtttaaagtgatataaatggaaaccaagaaatgtctttactgggaccaaatctggacagcatttactgtatttttgctggtattttctctagtctttccgggtatattcacatttaatgatcacttttctccctttgtgctaatggacactgaatccattccactaccatagttcttgctaatactactctactttttacacaaaattaaaatgccaggagcacctccaggtagactgactataaatctagactgaaaaaaaagcttgtatttcttaacagattaccttgtggaacatttgctcctttcaactaatgaggcactaaatattgtaactgctcaactggtgcttttaatttatttgtctagactttgtcatgttgccagaagctttatcctggttggagttttgaaaacagtattgtttcttcagaaagaaaaaagggattgtcagatgatctaaaaataaagaaacactggaaatacaagtatcccaaggtgatagcattaggcaagataaaaatgttgaaaagcgaaaaagaactggttgatagagaagtgttgttattcagtagaacctaagtcttgtggtcccatttttaatgaaaaatggtgaattttttggtttttattgttcttgttcacacaaatctgcccattagaataagccaagccctaaaaattaatttcagtttcactgggaatcctttagtttatctactatgtagtagagaggttttgttttattgcatgtttgacgtaggaacgtatatatgcaagacatggaggaaaaccaagtgggccagagttttgaaaattctttatcttttctttctgccaaagtgagtctcccaagtttgtcttttttttttcatttccactcttctatggtttctagcattatataaaccaaacaaaaaaaatacgttcagagattccttcagaaatgctggatgatcttgatatcgatgcttttcatatatgtgtttatgatgctggtttctggggctggctctcagtatcacaaagatgtctgtaaacagaatatgctatttcttctttgtgacaaattttgaacattatgtgaatgtccaagaaagagcaaaagagggcaaacttctcatacatttttgatgtcgaaaccaagagacgcttttattttcctaacttttctttgaaagttcaaattaagtaattttatcctgtcctaaagtttaaaaagaaaaaaaaaaggaagaaggaattaaaaatccaaagaaaattatgtttgtttgcttttctgtttttttcttccttccaactccgagactttgcaagggcatagttctgaagatctctgacactgagacattagagatctctgtatcaatggatcatttgttttcagacatatgaaacaggaactttgaacaagaaatttcccctctttttctcatagtgatcctgagacatcagctgtggaatcacaacacgtcattagttttggcaggtccttgcaggtgttttgttttgttttattaatgttcttccctcctgtagctagacagcaatcttggagaatctgccagcttggaagactattgtgtaaatttcaaggtggagcctcctttaatttgttctgtgttacctgtgagctgtgaggtcatgaagaggagacaatgaggctaatcatgagagccccattggtttaggcaattagaacaacaagatctaaaatggtttattagccttgaattgtgttaagcacataattcataaaaaacagaaaaaatatttttaaatgtatgtctaaatcttcagttacaagtttgaaaggtgacaaactattctgaggaaatgattaggcctattcttgcaacgagtctttatgatctgaaaagaatctatgtccacacataactcccacctcaaagatggggcatcttttgctctgggagatatcaaatgcgaccaaaacaagtgtttgtagatttgaatgatgattcagcagtgtagcagttctcactcattttataataattaacaacttaataattaattattaaactcctacatgcttaacattataagtatgataacttctgtggttacataaaagatatacatagcacttgtccttgatctgtcacagtgaggtcccaatccaacctatgagcttcaaatgaaaagttcaaaattacactcattgtcataagtcagagatcaaaggaagaaaggatttaaccaaaatgataaattaaatataggtgattaaatatagtcatggttcaaggcatgggccagttagggagtgtgatgtgggtaattatgaaaggccagctcccaagccctgttgttgctactcccccacatcagtcatccttcctttttttctacttctactgcagtgccttcctcatcttttcccttgcatccctccattatatgagtcatacaaattagacttttcaaagcaacattaacattgtgtgaatttggggtttttgactaatcccaacattccacccccacattccagtcccacatgggatttggagccttgtttataaacctggcacttctaatatatcttatcttagagtaatccttgtatttgtttaatttccacttagcattgtaaatacttgcaggtatcctagttaagaaagcaaggtttaaacacaaaatcatcaccaattaaagcaggctagataaagaatgtaatagaaatgctagataaaacagattttttcttactaagttttctgtcccttatagagtgcataacacaataacttgcttgataagaattcaatgtacattgttttgtgctgaatcactaaatgcttgatttctgtaacaagagattgtggttccatcagtatctggattttagtctgtgtaatcttaggcaagttatttgatttctctgtgcctctgttttcttgtctgtaaaatgagtataatggtagtaactaattcattgtgtttttgtgaggattaaatgagttaataactagtactcctccctggcacatagtaagtacaatatgctgtgctgtggtggttgttattattttttatagttccttgagcaaaagaaataatgtccccatcttagtataatattggaggtatataccatagaagtgaacaaaagaatatagtttcacaaagaaagtgataattaaggcggttcataaagggtcataaagcttgtagattttagaaatgtgggggcatgaggatgtggagagggtattccaggatgccagacagggagattatggatgagtactaagatgagaactagaaaaagctgaggggcaaaaggtcagaggaggccacaagttagggagtattaggaaaaagaagttaatacttgacaagtgccaacatggcttcacgaggaatgggttgggcctttttgagtgaggaagaggctggtgaaagggtggtggaggacactgctgctgctgatggcatggggtgtaggtggcaggagaggcagggacatgagctaggaaactctccagctatgaagtgatgagtctggagtaatataaggacagtaggggtggagtgctgaacttaagggaggagagaaaaataattggtatggaagtaggtacaatgcaattttattatttctgagcctaaaaatgtgaaatttttgattatttggtcagaccagggaagtattttcttttatgctatctctgaaaatgtatacactaaaaagttgtagtataaaaaggttgtaaagcattaagtaattttagaggaaacaataatttggatattttacatgcaatcatttatatgcaaatatatgtaaatattacaaaattattctctatttgttacaaaccttaaatatttttgactgaggaatattttattcatctaattatagctactttgttctaactaatagatattcttgaaaacaaagcaacacttttttggagacagagtcttgcactgtcacctagacttgagtgtgttaccttgaactccagggctccagtgatcctcccacctcagtctcttgggtaggtggattacaggcccacactaccatgcccagctgtattagtccatcctttcattgctataaagaaataccggaaactgggtaatttataaagaaaataaatgtaactggctcacggttcttcaggctgtacgggaagcatagcagcatctgcttctgaggaggcctcaggaagttttcaatcatggtggaaggcaaataagaagcaggcatgttacacgacgaatcaggagcaagacaaagtgagggaggaggtgccacacactttgaaatgagcagatctcatgagaacagcgccaagaggatggtgctataccgttcatgagaaatccacccccatgatccagttacctcccaccaggccccgcctccaacactgggaattacaattcaacatgagatttgggcagagacacagatccaaaccataccaccagctaataccaaaaaaaaaaaaaaattttttttttaagacatggtcttactatgttctacaggctggtcttaaactcctggcctcaagtgatcctcccaccttggcctcccaaagcactgggaattcagacatgagtaacagtgcctggccaatacttatttttaaacattctctaccataaacttaggatcttgatttgttcacattgaacagatttttattatacagattgaatttataagaaaatgttgcagacattgtcaaaaagggacgtccaaaccactgtgatatttataagcatttgggccacattttgatagaactatacacggagtgtgtgtgtgtgtgtgtgtgtatatatatatacacacacacattatttatatatatgtatatatgtatatatatatatgtatttatatatatatgtgtatatgtatgtacacattatttacctacctactgtgtgagtgtgtgcatatatacacgcacacacacacacacaaatatatatatttcccttctgagacaaagccaaacagcactgtatgcttaaagaaaaacagtcacacttcccacttatgtaatttatattacatccagtcaccacaccagccaaactgctttattgttttttgtttgacatccaatgctaaagcataatgcctgttgcagtgaaatatacatgagcaaccctgagaactcaatatagcctcacgtgttgccactgagttgagttgaggagtcaagctgtagcaaaaaggtttgtcaccgggtgagtaatggtgctcttatttttctctgggtctcaagaagtgctctttatgacatatatggcattaaataaatatcagatatttgcacatcctaactttcctattggtgaagtttcttaaaagagagataaagggccattgtgtgattgatagtttcaggtatatttttgctgcacagtcagtccgagtgtaccacgtagggcaaaccacgtaacttctcagggccttgactgtttcatttgtaaaccagagaaaaggacttgggtgacctccaaagacctttcaaatttggagatgagtttgtggaaagttcaaacagtttagaaaacagaactaagacacccactggcacccctggaagcaagagagtgccaggtactatttgtaatacaggaatgaaatacctaattgtatgaaattgaattctaactgaaccagtttgttcagttaaattttttttttcaattagagtgcttacttcagtatctaacactagacagtaaactgtagacaaaagacctacagaatttctgaatggtatcaaattcaccacacttaaaactttgggatgtctaatttcaaccaacagctttctttcttcataatgttgaatatatgtgtatctattttagctaaatttaatatatatcaatatactttgatagatattttatataaactattagactatagtattatgagtaaaagacccaccatttcccaagcaattataaagaacgatcaaaattttaatgggttgttagtattatttctttaaagattgtgatactgataaatatttggccacattttaatagaattatacatgggatgtgtgtgtgtgtgtgtgtgtgtgtatatgtgtgtgtgtatatatatatggcagtagagatatatatatctacacacatctagatatatatatacatgtatatctatatatacacacatatatctgtgtgtatatatacatatgtatatatacctacatacatatgtacatatacatacatgcatatatctgtacatatatatatagtgtgtgtgtgtgtatatatatatatatatatatattttttttttcctgagccaaaacaaaatactaggttgtaatagctgttctttcagaaggaagaaaaacaacatgtgctgaactctgagtttgatgtttttgtattttacttcctattttcatatcagtccatttatttattcaggaagaatttattgagcatatattatgaacacagcttttgctaaggacagggtatgcagcagttatggcctagtaggagatatggatgttaaaaacaaaatgctcacaaatgcacatataatcttaatactcattgtaagctatgaaagcagagtgtgagtattatgagaccatatgttgggagattttatttggtattgaggatcaggaaagatacccctgaggaagtgatatttaatttgaaacctaaagaaagcagttggccatgggaagaaggtagggaatgagattcccaagcaataggaatccaatgtgtgaagaagctgagggagtgaaagaaagctagtgtggtggcaggaagaaagagaagagaatggagaagggcactaaatgagtcagagaagtaggaggggctaaaccatgtagggtcgtgtaggccatcttaaaggcctgagtgtagtggaaaacctttgaaggtttgttaaaaggtcaatgaaatgttctaatttctgttgtagtgaattgctttgattgctgaatgcgaatggatgggtagagatgcaagagtgaaagggaagaaatcaattaggaggctcttgccctgctccagataggactgataattaattttatttgggaagatcagggagaaagataagtcatgaatgactcccaagtttctggattgaagaaatgaaggtaccatacactgagatgggaaagcctaggggtagagtagctttgagaagaaaggtagcatttccccatttcataaaacatggaagaacaaagaggctggattcctgtttgtagacataccttccaggccagaactgcattactacaacatctttgcaagccacattgcctttcataactctgtgtcagtgttgatgccgtaacatctttggccttccccctaccatcctcccgcagtcctccatgataatgccattattccgtttcaaattgtgtgcttccattggatgtgtgagtctccttgaaagttataatgaggctgtagcccatatgaaatgcttcaactcaggtcctgcataggaagaggaagctaatctctccaggaactgagcctgtggctagagggatggataattgtttaaataaagaatatgctgctgagtactgatgggctctttatgtacccatttggctgctgctgcccaacctttaatctttcctgagctttaaataggaaggaaaaaatggtccacaaaggatttgagccattttgctgtggtgatgaggagcacgggtttagagacaaacactcctgtgtttgaattccagctcctactatctcctagctaagtgaccttggacaagtcacttaccttctccaacctgctgtttcttcatgtacgtaataggatttacctcatgaggttgacatgaagattgaaagaggtaacatatagaatgagcctgtcccaggacatggttcatgataagtctgccataaatgggagctatgtgtcccacccttttggaggagataactgttctgtagcaggtaatatattgtttgatacttggttaacccttacaattatcatttcctgttcttctcaataatgctagaaaccttttatttaaagaaccacaatataaaatgaaaaatatataaaaaaagcaaatggaaaaattctattggcaaggctttttaactttatatactaaataaatccaattgcttaaataatgaactgactcaagttctcagcactgcttcttgtttaattctctttagtttttcagaattctccaataatgacctttgtctactctcttcagtttattcagaaattacttttatttacatagaagtttggaagtggatacacaaacatatccctcacatatcttatgatcctatgagtcatatactcatctcttatattccctctgtaaagcaatgtaggtacctttcaggaaggtgatttttatgtaggttgagaaatatcagcatggaggtcctagctgacctctctagagagtttctgagacatttgacaacaactttttctttaagtcatcagttatgccccggggtatgaaatttctaacatgatcctcagtaaacttggctgccttgctgaggatactctccatctgcctgagagacacagacaccattaattgggaattgacttgacttgtgtggttccttgtggaccagatggccactaaatattctcatttcaaggcaattggtaaaaactacacttcaagaaatttcattcttaattccccttagtggatgttattaaccaaaggcaaaagaaaaaaagggtaaaaaaaatattctaaatgttaatatcaaaaatattattttcaattcaccccaggcacagagaactaagtattattattgctattgcaccggcattccccaatgagacagtgattttcttttaagacatttttaaataatataggcagaattaagtagacggtgatctggtaagtagatgtttcagggtaacagctgtgcaatgctccatgcagggaattagattgtcattttattccttaccaggaacatacattcagttaaacaattatttgacttctgctcttccactgatttctaagttgaggctctctcttgtgcctgtctgatcagataagtagagttgtgccttggtttatagatgagataaatgtgtatttgaataagcataagttaaagaaattttaaaatcccttaggaagctaggcttatcagagaaatccaaggaaatacattaacaaactaggaatttgttctaacaggttaattataactcataaacttattgggtttttttaccttttaattttatattacatttgcttataataaggaatattgctaggaataaaattttttaatattctacaattaacaattatctcaatttctttattctaaagacattgggattagaaaaatgttcacaagggactccaaatattgctgtagtatttgtttcttaaaagaatgatacaaagcagacatgataaaatattaaaatttgagagaacttgatggtaagtacatgggtgtttcttattttaaaataatttttctacttgaaatattttacaatacaataagggaaaaataaaaagttatttaagttattcatactttcttcttcttttcttttttgctatagaaagtatttattttttctggaacatttagaaaaaacttggatccctatgaacagtggagtgatcaagaaatatggaaagttgcagatgaggtaaggctgctaactgaaatgattttgaaaggggtaactcataccaacacaaatggctgatatagctgacatcattctacacactttgtgtgcatgtatgtgtgtgcacaactttaaaatggagtaccctaacatacctggagcaacaggtacttttgactggacctacccctaactgaaatgattttgaaagaggtaactcataccaacacaaatggttgatatggctaagatcattctacacactttgtgtgcatgtatttctgtgcacaacttcaaaatggagtaccctaaaatacctggcgcgacaagtacttttgactgagcctacttctctcctcactggtatggctccaaccatcaggccctatcttggtccatttaggctgctaaaataaaataccaaagactgagctgcttataagcaatctttggaggctgagaagtcaaagatcaaggtgccagcaggtttgctgtctcgtgagagcatacttcctggttcattgatggtgctttcttgctgtgtcctcacataatggaaagggcaagacctctctggtgtctcttttacaatggcactaatcccatcatgagggctttgttctcatgacctaatcacctcccacatgtcctacattctaatactatcaccttgggggttaggattttaacatatgaatttgaggaggtggcgggggggacacaaatatttagaccatagcatttcactcctgacctccaaagttcatgtcttcttcacatgcaaaatacattcattccatcccaatagcccccaaagtcttaacttgttccagcatcaacttacaaggctaaagtccaaggtttcatctaaatatcagctaaatcagcacaaacagctaaatcaggtagagtgggacttaaggtgtgattcctctttaggcagattgctctccaactatgaaattgtgaaatcaaacctattatgtactttcaaaataaaatggtgaaacaggcacaggctagacagtcccatttcaaaaaagagaaatagaaaagaaaaaaggagtgacaggtctctataagtctaaaactttaaggcttgagaataatttgctttgctttgcctccaggctcactggggtggtgtcttacctctggacacactggggtggaggctctatcctcatggatttgagtgtctcattctttgtggcaggtctgtgctccaatcccacacctatggctccctgagtgtgcaattgcatgcctggtggttctactggtctgggattgcataggtggcccagccttcatagctccactgggcattgccctaatgtgggctctatgtggtgacctcacccctgggcctctacctgggccctgtgactccctgggttcttgaaatctaggtggaggcagccatccccctacagttgtgctgagtgtagtgcatgagtgctggggtctgctagagctatacctagggtggtggagatgtatggcaatggagtatggggagctgatatggtttgggtgtgtccccacccaaatcttgtcttgaattataatttccataatctccatgtgttgagggagggacctggtgagaggtgactggatcatgggcatggttttcccatgctgttcatgtgatagtgagtgagttctcacgagatccaatggtttcataaggcagttttccctgctcttgcaccctctttcttgcctgtcaccatgtaagacataactctttcccttccgccatgattgtaagtttcctgaggccttcccagccatgtggaactgtgagtcaattaaacctcttttctttataaattacccagtctctttacagcaatgtgaaaatgtgctaatacaggagcaaagactgcagtgtgaggtggcaatgtgaagtctgcaatgtgaggtggcacggggcagttgtagcccctcctttgaaatctttcttccctaccccaggcctctgcactctgaactatgatgggaaaggcagcttggaagatctccaaatggctttggagtcattcttccattgtcttggactataaattctggcttctgtttaggtggctgactaatatccccactgtctgaatgcatagcacctagtttctgttgagatggctagtccatagtaatttacttatcaaatttggccacaccctttgtattctctcctgagcaggctttctcatctttcacaatatggataggctgagaattttccaaattttgaagttctgcttcccttttgatcaataattccattttaaagtcatttctcatcttgaattttactatgagcagtcaagagtaactaagctgctccttcaactttgcttggatatttcctcagtcaaacattcaatttcattgctttcaagttctgccttccacaaaacactaggacacaaacagctcagccaagttctttgacattttataagaaggatagcttttcctccattgtccaataacatgttcctcatttccatctgaaaacccatcagattggcctttaccgtccatatttctgggaacattctgctcatgaccacttaggtattcggtaagaagatagtagctttctctatagctctcctcctctctggagccctcaccagaatggcctttaattgtccattcacagcaatgtaggctttttctagcatgtacctgaaaactcttccagcctctactcattaccttgttccaaagctgcttccacattgagtatttgttacagcagtacccagatcccagtaccaatattctgtcttagtccattggggctactacacgatgtcttataaacaacagtaaaatttatttttcacagttgtggaggctgggaagttcaaaatctggtgccagcagattttgtgtctggtgaaggccttcttcctcacagatggctgtgttctcactgtgttgttacatggcagaagagtgggcaggctagctctctgggatgtcttttataagggcagtaatccaaatcatgggtttagggtagagccctcatgacctaaatcacctcccaaaggccccacctcctaataccagcatctttgaagttaggatttcaacatatgactttggcagggggacagaagctttcagtttatagcaaaccctataggtagcactactttgtcctttcctaatcaatttgcgtcaatgaaacatgaattagaagagacctaggcgactccactatactgggattattcccagtataaattatcatctctccacaccttctcatctactccctatctgagttctgaagctctccactacaagaaggaggctttggtttgacttgatatacttctctgggaaacaggtttagcataaaacagtgatgctcattctagaacacctgcaaatgacaatagttttctttcgaagtcgccaggaatcgtctgcctttgggtatgtggctgtgagcactgccgggcaaaatgccatatgacctagatgaggcatatgccatcctttgaagccattaggacattatataggaaatatattaactaaaatggaataaaattttctaaataacaccttatgtttatccaacaggtggttcattatacttgagagcattatacagaggaatttgatggggaggagagctggagaaattctcgaaattctgggtttctttaacagaatactctagctataaacttataattttaaaaaataagcattatattaaagaaaagggaacataaattattttgttttattaaacttaagtccaaaggtctggattgtggcagaataggatcaggggacctaaaatgttgagcctcaaaggtcttcttagagaacaactgtattccactattagcgcttttggtccttttagcccaatttctgtttatcccaaatgttcttcccttttctgccttccttcacagtggaccctgccaggagctttgaaatgcctgtgagtgttaaacacttacccattgagtgcccaaccttaacatgcccctaataaaatgtacttagattaaccgttttcattatcaaagtttccttattacccaacaaacacaggcgctttaaagaaaacattaactaaattgcaagtgacacattttaagatctttgatatgacttcagagaatgcactataggaacacaatgcaatgggagggaaacttgggagggaagacattagcctttataaaatctgcaagtattgccaaatcaaaataaaatttacaggaaagcaggatcataaatataatctaaaatcttagaacctgtggttatgattttaaatactaatacaatgcaaaatttttacctgtttaggtttttatttcatcagttcatatttaggtatatacttttactgttctccttttttataatttaccattcacaaagatgatgatgttagtctaactttaatgtcatgagtgctttgagtagtagtgctaagtttttgttgagtagtagtgtgcttttttgattagtagtgataggtttttgatgagtaagcctgctagcagcatacaaacaaacaagcaagtatcagcctagagaagcagaaaaggcatttgggtttcaaagtcacaaggcctaggctttagtctaatacagctgataatacaatttgtccaaacaggacatttttgggtgtgtcaaacactaaactggacaggacattatgacaaaagtgcaaagcaggactttccggggcaaaccaggatgtatgtcatctcactgagtcctctctttgtccttgccatgactagtatctctagaggtaaatgaacagagtaatgacaaatagccagacacctgaatcttatcccaacagcacctcctacataattccccattatcccaaatggaaattaaaaatatatacagtgataattccaggccaagaaatgctttatttctagcttggacttggcttccatgtccagtgtagaatcttatccttgctgatctggactgtatctcatgaagccatgacttgtacctagttactagctggaaggcttagaacaaaagctggtccagagagcctcctttttccttatttcctgggtccacacctttaccatggcagtctgcctatcatttgatggaggaatttaaagcaagtccaagggaagggaagagagtttctaaaatctagaacttggatagtttaatttacctatcccaaaacagcttaggcccagacagcttctctccaagattggtgccaaactgaaattaccagctgtgtagaccaaagagaatttcaaaagaaactgaatcccaagagaaaaaaaaaagacttctggcattgtggcccaataaattggtaggattgttgtgacttttcaagtttacatgtaaaatgggcccagcgcagtgcctggcaaatatgggtactaagtaaaagtaactataatcatgtttttttaatctggacttcacttggtcatcctttaaatggtgtctgacagaatcctagttcttgtctcactttacttagtttccctgggaaatttcatgtgtccttttggctttaattaatatctctattttgatgacctccattatctgcctattcccagagctttccacctgatatctcagcacatgaaaagcaccttatgtcaataagtgagttccttccctgccccaccacatacctgtcctgtgttcctaattccactgaatggcatcccatcctccagtttcccaaggccaagacctgggactcatctttcactctcaagttcctccacgggtacccacatgtcacatcctgtcaatgctgtccctggggagtatctgaaatatattcacttttcttcatttccacctgacaccactattaacacttgcacaaatttctgaggttcctggctcatttccctcattgacccccaatagttcattctgctctttgcagctctggtgatctttccaaaccccacatctgatcacttgtttcttcccttcatatggctccttaatgccttctggactaagtccacactgcttaaggtggcttaccaggtccttcatgattttgtctttgtttggctttctacactcactgcccaacttccccttacttcccatgattcagttatactgaatttctttggttctctaaagcacatgtgctttctgttctgcagaggcttttttgttcacttgctattctctacctgggaaactcccccagcccttcactgcctccttctaccatctttcaggcctctccttacacatcacttctttccaaaaatctgccttgacactccaggtctcggtttcctaggtgtaccctataactccacccctttcatagcatttctcactctggctggagatttaccttttaacttgtccatgtcccccactggagtggaagttcctggaggtcagggattatatcctattaattgttgtatttccagtgcctagagtagtcttgcatacatggatggtattcaataaatattggttgaatgaataaggagttctttcatttcatatgtaatagatcatggaaatagccttgtgattgatacacagcaggtattaccatcctcactttagaatgaggactcagagccttgagatgtctgagggccttgactgggacagctggcagatgcaggagcagagctgcatcacccctgtgggctatctcagggttgtctgtaatctaagtacaatgtctgttgattttggactgaaggctttttgggtaattgtttgctttttcaatacttataaaatagtttccatccttactcattgatagtaaggttagttattttagaaaacaagctaaatagcagaaatagtggccttttaagttgaaaatttaccctgaaaaatctacagagtagcaaacagagtatcaaaaggagttgactgtatctatttttataactgccacttatggattattcagtaaaaccacaattcacttttatgattttttttcatgtttctctgtcacaagagcaaactcttgctccataataacattccagaatacagcaatagcaaaagtcaacattttgaatcctttacaaactcttagacatttttttttttttagtttaacatgttacaaaacaaaatttcttcttttttcacagcagtttgggaagtacatactatttattagctcatcagcatgaagctggaaaattctttttcctaaagttctttatatctacaaactgttgatgttttcatttatttatttttaatgctacgttgtaatgaaaatcattggaaaactttagattctagtaattttgaagtcttcttagtttggacaggactgagctaaagtttgtactttttttaatttattgaaaaatggtttctaatgatagtattaacaagattatattgggggcaggacgcagtggctcacacttgtaatcctagcactttgggaggccgaggcggttggatcacctgaggtcaggagttcaagaccagcctggccaacatgtagaaatcccctctccactaaaatacaaaaattagctgggcatggtggcaggcactgtaatcccagctacttgggaggctgaggcaggagaattgtttgaacctgggagtcggaggttgcagtgagcccagatcgcaccactgcactccagcctgggcaatagagcaagattctgtctcaaaaaggaagaaagaaagattatattggggatatatatgtgtgtgtgtgtgtgtgtgtgtatatacacacacatatatatatacatatatacatatatatacatatttaaaggataaaggattctgctgccacagatcactaaatcagatgatctctagcaatttcctgtttgtttgttttttgcccatagtgcttatctctttgaacagtaattttccacttactatttttctccccttttggaccataatttcctttaaggcagagcctcctgttactcatctttgaatctggggtctgtcagagtacctagaatttaataaactctcattaagagccagttgaaagaatatatgactaagcagtcatttacatccaaaagatccgtaggagaattcttatcagcacatgtgattggtaacaataactttgtacttttcaaaaacaattactaatctatcttgctttccattatctcaccaaaacctattagcatgtctggcagaaaatagatacttaataaatttcttaaatgtttactgacttcaattttaagttttattaactatgttgacttttctctaatgaagatgattctaaaaagctttttactatacttcacagtgaataaaacagtgagataggaatattgcaaaatgtcccctgtgttggtcagtcttagtgtcattcattttaaaaattctgttctctaaatattgacagttatatataaatttatgtaattgtttacttctaataaagaatttcatctggggaaaaacatactttgctcagctctttgccacaagtgcaaagtctaagacagtcaaatagctttcctagtacggccttaggaacttagtatatgactggtgtgaatctagagggagcatactgcattctgaccaaaatctccaccctgttactatggccatcactaacttcgcagtattgcagtacttcctgctagcttagttcccaaggcaacttgtgaaggaaaatttttacaaagctgttgtcacacaaaggtagtgtttcagttcctgagcccatgtccttggagttgcccaggctccaataatactaataattactgtacattaggtacttaccatgtgccatattctgtgggagccgctttccacaaattatctctggtaatccttgtaacaaccctttgacatcaatattattattttctccatttttttacatatgagataaatgagacttaaaataatgtgcctgatatcatcagcaaatgagctgaggagggcagattcaaagctgattgtgtttgactctagagctgcagtcttaagccagaccttttcttgctggttaattttactgaaaaaaaaaaaaaaaaaaaaaaaccctcaaatactgctgattgatctaaagtactaacatttctatcagtgttagggaaattttaattttataatttgattttgtgagaaatttatagcatcttgaatactcacatgcaaagtgatatgtcttagataacattttacaatggcagagcttaagccagtgctcagtcattcattcatcctcaagttttgattcatttatcattcatcaaaactctgttttgtttggccacccacattctaggagctcagtacatatttgataaatgaatgaattgttgaggttgacagttacccaggactggcattaggaacacagagctgaagagcacgtttttaccctcaagaagcttacagtctaacgagggaacttgcacaaatactactatcactaggtgcctggttgaatggcttaagagatgatcagggatattcagaaggatatgtcaggctcagcaatggcatcacttgagagcatcaaggtgtttagggaactacaagatgtttggttctgctgggaataagagtgaagggggctccatttggatgcctcatacaccaggtgagagatcttagattttattccaccaggaggagaactaccataggatttaaaacagaaatgatatggtcaaacctacatcttaggaagatccctggggtgtttgtatggtggacttgcaatttgactaattgagatttgtaggatgattcttaagagatgatgatgacccagactgggatcactataatagagttggtaaggaggagaatgatttaaaaagtagttggaagaattctagggatggagataaacatttgaaaattattaacttataggtggtcatcaataccctgaaaatgactgggatctcagaggagagtctggagagttggaaatgacaaagactaatattcaagggggcaggaagagggagagttgttcacacatgacaataggaagaaatggccatagagtgtgtggtttctctcaagccaaggaatagatgttttaagaaaggaaaattcttgtggtgggaagcagtagagatgacagatacacattaatttcttgagatttctagatgactaaatgggcagatgttgaatgatagctaaaggagaacccagaaacaagggagggattttgtttttgttttttaaaaaagatagaccatagcagcttcatagactgaaacaataaaaaagttgaaggcacaaagaaagacacaggtcctctaactccctgcccagtgccctttattcatattctcagcacttgtatttctaagttttatgtttgagtcttcggggatacatcagagtagtcccccttgtctaataaatgtgtttacatttcctgccataccagaaacccttctcaaactttaatgaatttctacaaggtgagattactttaatgagaaaccaaccaaggaaaggagtatcatctgcaatatactttcaaatgttttttgcttgtttgtttcttgtccagctaaaaaaaaaaaaaaaaaacaagccattggtcctaacacaactttcatattctaccccaatatcaaagaggcttaaaatctcctggtcgtgtgatgggcacacagttaattttttgtgaacaaacacagtgttatgggccatttctgaatttatctctgaaatcataagattctttctgagccattatctcattctatattacagtcaggtggagcccatcttacctcctcatactaaattctagacttctcaagggcaggagacaatcatctgtatatctctttggccttcatacactcaggagtacttgccaaaaataaacatttaatgcacatttatttgaataattgataagatccaatacttcaataactttgtcatatttttatagaatgggtttctatatctcatttgcattttcaaactttacttttactgtctagctttaaaaaaaaagcctttgactctaatacagccctcatattctaccccaatatctaagaggctttatatctcctagtgttgtaccactattttaactccagtattttttacttcatagttttacctatttgttacagttagtttttatgaattcaagagatgaatagcaattttccatatgtaatttaaaaaaccccacagttgactattttatgctatcttttgtcctcagtcatgacagagtagaagatgggaggtagcaccaaggatgatgtcatacctccatcctttatgctacattctatcttctgtctacataagatgtcatactagagggcatatctgcaatgtatacatattatcttttccagcatgcattcagttgtgttggaataatttatgtacacctttataaacgctgagcctcacaagagccatgtgccacgtattgttttcttactactttttgggatacctggcacgtaatagacactcattgaaagtttcctaatgaatgaagtacaaagataaaacaagttatagactgattcttttgagctgtcaaggttgtaaatagacttttgctcaatcaattcaaatggtggcaggtagtgggggtagagggattggtatgaaaaacataagctttcagaactcctgtgtttatttttagaatgtcaactgcttgagtgtttttaactctgtggtatctgaactatcttctctaactgcaggttgggctcagatctgtgatagaacagtttcctgggaagcttgactttgtccttgtggatgggggctgtgtcctaagccatggccacaagcagttgatgtgcttggctagatctgttctcagtaaggcgaagatcttgctgcttgatgaacccagtgctcatttggatccagtgtgagtttcagatgttctgttacttaatagcacagtgggaacagaatcattatgcctgcttcatggtgacacatatttctattaggctgtcatgtctgcgtgtgggggtctcccccaagatatgaaataattgcccagtggaaatgagcataaatgcatatttccttgctaagagtcttgtgttttcttccgaagatagtttttagtttcatacaaactcttcccccttgtcaacacatgatgaagcttttaaatacatgggcctaatctgatccttatgatttgcctttgtatcccatttataccataagcatgtttatagccccaaataaagaagtactggtgattctacataatgaaaaatgtactcatttattaaagtttctttgaaatatttgtcctgtttatttatggatacttagagtctaccccatggttgaaaagctgattgtggctaacgctatatcaacattatgtgaaaagaacttaaagaaataagtaatttaaagagataatagaacaatagacatattatcaaggtaaatacagatcattactgttctgtgatattatgtgtggtattttctttcttttctagaacataccaaataattagaagaactctaaaacaagcatttgctgattgcacagtaattctctgtgaacacaggatagaagcaatgctggaatgccaacaatttttggtgagtctttataactttacttaagatctcattgcccttgtaattcttgataacaatctcacatgtgatagttcctgcaaattgcaacaatgtacaagttcttttcaaaaatatgtatcatacagccatccagctttactcaaaatagctgcacaagtttttcactttgatctgagccatgtggtgaggttgaaatatagtaaatctaaaatggcagcatattactaagttatgtttataaataggatatatatactttttgagccctttatttggggaccaagtcatacaaaatactctactgtttaagattttaaaaaaggtccctgtgattctttcaataactaaatgtcccatggatgtggtctgggacaggcctagttgtcttacagtctgatttatggtattaatgacaaagttgagaggcacatttcatttttctagccatgatttgggttcaggtagtacctttctcaaccaccttctcactgttcttaaaaaaactgtcacatggccaggcacagtggcttacatctgtaatcccaatactttgggaggctgaggtggggggattacttgaggccaggaattcaagaccagcccaggcaacatagtgaggccccatctgtctttattaaaacaaaacaaaactgtcacagcttctttcaagtgatgtttacaaattccctatggtttagtcacaaggaagttctgaggatgatgtatcacgtcatttctgttcaggcttttgagcctcctggaggtaaatggtttccttactgaaggcttgttattaccatgattatcactaagcttgaagtaacaaattaggggggcagactcacaacctcttgccctgccatggacaagttcaagaatctaagtaaagtcctctattgtctgatcttggatttgctcaacctgaacaagccaaggaggtgtattaaactcaggcacatcctgaccaatttggaattcttaagcttcagatcactgtggaagaggctcaactctttatggtgctgtagacttacgctcattttctaggtaatttataagggacctaatattttgttttcaaagcaacttcagttctactaaacctccctgaagaatcttccagctgctgagtagaaaatcacaactaatttcacagatggtagaacctccttagagcaaaaggacacagcagttaaatgtgacatacctgattgttcaaaatgcaaggctctggacattgcattctttgacttttattttcctttgagcctgtgccagtttctgtccctgctctggtctgacctgccttctgtcccagatctcactaacagccatttccctaggtcatagaagagaacaaagtgcggcagtacgattccatccagaaactgctgaacgagaggagcctcttccggcaagccatcagcccctccgacagggtgaagctctttccccaccggaactcaagcaagtgcaagtctaagccccagattgctgctctgaaagaggagacagaagaagaggtgcaagatacaaggctttagagagcagcataaatgttgacatgggacatttgctcatggaattggagctcgtgggacagtcacctcatggaattggagctcgtggaacagttacctctgcctcagaaaacaaggatgaattaagtttttttttaaaaaagaaacatttggtaaggggaattgaggacactgatatgggtcttgataaatggcttcctggcaatagtcaaattgtgtgaaaggtacttcaaatccttgaagatttaccacttgtgttttgcaagccagattttcctgaaaacccttgccatgtgctagtaattggaaaggcagctctaaatgtcaatcagcctagttgatcagcttattgtctagtgaaactcgttaatttgtagtgttggagaagaactgaaatcatacttcttagggttatgattaagtaatgataactggaaacttcagcggtttatataagcttgtattcctttttctctcctctccccatgatgtttagaaacacaactatattgtttgctaagcattccaactatctcatttccaagcaagtattagaataccacaggaaccacaagactgcacatcaaaatatgccccattcaacatctagtgagcagtcaggaaagagaacttccagatcctggaaatcagggttagtattgtccaggtctaccaaaaatctcaatatttcagataatcacaatacatcccttacctgggaaagggctgttataatctttcacaggggacaggatggttcccttgatgaagaagttgatatgccttttcccaactccagaaagtgacaagctcacagacctttgaactagagtttagctggaaaagtatgttagtgcaaattgtcacaggacagcccttctttccacagaagctccaggtagagggtgtgtaagtagataggccatgggcactgtgggtagacacacatgaagtccaagcatttagatgtataggttgatggtggtatgttttcaggctagatgtatgtacttcatgctgtctacactaagagagaatgagagacacactgaagaagcaccaatcatgaattagttttatatgcttctgttttataattttgtgaagcaaaattttttctctaggaaatatttattttaataatgtttcaaacatatataacaatgctgtattttaaaagaatgattatgaattacatttgtataaaataatttttatatttgaaatattgactttttatggcactagtatttctatgaaatattatgttaaaactgggacaggggagaacctagggtgatattaaccaggggccatgaatcaccttttggtctggagggaagccttggggctgatgcagttgttgcccacagctgtatgattcccagccagcacagcctcttagatgcagttctgaagaagatggtaccaccagtctgactgtttccatcaagggtacactgccttctcaactccaaactgactcttaagaagactgcattatatttattactgtaagaaaatatcacttgtcaataaaatccatacatttgtgt

SEQ ID NO: 36700 - DNA, 20357 bp, Homo sapiens
cgcaggcatgatgaaacttcccgcacgcgttacaggagccaggtcggtataagcgccagcggcctcgccgcccgtcaagctgtccacatccctggcctcagcccgccacatcaccctgacctgcttacgcccaggtgagccgggtcctgcgccccgtgccctgcgccccgcgccagcatcctcctcgcgtgccctggggctgctccggaaggaaggggtggaggatgcggtcttcagcctggcacccggcagacgcggttcgcgggcgcctgctgatgctgcggctcctgcggtagggagggcggggcggacgcctagcgattgttacgcacctgacagctagcggaaggacctttctgtcctggttccctgaagcatcgagagggaaccgcggccggcaggccggaccgctccggagaggaggcagcggcagtttgagcccctgtaaatgttatatgtgtacttttttttactatgtggcgtcgaagcctgtggacattttcgcggtccgggtccctgcggcggacgggtcggatcgtgctcgtggccagggcgcagtcaggtgtcgcgtggtcctgatctaggaagagactgcggccttatcaccgtctcggtgtctgctttcaccttcaactgcccccctcctcacctggaccgctcaccctcctcctcccctctcaccccgccatccccaccagtccccacctgtctctgtagactgcaagactcatcaagtgacttgctgagcaaaccctgccgagaagaggtctgtttagggacacaggcgaccaagtacagaaaaaggcaaaagaactagcatgcctttttcaatggctgtcattttgcagggctggcttcagatgattgttatagctttaaataaaaaggacagttttcatctcggcccgtggcctacattatttctttactgtccattgccctgggcgcttgactaataatttaacagcagtttttttttttaaattttaaatcatgattcatagcattgctgtaagagtaattagaggtaaagtagggcttgaacctgtctgtagttggttacttactgagatcttaatataaaagtaaagggagagggtgaagttgtaagtagcactaagtggaatagaaattaaatgcactgaaactgccatgtccagttcggtaggcgctagccacctgtaactgttgagcacttgaagtgctggctagtcctaactgagatgtattgtgttaaatacactggattttgtcgttggagtaggaagaacagtgtaaaatatctgctcgataatattttatattgattacatatatgttaaaatgttactatttgggacatactgagttaagtttatttaaaattaatttcacctttttcttttaatggggctactagtatatttaaaattacatatgtggcttacatatatatttattggacagcactgttctagaagtttaggaagaaataagaaaaatattgagaacaggtagcggcagtaggaactttgccctcctataagactgattccaataaaaataataggttatagttttaattggctttttcctactagaaaaaataagtgtactttacatgcctctttgttctccctttttcccctccagtttagtggttagaatgtatttattatagcaggattaatacagggattcactaagcagcgttaagaagacttaggtaactgattccctgatgaccatacttgattttcaaagcactttcctaacccgttttaaattgatatagagtcaaaggcagatggcttattagtagtcatctcatttaaatcttatggaatttttccagtaaatctcaaataatttgttataggctatttgggctatttggtcaagtgcatggaagagacagcataggacatgtggtacttcatttccaaattgcttgagatgattttcattctaaccatatattatttggttctggttttccggaaaagccagctaaacctttggttcttttagatataaatgaaatatcatcaaagaatagctcaaagtgacttatgcaacttgaatgtatattttttccttagggtgtttatcccaaactatttgggcatttgctgcaattcgcagtttttttaaaaaaaacaccaaaatagttatttttcaagttagagatgttttaattaaaacatcttgtttttggtgtatccattgacattctcaaaacggaatgtatctggacctctgtgtacaatcttcgtagcactcagacactgaacagaaaggcagtcatcactgccaaacagggcccaaatgccacacatggtgcaatgtgtcattttgagctggcagcagccaaataaaacagccctttatttcacagttgagaatttgaaattggaaagtaattaacgtatgtaagggtgatttatttgcttccgggcttatagggatgagctaagttttttattagggatgttgttggtgtatatgtctcacctactttgcttccttactgaacaatgcaactttgagacagaaatatttgagaacatttttgtcagtgaggacattttgatagtgaatattttgtatcttctattaacttgaaatgttttatttgttataaagccaggatatctgatatcaaattaaattgttttttttttccctttagattttcttcaatcacatctgaataaatcacttgaaggtaacctagatgtaatatagtgaaatgcttgaaagagctgcgtatcttttacacttacagcagtatgattttctgttgtacccattatatggtacctgcagctagttcagataaagagggcatttaactgtcaagggaacctgagaggagactctagtaatctggaaagtctgttggatctttgagggattttgggatggtgagagtggggctaggatctctggctaggttggagccagcctgcatttgtatctgtatcttggaagcaaacttagaatgcagagacagatgtggcatggacgctgtcagctctagccaaccactaaatcctaaggtgggagagatgcaggctttggctaggtgctaagctgctgtagccggttgaatgtagaggtcactatcttttccgaatacctgtaagtaaattaaatcattctctactcccatgtgcctgccaacctaatgggaaatcgctatagaaaagatggtttaaattttagtctttgaagtggtttatgcacgtttccggaatcaagatttaatgcagagttggattggatattgaatatttttgatttgtctgcttttctctccatagaaagcttatagcttcattgcaccatgtgtggcatttgggcgctgtttggcagtgatgattgcctttctgttcagtgtctgagtgctatgaagattgcacacagaggtccagatgcattccgttttgagaatgtcaatggatacaccaactgctgctttggatttcaccggttggcggtagttgacccgctgtttggaatgcagccaattcgagtgaagaaatatccgtatttgtggctctgttacaatggtgaaatctacaaccataagaaggtgaggagaaagaaaccagatgtctggatgcgattaaacttcagagtttgttggttacgatgatgttacatattctgtatcatgctttttcctttgcaaagcactctatgttcgttatctcatttgctctaagtatgtaaatagggaactgatgaataaaaaggtgagtgaaatgacttggtcacaaaaaaagtgataaaaatggggattacagttcagtttcattgactcttagaattttttctccttctccccagcttttcattttgaaaaaattcctaacatacagtaaagaacagaacaacaagcacctagattaaatagtcattaatgttttgccatagttgcttgatttttctttctacacacacacacacacacacacacatgtttttgctgaatcatttgagagtacagtgcagatattatgacactcctaaatatataagcatttatctcctaagaataaggacattcttctacataacatcaatgccattattaaacctaagagtccataataccacctaatatccagttaatacttaaatgaaatttccctaagtgtcccaagaatatttttatttatttatttattttgagacagagtctcattctgtcacccaggctggagtgcagtggtgcgatctcggcttactgcaacctctgcctcccaggttcaagcaattctcctgcctcagcctcccaagtagctgggactacaggcacctgccaccatgcccagctaattttttgtattttagtaaagacagggtttcaccatgttgcccagggtggtctggaactcctgagctcaggtaatctgcccaccttgacctctcaaagtgctaccaagaatatctttatagctggttcttgtttgttttgagccagatttcattcaaggttcatgcatttggttggtatgtttcttggtattttttgagacttcttgatagatacctgtcaggcattgatagagatttacatcctaatcacattttggacatttttatctgtgaacaatagcttttgtcattgtttgttgcctgctcataggaagactcttaataatagtcttctcatttaaaaagttttaaaatagttattcaggaaattccttttacacatttctttattcctttattaagggtctactatgcaccagacatcatttttctaggtgattggagatgaaatggtgaaaaggaaaggcaagaatggaatttcctgctagtgggaggtagaagaagagagtattaaaaattttttctaagtcaaataatgtcatatacatgagaacgctaggtggtattatggcattatcagcttggctttccccttaaatgaaataggaagtgccctgtttcacttgaacagtgttatttcttttattaaaaagttacaagaagttaaatattttgaaaataattaatttctattctaaattagccaaatgttatatttgtaaaagtagagaagtttgttccattgcttctaccaagcatctaagtttatgtagttggggcagctagcagtctgtctaatgagcagaatgtatactttaggcttatataaagtattcagaaatcccccccacacctcctttttggtaaaaataaagtttaccactacaataaaatacagccagaggtgtactgggagtagaaggagactgaatgaaagaaaggaggaatggggtaaaggctggggcaaagagcaggccctctccctgcaggggagtatcagggcctgcagccaagtcaaatgacagcatgacgtcaggaggcaagatttgagggcttttatttaaggtgcagcattggagtttggttttaggagagtaggaagtaatacatccgttacccaaaggacccttctcctttttaaataagttacctgcaaagtttaggccaaagaggtgggtaaggtagatttgggaagctgttgcttactaatatcaccgaatgctttatggtcactaacccttcaggcagttcagcccagaagagtcagcagaagactgtttacaggcccccacctgctagttacagatcatccctgatagagcagagaggggtgaccaggtagtgactttgtagtcactggaggcaaagcccatttttggacagttcagtgaggacttatagacaaaagattcacaaattatggagtgagttggatggagtgtgaagcatatttatgggtcatgcacatacataataggtttactttttgaaatttgaaagcatgttttaagcttatctaggatttccacctgatttaaacctcttctttctctaatgtcagccaaaaacccgagtacaaagaagaaagaggaatacatcaaggacttttcatcctcatagtttgccattaatggctcatagtttgccgttgatggtggagagtgtcagaattggggagtagcctaatcaaaccttcttactctgcatgcagtggcagacagtccctttgctgttcttttggggaatgcagactaataaagcgccaccgtcattttatctatcagtaaggagtagctttaatgctgctgcagtggtggaagcactgggcattgtcatccacccctggggaccagcagctttgttttggatcatgtatctgttattgtgatggagccatttatttttcagggaatgatgccaaatgatgtttgtccctttgctttacatttttatagctaggactttgaagctgaactggaggaacttcttagccaatactatcttctcaaatcaaaagtttatagttgcaaaagacacgttttttagtgtcatggcaaccaggcaacctattatcttaacttaaatttagaggttgagcatccctaatctgaaaatctgaaatttgaaatgctccaaaatctgaaactttttgagcactgacatgacattacatgtgcattttgatgtcacagtcaaaatgcaggtgtaaaacacgcagtttatttggcgttccctagggaaaaaagaccctctcagcccgcttcagctgcagtataacttttctacacatgcccggatttccccatgcaagcacgcccacaaagggtaatagaatggcacatgttcaagctggatacgccattggcaggatccccacagatgggacttatgtgcattatccattgtgtatttttgcttattttctgctctgtggtgttaagatactgaaaatgtcaaaaagacctgtagatatttctatgagcagcagtgataaggaaaagtagaaacacttataacacagaaagtcaagctgtaggagaaactggactgtagtataaaggtatagatgacatggtgaaaatgtgtgatagagatattgaaggactagagctacctgcattcataacagaacaagaggtcatgtcagtttataaaatcaaagagagccttccaagacaaaagccattgttaatgaagcagatgactctggagaaacatttaaaagtcatctggccgaatgcctcttcaatctcagaggacccgcttcctagttgctcagctgcttctgatgtttcttctcacctgaaaaaggaaaaaaaaatacagtgtatagtaaccttttaatcaaaacgcagcattgtaggtggagtctgaaagcctgccattgtttgtacagctgtttaacagctgatgcaggtattctggtgattctactatgctacttattactttcttactgtattaatggtatgtcatattttataagcatatgaaaatgattgctcatcagcagcataataaattcagagtcaggaatgatggtcaatgatgtcaaacagccacagattttccacatggtagctgagatagtgacccctttgctttctgatggttccatgtatgcaaactttgtttcatgcacaaaattatttgaaatattatataaaattacctttaggttttgtgtataagatatatgaaacataaatgaagttcatgtttagacttgggtctcatgcccaagatatctcacatatatgcaaatattccaaagtccaaaacacaaaacacttctggttccaaacatttcagataagggatactcaatctgtatatatataaatatatgtatgtattacatatatggtatgtatataatatacatttccatccctccacaggttactgttctggcacattcccattatgttctgtttatcagactgcaactaaaattttcatgggttcggctttatgttgaacagaatttgcagaatatgagttgaagcgaaccatagtttaataatgctgtgattctcctaaatcaccaaagtgcatgaaaggattatagagctcagaaatactgaagcatctttgcaataaaaaattattagtgaatgtacaaggagtctaacattttggttttgctttcgcttcctaagatgcaacagcattttgaatttgaataccagaccaaagtggatggtgagataatccttcatctttatgacaaaggaggaattgagcaaacaatttgtatgttggatggtgtgtttgcatttgttttactggatactgccaataagaaagtgttcctgggtagagatacatatggagtcagacctttgtttaaagcaatgacagaagatggatttttggctgtatgttcagaagctaaaggtaataataaatttttctatagattttcattattgtcttggttgtacgttttcttttaaattatatttgaaaatctcttagagagcaatccagaattttacaagtgactaagttatgagtctttacctttttttaaaaaaacagaggagttgtactctccttttcagcacttaaattctgtaatccttgaaggatgattctttagtgcagtcgtttattttttgctgtgctaatatgctctacatctagcttgatcttaagtgcagttttaagttttcctgtgtcatactataatcgtagggttgactctgcaattattgcattgtggtactttgcgcagttatagcacagcaagtgttaggatttctaaaacagctttattgataattcacataccatgtaattcacccacttgaagtatacagttcagtggtttttagtatattcacagatgttggtaaacaacactccaatcagttttaggattgtttttccacctcaaaaaaaaccaaatcaaatcctatgccctttaccttagtttttgctggcaggatcaactaggtttttgtttgtttgtttgtttgaagagatggggtcttgctcagtcgcccagcccaggctggagtgcggtggtttgatagctcagtgcagccttgaactcgtgggctcaagcgattctcccacctcagcctccctagtagctaggagtataggcatgcaccacaacaccctgcctcctgtgccctttagctttgaattccatctctccatatccatcagctgcacccctgcagttgtagccccggcaatcaccagtctttctgcctctggattccctattctgtatgtttcatatgaacgggattatatatcataccggcttttgtgactggattctttcacttggtatagtgctttcaagatttgtctatgccgtagcatgtatcagtacttacttcttatggccaaatgatattccattacatggatacactgcattttgtttattcgcttgtcagttgatggacatttaggacattatttaccccttttggctattatgaataatgctgctataaacattggtgtacaagtttttgtgtggacatttcccttgggtgtatatctaggagtagaattgctgggacacatgataactatgttcagttgaagaactgccagactaatttttgaaatggctgcatcattttttattcactccagcagtgtattaaaatttctgtttctccacatcttcacaaacagtgtgtgactttaattctagccattctagtgtatgtgaagtggtatctcattgtgattttgatttgtattttcctgttgacagtgatgtccagcatcttatcttatgcttattggccatttgtatatcttctttggagaaatatttgttcagatcctttgccatttttttttcctgttagggatcattttattttaaaaacataatagactttatttttttttttgagcagttttagaaaaaattgagaggaaagtgcagagagttcacatatgctccccctacagtgcccctgcccagttttccccactcttaacatcttgcattactgtgctacatttattagatttgatgaactgatacttatatattaactgaagttcatagtttacataagggttcactctttgtgttttatagatttttggatttgacaaatgtttaatgccatgtacccaccattacagtattatgtagaacagtttcattgccctaaaaatctcctgtgctccacttattctttcctcccgtcctcttcctcctaaccccccagtcattactgatctttttgctttctctctcactttgcctttcccagaatgtcgtataatagttgtaatcatatagtatgtagctttttcagactggcttctttcacctagcagtatacatttatagttcttctgtgttttttcatggcttgatagctcatttattattattattattatactttaagttctagggtacatgtgcataacgtgcaggtttgttacatatgtatacatgtgccatgttggtgtgcttgctgaataatattccatttgtttgcatgcaatgcaatttgtttatccattcttgaattacccatttctaattgagttattttgtctttttattactgaattgtaatagttccttatgtattctagatacaaatcccttctgttcatcagggttgcaggatacaagatgaatatacaaaaatcaatggtatttgacacactttaactgaatactacatacttaaaatgagcaatcaaaatgaaattaagaaagcaacttcatttataatagcatcaaaaagaataaaatacttagaaataaatttaagaagtgtaaaacttgtactctgaaaactataaaatgttgttgaaagaaatgagaggagatctaaataaatggaaaagtatcccatgatcatgatttgaaggcttaacattgttaagatggcagtcctccctaaactgatttacagatttaacttgatccctatcagaatcccagatgagttctttgtgaaatctacaagctgactctcaaattcatatggaattgcaagagactaagaatagccaaaacaatcttttgaaaatgaagaacaaagtaggagacctcatattaactgattttaaaacttactacaagacaatggtaataaggacaatataatactgacagaaggatagatgtatagactagtgggatagaattgagagtcagaaatgaacccatacatatatgatcaacttatttttgacaagggtgccaagattattcagtggagaaagaagtttgaaaactggcacaggggcaaccagatatgtaaccatatgcaaaacttggagttgaatctttacccaacatcgtatacaaaaattatggatacagaaaaatggatcaggccaggcgcgatggcttatgcctgtaatcccagcactttgggaggccgaggcgggtggatcacgaggtcaggagatcgagaccatcctggctaacacagtgaaaccccgtctctactaaaaattagccgggcgtggtggcgggcgcctgtagtcccagctactcaggaggctgaggcaggagaatggcgtgaacccgggagacggagcttgcggtaagccgagatcgcgcaactgcactccagcctgagtgacagagcgagactcatctcaaaaaaaaaaaaaaaaaggatcaaatgaatcagttttgaactaatccacttaaatgtaagggctaaaactataaaatcccgagaagcaaacatagaagtaaattgtcatgaccctggatttggcaaagctttcttaaatatgagaccagcaacaataataaaaatcaatgaattggacttcatcaaaattaaacatttttgcacatcaaaggacaccatcaagaaagtgaaaagacggcccacaagttggaagaaaatacttgcaaatcatgcatagcactttttgatggtaaacttgaggaagacatttatcttttatcccttacctgtgcagcagtaacatcctaatatctctctccctgcctctttttgccattctttaaattctttctcacttaattttcagatttaatattggctgaagcagggataatgagatcaatcaaaggggtccttaggacactagtcacagtgtttgtactaatactggaactggcttattttcaggcatttctagtgtgatcagatggcaaagaacaagcatatatatatgtcagttgccaggactgctgggaaagcctggtaaagagaacactggggaaaagcagcctcctgctcccctgggccttctttgagcctgatgatcacttgatatggaacttaccctctgaaattccttaattgttcttttctatatccttgacactgtccttttccagaccaaattatctcatctggaatactgcaacaattttcttttctcagtgcttttagaataacctgtcaaaatctcatctgattatagtattgcctgcttaaaaccttttaattactccccattccctatccgggttgtgtagctcacttgagctctgctggctggtgagggaatctgggtcctttttctggtatttgaattcagtgctacacaggttactggctgggtagacaatctcaaattgtaaatcacgagtattccatgtagatagtccattacgatctacaataaaacattgatgtttgtatcaaagatcatggtgatgagaggttgggtactgtactgtctgtgagaatttattgaggaaatttaagttatatggttttattcacatatagtgtataacaactagttaagggatagatgtcttcttatctgactttaaagtaggtaaaagtggatcattgtacttgttaaaggtctgggaaccatggctgtgttctgaaaatacctcagtgatgacaaataaatgactcccagcctatcataacattaggactccagttcatccctttgcttcataagtgtgtcttttccttttgtgtatttgctttagtatagaaaataggttttcttgattagaaatctaagaagaagaaattgaacactggagatttttctatttctttgaattacgaaaagttagtgtaatttggcagtatatccctgtgccattattgtctctcaggtaagtagatggtagggcttaggaaaatagaaaattttttttcctattttgcttatttaatgggtatgtgtttgtattaaaaagggaaaataggaatgtagatgatgttaactaatcgtgaaagttattgggaagggttacctaatttgaataaaggtatcattgtgaatttctaggtcttgttacattgaagcactccgcgactccctttttaaaagtggagccttttcttcctggacactatgaagttttggatttaaagccaaatggcaaagttgcatccgtggaaatggttaaatatcatcactgtcgggatgtacccctgcacgccctctatgacaatgtggagaaactctttccaggtagcagacacccacccacctattccccatccttctccaagggaaaaaaattttaagttgtattctcccatcatttgaatgattttagtttcaagacctacttcctattttgtttggagggaacacattaagatttggcacactccaccattgagtaaataccatcatgatagatgttgatgattgtgtatttcatttcaataactaatccagcccaagattttctggagctgtttgatttactgctgtgtttataggttttgagatagaaactgtgaagaacaacctcaggatcctttttaataatgctgtaaagaaacgtttgatgacagacagaaggattggctgccttttatcaggtgaagtcaattaaaaaaacctaattatatttcatgtgtgtttaattgaaatgatttgtagccatccctttggtttttactataaaatatttactgtatgatttactctttccttcattataggatggaaatgattttttataagctgtatttaatagtcatagtcatactccaacttgagttacactatagctatgttattggtgttaagagtgagtcagtgaatgttctttagaattctgtgtagtgatttttaaccaattcaaatactactattatcacagtttatatatttttctcttgttgaagttgatttcagtttataaaacttggcggattttaaatagtaaaactatgatcttggtgtttatcaggaatatacatcttctgtccctgtcttatgcaaggcacataactaggacacttccacttcctcttttgcatgtagggggcttggactccagcttggttgctgccactctgttgaagcagctgaaagaagcccaagtacagtatcctctccagacatttgcaattggcatggaagacagccccgatttactggctgctagaaaggtaaggtgctgtctctgtcccttgtgtagtgtagttagagtagacttgttattagaatgaaaatggagtcaataatgggtgattctactgctgctgtattgactgggtcaattgttttaaattgattgtattaaaatagaatgaaatggctgttggatatgcactgtgttgtacactgtcctctgtgtacttttatctgttatgacccatgcaattctcacaaagaccctatgatgataagtatgctcttttgaaagtaaaggtgtctgggcatggtggcctacacctgtaatcccagcactttacgaggctgagggaggtagattacctgaggtcaggagtttgaaaccagcctgagcaacataatgaaactccatctctacaaaaaaatacaaaaactagccaggcttggtgacgcatgcctgtagtcttagccttatgggagcctgggtgacagagtgagaccttgtctcaaaaaaaaaagaaagtaaaggcataagtcaggtgcagtggcacacacctatagtcccagatacttgggaggctgtggggggaggtctgagctcaggagttcaagtccaggctgggcaacgtagcaagaccccatcttgaaaaattaaaaaaacgggttttttgttcgtttttttttttttttttttttaaacgtaaaggcatagtatcatggctaagactgcagactttggaacctgacttgtggtttgaaatcctggctctactcatttatgtaaccaaaataatagtgtctgctatggggaaattttaaggtgaaatgatataattcatgtaaagtaagtagggtagaacttagcatgtagtaagtacttaatgagtgttagctgttattattatttttgaaagtactgtatttagaatactgtgggcagagggcagcttgtctgtattcagtgagcgggagacctagttcccactatggaggactttcgtagcatggatgagaaaaagctagagagcagtctcagtgcaaggtaatcaatgccgagagaatccaaaatagccaaggaaagcagaatgaggggaagggccattctatataagaataacatcctggatataaaattaggcatttaagaaggaccaaaaaagaccaagcttagcgtgggaccatgttggactagagagagatgaggtgggttaggtaaaataggtagagagggaggtgccaactgggagaatggttgaagccttggcaccagaggagctgaggggagacttacttcctggtggtggagttgaagcaggcgagggaacagtgctggatggggcttgtatgtggtgggctgtaaagtcatttttctttttttcccttgtttagttttcaccattgttaattcataaagctttgtgaactcccatcatgtttgattttcaagggaagttattttctttaacaagtaaatgggtatttctttatataataaggtggcagatcatattggaagtgaacattatgaagtcctttttaactctgaggaaggcattcaggctctggatgaagtcatattttccttggaaacttatgacattacaacagttcgtgcttcagtaggtaaggtattatgatattcttaaataaaaagctttttttaatactgaaaaaaatgtaaggtttaaaaaaattatttcaagccatagttttaaaatgttatttaaggatgaatgcaaattaaatccctatgttactgattatttaagaccacttaagaattctctgaatctcttttggagtgaagggaatagtaaatacgtagttcaacctccacattgttggtgtcactgttggtgtttccccagggagcagatacatattttctgccctctacctcccatttctcttatagtttcttgggctacagtctatatacagtgaggaaataggtctttttggtaatgcatttttgataagaaatagtcattttagatatattccatcacacaacttaccagtcactagctatcattgctctgcaaacaatactaattttatcttgtagataatgtatctactgagattggaagtataccccaaatcagactgatccagtgttattgagcctttatatgctactgcctcccttgagagacttgccttggaaggcaaaaatatcttaggtattacaatggtttatggccctccaaaacatcacagtaaataagcagatagacaggatagctctggtattggaatttcatggggctggggtgaggttaggaaaataagtgtctaaaaaggctctctagctgaggtgataataaaaacaaggttgagaagaaacactggtttagagagatgtggtgcaggaccaaggaggcaagtttaataacttatatagtctccccagctttatgtgaaatctggtaaatggggagtggcagggggaaaatacccatcaaaattaacactaaaccaccaaaacggttattcttatttttgtgtcataataccactatgaaaggcatgatttttaggtatttgagtcattgttcagcttagcaaagttttgaggtggacattcttggtctaaaaacattagaattttaaaacctgtttagaaaatgacaaaatggttccgggttattttattttacagtagtacttttggattaagtacatataaatggcttataaatacaaggtcattattgtggaaactactttatattaatatgaagtccagtatagtagtaaagctttcaattatttccaaaaatcaaatcaaaggcatttttggtggaaggttatgttgacattaaagttaatttctctctctcatttaaggtatgtatttaatttccaagtatattcggaagaacacagatagcgtggtgatcttctctggagaaggatcagatgaacttacgcagggttacatatattttcacaaggtaaccactctgaagtggagggatattcatgctatattaagaaaagtatgaattgtttgactattttctatcatctttcagtatgacagtgatatttttgagtatcttgtgaggttacaaaagggaatctgatagtgtttgctttctatctcttggggaagaaagaaattttaatgtgtcagataatttttattctttaaaactagttacagctgggtatgagggctcatgctcatacccccagctgctgaggaggctgaggtgggaggatcacctgaacccaggagattgaggctgcagtgagctgtgattgcaccactgcactcctgcctggttgacagagtaagaccccgtctcttaaaaaaaaaaaaaaaaaagttaaaaataaataaataaaactacttaagcttgagaatcccctttctgccatttcttagcatcctgtggaattatgactgttgcccattgtgttcattttattctaatattagcagtttggtaggaaggaaggcatgttttgtgaagcattgcttacctctgttcagttatttactcccttccctaaatttgtttaactttttgtcttatccacctttaggattggagagggagaaagaaaaactgctttgtgtgccaaaagcaaaactcttggtgtttttgtttgtgaaataggctccttctcctgaaaaagccgaggaggagagtgagaggcttctgagggaactctatttgtttgatgttctccgcgcagatcgaactactgctgcccatgggtaatatttttagaggctattgtaaaacaaaaacaaaaaaacaccaaaaacaaaacaaaacaaaaagctcaataccctgagaaaataaaaatcaatagctgattggctatatgttacatatagttggctatatgttacaaagtgtgacttttatagagaaaatgaagctgtttcttaactttgtcccaaaaggattaggccacatttcaaagtggtgttgtggtatatggagagaagtcttcttccataggttgtttgaggtggagttttcacctttaaagggtaacaacattctgctcacatctgaacaaccaagatggaagaggcaaggctgctacagcagctaccgttaagtgttttaaagagaagtaaagatcgtaaacatcatgtgacaagtagtgagtgcccaccatgcccatgtggtgctgtagtgaccctgagggaatagagtagtgaagatacaaggggtttgattacattataaagaaccaggtttctttggttatcatttctagttgtctaaagttatgttgaagaactgaagacttttactgtacaggataaacaactgacattaaatgtcttagttgcctctgctgaatcacacctagataaggatataattaaatatgggtttgaggaatgaactgaatctggtcattatcctctctgcttgtcctaactagagtcactaggcttcaggaaaccggtgatttggaatttgatgaaatatagtgggacactggtttatatcgcatattgtatgtgaatttttaatcagtggcaaaaaaatactgtatcgtcatcacaattgttagaagagatggtctcacctagtaaacactgagttaggtctaggcaaggtattttcttaatgattgggtcactcatgttttgtaactttttctgctttttgaaatatgcatttaactattcctagaagggaaagtaaaagtaatagtctcagttagttttactccctagatgacatgatatatgtattattttaaatgaagatttattttttgtatctattcattagtgtagggcagtcattaggaggcttgtatgtgactgtatgaccttaacatttcttaagatctggttgaattgatgggaaactgaatcagaacctaacctggcaggcactaaatacccattttaatttagattttcttcttttctcctttaagtcttgaactgagagtcccatttctagatcatcgattttcttcctattacttgtctctgccaccagaaatgagaattccaaaggtaggtaaatcaactcaaggtaaaactgtccattgccatcagattatatttgtaatttttacctgatgctcctttttttgtcacgtcagaatgggatagaaaaacatctcctgagagagacgtttgaggattccaatctgatacccaaagagattctctggcgaccaaaagaagccttcagtgatggaataacttcagttaagaattcctggtttaagattttacaggaatacgttgaacatcaggtataatgtctttaaaaacattttcaggaataagacagtttggatgcagagctgtcattgctgttcattttgtatttagtttgaatgatacatgtatttagtttgaatgatacatgtatttagtttgaatgatacatacatcagatatctctctgataggatgtccctatcagagagattcagagtctctgtaaacaattatctcttttgtaagaattacgtaagaattaagtagcatgaaggattataaagtagcatctagaatcgagagagagaggagacttactactaatcatcactgattttcatttatcagatttttgggcacctgctgggtgccagatcttgttaggcacaaatgactaaaacagagccaccaagtattaaaaatatgcatatgagtgttctttaaaaggcactgcagctatccatattatgaatactttagcattttctaagtgatgggtgattcaaagggtctcatacaagttacagtcacgtcttaacattttctgtttcgtgaaatgagactaaacacaagtatttcctgccattttaagccattttgctcttatatgcttattcttacaggttgatgatgcaatgatggcaaatgcagcccagaaatttcccttcaatactcctaaaaccaaagaaggatattactaccgtcaagtctttgaacgccattacccaggccgggctgactggctgagccattactggatgcccaagtggatcaatgccactgacccttctgcccgcacgctgacccactacaagtcagctgtcaaagcttaggtggtctttatgctgtaatgtgaaagcaaatatttcttcgtgttggatggggactgtgggtagataggggaacaatgagagtcaactcaggctaacttgggtgtgaaaaaaataaaagtcctaaatctaaa

SEQ ID NO: 36701 - DNA, 82695 bp, Homo sapiens
gatcccatcgcagctaccgcgatgagaggcgctcgcggcgcctgggattttctctgcgttctgctcctactgcttcgcgtccagacaggtgggacaccgcggctggcaccccgaccgtgcgactactcggcgaagcctgtgcctgggagggtggtacccgccagggtgcatccggagagaggactgcgggccctcagtgcccgtgcgttccagcctccggggagactccaggtggccctcggactctccggcgccctgcctcgctcacctgcgcgaggagaccccagctgctggtggtgggggacgcgaatccggggttcttcgggaatggggacagcaagagggggttaggcgtgagcgaggctgcaggctccgtgcgagtttggggtggcttttgtgccgacgttgcgcggggggcggaggcggggggctcaggggtttgcaccgagcgccttctcttgccgtgcgaggcgcggccgcagcttccttttgttaaaagttgcgtgtgtgtgaccggcgcccgggaggacctgcctgcaggttctccgccgcgctgagggcaaagttagagagccctttctctgctctgcggctactgccttccaaccgcaggcgctctttgtgcccagagctggggaccgacccgctgccgcctctgctcgcggcgccacccgtggagaccaatcgaaggctgcggcgtttccccgcctccgggttaggcttttgcgctgggagtgcgcggcgtggggctgttgtggggccggactcccgcgagcctggaggtggtggcgacagggacaacttgggcagggcgtgtggaaagcagccgctaggttgcagactttttgctttcgtacatcccgtgctcgcccctttctgccgcggcgccgtttcattcctgccgcgcgccccggggcggctggaggctgtgtttgccgcctgctccgggaaggcaagggacagcgtgctgggactctgcgttccctgactccaaccgcctagcacgccggccagagtgcccggcctgcctggcgggttctgaaagcccctagttcccggtgtctgcgacctgtattcgcaggtcctgttttcttcggaaatttttgagattcgtgaccgcccgcctccccgcccccgggacttctatacttcagggctgcctgggggtggggtgggagatggcgtggaactttctgcaaatcctactcagttcttaaagctataacagaaatccaggtatatccgcgcgggaactgggtcttaggtgaaggatttgcaggttgctggagccccttggtcagattcctgcctcccgttcccttttttccaggtgtcgctggtgcgggcgagtgcaggtcgcccagctcacccctgaagccctgctatctcccaggtcattttttaaaacaaacctttaaggttaccctgatgatgtaaggatagaaagtgagtcttagctggaatcaagcgcttgaaaggaagcggcgcaatgaacggttttgagactgtcgactaccggtcagtttctctataaagtctccaggcgcagtctgcagcgtcctggacttgtaactattgtgagggctttcctgtggggggcagagaggccttgcatctggacccctgtgcagcaggaggggtcagcaggggtcacgagggagtgttcggattctctggaggatttgatcacctagcttaaaacaacacatctggtctttatgtttttgtgccttgacctttttaatatcagttaagctatgtgaactagaacctagtaggagactagaaagaccacatcgaatatctcccttttaaaaaattaaaagaatcaatggttttcttctccccaatagatttttggcaaagggaattttaaggtctgtctcctgggggggcagtgtggtgtaacgacaaagccttgctctgtcccctgggttctcggtttctctgccatttcttggctgcgtgcccttggccaggttgcttagggcaggttgcttaaattctgggaaacgcagtgcctccagagtacaaggaggcatctgcatcatgaaggatcctttgggtccagaattctcctccaatgttctgagtgtagactcagcactctttttaactattcccctggcccctgtctgcctctttgaaattcctctgcctctcctgctcacagggaagtcatagagtatgggtgcatctgaccggtctgcccctgactgaagcaaggagctgtggcttatgcttactgcccttcaattcccatatattcctctgcattgccctttgagggcccccgccccccaagtattacagctcctgtgcctaacaggatgaacctgctaggaatagtgaatcataccttccccgtttcgttcctgcaggtgtgaggctggagtcattctcagcagctggacacaaggcactctaaattattatcctgctggaaataagagaccccagataattcatttatccctattctgttttttcccccactcattcccattttttttctcatgactctgtaaatcatgtaatgctatgcatttatagcatgctttctaatgggccttaagtttcgtatgacatgtgtggtgtacatagttgttgctcttcagttggaaactgtgtgccaggccttttgcttggggctttacctatttctagtagtctcaatgagcctaggaagtagtactattattacccctaacattttacagctggagaaactggctaaggataagccctaaatcatcagtggtgaagcctgatgagattggctgcatgtgcccagctctatagccattcacatgattcaccagaatctgttgtaagactcattcaaaaatatttaatgagtttttactatgtgccagggattgttggaagttctgggaatacaggatggccaatgtcactaccttcccaattttggtgaaaaatatttagaattgcgtgtcttatgaaagcggattatttgtggagggaggattaattaaattttagcttggaggaagggctgtaggcatttgaccctgtggtatgttggcttagttgttagctatctcattccagttagcgtccctcagaaatgaaggtaagctgtttctaaaaggatgatgcaagccagttaaaaatccatctcccactccaaaacataaaaatggtcttgtgcataggtgtgaaagagaacacccccaataatggctgatgtcattggctatttaccctggatagcatggtgagaaataatgacaatctaccatccaaagccattttttctcccaaaagaaattctcatcagaaatgtgccaagtattctgcgggcttcccttggagaacatttatgtacagatgttgtggtggtgatgaattttgctgctgttgttgacagcccttcgaagttacccttagggttttgactcatttcctcaagtctcttccagctgattaaagaaggacacgaggaaatgaacctcggtgtctctagcggaattctcagagctggcctgcagtgtggggaccccttcaaggtagtggtcaaggctgtggcagctttttcttcagaatgaatgtagtttaagagttggcaggctaggatgtgggaaatgctttcttttgctgcattaatgtgcggtaacttttaaaagttgagattgaatgacatttgcaggaatccaaatatgcaaatttcatgtgcagttttggtaacttgaatagatattgccacagctataagtccggattgaagaaggcctggggaagagttagaggaggtaaaagtttgcctggagggcaaatccagtgtaaatctttgttgtacttagagaggaattgagttgagtcatagagaggaattgagttgagtcggcttggcccagcagctctgatttctgacattttttggatgtgatcatacagctcatcttttgacctaagactcttaataagtaaagagcagttgtaatctgatagcccgaggagacatgttttctttggcctacatgatgctttttagaaaacattgaggcgatattaaacaatctagagattttttttaaatcaagatctctatttctgtctcctctttaagaattgaaggtcatggcccctgtagatgaggcctgtgctcttcaggttgcattaggctctagggctttatcctgccatcccttaggcattccccactgggccctggtgagtgcaggaatccaaatatgcccctgggaccaggcagatgacaagtgggaggagacaggccggcctaccttgtgttggtctgatggcttcatgactgacagcttgatggccttagagcaaattgtttaacctttttgagctttcattgtccatcctagttttgccacttattagctctgtgactttcggcagattacttaacctctctgtgccagtaaatgtgttgctacatgtaaaacttttagagtggtgcctcatagtacaggctcaatatgtgttagccataattatcgtctgtaaaacaggaattattattgtccctaaaatgggaataatgcctactcttttaagatgattgccctaaagattagaaaggcattttttttgtttgttttaaagacagtatcttgccctgttgcccaggctggagtgcaatggcgcaatctcgtctcactgcaacctccacctcctgggttcaagcgattctcctgcctcagcctcctgagtagctgggattacaggcacccgccaccatgctcggctaatttttgtacttttagtagagatggggtttcaccatgttggcctggctggtctcgaacccctgacctcaggtgatctacctgcctcggcctcccaaagtgctaggattacaggcatgagccaccatgcctggccgacagttttaaaaataagctttaatttttttggtcttgttttatttagcttttgataagagttaggaaatcactagtcctagagattgaatagatcttgaactttttttttctccaggggggaaaaaaaaaaactacacatcttgtaagattctccaacataacatttgtgtctggtacttttcccattcatcttatgttttagctttcatgcttacattttggttatgacacacttttgttagacatcttcccatgcatacctttctgacaggttttcaacatttttgcaaaatttaaggtttaagccaaattattattcaggacatgtggcatcagttaattacgagcttgggctctgaaattgacacgctggatttttattccagttctgcctcttccctgctgtgtgctctgggacaagacacttaacctctccttaagcttcatttcctcatctgtaaaatggagatgatgacatagggcccctgcgaggattaaatgagattctgcatgtaatatgcttagcatagtgccccgcatagaggaagtgtgtggactccactatcaggctgattttcttatgttcccctttcagctttgcctcttagaaaaaaattgaaaacgtgtaaacagaatatgtagagtggtttttttttttcgtattaagatgaagttgttaattagtggtaatgcatgtttatctgcttggctctttgtttagccgtattcttgggttactttccaccaaaagagatacaaatttcttgataaaagtttaggttgggggaatgtctgcaaatggccattttctgtaggtgaataagtacatgtagttcacctagggtccatgaaagcagtcaaggagcttttccatgactgctttcactaggagttcaaggaccaagctgaacttgtccattgccccaggctagacacagcggttagtgttcagtaagtattagtttaacatcttttctattctccagcacttacactaagctttgaacataaatggtcagtaaacattttggattcagtttaacaaaggcttatcaatccccatgccttggtcctacgttacaggctgggggtggaggagggccagggcaagagcacagcccctgattcgaagtagaatttggttttcttaagtgtaaagtgctctgggcaggattttcaaggagatgagcttaaatcttgatgggcaggtaatagagatcaggaatcagtaagagcatccacataggagataatatttgagattaatttctgaaccttaaaggaagagggcagtgtagttgtggcttcagctgaaaaaaactacagtacaaggaacaaggcattaggatcttacttcaggattatcaaacctttctattggtatgatggctgggggtagggaattggctgggaaggtaagactcctcttactagcctcaaggagcatggagggaatgtgtatttagtgctgagtttggtctaggttatgaagaatgctttgaagtcaaggctaaggtggacttgacccaggagtggccccccaggctttgcatactagtccagggctgcctgttccaccattctgtccaattagacatactccccagcctgttccaatagtctgacgaagcgagaggccaagccctgccttaaaacttggacactcccttgctgtgggcaaccaagactaagggagagtctgtttttattatttatttatttatttatttatttatttatttatttatttatgagacagggtcttgctctgttgccaggctggagtgcagtggcacgatcatagttcaccgcagcctccacctcctgaactcaagtgatcctctcatctcagcctcctgagtagctgggaccccaggcgtgtgccaccacaccggctaatttttttatttctatttttgtagagaatagtctcgaacttatgagctcaagcgatcccccagcctcagcctcccaaaatgctggggttacagatgtaagccaccacacctggcctgttttttttttttttaatagtaaaacatacataaaatgaaatttactaccttaatcatctttaaatgtatatttcaatagtgttaagtacattcatactgttgaacactttcatcttgcaaaactgaaattctatacccattgaagagcagctcccctctccttcccccagcttctggcaaccaccattctactttctgtctctgaatttgactattccaggtaactcgcaaatgcagaaccatactgaatttgtctgttttttgactggtttatttcacataccgtaacatcctcaaggttcacccctattgtagtataagtcagaattttcttcctttttaagactgaaaaatattccattgtatgtatagaccacattctgtttacctgttcctcctttgatggacatttgggttgcaaacaatgctgtaatgaacatttgcatgtaagtatctaagggagatttttcgtggagactatttaggagggttaaactcatggctgcgagctacatgttggggagctgggcagaagatgggctctttagattatctctgagtgaaggggtagtggacctgggtattagggtacatgctttggaaagaaagcgcccttaagagacacgaggaggataaaggtgcaggtcttctctcattcggcgtatttatgggcaccttctgtgtgtcaggcactgatgagattgaggggaaggagaactggaattatcatgggtgtaggtaactgggagtattgttgatactatggaattagtggaaataaagccaagaggaggggtggcctatttgagggagagaatatgatgttggactctgctgggtttattcattgattatttgtgagctgcattttcttgaaactcaatttcacagacatggagggaagacgtcaatgaaatcttagggtcaggtccctgtaagaaataaaactaaaccccaaagtcacaaaacatggctctataatattacggtagcattggggattataaagaatggtatgttaactgtgaaccagtcttatggtgaaaagtaagttttcatgaaaaggagtgtatactaggaagagaatcctgtattcttctctgcattaggccatgtttaaggtatgttttttgtttttctcagaataaaatggccatactgggtatagaggaggacatagaattgacgaaagctttgggaaataggtcctttgaaagcaacttaaagaaattggatttattaagcctggagaagataaggtgagggaaggtttagtgaatgacagtcttcaaatatttttagtgtgtgagtgaaaagtagaacaaaatgagagtcatttaaattgccccagaaggaaattgaaaatttttttgtttttgttttttgttttttttgttttgttttgttttgagacagagtctcactctgtcgccaggctggagtgcagtggtgtgatctccgctcactgcagcctccacctcccgggttcaagtgattctcctgcctcagcctcccgagtagctgggactacaggcgcacgccaccatgcccagctaatttttgtatttttagtagagacggggtttcaccatgttggccaggatggtcttgatctcttgacctcgtgatccacacacctcggcctcccaaagtgctgggattacaggcgtgagccactgcacccggcaatttttttttttaagggaaaattctttcattagaagggttggcagagactttattcagttatagggcctttgctggagctgtgaagaaaaccaagtaattgtcattttgaaatggttcttaggtcctccccaactcagttggtttgatggccctttaagggcctgcctgaaatcgtttgggaataattcagaaatgggaaaataaccaaccgtttttctttcctcactgccttggctgtggggcagagtttctcataaatgctgaatagactctaacataatccactactatagtcacaatttcggctatattgataacagcaagtaaagaacccacagcctaaaaatgggttattgatctgttaggtgtggcgggatctaaacacagaagaaattgtacggtgtggtagcttaaactgagtgtcaaaataagacaaaaggaagctcaaggtctagagaaatccataatctatcatttagccctaccctaagaatcgctgtgctataacgcagcatgtaggcagaaagtctgtaagcatgaaggacggctcccaaagtccttttctcttgattactcaggggtggattggttacccaccactctgactaccctttccatctgtcctttccctctggtcattttgtggtcatggctcagtggcacgtttgagatcagcccatggtccagtggggaaggtggtagaaatgacattgcaattcagcagctactgcttgataacattttattaatacctgtcactttgaaattgatgagtcttaagatgggatccttgcctttaaggatcctaggacctataggaagatggtcctgggtaggcgccaatgttacaggatttgtaataagatttaagttaacaattccagtcctattcattaccattggtttggaggacataggcatcacttcttgaatggccaattgaaaggaagataggggcctgaattaaatcttaaaagagtggggtggaatttggtcaagatgtgaagaggaaaagcaaaggttagagttagccggaaggctctgctcccgccgacagaacgtctgtagagagtagcggaagatgagatgggataatttttagggcacctggatttttattcttcaataattgaagtctttcctgcagtgctatatgtgatgagatttttgtaaatgtaatctggctaagtagttgcctattcagagaaataacttttaaaaatggaaaagtatggatatcacttttgcatgtattacctgtgttgtatgttcgatgcacatccagtatggatatgtattttgagttgtttttaagtccaaggctaattctgctcccttctccctaccgaccttccccactcctagccaagattagagattttgtgggctcaacttctgattgtggcagtagatgacctttcatttgcttattaacatattttaaatatttagcaaaataatacaccttgtttatgtcagtttattcattgaagcaaagatagcaacaaacaagcctgcaaaccttgataaggagcctgtgtggtttggaacatcttgagattcttccctggatccccccgagtcctgttttagaaacctattaggggcacactggtggctgccctccccaacccagggagtcttcggagggaggaggaggtggctgtttgtggtgggcagaactctgtcacttaaggaagaggcgtgtctgatagcacttgccagtagtgaatgcctcattcttgaccaagtagaaaaaagataagagggaaaatgaaaaaggtgaaacggttctcctttaccttgtattttaaattgcttagtgaggcaaaatatccaccttcatttgggtttaccccaggtaactcatttcacagggtgttagaacatttcagagggtgttagaaaattccaaacaatggccgggactcccagtaatttaaatataatggcctatgcgggttcttaagcagaggaattagttaacagagttagaacaaaggagagcattatcacaaagagctctggaagttaatgtgtctctttttattggaaaagaagtatttctagaacaggattcaattggcttctggggaaaatatttactggagattttagaagtgtgaaaggtggcaggagacgttggctgtctgttattctacttggctagtgcacacttaaaaataaaacaagactatgttaaaaagatcttgagaattctacttggaaagactgaagtaaagatagtacaggtacttttcaaaggatataaattttggcttataaagtattttaaatgcaattccatcccaactttcacaatgcagacttcctttttagtggctgatgttgaaagaaggtaccttagaaagattttccatttaagaaatggttgatattgatatttatttggctgataaaacaccacaaggactggtttttagaattttttgtcattgttaaatcaagccaggattcttaacctaaaatatgttaggatagctaatgaaaatacttaattggaatgtttaaatgtttctctacttattttagtatagtctgtatatgtgcagctgggaaatagtatatacgtttttagccgcaccaaaaagcatcactttgataaaagaggaccccccccccttgcttttttaaaataaaccagcatatgtagaagggtttgtgagtttttttagtagatctgaatgtgttgcccaatttacattccagcattttcaagggatattatttaacatgatcatcttggtttcagaaccactgcctttcaaagagtctggcccagagcattgtgtgtgcctgcgagtgaggtgggtcccccacggggtctagtggctttgcgccatactggccactgggaacaccagctctggcggtacagcaggggtacttaacattacagctttattcttcattcttttgatcccttctgtatctttaatctgcccttataccagaaatccatagatttattcacaaataattattgaagcatcggaggtgtagtagtgaacataccaggcaaaagtctttgtcctctcttggggcttatgttttagtgaattatttttctctccaggagagagaaaagtccaggagtccagaaaggaaaaaaaaaaaaaaagaaagatgtaatttgaggggctatcatagaaagcagtttaatttagacttatttcagttccatattgtggttagttaaggaagaaagagaaaagaaaggtgatgcagagggtcagagggtaccagttcaaaaaagaggaaagccaaagaaagcaactagaacaataggaaaaggagattcaggggctgggggagatgggcaggagtggagtcagggaagctttgtgaggtgcttttcactacctgccaccagtgctgccctccagagggctgagcaccagctccatcccaccatgtccctgccccagtttctgtaacttcagagcagcaggcctcttgattcaacaggtgtttttgatggaggatttacccaagaggattgactagtgataggtgtcttcactttcaggacctttggagcctttaatgtgctttagtctgcaggtttggaactgtttgttctggaatgtgccggaatgctctttcacatctgagagagatgtttcagggtccaggctagatgctctttggtatctctccaaggactggagattctgcccctctttttaaaattcattcatgtttttcttaaaatatgaccgaactcctaactcttgctaaccttacacctgggattcttaggccctcagctgaagaacttgatgaatttcaactttaaagaggttcttctaacacttggccatttcaaccaggctttgctataaagtcctgtgaaattgggggactgaaagctaattacttggatcacaagttgcctgtgaaaactgcaaggacctgctgtcagggctcattaaaccccaaagtatggcaccttggcatgcagactactctgaccaagaggagactggaaggcctcagaagccaggtctctgttctttcctcctggttcctgctcccttttctcccgcaaagtgagtcacagaaaccagaattctttttccccaaggcaggtcatagaaactagaactcctctctcccaaagccagtcataaaacctagcaagttcactctcccttcttcctggaagaccctcattcccgaggggtcctgccccatccccaggggaaggggaattgtacagagcgggcttgctgggtttcaccactctgtccatcactgttaggccagatcctttgtgtccaatcacttttctgcatggctgttcattcatcaaacctaaatataaaaataaaggttttccctggggaaaaaaatatgacagacttcagttttaataataactgttgtaataactgtcggtctgtttgacacggtaccatttagccaccatcagccctactgcatgtcaagtttcaatgctcctgttactgtagctggcctgggtgaggtgccagcagagaggtgacagggtgacttcatccggctttttgcgttttcactttagagtggcctttcacagttccatgaaatgataagctctccagtttcaaatgaaggacgcctcaaattgagaactgacaccattgcattcctcaggatgggaaagttccttctccatcaattcttgggcactggagtaggactcttgctgcagatggtattgttctggttctcgagaaggaatccaagataaaggctgtctggggataaaagtggtaccctcttggaatatgggcaggaaggcatccctagtgaccatagccttggttgaaggtattaaggaggaatcttgaggtgcttgtctgggtgtcagttgacaatttcaatgaaattagcagcattaggtctataggtggctgcttaactaattatgaactcagctgcttaaatatatttgctccaggtttcacaattccttttatttacagtaattatcactggttagcacctattgttttgggtgagaatttcagggtctacatttaagtaaaccctatttaaatttattagttgactagggaagggttaaaaaagcagtaaggagtctatgccttctagagtattccctggcttgtttgaaaatgtgttagcagccatttttcaatatgaaagaactgaactttaaaaaaaagtatatttttatttatggcaacatttcaaataggatagtgtaatgaaccctcatataaccatctagcttcaacacttaccaatacggcctctacccactttatcttcccattattgggaagcatgtctcaagcatcatagaatttcatctataaatattttcagtatgtagtcctaaactacaaagaccttcttttctgaacataatgatgatgccaatgtcaaacccttccaaataaatataattacataatgtcattgaatagtattcacattttcctattgaagatacataaaaatataaacaaatgtatgcacatttaaaagaaagcaaacaagatctacacattgtaattggttgatatgtcctttaagtcatttcttctctgtaggtgttagccccgttttggttaaggaaactgcagttgtcctgtgcagcttttcattctgattgcattccttggtcttcacctgtaccattttgaatatttcctgtaaattggtgacttagacgtttgatcatactcagtttgattttttttttaatgagggtactgtgtaagtggtgtgttctcttgttctgctttctctttttggtgtacctttgggtatttgtgaagattcatattttttgctagatttgtatttttggttttaatggttgccttcagactgatacctttctataatacccttgtctgctgtttttgtgggggctattttccattgttgctaccataatatttaaattagccagcgtttgttctttgctctctctttactctcctgagctggggattggaagtaatattcttttacttccagttaatatctaaaaggcaatcagcaagcatattctacttttcggaacttcacctattccccatttttctgatggctatactcatttttcagagcatacagcaattatatactctgctgtctcccttgttaccatcatttagtcttagctctacaggtaaatatctgtttaatgctggcggccagtctttatatcatggctttcctggcattttggttttctgaaacgcaccctctaatagatgccttatgggaagtagttcctgaattatatgtccacaacggcgagtgtgtagtctgtatatttaaaggtcaggttggctagtataaaattgctggcccatcttatctttgcttggatacctttattattttactgtattgcattttgccataaagtggcgtcaaaatctgatgataatcttattttctatccctcaaatttaacttggtatgtttgcctagatacccaaaggaatgtttttccacctttattctttaaagcccactagttagttttatagtattggctgctgtaggttgattattttttttccatagacacaatgtgctcgctgctttaatgtgtaattttaagagttcttttttatttcctctccaataaagatttcatttaccatttgttctgatctttgttggctttaggaactcccattattcatgttagaccttcttagcctgtattctgtatctgccactttctctcaaatccttttaaccgcgtcataattcatttgaattgaaaaattttcctcctttccgtcttctggttcatttaagacactgttcatttttatttgctctcgtgttgtctttacctgtcatttctgaaatgattattttctttatttttaattcttagttcttttgcctccatttttaaatcttcattttcttcaatcaactcatttctgagttttaaaaattctgatttatgctgttcttcatagcttctttcatttagttaatttctcttggctccttctgaaatattaggtcatagctttcctttgtgcccttctggcgtgattttattgtttacacgatggatgtcattctgctccttagtttttctttaaaaataactatgtggaattcaactggattcttttctgttgttaaccgagttttcctatacttttaggagggccagtgtagatttcctagcatcagagatttaggagactctgttagttgttttcattttattttattttatttttgagacagagtcttgctctgcctccctagttcaagtgattctcgtgcctcagcctcccgagtagctgggattataggcatgtgccaccacgcccagctaattttttgtatttttagtagagacagggtttcaccatgttggccagactggtcttgaactcctgagctcaggcaattcagccgccttggcctcccaaagtgccaggattacaggcatgagccaccgtgcccggcctcatagttgttttcataaagtggtaataaaaatatgaactctactttcctatatcctaagactttttttttgtccctacccacactgcttacctgcccagactttcccttacctttgcccctatttcctcatcttagatctcatccccagcagcttctccccagtgtggggctttgccttggcttgctaattcataggagtcagacccctcccactccagaacattctggcacattggacatacaggtggcacagccctctccgcactcactaattaaactggaacttttttctctgtctactctcaggatgaccctctgagctttccagtgagtgcctgatagtggttcctgtagctgatggtagtttgtcatctagagttgttgtggatgttgtccatggtttttgagtctgctctctgtcagtttttatggttggggagagtcaataattatgctgccaccaccatcttcccagaatctatattgacattttaacacaaaatttggcaacctttgggtcaatgaaatctggataaagtcctgtcttgaaatctcaactcagaggtagctgcttttcaaaatgatttgcttccaaaataagttattaaaaatttgtaactatctgaaaactgattactatggaaatgaacactgtatggcctacctaacattagctttctaagcttattgtttatgagaaaatatagtggctgaaatcatccgagtgccaggaaactcactgctgagctattatttctgagaaaaatttataagaactgacatgcttttgtcattatttgtttggtgtgagattccttgagttctgaaggagagagtgctattttacagttttaaaagtattaaatcacatttatacttaatatcatctaataaagataacagcatttcttaattaggtgtattttcctctgattttttcccccactgaaaaatttgcatatctctaattataatcatttctggaaaaaatgctgctagggattgacatgatattaatttagatttccagaaatactaaatttccttcctccaacctgagttttcctccaattggccattgatttaaattacctactaaaaggttacaattttagaattgacctcttacccctctgcttttgggaatggccattatcctaaagccatatgaagaataaggacagatttctcaatagacatactggaaacttttgttatttaaattctggaagatagagtaagattgtttttagacatttcctcttgttttccacaaaaagattgagaagaagtaatttcaaacacagggctggtcgttaagaattctttgcaaagggaaacaggcttaatgtattgctctaagtgaatgtcacccaagaaaaattaagggaaaagtgaatactcattaagcaaattgaccagcaagcgttctgatgaatgttgaaacaaatttgaataaaccaattttgtccattagtgtgcttttaaaccaatgtgattgttttggcctaattattttctgttttgcttattcaaatgtagaatggctgcagaattaactattgcagcaattatctgattagcaatttagaaaattggtgaatggtatctgactactcaccaagaaatatctggtattttacagggctgtgtggaagaacacagactgtccagggaggatatttgctgtttttcactcactacaaatggcagctcagaggatctcactggattagtatgggctgtggatgtgggctccgggctctcagatgtagtgcaccagattgaggtctgatgtgctgcagaagttgtatttgccacccggtgtcactattctggagtcccgtagctgtgactggagaattctgcaacatttcccacttctaaagcttggggattcgagaaatctgtgcccgactggctgccaaagcttgtcagggggacccagtgctaggccgatttctaggtgtaaaagccaggcagatttgctcactcaagaaaatctgtttttgcaggtttgctttgagttccaagatacagatcctggtaaaattgtttgctgcgctaatgccctgagtttcttgtggtagctgggttcccgagtgtggtctggaccagcagcatcaggatcacctgggacttgttagaaatgcaaactctccgcccccacccaagaacctgctgagttggaaactctgagagcagggcccagccatctgttttaacaagctctccaggtgattctgctgcaggcgaaagtttgagaaccactggccttgagtgtaaaaattactgggctttgtcacagctgtcaggctgtgctagttaaaaagttaaagccctcgtggattcttcaattctcttaatgtcagaacgtcagaccagggtgcaattctcagttctccttgtgtcagactaagaaagatagatatgagtttcggttagtccagacaggaaaacagacaactggagtaccatgggacagtgctgcagtagaggcttcgagaaacctgcatgggtggagggagcaggggaagagtggtattttcagaggacaaatacgattgtgtcctaccctgattaaaacctgtcagagactgcccagtgctcttggaataaagtctgtctccgtagatccctttcaagcctccagtatctccttttgatctccattttgcacacagcacttgcctcattgttggctgtggagtgcacgctgcacccccaaaggtgtccagctcctatccacccatctgtggcctctgcaggagctgcccttctgtccactgccaggggcctcatgcttctccctggcctcctagtgcacttcacagcccagctcccacccgtcctttgcaatcttctctgacctcccagggtaggtcagatcagccctcattgtacagcgtgcttgttcgaacttatcacattgtaattacctaattgtataattattggtttattgctgatgtggagttaaatataaactctatgggtgaggggtggggaattcttgccctcttgactgtcccaagggcccagcacacagcaagctttattattggatgaatgaatggtggagcagtcctcatctttgttgttaggacacatgggctggttaatatattacattttgattgaggtgtcacctgagctttagacccctccatccctcccgcccccatccccactctcatccccaccctcgtcccaggagcatttgccaccaccatctcattctactatgggaaaggcaggtccctggcactgtggcagcgaaatttcataacttggttctaacttggggtctgccctgtgggacactagagagaagttcttgagtatcagtatttcagggatatggggaaggaagaactcctttgcttttgcagacattcataatacatgggtcagaagccagcagcctggagtaaaggtggccccggaaggttttcagggaaagtgactcttgcctcctctttcctcggggcttccaagaaacactgcctccttctgtcacagaagttgatggcaggctgggggttgtgggttgtgtttcttcccacccacttccaaatctatttgttagaagatacgcactcctttgccttttagtcaatttactttggcctggttgaagccagtgttttttattcctattctagaaggtaaaggcatggaagttgcccttcagaagcaacagctgtgcaacattgggacatttgtctaaaataagaaactcagccttgctgatttaatagaaagcttgacaatagcttataaaaatacatatattgagaatgagggctcatgttttgtgaaagattggggtttcaagacctagagggtaaagaggctgacgtgcttaatgggaatgttgcttttgatagaggaactggtaatctgttcactattttatttgcacgttgattgatgtgtggtttttgttttttacatttgaggctcaacatattctcttatacctatcgtaaacgtctgctagattaagtgaatgtaataaaacacagtaaatttgggaaaaattataaacacaattcctcactcactgtcagaataccgtagctaccatctgccaggagtgttgatagcaggaagaactataattttgtgctttgataacctatgttgtctgtttccttcatcttcatcagctgccatttttcttcatagcttcaatgcattccatggctggctcgctccttccttccttccttccttccttccttccttccttccttccttccttccttccttccttccctccctccctccctccctccctcccccaatccctgtgaggctgtctccctgctccttcacgttgccttacccccttctcttctcttcttgctgtcaagtgcagtaattatagtagtagtaacaacaggaccattttatttgagtataaagcatttaaaggatttgaagatggagattctgacctattttacccctatagatgtcaaaactgaagtttgtagaggtcaaatgagttttcccaaagtctcacattgcaatccatgcatgtctgactccaaaacccacacctgttttcataatattcctcttgttttcatctgctcacccaagctcagagaagcaccttaatttccagtgtctgatcctccttctaaactttccaatattgctgagtaaagttacaaagctggacccactttttgttttaaagctccttttttggaaataatttcaaacttaaaggaaaattgcaagattagtacagagaactccagtacaccagttgttaacattttgccacatgtattttgttttatatacatatttttttctgaaccatttgagagtaagttgctaacatgaccccctcccccacctttgctgtgcccccttgaagactcactgaaggagacagccttgtattattctatgagaaacactgaggccacccagggtgagttcctctgcctccacccaagtgcagcctttaccttgtccctctagagctgagggccctgctccaaggagtgacactgtgagctgctcacttgtgagccctttaaattaaactcatattctgaaacacatgcactgccttcctggaaattggctctctctagcacttaaaaaacagatcctcctctgtggcagggtaacacaaaggcaagtgaaaaggggctccctgaatgtttctaccaactccagagaggggagaaaggagatttgcctctgcttgttatccggagctgtaggtgaactgttctgctgctggtaattgaagtctatctgcagaacagttatcaagggcagtaaccttttttctagcaatggcctcagataaaacttgtttttcttattaataatttgtttttacttcctttggtataaaccatccctatggctataaagtgacatttttgaaagtggaaatagaaggaaaaatgtcctgtctgttcagtgtgggatggaggggaaggtgcaattttccctatttgacaggcccattaaagcaggatttcagagtatgttcactagcaaaatgtactgatttacccattataatgaaaattagcttaagtatctgagtcaagtataatttatagcatttttaagagctagaaaatcaggcctttataaaatgtagatcataattgaagacaggttttaaaaatgccttagggaaataatattaataaaatgtcaagacgaatggataaacaaaaatatagcatatacacagtggactattattcagccttaaaagggaagtcaacttttacaaatgatacaacatagatgaaccttgcagaccttatattgagttaaacaagcaagagacaaaaggacaaatagtgtgtgattccacttatatgaggtacctagaataatgaaattcatccagacagaaagtagaatcatgttgatcaggggttggagggagcagagaatggtgagtcattatgcaatatttctgtttgggatgatgaaaaagttctggaaatggataatggtgatggccgtacaacaatgtgaatgtacttaatgccactgaactgtatacttgcaaggttaaaatggtaaatcttatgtcatgtatattttaccatagtaaaacatttcttaaatgccccagttgccagatatatgtgtatatatacacatgcacacagataggcatatgtgtatgtataaatgttaatcagcctctcacttatctgtgtttcatttgatatcattcaaattagatgccataagttagaactagagtttagggttgtcacacttttttatgtcttgaagttttcattcgtccttttttttttttttttttttaatgagaaggagttttgctcttgttgcccaggctagaatgcagtggcatgatctctgctcactgcaacctccgcctccccagttcaagcgattctcctgcctcagcctgccgagtagctgggactacaggcgcccgccaccacgcccggctaattttttatattttaggtagagatgaggtttcacggtgttgggcaggctggtctcgaactcttgacctcaggtgatccacatgccccggcctcccaaagtgctgggattacaggtatgagccaccgtgccggccttatttgtcttcctcaaaactccatttcccctcctgagcctgcagggaattgacattttgcagaagcttgagtttcctgataggaggaaatttggtgattagtgaatattggagcgcctagctcacactcgcccacacccacacctgtccaggacagtgctaacatgaaggcagtttgcacttgtcaggtcctcctgcaggatcttgttgcaagaatctggtgatgcccatctgtttgtggagtgtgcagccaggaggatctgctcggaggtgagactgcaccagggctcccttttgtatgtcctaggtcttgggggggtgaagtctttgactagtgtggctgacctttgccatgctcttttgacctgtttctttttactttgttctgaattgttctttaagtgaaggaagaaaatgttcaaagaagggacgagctcgctaccccgaccccaaacttcacagatggtgagggccttgttctggtgtttattggattccaatccttagtgcttttctggttcatgtttcaatatgtgctttccagaaatcaaaacacagaaatctacatatttacggcagcggggatggggtggggggtgcggggaaacgggggactgtgctgggctgttgggaagaacccactggaaatgagaaagttcctcctttctgctcagggatggatcccagtatattttgcttgtcacatccagaccttatccaactccccaaagactgacttcataatggcagagaaaggtttcctcttagtctgtctctgagatcaaaaggggaggtctttcctcaagcattaggttgtatttttgttaggatgagtgagtgagaagagaatatattaagtagtcctatgaaggtctttgctgctggtaaggtgtgtgtatctaggagaagtctgaccacataattagctgagaaaggtccgtctttgagtgtcgaatgatacttgcatcttcatagttaattataagatgtcagagccgtaagtcaaatttcatgtttaggtccttattctaattctgtgtccaaagagtagtataaaaacaaagtaggcctggcatggtggctcacacctgtaatcctagcactttgagaggccaagtcgggtggatcacctgaggccaggagttcgagatcagcctggccaacgtggcgaaaacctgactctactaaaaatacaaaaattagctgggcatggtggcggaggttgcagtgagccgagatcgtgccacttcattccagcctgggaaagcgagactccatctcaaaaacaaacaaaaacaaagtagatgtttagttatatatttatattataagagaatcactgctattcattcttgccacaaacatttgagtgctttctatgtacaagaactgaattttctttttttttttttttttgagactggatctctctttgtctcccaggctggagtgtagtggcacgatcacagctcactgcagcctcaacttcctgggctcaagcgatcctcccaccttagcctcccaaggagctgggagtacaggcacatgccaccatgcctgactaatttttgtattttttgcagagatgatgtttagccacattgcacaagctggtcttgagctcctgggtaagcaatcctcccgccttgacctcccaaatttctgggattaaaggcatgggccaccgtgcctggcccaagcactgaatttttattaatgtaagagatttctttgtcttttttttcttttttttttgaggtggagtcttgctctatttcccaggctagagtgaagtggcacagtcttggctcactgtaacctccacctcccaggttcaagtgatcctcctccctcagcctcctaagctgagattacaggcacatgtcaccatatccggctaatttttttggtatttttagtagagacagggtttcagcatattggccaagactggtcttgaactcctaacctcaagtgatccatctgcctcggcctcccaaagtgctgggattacagatgtgagccactgcgcccggccgatatttctttgtcttgaccgtttttttttttttttttagaagacagagtctcgccccgtcacccgagctggagtgcagtgacgcaatctcggctcactgcaacctctgcctccctggttcaaacgattcttgtgcctcagcctcctgagtagctgggattacaggcatgctacaccacacctggctaaattttgtatttttagtagagacggggtttcaccatattgaccatgctggtctcaaactcctggtctcaagtgatcctcccgcctcagcttcccacagtgctgggattacaggtgtgagctactgtgcccggcctgtcttaaccttccgatggggcctatgtgtttaattccaaacatacaatgtaggatgattaaatcaggataattggggttatcccatcacctcagcatttatttcttctaagcatttaattacagatcttagaattgttagtggctttagactctttactttgtcaaatgagaaaaacaaggcctagagaacctaagtaacttgcctaatgatttagaatccagaactgctatgtctctaccagtatatattttccccttcacatccttcactaattgcttaagagcaaaagtatgcagttatggccgggcgcggtggctcacacctgtaattccagcacttaggaaggcagaggcaggagaatagcgtgagcccaggagttcgagatctgcctgggcaacatagtgagacctcgttctccaccaaaaggtgggggggtggggaagacaaaacccccaaaacccaagtgtaactacctgcaaaagtatgcatttatacatttcatctaatatatacaaatattaaatatttaacagacaccaaacatttaataattttgcttgtcttctccagcctgagaaaagctttgacagatgtcctgtctctaaaacacactcactggaagcttgagtcgttgctgctgggtcctcttagtaagtttccttagaagcacacagaacatttaacatgttctctatcttgggagtgctgttcaaaaagcagaagcagcccaagggcatcttcttttgccaccaggtggcacgcttgtgaattgggaactggtggaaggaatgagtcaaggtgagggttgcactaaaatgaatctcccagctgggcaatgttgaggaatctgagtggggaaatgcttcattgcagagaatgaagtctgtctgatttgcccagagatcacaaaaataaaagacagaaaagcagaacatgaaaatgctacaggaaaggtgggatcggcacaaatgataccttggcactatgtccgtgtggtttaaggcagaaaactgaagggctgacttggccctgaggaggaaactactcagtagcagaggcaggaagggcccaaaccacaggtgaatccacccaggttgaacgcccacacagaggtgtgtgggtggggtggggtggggtggggtggtgcagcctgactgcctccgctgcaaaggatgtgcctttgtgtgcagtgtgacatccctctctagccttggcgaacctgggaaacacttcgtctcacatgtccttggaaatgtgggacccacatgtaccatgggctcctttgtaccactgagagtctcctgaaaagagtaggtccaaaaaaaggggggcttgagcccaaaatgggcttctgcaccttatggacacatgcatcagctcctgggcaggtcaacttaggagcccttctagtcatccctctggctatccctcccctcagttccttctttctttattgccatcttcctctgtggatgttcatctccccaactcttcattctgagccttctggaagcaccctgtgtcttcatgctgccatcaggcactgtcccccacactcactgactccgagggtcctccctccacctcctcccccaaactcctccctgacaccagccagtccccacagttgctgctcccccggcagcacgacaaagctcccttcttccatgtcccacttctgccataccaatggccgggcctgcttctgctgtaccagttgccaggccctgcatctagagatcctggtttgactactgtgggcaaagctctggtggttccgacatgcagctgggattgctaatgagtgtatgagttctatgattgtttctcctcactgctgtcagtggccagtcctgtgccctggagacttgagggtgggttccccatccttctctgctccccaacctactaccttgtcctgaggttctagtgtccatctattttgccattcaaagtaatggcaaaaaccacaattacttttgcaccaaccttctatagaaggccctgtgcactgtctgatctggaatttcctggttctcctttagcagtggagtcattgtcatctctatcctacttcagccaccctgggccttgtcatttctccctggcccctctgttctttgtagtctccactccctccctgggggatttcatggacaccactaccaccctctgtgtgccagtaagactccagagtatatctgtggatataccccacctcctgcctccagtttccagaacctttttgctgctgcctgctgggccaaatgcctcaaaatctgttttacccctccaatctattggcaccccatctccccatcatgtaagacaaaaccagggatatttttctccttgcttcttcactgtccagggccagcccacccaaggtcccaggctcacctggcataaagccacccctccccttcatcccaccacctctggttgatgccctcatcagctcttttctgggtcgctgactggttgtctcctggctgacctttctccaattctgttccccttgcactgtccttcactgctcccagaggagtcctcctaaaacatacatctgcagctcacccccttaccatgacggaggaggcctccgggggttctgccctctgtccctctctagcctcacaccggcagcaattctgaatgattttgtgactcctaggcactgactccactagttctgtgatatttggtcttgaatgtctctcccttctcccctgacccaagtgatagacctttctcctcttctacccctcagcctggctgcacacatcacttgttttgagccctaggaatctttttctgagccttctccacttgcccactgccttagtttcccagctcagttctacataatactctgccctgttttagcctgtacttgcttcattgtatggtaattatgtgagtctgtcttccccactgggctgtgagccccttctttgtattcccaggccaaatgataggagctcaattcccatttcatcaataaggacacgttacacaagtgcttgctttgttactgatccagccttgtttgccattaattactgacactctagctttagctttatttctctgttctgtgattcccctgtgtcaattagttcatcatctttagaccaaccttgaaatatacttaaggagctacttaaaaaaaaaaactaaatatgctgtaatgaagtctgttattttgtgaattttaaatggctaatcatttttaaatggtatagtgctattgcttgaaaccttaaactgtccaaattctgtaaaatcactaaatatcatgtacataatacagtactgagacctggcatgcagatagaacatatctttaatttttaaaagctaaacagaaatttgcattgtccaaaggaactggtttctcaggcctggacatgggaatattacaatgaaaggtaaggaggagatgatgtcaatcagttacctatcattcacctcatgactaaacctgagtaggttttttctttttcttgaaatggggccttactccactcctcaggctggagtgcagtggcacaatctcagctcactgcagcctcgacctcttgggcttaggtgatcctcccacatcagcctcctgagtacctgggactacaggagcgtgccaccacacccagctaatttttgtattttttgtagaaatgtggtctcaccatactgcctaggctggtctgtaactcctggactcaagtgatctgcctgcctcggcctcccaaagtgctaagattacaggtgtcagccaccactcctggccctgagcagattttaatcatgagttctgcctaaataattgctttaatctctgtattactggattaaagatagatctgaacttaagagaaagtgtgatccgtccaggcatattctcaaacttttccatggaactacttttaaagattggaggtaccactggtttgagtgggacatttgggaatatgtggttgtaaagtaattcagtttcttcgaaagctcatttatttcctcctgaaaaaaatacatttgattttaccttctatattacaatatgtaaaacaatatgaaagactgtttaaaattatttaccactgagtgaaatcaaccttcaagaagactcataatcaactttgggaggccgaggcgggtggattacctgaggtcaaaagttcgagaccagactggccaacatagtgaaactgcatcgctactaaaaatgcagaaattagccgggtatggttatgtgcccctgtaatcccagctacttgagaggctgaggtgggagaattgcttgaacccaggaggcagaggctgtagtgagccgagatcgcgccactgccctccagcctgggcgacgacagagcaagaccccatctccaaaaaaaaaataaaaaaaagacttacaatcaaacatcctcaatgaaaaagcattgctctgtagggtgatgccacaaattatttaaccattctttcctttctgcccctttgcatcttctgtactgtagacattccttccccctgcacttagcaggtggtatattcctggcactggacagagaccttactttggattgtgagagctcacagtttggttgggttggggtccccataggactagcttttcctgatgctttggacaccccttcatgctttgagaactttgtcttcgccttccttttccttgaatacacatagaaacacatacacgtgcaaacacatatacaaagtcttcctggctcagctctcccctacaccctttcatggtccttctgggcagcacaggcctgtagcacgtgtgtcacctcttgatgttttatttcattagcattatgtctttgtctgcacaaggctgtgagctcccccatgagcatctagttctggttacacagtacatgcgtgatgaaaggtaagactttaatgacgacggtgcattgagctccccatagtagaacagggacatttttgagattctctgttgcatggcttcctttggttcatgtgggtgattcagagttgatttagtctccccactgctgggcaagagtgttttgaggacttgtgtggttttcactgagctcatactccccctcccccatctgcatgctatttccagtatcatctctttgtttgtaaagcctcatgggtgttgtgggcgattactgggatccttccatcatggttttcatccagtttattcctatggggatataaaagtgtgtcagaaacagtataatatacaaatcattagcttttttattacgaattgtggttaaacactatgtgaaccgaagagtagttgaactacaatgcacaggctctgccccagtcacagttcttcctgctctacttccccaaaactagaataggcctaatgtggtgggttttcttccccgccattattttgtctagttccttatatttgtgtccaaaagaggacaggtttagaaaggacttccttacttttaaccgcagctatcaatccagttgttggagctttagccttttgtgaaggatagaaagaccttgcagtcatggttgacctgggccagccactgctgaagttgccggggagaacccctgagctccatcaacaggtcactcctgcttccacagatcactgcacctagaattgcagtctcaactagtctgtgaattgacatgttaaaaaaatactacaggtatgctttgaatattttatttttacgaattgtggttaaacactatgtgaactgaagagtagttgaactacaacgcacaggctctgccccagtcacagttcttcctgctctgcttccccaaaactagaataggcctaatggacagctaggagatggacagctgcctatcttttgatggagggccaaagcctcttctttgagttttggttgagtgatgggctttctcaggaaagttctgagctgccattctttccatacaccacacccacaatgcagagtctgtgattccttatttctgtgtccttaaatggagtacttgtgaaacaatccaaatgcagaacccacgccaagtttttgtaaattggaggccctcctccgatctgctaatgtttgcccacatttaattcaatagtagactttctttagttgagcgacccatataaagcctttcttagttatggaagaattagcagctttctccccataagcacacactcatttttcaccaatttccataatgtgcactttatacatgtaatttatacataataaaatatcgaatacaactcccataagcaggtttggggataaaaccagatgactcatggtgtgagcagaagagcaaagatacactagagaagaacttaatagtattggacattaaaaatgccttgggcagggtcagtgtggtttaaaataagagcttccaggtctttccactcagagagttaaaagaccttttcctgccaatgcttatttagtataagctcaactgtatagcaaaactaaataaaaatagtgaagcaattaattttttaatgacatgaattaaaacaacattgaggggctcacagaggctaataatagaggccagtgtgatcagataaaaaagtgtcaagatagctgaggcaggttttaggtttagccgggccttaaagaattgttgagtttttaaaacattaattgcagtaaaatacatgtaacttaggatgtactatttttaagtgtcccaattctgtgtggcaccaagtatcttcacaatgttgtgtaaccatcactactaaccatttccagaacttcttcatatcccaaacagaaactctacttattaaataataactgtccatcccccactgtactccctccccacaccttaataacctgttctactttctgtctctgtgaattagcctatcctatgtacgtcatataactggtatcacacaatatgcctttctgtctggcacatttgacctagcatactgtttgcaaggttcattcatgtgtggcatgtatagaatgttactttttttttgtggggggggggggctgtgtaatgttccattgtatgtatataccacattttatccaagttattggaccacattgggttttataagttattggaccacatttgggttgtttacaccttttggctatggtgaataatactgctgggaacattggtgtacaagtatgggtttgagtttctgctttcaattatataggttgaattttatactgctagtgatgagggagacatagcaagtacctgaagaggttataagccagaggcatttcttttattttgagctatcactgaaatcttgcattgttgactcttcgtaagtgtccgcttcctcctctatgctgtttgagagcgaaggccattttctaggttcagcacttaccaagtagctgggataagtatttactgaataaatagttcccggagttcctagcttaaagccgtcattccttatagtgctagttggtctccagagtgttgggttttgccacctatcctttttttgggttaattaattaacatgtgttcagggaacagaaaacaactcttaatattagccttagccaaacataatttgggaagtacatttgctaatgcaaaaagtcctggtgtaaataaaacacaattcaacaaacatttgttaagaacttgctgtctaccacgcacatttcaaaatttggaatttcagagcaatttcaaagctaagttggaatacctttttgaaaggcgttctcttaatacgaacctctactcttttaaaaaaaactttgtttttcaaaaattgtgagactactataacaatattaaagacaatttaaaaaagagaataaacattacagtcccaccctaataaaagccctattttcattttataatgtgagtttataaatcatttattttgaaaataaaaccctgaatacttctggtggcaattattttaattattttttaaaactctagaagtgaagcatgaactcatgatcttgaatttagagggcccttatttggagggatgcatggctgtttgacttgatgaagccaagcttttcttggtggagcagcagaattgacatgggtcatcttttggggatagatctgtagactgttgacatctgttatagggactgggtgtttaggagcctgtcctgtctttattctttcatatgttcaggattgaagaaaatgtttttattactgtgctagagggaaaagtacgatttaggatccttacctgcaggatctaagaccttggagtggatgtaggagatatggacacagttgaacatcagtacaaggcaaatgagtgatgggctgcctctgttggtgggatttagtgaggacaggttatcgcaacatggagtggctagggaacaacatccatgaagaggctgtcttcagcggggctttacacaagacaagatgtgtcccagggacacaggcagaagggatgatgggcatgacaacggatgaagaatgttctcaggatccttagccagtcagcctaaggagaggcaggttgggtccggggaaaacagctagaagttaaccccatggcagttcctttaaagttgtaagagctgctactgttagctgctgctgcctctgttgtggttttgaggctggggatggaattgttaaaaggatattgttttaggctgatggacctcagagttttgagggaggatgagttggggtggggtgggtggcggctggcggggagtcttttaggagaggatattacttctgtgaagtagttggctggtctcaagtggaacagcaggaatggaagggatacagggtgtgtggagggggctctgaaggaaagaatgctaggatgtgctgcccgagagggggaagtcaggtaggaacatgtttggcagatgatggaaactcttcccatacataggaagtgggtgagtccggactgatttggaaggccaataagaagttccatttctggaataagtgtgcctaacatttattatgtgttttccatgtaccaaaacatagttctaagagctttacataacagccttataaaataagtactgttagtatccccactttacagatgagaaactgagggcagagttgagtaggaacttgcctcagggttacacactcagtggcagagccaagatgcaagtctagacagtcctaactcaagagccaggctctcacttggtatgctaaaaggctttcctgcttttctatgatagcatgtattaaaaactatccagtcctgttttaatctccttacatgtgttacctcacttgattctcagaaaaactctatgagatgagggtatttttatcctcattttccaggtgtggaaacttggacacagagttagggtgatatgcctatgtcacacagctagacttagctgcattggcctggtgtgtctcaggaagtcaaggatgtttatttgactggattgtaattatctatatccatcagatcaacccatgagaaaatggaattgattgaaatagattgcagtataaattctttaagaaatattgggtcaaatttgctatcaatatcatgcacattcattgggaactgttcttttttaaaaggaataaataatataaataatagcatctctattgctgcctctgtttttattatttagtgctctgtacaactctgaaaataatcctggccactgcgtgcccatattcttgctgccacatttagatgctgcacctagcggactcaacgtctcactctgtagcctttatgacgttgttgctgcctaataatatttaatgcttataattggacttattgtcttttgatctggggtgtactttgcttgacataatggggctacagttgatgccaccacaggcaatatttggctaataaacaggaattgagactggtcatctatacacacacctgcaggaaacaatttccaccctcctgtaaagcaccttcagtctgtccctacccacaagtgctcttctttctatctcgcatgtgagggggtctcctgttttctttacctttaagcctggtttggctacagatctctatttctgtcttgtactgccagaactacccaagggagaggtctgcatttgcagcttgtagccctggagcaaacaacacttcccactcaattgaaattgtactttagaatttccagcagtctctttgtaaccagattaggggtcttttgttcattccctgccatcttactgtggcatctgcccttagagccaccaccctctctttgaaactttgtactgcattgccttctttgccacttagcctctctcccttttcttcctggtggttctttttcttaaatctctcatgaccctttcctacaccgtcttggctggaagagccctttaagatcaatgcttggttggttcctcaaacccttttctttaatgatctgatcttgttttttaacttcacaaggtgtcactggaccaccatcatctgaattccaggtcataagcaacccactgctgagaagtcccattactggccaggttgtacctgtgagcaaattacacctctcacgtcccctcccctcagaatatgcccccatcccctatcctcacccatcctgaacttgtgtggctcactcagatcagtcctcatctgcaaccttgcatatggtggcaggggacataaatctgatgtgcatgaaccattcccttcaccattctgcaagaggtgactgggggccccagggaatcttgttatcacactgccccagcccacctcacctggggaccttgccttctgcctcctcactgaggtcttccctgagtcaaccttttgctttttcatcccgctgatatggccttcctctgacaatctatagtgtcttttcctgtttattctgaattccttactgtaggttctcattacttctgcctgcgaccagcatgtttcactcatttccttgaatctagttgattctctgggatctcactatgcatgtcacttctctgctgaaaaacctaaattgaatctacagggtccctgaggtacgttcccagaatttacacccagaagttcaggacccttgatggatctggtttcactccacgtagtttcacctgtcatgtgctccgcaaggtaccctgttttttagccaggctggtttctgaataactctagaggctctgtgctcacttcactgccagttcatgctgtcatcttctcctcctcctcctcctttgcccttatgatatggttacactccagcccacctcttgctttttcttcagattgacagtaaacctcatagctatgttttacttcagtactttgttctattgtttttagagagacagagtcttactctgtcactcaggctggagtgcagtgttgcaatcacagtttgctgcagcctcaacctcctgggcttaagtgatctcccacctcagcctcccgcctcagcctcccatgtagctgggaaaacaggttcccactaccatgcccagctaatgttttttctagtttttgtagatgtgttgggcggtgggggcgtctcactgcgttgcccaggctggtctcgaactcctaggctcaagcaatcttcccacctcagcctcccagagtgctgggattacaggcgtgagccacggcacctggccagcagtttgttctttaaaccctgaaatgtatgtgaggaccatgtgtcacactagcatggacttttccccagcatctagcatggtgcttttgtagatgataattaatgaataggtatttgaatacatggaggcatgcatggctgaatgaagtggctgttgtaaaatttctagggttcaggtttcatattcagagcctaaagtttgcatctttataaactaaatagtttcctatctaggaaacctatttaggcattagggtgttaaaacaggtgtatcattttctgccttagtgtttagagatttgtgaatagttctccttttgatgaacattgccatgtaaagagagttatacagaaataactgaattcacacagttttaaggaaaagctattctatgtcatggtcatgtatattctgccaaagagagtgacaggccagtagtttcttttttctttttccccatagtgtgagattttgtttctgttgtttctaagctgggtgtctgcatgtccacactgcgaagatggcccatattcagaatgaaaacttgacccaattgtatgtttagcccagagaaggctggggcattcagcacatcctggcttggggaccaaatgtgaccctcaggattaattgagggttggagaaaataattttatagatgaacttaagacattttagacagaactctcttttcagccataaatagcagggcagctttgtcctatttttattgtagagtacacagaagatggaactcagtattggaagaagtgctttatttcgccaaggaagaagatcatactcaacacgattctgtttttcttggcaggctcttctcaaccatctgtgagtccaggggaaccgtctccaccatccatccatccaggaaaatcagacttaatagtccgcgtgggcgacgagattaggctgttatgcactgatccgggctttgtcaaatggacttttgagatcctggatgaaacgaatgagaataagcagaatgaatggatcacggaaaaggcagaagccaccaacaccggcaaatacacgtgcaccaacaaacacggcttaagcaattccatttatgtgtttgttagaggtaaatgcttggctttctgcagtgctgtgctttcaagaatttaatatcctgctcttaattttggatgacatatggatgactgagccatagataaaatatttctggctgggtctagaaggcctaaaacacatgtttcttcactgttctctcccatcttttgatatgatacatagtggctttgggtatggccccagctggaggactgcaggactgtgatactcttcctaatgagattacagtaggtttagcccatttgtgctggtgctttgagtaaaccctgagaatcaattaggccctttgggaaagctgcattttaatgccttgagatactagatactcccacttagtaaaaacacttcagggagccgaaggcctctcaaagcctaaccagaccgacacttcgaaagatgtggcccactcttaaggagtaaatttcagaaaaataatttggtcagctaaacatcccatgtctgtcatgggttctttgtagagttgtccatagaaaaaaatgtgacctcttataaacaaaagaaaaataaatatggtagttggagttctttgctttatttcctatgacaagttcagtgatttgtctgtgattttaatagccttttcaagagtaagcatgctgggcaggggtgtatcttgtagttgatgtaaaaactgatccactggcagcttaagggacatatccaagtgacgggaggagaaatagagttctattttctagttctgggtgcccctggactggggctgtctttgaaacaggcctgagaggccttatccatggtattgtgaatgaataatggatacttttattctagattggagatcttaggtacctcctgagttcagttcctcactacagtatttggataagatgatctgttctgtcttccttacgtaattgttagggagccaggatggtacaaattctaacatgctccatcaggagcgaataaagctgactctaaagtttgactgtgcctctccgctttatcagttgtcctttccgaagtaggtagctgcaaagagatataccctggtaagtcaccacttcgcctcagggcatgcttctgtgattgctgagctaatccatgtgctgttctttacattcaggaaggtattttgcaatttccaggtggcaatgaagtatcatgacaattgaataaatgaggaaaactgttgaattggttaaatcactctaacagggctcacaaacattcttcatagggaaagtcatcttctgtatcttggaactatccttaattataacaaatgtaagatgtttgaatacttaagtaatctctgttacagcaatgaaggaaggtggggcatcattgtaggagctagactcaagtgacctacaaagagtagataaaacagtaactagctatggcctgggaccatccatagttcaaccatcatgaggtcatttatttgcagaataaattagtaaggttgggagatgcataatttatcttggaaaacttttttttcaaaattgatcaaggataaaacacaaacctatttcaatgatgtcaagttcattttgtgaaacacctgagtttcagatggaaaggacagtttaaaaacagattttaaatgtaatctgtgggcctaaacatgtatctgtattatgacactgtagagagtggcagcatattgtgtatacgaaattaggtttgtctggcttctatgaggccccagtcagcctgagccactccgagtctgttcctggtgtcctgtcataaacactaatggtgttcactttcactcacaagtgtcctggtgggctatggtatttgccacagaattcctgaaactcacaagctccccttgtgcatttgaaattatttgatttccagaagctacatttacatgtttcttcagaggaatatgaatcaagtgagactcacctatcatgggtactgggtggcctggtgagagttttctggattctctttagaagccgaaagactctggaccctggaaagggtcctgcaccaagtggttagaaggaggaagcctttcctgctctcactaggaatcatcacactggcttattggcagatgatccctggagttgtaataaagttttcccaaagttttaagagctcaaatattgctctctgttggacttgggtttgagttccaatcagccatttccaggtcatgtcactttaggagggttgcttttatgacaccgcagtttcatctatgaaatggcaataataatagtactgatcatgggaggggcaatttgaagattaaatgagattaagtgtaatggtccaagcttagtgcgtgatacatggaaagcgtttaataaatgttaattctcaatagtactagatggataaattttgcttttgtttacacagaaaaaagcagccatttgggccactagtcatgaaaggcaacatattagatcttttaaaaagtgttttcagtgtctgtgaccagccattccaactactgattttggatatgcttctatagatcctgccaagcttttccttgttgaccgctccttgtatgggaaagaagacaacgacacgctggtccgctgtcctctcacagacccagaagtgaccaattattccctcaaggggtgccaggggaagcctcttcccaaggacttgaggtttattcctgaccccaaggcgggcatcatgatcaaaagtgtgaaacgcgcctaccatcggctctgtctgcattgttctgtggaccaggagggcaagtcagtgctgtcggaaaaattcatcctgaaagtgaggccaggtactggctctttcttatctgcctctgggagttgagaactcacttatctaaagaagacttctcttctcgttgatccaccttagtgtagtcaatcagggagctagctgttcatagttcccccagcttcaaaaaatgtcatctgcttttgaatttgtttatttcatggtcctgaccccgtgtggcagttccatgactgcctctcatagaggtgaatgtatctgccatagattggcatttagactggactgacttaagtcagcccaaagtttcataattgcatcaagtactcgttctaagggaaacccattgggtagcttgaattatgttggttgaaaagattagcatgcagatgattcattctttgatttactattgacatatgaattgactttcccttcagctgatcaattgcaatgcatcctcaaactgtttgagatctgagaaggaaaattccagttgactgtggaacttgttatggttgtgccgttatgtagaatatttcgttagctggaagataatctaggttttaaatctcagagatcatctaattcaacaccagttggcattcagctattgagtacagtttttattaaggcttttgaaaaagtatacttattgaaattagggaaaatttgattatttaaaacctgggatttccagaggtgagcagggtaggatttgcatgagaaagacgcctgtttgcttaaaagaatataagtagttgttggtcacatcctcctgacaccatcaaggttgtctgaaataaagattaaagcagcttctctatgctagggcttctacttggtttggaaaaagtgttttccagaagtattataatctcacagtgggcatttctgtctttttcactcaatttacttgaaggatgcttgatttaattgctggtaccttcagatatgcaagtagtacagataggttagcaccatgctttgtattttatttaaaagatgacaaagtaagctgtacacatttgaggagaaatggtaaatcaaaatttcatgctataatacaaattatttgaggggccacatttcttttcattctagccttcaaagctgtgcctgttgtgtctgtgtccaaagcaagctatcttcttagggaaggggaagaattcacagtgacgtgcacaataaaagatgtgtctagttctgtgtactcaacgtggaaaagagaaaacagtcaggtgagtgaatcgcttcattcttctcatgttctgtctctgtgggagatgataagttttctctttcagaagagtctgtcctgaaactgcctcgactagtgcgtctgtcagaggtggattgtctgggagagtgttgggattgcatatttccccctttcatacctccacatggagatatatacatttattattagtaacaaataaatttcattttatacatttattttgagaaacttgagagaacttcagattcatgttattacttcatgctgtttctttgaaaaactgttagggacttaaaaaacatggttaactgcatgaatactttgatttaaagctattgttgataccgtttaggccagactatttaaaatattgaaaagagttgccacttccatacttaaaaagaatagagagtctcaattattcaccagaaaacccttccctcgcccacaaattggcctatccatttgaagatgggtttctttttgtaaggatctgatttcctcctttgaggctggttacctgagattaagttgctaatggttttctatttgttttagtcactattaataaaactgttatccttaatctgaaacatctgggcatgcttacgttcccattcatttaacaaatgcatattcaatgccattatacctcagatactgggttaggcatatcttaaataaattttagctagttactgaaattttatccctactaaaagagcagagtttttacactgtcttaatttccaaatactttgctttaaacttcccattgaccaagttttcagtaatttttgtttgaataatcttggccatctagttaattagctatcacagtggtttttattcattacccatgcaagcattatattggaaaaaagaaatattatattttctttctcctcctcttcctcctcctgccccatgttcaacattggcaattttatgcctgtttaaaaaactctttgctaaacaaataaccatggtgattgccataatgcaaagacagtgtgatgatattcatgtagacctgtgatggatgatatcttgctaaatgaagcctgccattgactggtagaatggattgtaccatagacttattctttcaaaccaatgactcagagaaacattttagtttttgtatcatataatgtaatacaaaaatagcttatgtatggatttttggctaaccttacagaatacaatctcatattaattggctttctataatccttgatttcagatgagagaacaatttagaccgggtgtgcatttgagcctctgtataacttgaacattatccttttttgagatgagaaattaaattgccccaggcagttttgttctgaaccatttttcccaggagccctgcatgccagtcccaattaatccactggtgctggtagataagccttcagtgttaggagctctttggggaaatcccagtgtgcacctccaagggttaaggaaaaccaaatcacgtgcaaacaatatgtaatgtgtgacttgcagatggggctcatggctgtctgccaaggttcatccatgaatcttttattgatatcttttggcttaatttagaatactattagcactatcaaattattaaaaaatccataatattttattctgaccctttggaataagtttaactcacaatgtaatttagggtaaaatgactttttagcattgttgccattgtttaagcgcaagggagtcttggagtttgttcaatactgttaatcttagttggttagctttcttaatgcctctaaaccctcacatttttacttgcttgtaatcagaatctttgacagtatcctaacttatgggctttgggtttggatgttcatgctgcatctcttatgactgcactattcctttcagcgctgacaagttcagagttcctgtttgagttctgttgtggactcttgggctcttgaaagaactagaaggaagataccttaaattgagactttgatatgttatctgtccattgtcactctgcctttgtggagaagtctgtgaaactatgaactgggaaaagccagtttgaaaatgttgcttcaccttgctcttacatcttcttgacaattgatcttatgctgtgaaatggtagatttctgccaattattagaagactctcttagaagggggtagtaggaaatctacatagtgttacaaactagaaaagcctttaaagatagttttgttcccacatacccttttagaaactaaaagttaagactagtgatgctcttgacttacctaagatctcacgattagttaacagcaaagcaggtttctgttctttttagtttgaaacattcagcttcagcagtcaacttttgtgtgtggttactttaatgtaaaaatatttgtaaaaccttaataacattaaaaaataggtataattccaccgtcatagatagcaatgctgtgtaatagaaatacatgaaccttatatgtaattttaaattttctagtaggtacattacaaaaaataaaaaaggtaaaattgattttaataatatattttatttgactcagtgtgtctaaaatattatttcataatgtaattaacataaaaattactaattaggtgttttacatttttttaaatataagtcttcaaaatccaggacatattttatatttacaacacaacttactttggactaccagatttcaaatgcttagtagtcccaagtgtctagtccttataaatgctatatagtctgcattttttcatattttttctcttttcccctatgcatatgtattatcagataattgcaattttaaggtacattcaatttgtgctttttaagtaggtaaacacctctcttatagtcataatgctatacttgatatacatttaggtcgtttctgagtttttaccacaaccaacatattgaagcttttattttctgttgagcaatttccttgagttaaatttgctgcagttgatcagagggtatgaacatcctggtaagctcctttccagaaggatttttctgatttataatactgtcagatgctttaactctattaggtttaccaaagcctcgccaaggaatcacccttgatctcattccatgtcactattagctccttttactttaattggttgtttttttccccattgtaataggagtgtgtgtacattacagaaaatttggaagatgcagaaagctatattagactttctttaatcttttcagaaagctgctgtagcttatgttatggtttccccatgactttttaaatacaagaaatctctccatgtcttgtctgcagacaaaaaatgagtgagatggtgatatcacaagggtaaattcacaaccttttcttttcagctcatgcttaaataatttgggccttgttcttagatgtctcttataccttggaactcccttcagtagtttacaagattctgctgggtgagaactgcaggatgagtttccaagctagttgttgacattgtgattctgttttcattcttgcaaataataaattttaataaaatagaacattattgttattagcaatgtgttcgctctcagtcattgggacatagaagagaaaaagacatgacaaaaatatgctgactcatattacaaaatatcagtatcccataatatttcagagatagcaacttttaaaatttagcgttgtatagaatttggaattatacatactagggttaagaaatgaattttcgtttttttcccaatcgttaataatgactgtctttcaacataatcctgtaatatgaagtgttccaatgacagacttgtcatgatgctttattattcttacttaagtagtgtataatgaaagttaatatggagaagttaattgctgctatttttaatttatctaggaaagattctgaatataaattatatggtaatcttcatttttttttctccttttctgaaaccagcagactaaactacaggagaaatataatagctggcatcacggtgacttcaattatgaacgtcaggcaacgttgactatcagttcagcgagagttaatgattctggagtgttcatgtgttatgccaataatacttttggatcagcaaatgtcacaacaaccttggaagtagtaggtaaatacctctatgggaatgtttaaattactggcagtagtgaaagaagaaattattagacagtttcttttttatgtaaatggaatgttgaacagattcttagaattttgttatcactgaatgaatgaaaattatccttgtagcctcttgcaatgaaagcacaaaaccaaattctaccagtttagtggaggaaagtggaaagctgttactaaaattgttcaaacctattattctttgtgcacctcaccctcctttccccaccaaacaaaacataagttgagatttttcaaaaatgctagtgctcgctgaatgacttgagtttggaaatggatgtagaatttatcaaggaacacaaatgcttagagcctgaagtatttctctgaaacttttggtaggggctgtgccccttggtttattgttttgccactcatcagatctagttccttctagtaaggactgaattggacttttcctccctagtattccctacctccttatctcacctgttctctaagcataaagattatagcataaaccttcaggaaggagtgccattgggacacaggtcattggttctacggagcataaactacaacatggtaatctgtccccggaccccatcatatctggtatgcacaattggttcagccttatcttctctactctagaaatttcactaaatatttattttccaagcatctttatttaaagagagcagagcatagtgagtttcttcatgcttttgatttactgagaataataataattttaaaattactttgtttacaatttttttgtcttttgagtattgtttgaatttaatccatttttctgtctttttagtacaaccatattcctagtgttagactttcattaaatacttctaaggtggcaaaattcttgatcaagaacaataataaagtgatgcggtatttgttttcatctctttccccgcctcaccaaatttcttcaataatttatgtagcagtattaaagctttgtgattatcccacaataatctcgtaaaattttggcgtttctgcccatgttataatggaaagtttctccccagactgaacatggaaaagatactttacttgcaattatagtcagcacacagaaagtgtactactttgttcctaaacatgattgtgaaccatttattaatttgaatagaaggctatgcttttaaaatattaaactccataagcactaatttgctaagttgattagggagcatgttgatatatcagcttcagctccagaaagcaattagtaaggatgttttgagaacattgttgtatgtaatcggatttttaaaatccattcatcaatttccaagaattatcactgtatgactggaaggacttgtggctgtgaaacctgaatctggttttgtattgttttgagaatgggttgaggtggaacaggaacaggaggagacaaacagaaaagtaattttttagtggctgggaggagggtttggatccatgatggagtgatgaagagaacagggctttggtatcactctttttttaagaaattacttttttattgtatatttttaagatatacaacatgatgttatggggtacatatagatagtaagaatattactatagtgaagcaaattaatgtattcatcatctcacaaagttaccctttctttgttttttgttttgtgataagagctgttaacattttacctggttttgaattggaggctctgcctgtaatcccagcactttgggaggctgaggcgggcagatctcttaagcccaggagtttgaaaccagcctgagcaacatggtgaaaccccatttctacaaaaaatacaaaaatgagccgggcatggtgccacatgcttgagttgcagctacttgggaggctgaggcaggaggattgcttgagcccaggaagtcgaggctttagtgagctgtgatcgtgccactgtgctccagcctgggcaacagagggataccctgtttcaaacaaaacaaaacaaaagattaagtgtcacaattattaagtaaaaggtatgctaaagtacttaaagcagttcttaacacatagtaagcacataaatggtggccataaaaataatgttagcaattactttattgctctctttttcaagatcttttttatattattatatcaccttttctaaggactccattatttatttaaccggttttctattttgccattttatattataatagcttataatagtgtaaatagcacttttgtttttggcctgtagctatctatctcattttaagaagagttctcaaatggaaattacaagatttaatcaaggaatagataatttaaaaaaaaatctatattgctaaatgcttcctaaaagaattgtgccaatttacagtgtgtaattcagcatactacttttaccacacttgcaaaattattgagtttagttaaaattagttttgctatttttaataagtgaaaagtgatgtcttattttaattactagtttagctaaacattttttctacattttattctcctttttcctgttacattaattattttactatatagacttttaaaaatatttatggatttaaatttgtcttctatgatgtttttcttctgttgcttctaaaaagcctagaaacttcccctctgtagaaatttcataggagtcaattgttatttagttaaaaataacattttattgttaaaatgctctttgatttatctgtgatatataagaagacctaaggttatttttcttcaaatactaaagaacattctttgaacatttttattaaacattagggctcccttgttttcccttaatttatgacaccttatcacatatataattatatattgggtctgtgtatgaactcactatttattccaaattcttttaacctaataaacatcaagactagtagatttagaagacttttaagatggtgatagatctttaagagaattgcttaagaggcagagatgggagaatcagtatttcaaatgtgtgtcctttctcacttgtgacagtgattctacaagagcaaaataaaatgaaaaacagctagttaaaattctcttattgccaattaatactggaaatcaaccaattgtttttgtaattccaagatgaggttctgtttttttgtccagtagttgtagataatggtttctttctgtcttatttcattctaattagataaaggattcattaatatcttccccatgataaacactacagtatttgtaaacgatggagaaaatgtagatttgattgttgaatatgaagcattccccaaacctgaacaccagcagtggatctatatgaacagaaccttcactgataaatgggaagattatcccaagtctgagaatgaaagtaatatcaggtaagaaatggaccttgccctgggggattacacattacccccttttccagtgggcttatcagatcttatttctgtaacccgtaaatccacgagaagatacctggtaaagaagaaagtctggggctgcctcctatgtcctcatcctagtattccattttgttgtgtgtttagagcatgcacactcttgcacacgcatgcacacacacacctgtgtgcctcagttttctcacttgtaaaatggaggacagttttctagagatctgagcttagctcaaagcagtaactttcatgtactcgggatacagcaagtctcttcagagaaaaagggaagttagtacctataattgtttcttaaagctgtaagaaaactaagagccaaataacttcgcttcaggcagtgaacccatgttcttttacactagacctctcatttgatcctcaaaacattatagtaaaaatagtagcaatagtaatacttcaggtaagacataagtgctttttttctgaagcatggttctaagtactttacgtgtattcacccactgacctgaagcctcacagactttgtgagtagacattcttatttcccaccatttttatagaagaggagacagaggtacagaggggtgaagtaatttgaccaagaccgaacggctaataagggctaagtgcctggatagggttttgctctatttttccagtcaggactgttgactgttggaaaaatacgggtgagagatgatagcgtcctgggccaaggactaaaggttggagggaagaggataaatttgggaggtctccaggtgattgagagggcaggagaggcagggaggagttgaagatgcctttaggttgggtggtgagagaccataccattcagggagagcaggaggacggggagggacaagtttctgaggaaagacagtgactttgttttggggtttgttggatttgagattgatagtgggatcttgagtgggattgtttaggtaggaagtatcttttgccaaacgccctagaagcagagcctgagacagggattctgaggcaagtgacttatgcagggatagactgaccagggagtaggggaagaggcatgggagggaaaggaggcaagtaaggatgtggctcagatgaccccaagcctcagtcttatccaggagctgagcggggcttttgcacctctccagctatcagtcacttactggctgcagacctggctgcacggtcaacgtcttccaaggattgcgcaagggcaatccttgggagaatgctgcaggcaagtgtttgggggcatgaaagtagctctgtagaggagacatggtacagagaaccctgcgctggaagtaaagacgtgaaggttgtgagccagcagccagcagctcagtgtgagagagtgggctgcccagggagcttgcatagtgtgagagttggcacaccgcctatggcaagttggtgttgtggcccatgtggatcgtgtgggtcgtggactgcccagggtgacacatgtacatcggagcccctgccagtaaccccgacagggttgtagggtgctcagtgtacacagccctatatggcggtcctgcaagaagtcagaagcttgagtggcaaatactgccaggagcactgagaagtctccggggtggaggaaaaccaggagatgggggtgttgcaagaaggaaggtgagcagtgtggacctcgctgagggcccagagtgtctgtgtgagggcagtgagcatgtgcatgcagggcaggtgagttcaggacactgtggagagcaggctcctgcagcaccatgggcaggggaggaagtggtatgcggacagcccagggtggtggggggagggcggaggcgggaggcggtgggccagtggagaggctgcagcctctgtcaggttgcctttgtgcttaacctttccccactctgtggtctctcacaacaggcgttggtcccagatggaatatgtgtgtgcgtgtttatgtatttgttaatgtggattttgctaatacttactgaattaaatgagttatatttttcctcaaacaggcatagatttccaggtagaaactgaaaaagacatgccttccaaggcatgctatccacaggtgattgactagttgtcttttctttgtagatacgtaagtgaacttcatctaacgagattaaaaggcaccgaaggaggcacttacacattcctagtgtccaattctgacgtcaatgctgccatagcatttaatgtttatgtgaatagtaagtaacatgaagggctccttttaattttttattcttttaaagttgtggctcgtgtttgtaacagctgcaaggactcaacttgtgtactatgtaaataacgtttcatgataatcttgaccttcacagagacttcgtggtttggtggttagagtgtgtcaaaaaaccagttccttgtcctacatttcactgatcacatgaccttgtagaagttgctcaaattctgcgtgctgcctttgaagtaaacagaggagccaaacaagttgaacatacagttgtttgagggaaaatgtattattattgattgttggaatggggggctagtggttgaataggagctgaattactgcgttaggtagggaagagatgctatcgagccctgacgtgatttctttgttcagtgctgtctcttttgaggctgtgatgttacttgtgtttagattgttcttccactgagacaaatgcaatactgacaggcccatggctcactactgagtaccatgtggtatgtgggagaaggtagcagatggtttaggatgggagatggccatgggcacctgagcacccaagtcctgcactgctggggtcctaccgaccccactcctgcagcccaccatgtcttagagaaatgtctgctctgaagttgaggccaagggagcccgatcatgagctggaccttttgccaagtgcagggcttcttcctggctccactctgggccccgtgtgcatttccaaggaaggtgcctcccacaccatacctgctagtgcaagggaggcccctaaagactaggagttccaagggagtggcccaataaatgactattggaattggctttcctgggtgtgtggaggatgaggagacaactggaatatttcatagaaaagagcttaggcgttatgctgggcactttatgtgtgttgggttatagggtgttgtgggaacaaaggactggggccaattccttgtcttgaaggagcttactttctgtacgaggtgttgtggttttgtttttttttgtttttgagacagagtctctcactctctctccctgtctggagtgcagtgacatctcgattcactgcaacctccacctcccaggttcaagtgattctcctgccacagcctcttgagtatctgggactataggcatcccaccacacccagctgatttctgtatttttagtagagatggggtttcaccatgttggccaggatggtcttgaactcctgaccacaagtgatcacctgcttcagcctcccaaagtgctgggattataggcatgagccaccgcgcccagctagatgttttgtttgtttgattttgagacaaacatgtttttgttttcaaacatgttgacaaacatgttgagccagcatctgtctctgtcacccaggctggagtgatcatagctcactatatccttgtactcctaggcccaagagatccttccgcttcagcttaccaagtagctgggagtacaggcatgcaccaccacgcacagctaatttttaaatgttttttagagatgggggtcttgctttgttgcctagactggtcttgaattcctggactaaagcgatccttctgccttgtcctcccaaagcactgggattacaggagtgagccacaacactcaacctgtgtgaagtgattttacataattgtcttatttgatgctacagctcaggaaagatggtagggtgggtggtgtaagccaatgaaaagaaatagctggacagattttttattgctaatccagagtcttttgactatgaacatttcaaaaattgtgttttctgaataagacattcatatgagtttagatgaagaaggtcacattcgtgtaattaaacacatatctttattactggccttcccagaatcctaatatgctaatgtgactttgccagagggggccatgggataggatgtatatatcccaaactcgtttgatcacacagttctcccttttcaagggaaacattaattattatctgagttccagcaaacagttttgattacatagcatttctctggtcctcaattcaagtatctctagattaatttcaatgtgaatcagaaagtaatagtatatagaggctggacgcggtggctcacgcctgtaatcccagcactttgggaggccgaagcaggtggataacctgaggttgggagttcgagaccagcctggccaacatggtgaaaccccttctctactaaaaatagaaaaattcagctggttgcgatgatgagtgcgtgtaatcccagctagttgggaggctgaggcaggagaatcacttgaacctcaacctgggagacagaggttgcagtgagctgagatctcactgttgcactccagcctgggcgactgaacgagagtccgtctcaaaaaaaaaaaaaaaaaagataatagtatatagagcttagtgtattacccatggacaaaattacctgcttctgaaaagtcttaatgttcatctcatttaagagatgaccgtaggtaaatcggtatccttgcaagcataatatgcatattgttcatacagaattttattgtggctgctcttgtgtgatgcttctcaacctttctatgttaaaagactttcttttctaagattcccaatacattgtggatcaatacttcttgtaaaatatagtaaaaaccaattactggaaaagtgaaatgaaaaagaacaatatacaaaatacaagctcgggtttttttattttttagattcaatagatataacaattactctttgtcaaattgctcctcctcagtgcttcttctcagtttctgtatttatctcctgtgcaccagcaacagcagatcgtgggtggggcccactccacagacctcactttgagagttcagtggttgggaattttatgaagtgaggtactttgtgttaccactgtttccctggctttaagtccaaaggggtgtttaaatgtgtctcttttcttcttttttcatgcttccatttgccagtgtgtggtctgccagttggtcatgagatattgacctcaggaagatgtttctgacttttctctggtgggggcaaaattgctactaggctaatttgccattccagcaggctcagttttaatcagtgctgctggtgaacccatgcttatttgaaactagataggatatgttgttagccttccaaaaggatatcttcttggattgcctgtaagtaggaggtcttttctgcattctagggtatgggtctctaatacccacccagcacttcctgaggtcccactgtatttcactggatatacagatgaggatcatgttggtcctgacctcaagctcttcagaaagtcttttccttgaagttagtttgttacaaataacaaactgacagaggcatttatttcacttacctaacacgttggatttattgatttgcaaacgtttggacagaggtagtagcatttatgtttgagctttaaactgtctatgaggtacgtcccagttgctctttagagatatagttagctgatttgttgattttttttaattgaaaaaaaatctagttaacattattatgtggtagtatttttaaaaattttatttcaatagtttttggggaacagatgggttttagttacatagataagttcttttatggtgatttctgagattttggtgcacctgtcacccaagcagtgtacactatacccgtgtatagtctttatccctcacccccctcccacccttcttcctaggtccccaaagttcattctgtcattctcatgattttgcatcctcattgcttagctcgtgaggtaggatttttttcatgttaaattttaaaatcaaaagctaaaataattctacaattttaaacttagaatagttgtggcctttttgacatcattttagctgagccagttacatatgtaggtgtactgtatggtttattttgtaaataagctgagcctcaaggacaaaagggattgtgttctgcaaaaatcagaattgataaaaatcagaataatgaatgcatagtgtttgttagtgcagaaattcagcctacttttactctgtgacactaatgcgtaattgcttaatagattcatctgcaagaaatgctattgaaaatccttgatttggcatggttaaatatttggcggttgaaaaatctatttgttttgaaaattccacatgtaaatttcagtatagtgaatgtggggaaggggcatgttttaattgcttatatggtagacttttaaaaaatattgtgctctgacaatttgtgttaagaaaacacgtatataacatgttaagcttgaaaatgttctaatactgtttctaacctctctaatcaagccatgatttacatgggcctattaaactgactcagtgacatttaaggtggtttataatggccaagagccattataacatggttgccatctttgagtagaacttctagtggaaactgataggaattttcattaaaaaacaaagcaaaaccaaaaattagtgattatatctgcattgaatttgcattactctaattaacttttggaattgcttatccaagatgtgtatggacatcaaattcttagatctgaaatgtttgatatccttcagcgaaaatggtgatttgtttttcttggaaatgaaaatcaggaaaaaagtagagttttgaaaccttacctcaaagtgctttcttaatagacattaacctttccaaaactcttggaaatattagaaaaaaatgacattgccaagatgctatgggtagcttatgctacttatttaggaactgatggcctctttggttatattaaatgtcacacaatgaggtttttttttgccagatccaggacaaataaaaggccaaatatgcactttaatcctaatatatccatttggcttttttccccactccatctagtatttcttgaataaataacaaactttatagtggacttaaaggataatcagtaaagtaaatattttgtaggtttattttggcttcaattttaaatacccatgtgaatcctgaaataatttacataattgtagaaataaattatggttgatatgataaaccagttgtttttcaaacctttggaataattttaagaagatcctgtaaccttaaagtggatagttcaaaacatgatctggtagcatttccagggcggtattatgcatttaaaatatgtggcaaacggtatttacggatcataaatagatcccgctcccattttgaaagcttatcctttaatgacgagcttcagccagtgcggtgggagtactgtgatcctcacgtggtggtgacggggaggcagacattgagaactgaagggctccctttgatcattagccttacataggatgcctttaatgttgagctagattggaagcccaagtgactgctgaagtgcaccaaattaactcagaagtcaccaatttcactccatttatggaagggtattaacagggggttgagaaacaatttaaggaaatgttaaataatgtattatttccaaatcactgcatcatataattaacatcctacctgttgttagcaattatttataggtcatacagtataccaaaatcagccaaagcaataaatcacccagaataaggcttctcgatgagaaagatcccctttgaccaagtatgcaaagtctgggctaccttttagtatttttggttcacagttaaatccagttatggatggtggaaccaattctagggagaagctcctgcagataaagcacatagccatctagcttttggccagccaaccagaaatgatcccaggtagactatcagtgcatttgtgttgctgttaaaaaaaaaaaaaaaaaatgcccggggctgggtgatttataaagaaaagagatttatttggctcacatttctgcaggctgtaagaaacacctgcttctggtgagggcttcaggaagcttccactcatggtggaagcggaaggggaacaggcatcacatggcaagagaggaggaaagagagagaggagaagaagggtgccaggttgtttttaaaaatcggatctcgagggagctaatagtgtgaggagtcactcattacctctagtacagcaccaggctaatcatgaaagatctgtccccatgacccagacacctcccatcaggccccacctccagtattcaggatcagtttttaaacatgagatttgaaggggacaaatattcaaactgtatcatagacccgtgaaagccagccatatagatggcttcacctgtttgccagctctctgggtcacccacctggctggaatctccaactacctttatccagagtaaaataataacggcagtcttgcctgcaaggactgctcagatttggtccttaaggccactgtgcccttcaggaagatcctcacaaaacagagcaaagttactagaacttcaacttttttggaagatggcaatgtcttcccaccacttaacctattagctttttctttccattttttaaaaaaatagtaggacctttcaaacacatgcgcgtccaaaccatacttgtgttagaggccacaaatttgaagacttgctgttaatttttgcttgaaagtctttgcttttcagtgttttccccattaggtggatactattagcgtgacttcctcttatagtaaataattgtaaattttaaacgttaaataaagtgccgaatagaactcctttctgatttatttacttgcttttgagagtttgctctaaggctgcaacagtaactggaacatagcttcgtttgtgtgaacatttgtatgctgcatgtttttaaattaaaacaattttttctcattacaaaagcattatgtgaagggtagaacaattagaaaatgtaaataagcaaaaataaaaatcaagttttatttttactttttatgtttatttactttttataggttaccattactaatattctttattatacattcctccagaccattaatttttttttaaataaaaatgaagtcatattgctttataacctggatttttggtgctgcacaacaaaagcattgtgaatatctttctataacatcattttggcatctcagtgtatggatcttttataatttctctagcccatgcctgatgcaattttgagacatccaggagcgaggcgggactctgaaatgatgtgactgaattttaaaagaaacctgtcagatgattatttaaagtttataattatcgtgtttaatgtctaatgagtgaccttgcttaagtggctggaagttaataaggttatcatctgttgttatctttcatgctctgtgtcttcaacatacgatatggcagatatactgtgctggctttcaggacagttctaaattaaggaataattttcagatcttcttagtgtggtagctaatctatgtaaaaatcgttgcttgtcttttcacattaatctttttatagataatatgtgttcatttgagatatctgacagtgtttgaactctgtttgtattttctgttcctgaacttgaaatgagtttttgttctcaaattgcttgggaattatgaatgttgtttttgatgtgacactctaatatctctttctccttataaagagaatgtctgtggaggcaagaattgttatagatgtttaaattggaaaaaaaaagatataatggcaacctacttttaaagtagaacttgattctcttctgttctgaaaaaatttagcagatgtagctctgaactaagctaaacatctttccctcctcaaaggctggcatcattactcttcctccctatctcataagaaagttggtctggtggatgtgttgctaatttaggggccttgatgtaaacactgaacctgtaagagaaccaggtaaactctctggatccatagcccttggttgcccccgtttgtgtggtttggccatttttttatgttgatggtggaaaagcaggagaaacaggtttaggtatgtagccatgtaaacttctgctggaattgactctaaacttgggtacatagacttcgctaaaagcagtgagtggtcccttttatattgtggaacttccactctgtggagattttcttttcagttgagccacttgtttttacatcaaattagcttccttcatttacagatatatgcaaggtcacctgtaatgtagtgaaatttaaattaatccaagaatagggacataatgtttccatgggcattctgtcaatacccttctcctccacttctgaattatgttgcaaaatgaattagctacttttccagagtaggaaaaaagaggcttttgtcccatgcctgcactccttggcagcaagcagagtggcattgtgatgtgtgtacaggtcttcctccccacggctgggtgatacagcaatggtgctcctgtaagttgagcagtgattctggctgaagaagtctctctccaagtagtttcatcatttttcaacgtaatctcgtgattgggatatctttttgattgctgtttagaacaggggttggtagaactatagcctgctggccagaattggcctgtagcctgtttttgttttgttttgttttttgcttttgagacagagtcttgttccgtcgcctaagctgtagtgcagtggcacaatcttggctcactgcaacctccacttcccaggttcaagcagttctcctgcctcagcctcccgagtagctggtattacaggcacctgccaccatgcctggcttatttttgtatttttagtagagatgggatttcaccatgttggccaggctggtctttctcctgccttggcctcccaaagtgctgggattacaagcgtgagccactgcacccggcctataacctgtttttgaatggctcacaaactaagaacgttattgaatttatttctgattagttttaaaaaatcaggagatttcatgagacatgagaatacaactcaaatgttagtgtccacaaggaaagttttattgaaaacagccatgcctatttgattatataatgtctatgggcacatttgtactacagctgcagagttgagttgcaggaaagaccttatggcccacaaatctaaaatatttacctgaaatatgtatctcgccctttatagtaaaagtttgctgagccctagttgagaaaatcacttcattaagagaatgattttttttctttttaaaatgacagtcactgttaaaataaataggtacaggagattatagttgaagttttattttgtttgttaaataaacttctgttagtgtccatatgccaatttctggatatctttaagaatgtataagacacagtatatgtccaaaatatctatcctgggaattttttaaaaagtataatattccttttataagtaaggttatttttctactccaattttagctgacttaaatttctttattataatggtattatggcacaagtgtaggttttacacagaccaaaaccgggatagtgaaaaattccggaaaagcattgcttcattgcctttaaacaccagcaaacctcgaattttaaaaacagaaattcattcttatgatccctcttcatttagtcttttattatttggagacttaagtgtttgcgttttttgtcctgctgattataaaatatgggcaaatgtgcatttatagcggaagttggttaaagtggctgggtgagagaactctaatcaaaaaatgcctccctgcatttagatgaagaaaggaagaccccttctaccattggcttgtgtattgcctttcagccaccagccctcagctttgttatctgtactatgttcttaaaattcattttgttcttgctttccacatggactggatggtgatgaaaaggaatattttccaagatcacaaatctgtggggtaaatcactggatgtgtaggatttttaattgcatgagcaataaattctcagcagagttacaagcatctgaaatctgcctacaagctgatcggtgttgttggcgatatcagaatgactcaggtccatgatgtttttaaaggcaaaaaggctatttttttttatctccacaggaaatgcataacttatacacctcttaggcttatctaaacctccaacttgggaggaattagagaatgtgtcatttgctatactgcttattgcagaatatctaagaagccacagctcagatttaacctggagaactgcagagttatgtatctttaaaggcaagatgtatatttaatgccaaacacggtgcattgaggcacttataaaatgcagatgagcccagattttcatttttaggaattagatttccacctggctcattctttatgcattaaacattttcataatgcaacttgccaggtacagctcatgctgtactagtgtgtctcatccttttcagaaggaggtctcttagcaccagtgttagggaaagggctggaccgaggtgaggcaagaaaggcacctagagtgtgaaatataaggaggtgctctcacagatacccactcataggccctttagggttagtgccttcttatttttatgccctgggtgcttctcttgccttactcttgtcctggctttgataagggttccttaaaggccctttaaaaaggtacattgctgggttataccctcagcttactagatctctggaggtgcggcccaggaatgtgcatttattctcttcccttagagagtctaaggcatattgaagatttaggaccctgtcagcttggttggccaacctaaggccagcaggacaaaagctgctcaattagcctcaggttatgacccacctgggatagaaacttaacaaaactgcttaattaaccggcacatgggaacaagtaggccagccagaccacaccgttgccagccatggctgttgtataactgctaccaggtgtcacgctagaaggcttggatgttagagcatacttgtaaccaaagctaaatggaattgattatgtaattttgagctgttccaattttttaattaaacaatgttttataggttcactttcagctacccattcattgcaaaataaaattagaaataaaagaataaaatagaaacttttcatcaccttactacccagagataaccattgttaacatcatcttaaagtgttctttcagcctttcctccgcctattaagttaatatttaatttcactaagaatttaccatgtagtgttatgagcattaggaagtatgagtattaagggaatataggtatgagtacatctatgttgtgaacttagctcctatttgagtcctattcagttatctctaccatctttgtgtagactggtcccactcatcattcatctcagtgttataaaaaattcatgttgtcaggcgcttggatttcttatctcatggccctccattgcaaaaataatagaaatagtgccgtatttacgaaagtcaccattaggctgttcccacaggtctcttcttgtgactctataattgaatgcctttggaatcttagagacttgttcctttgggtgggatcttcatcatacaacagtgcttactgtgtgcctgctgtgggtctcactgagctaggagtcacaagtatactcaatcagtaagatgtcgtttctgccctcgagaacatcgagtctgatggaggaggcagaccaagatcttgcataccagcgtcaggtgttcttaaatgctttgggaataaggaaaggagagagaccagcttggcatcagagagtttaggcttgcttagaaaaggaggtgacacttaaactgagtccagagagacccacagtatggcacctagagtccctagcaaatagcactctcctaagggtctgctgatttcttgtgtcgtgtcctacttttcagcctgatcacacagttgcccatgataattaaatgaaacttgccagatggatgctttcgcaagacgatggcttgtcttcttgctctatttgtaaagctggcattggatccaaactctcaaggatgcccctaccttgagattgttttggagagtttctcttttgtgtatattagccaaatggcctgctcatcagcagggccaggttgagtgacaggtgggtgtgtcatgcatgtggatactctgatctccgccaactccagggaggtgcctccagggaggtgaggtgctgagaggttattctacaaagatgtcatttatcagtgttaccttcctttggggaaataaacttcctaagtttctgatctgtcagtctttccttctcactgcatatattttccctatcagttgcaatataattgatgttgaattccctgcgcattgggttaaaatatacaccttatcagactattctaaagaaggaatttttagattattgaggagaatatttagagtggcaaatacagttcacttcatttgtagtgaaattggttatccaagaaaggtagatattctgattataaaataataactcagtattaatagtaataataaattttattgagatggagtcccactctgtcacccaggctggagtgcagtggtgctcactgcaacctctgcctcctgggttcaagccatcctcctgcctcagcctaccgagtagctgggactacaggcgcatgtcactgtgcccagctaatttttgtgtttttagtagagatgcggtttcactgtgttgcccaggctagtctcaaactcctgacctcaggtgatccactgcctcagcctcagcctcccaaagtgctgggattataggcttgagccaccgtgcccagcaataataataataaataattgtttcatttctataagtcattcttagctctctgtatgtgccatctcatttaattgtctcaatatccctatgagaggggcacagttattattcccattttacacatgagggaacaaaaatttagagagatgtagaaacttactcaagttcaaagaactgagaaatgtaagagctggtattcagatgtgtccactatgcatggggctcccgtaattctgtgcttagacttggcacaatcaatgctattcttcagagtacagggtgagcatatcagcatccctgccatcctgttgcttctgttgagcttatttattcttagagggttggaatccttcagatgtattgccatcagaaccaccgagtataagtgcatcttcctttcactttgtaaataacttcaaaaattagaaattcttgagtgttagctggttattgtagttacatagaaataccaaattagagcatttctgctgttacagtgaatatattcagatttatatatatatttatatatatatatgtatttatatatatttatatatatttttatatatatgtatatatatttatatatatgtatttatatatatatattcacgttcataatatacataaatatataaatcttaggctggttttcttttctagttttctgttcatattttgcatttgaaacaaagatttgaagtaaagcccatattgtattttactctttatgttctagcttccctgtaaatagagtgattcggcttttaatcggcaccacccttccacccccaaaaaggagaaaattcatgtaagagcaaaagagtggggcttatcttttcctctaacaactcctaatttcatccattccagttcccacaataacttgaaattcctagggcaggtacagttgcttgaaatcccattggcaggaatcctttaaagtagatttttacctgtggaacactttggagtcctagagtttgattagaagcagtcttcagatccctactccctgaaagcagaaaccctgcagttggccctgccacctctgcctcagccatctcctctggggctgggccactgtggctgggaaagcctttctgggttggaccctgacagccgcctccttgtaccttccactccttggttcagattctgccctttgaacttgctccctcaggctactcagcagcctcaggaaggttgtagggattagagagggagtgaagtgaatgttgctgaggttttccagcactctgacatatggccatttctgttttcctgtagcaaaaccagaaatcctgacttacgacaggctcgtgaatggcatgctccaatgtgtggcagcaggattcccagagcccacaatagattggtatttttgtccaggaactgagcagaggtgagatgattatttttggcactgcttataatgcagaggggaaggactgcaattcacttgaatttcaaatatgttttctgattttttttaaaaaagctttgttttgattattgttttttttctagccatgtggctttttagaagggataattgctatatttttcttggtagacattaattttgtttgctgaaaaatcattactgaatgacttctctattttggtgttatctttctggatttatcatgcaatttctagcctgcaggtagataaagcaattttgcaggacagagtaattagatttccattctatacacaggaggtaatgtgtgtgggaaatgtgactgtagttatcatgaaaaaattacctcagtagttaattgccaagttaccaaaaagtaatgatcgcacaattacaacatacatatggcatttgcaagcgaccgcttttaaaaagggtttcttcttgataatgtgcccagcccctgaacagagaacatctggcactgtgctgcttgcccctcaccatccacacttaagccttaaattgcccttttgcattacctgaagacgaaaatggggtcaccacagctgtttttatccatcaattgctattttatgctcaggctttaaaagcccaggttaacatcacaattgaatagttagtatggtcgcagaaattttatttttcatggaataagcctctttatcacaacaagttggaaggggttacatcggattgctgttttcagctggggtttaggagagtgttttcttttggggaatactaagtagggttcaaggcccctgggaggaatggccacagcagaagcaagccctgtagttacaggcattcattcagtagatacacagggagtggcaagtgtgtaccagacactattctaatggacagaacacacccaagtctttttgcctttatgagtttatgttctagtgcaggggtgttcagtcttttagcttccctgggctacactggaagaagacgactgtcttaggccacacataaaatatagtaacactaacgatagctgatgagctaaaaaaaaaaaaaattgcaaaaaaatctcataatgttttaagcttcatgaatttgtgttgggtcgcattcaaagccgtcctgggccacatgtgggctgcaggttggataagcttgttctagtgggtagaaacacataatagatggaataaacaatgaatgtatgtaggtgttaagaaaggaaacagggaatagctaggtgtttagaatagggaagtcggggtctggctcatgaaaaggatcccttgcagtggtggtctcagccacctgcagtataactaggccttcctgcttagaactcaaacttcagtcctcactttgactattttctggtctacatccttgattttgttgttgttgttgttgttgagaccgagtctcactctcttgcccaggctggagtgcaatggagtgatcttggctcactgcaacctctgcctccagggttcaagtgattctcctgcctcagcctcccgagtagctgggattacaggcgcctgccaccacgcccagctaatttttgtatttttagtagagacgaggtttcaccatgttggccagtctggtcttgaactcctgacctcaggtgatctgcccacctcggcctcctaaagtgctgagattacaggtgtgagctactgcgcccggccccttgaagattttttatgctttcctcctctatgctatttcttttcaaccattcgtgtacccttttgaagcttgtttattttagggatctactgtgtaccagcatatatgcctgccattttattgaattcctttccaatcctttcagtaaccctctgcaatgggtattactatccctgttttacagtcgtagaaactcagtgttggtgggggttaaaaactcatcaggattcaaacccgcatctgactccgaagcctcctctgccttctcttccccagtgcttttttcactcactaggtcaccaaagtgcttattcttagacacttgtaaaaggacattttctgttgattatgaacctctaactttgttttaaaagtatgccacatcccaagtgttttatgtatttatttattttcctagagtaagccagggcttttgttttcttccctttagatgctctgcttctgtactgccagtggatgtgcagacactaaactcatctgggccaccgtttggaaagctagtggttcagagttctatagattctagtgcattcaagcacaatggcacggttgaatgtaaggcttacaacgatgtgggcaagacttctgcctattttaactttgcatttaaaggtaacaacaaaggtatatttctttttaatccaatttaaggggatgtttaggctctgtctaccatatcagtcatgattttaagttcattccaacattgaccatgtcatttctggtaatacatgcatcacaccatactgtcatcaaactcactaagtttcattttgtactagcttgttaagtatatgcttttaccagagcaattttaaccatgctactttatatattttatatgtatgtgtgtctctattagttgtatatttacaattgtctccattaaaaagagctagagaaagcaaatgggggaatatatttaccttacacccaaacagaattagaacaatctaaaatttaaattcaattaaaaatttcagttatttaaaatgaattattttaacactttgccagacactgtatccaaaagttaacactgcctttatgaagtcatgttagcaagttatttctttaaaatatttaaaatttgattcatgtgtgactaactctcttaacaagttaaaagatcttttgggcaaactgatgaattggtacaaagtgggaagacaaagaaactgggcacttactttttaggccttcttggggttttgtttgtttgtttgttgttttcgttttttgagtcggcaaagactagtgccaaaaagtggcgtgttttctcaggttttgagtagtgaggggaagaatcttccatgtttttcagacagggcaacgaaaagaataccttaaaaatgttttttttttttttggttgtgaaagacattcatgctcagtgtagaaaatttggaaaatacaggaaagcttaaagaagaaaatataaaccgtccataaaggaagcttcttttttttaaagttgtacaaggcaggaatttgattgaagtataaagtgcattcagatgttgcttttcattgaaaaacagcataaattattccttttctacagaaatctcaacttctattctgcagtattgtggtttcaagttatatttttaaagattcatttgaataacaagagtacaatgtaaccaaggtgaagctctgagactcacatagctttgcatcctgccatgggctgtgagttgggaggtggggtcagtttgggactgagtggctgtggtagagatcccatcctgccaaagtttgtgattccacatttctcttccattgtagagcaaatccatccccacaccctgttcactcctttgctgattggtttcgtaatcgtagctggcatgatgtgcattattgtgatgattctgacctacaaatatttacaggtaaccatttatttgttctctctccagagtgctctaatgactgagacaataattattaaaaggtgatctatttttccctttctccccacagaaacccatgtatgaagtacagtggaaggttgttgaggagataaatggaaacaattatgtttacatagacccaacacaacttccttatgatcacaaatgggagtttcccagaaacaggctgagttttggtcagtatgaaacaggggctttccatgtcacctttttgggtacacataacagtgactttaaggaactccagtggcttcctttgttttgttccacctgaaacaatgagttttctgtgaaattgcgccccttttgataggtttgccatagagaacatcgtaggaaaatgtctctggacaacattgtttttaattcctttattgattttgaaactgcacaaatggtccttcaattccaccaccagcaccatcaccacttaccttgttgtcttccttcctacagggaaaaccctgggtgctggagctttcgggaaggttgttgaggcaactgcttatggcttaattaagtcagatgcggccatgactgtcgctgtaaagatgctcaagcgtaagttcctgtatggtactgcatgcgcttgacatcagtttgccagttgtgctttttgctaaaatgcatgtttccaattttagcgagtgcccatttgacagaacgggaagccctcatgtctgaactcaaagtcctgagttaccttggtaatcacatgaatattgtgaatctacttggagcctgcaccattggaggtaaagccgtgtccaagctgccttttattgtctgtcaggttatcaaaacatgacattttaatatgattttggcaatgctagattataaactgcttggaagatttttttacccagactgttgttctctcttgctagattttgttttcctcattgttcttaagaatgcagattttaattttatcattatggggtagaacagcccaggacataccctagttattgtcgtatttgtaacatcaacgacatcagcctcttgaatatctcatcccgaccagaaggcttctgttatcttgtaagctttatacatttcttgatcatatgtagccactgaaagggttaatattaatttgcatactacaatttaaaacaggcgcctaagcctactggttctcaaatatacaccaaatgaggcaaacatttcacttctctaaaaataagtttccaatttgaagccttagttgaagttcccatcaaggatgtctgtgatgtttgcagaaagtatttcagttgaaagaaacaaagatgtgtaaaatgagctgtttctggagatccacgataaagttgacagccttatatcatgtcttccaataatccccataaatgttgcttcaccacatcatgaattgttcatgagaaaatttcttacccaagttaattagttgcctgttacttctaaactacagtttaaacattcatagcaccaaaaaatttttcaactagtagcgctcagaacacaggtcattttaggttttcactcactttccagtcttgtcccagctggctgctccttgtggctgattttcccactatgccacagtttgtgccttcattatttccataataacgttacagagagtgtgtgaagccctgctgtaaacagaagtgaaccagaggattcacgtaggaagcttgataatagtagaatctttgaaagcagtaacttctctctgtaaaaccagcagtcatgcttggctccaaatactaatgtcacttagaaattcaggttaaaagaggcttgcttgttttatgttactccacataaggctgcttttttgataagcagtgttaatatatgggattgtattgggactaagtagtctgatccactgaagctgaatattaatggccatgaccacccttgggtatttttatgggaggcagaattaatctatatatctcaccttctttctaaccttttcttatgtgcttttagggcccaccctggtcattacagaatattgttgctatggtgatcttttgaattttttgagaagaaaacgtgattcatttatttgttcaaagcaggaagatcatgcagaagctgcactttataagaatcttctgcattcaaaggagtcttcctggtaagactgatttacataaatagttagctgttgacaggcagttcatggggtcataagggtttgcaatcaaggctgattctttaaaaaatgaactgaggtactctgaggtatgaaatcaaaattattaaatcatttaaatgtgattaacagtttagaaagttaaattgtgtttttaaagattcaaacctagatttttgctgattttttaaaaatgtattttcagttttcttctacactttagttccatgcaactgaatgcattctatatctgtttctcttacggttctgtcctgcatgtatttccatttatactattgagcttggtactacatgcatgtttccagtgagatactgtttatagggaaaatgctaaagcctctcaagttgccacagtaaagtccctttaaaacctttagcagaatgacaaagagctctgaacatatctccacatgtaggcttcttgccatcgacctctggattattcctgtataccttgcctcttgccctttttatttcatcatgctattaaaagacataactactccagcacattttttaaaaattctggacattattctcatctctttcatcattgatgccattctgaatttgaatcatgtataaagagctttgagtttgacttacaaccagaaaagaattcttctcatatcttgcctattctttctttggaaatgctcttaagggccaccatttgagaagacttcctagatgtacccagtccaacagaagtcatggttattttgcccagtcccctatactgtatattgctgcagttgtgtggtagatttctcctatccttttcatgcactttatatccactgcatcttgcaatggcaagacattgcctcctgaactcttaacaccaggtcctcaaggagacctcagtaaatattattgatgggcaattaccccttaaagccattttctgtacctctggctaaagtttaaaaccccaggtgaaactttttatttttttttaatcctataaacttgagtagtttaaagtggtagtagaaactgtacaaaaccactttttgttagtttctcctgggcatgtgctcattatatgaagaaatgagccattttgcttctttccgaaaccttggccctatatatatcctttaactttctgatataatggcctaaattgttcaatcctgtgtgatgttctttgtgctttgggatcccatatgggattggaaccaccagcacactctgaaggagattgttgtcatggtgtttctatgctaatcagaagcaggaagtactagaaatcttgaagagtctccagccaaatgttgcagattgaagaggtccagatggttcagaaaatcatccaaattattggtgtttatctgaaccaacttgatttttttttaaaccttcctccatcagtcactatatgttaacgatctctgcctcctgcataacacgtcttggaagctcttctttgtctttctttcatcttgtctcctggggctcatttagagagtttgaggtaatacgggataccatatttggctctctgtctcccattaaattcattgtgtcaagagacgggaaatttctaacctgagtcctctatatgattatacacaaaaaggacacctagtttctgggcatggaccccaatatcgattattaaaaactcatttcttacagaacaggattttcaaactctttattcaaactttacatgactttcctcaaattggtccagtctattatgtagcaaaggggatgaggaggtagagcatgacccatgagtgcccttctacatgtcccacttgattcagtcatgacttgtttcatctctcccagcagcgatagtactaatgagtacatggacatgaaacctggagtttcttatgttgtcccaaccaaggccgacaaaaggagatctgtgagaataggtgagtacctacctatcaagcaaccaagagtaactttacagagagtatgtatatcatgctaatgtggaatataacatcattcccagtagcaatgatgcagaccagttctgctttatggtagcagtgccaatggtcaatggcagttagggttgcaagtgggtgtttggggtcagagcatatgtttttgtgcctgagtatctttctatagatatgggatctttgctttaattcgccatccctctcctctatggattttgtaacccagcctaggattgttaaatattaactttgtgattcagcatctacctttcctggacaccagggaagtgatctgcctgcaagttcacattagttcattcattaccagcctttggtatgtcattgccactgtcttttcctttcctgacctttatggttgtaattgctaagaaaaatcctctcttcctcacaggctcatacatagaaagagatgtgactcccgccatcatggaggatgacgagttggccctagacttagaagacttgctgagcttttcttaccaggtggcaaagggcatggctttcctcgcctccaagaatgtaagtgggagtgattctctaaagagttttgtgttttgtttttttgatttttttttttttttttttttttttgagaacagagcattttagagccatagttaaaatgcagaatgtcattttgaagtgtggtaaccaaaagcagaggaaatttagtttcttcatgttccaactgctgtctctttggaattcctgttctaatttataagctgtaaagtacaagcctgtctaaatgagtttttctatgaatattcttttatatgcagtgaaattcttttaaaacttttggcttttaggatataggatatgttcctagagaacagaatcattttatcagtaaaagcagagggcacctcatagttacaaggcttggggtgaagcatagacttgagttttattgaagttagatccaaatattatatgtgtggcttatgaagtgtcaggaaataaggggtcagagggagtaataaacacttgggagaaggttaggaatggaaagaatgatggaaccaaaacaaggagcatggtctgtggaagggtgaaaggagttccttaggaagtaagattaaccgaacagaatgagttaccagtcctacccttaaatgtcatgggtgacatttcccaacaattaccaaactaagaaaggatataagatggctgaaataaagaccttcttccgtgtgtccttgggagatgtcagattgaatttgcaaaggcatattaggaactctgtgaaaggacattcaaagagatgcatgcaaaatgaattttcagtttaaacaatatgatatgactatttcttatgtatttccctatgaatgaaagcagtcctgagaagaaaacagcatttattagaattgcttttaaaagagattataataattagactcttgattatgtgaacatcattcaaggcgtacttttgatttttatttttggtgtactgaatactttaaaacaaaagtattggattttttataatataagcaacactatagtattaaaaagttagttttcactctttacaagttaaaatgaatttaaatggttttcttttctcctccaacctaatagtgtattcacagagacttggcagccagaaatatcctccttactcatggtcggatcacaaagatttgtgattttggtctagccagagacatcaagaatgattctaattatgtggttaaaggaaacgtgagtacccattctctgcttgacagtcctgcaaaggatttttagtttcaactttcgataaaaattgtttcctgtgattttcataatgtaaatcctgtctagggatatcacacattttagcagtcaaattaagtatacttcagcaaaatttgcatggtatgctgaacattactacaactaacattcaataatagaagtcctaattctaattgtgtaattttggggcatgtgaaggaaacagaaatagccttaattttcattatagcctgagaatagcaatgaacttgattttgctcaagtgtaacaaatgtaggtcattgaaggtcacagcaggagaaattttggggggattggcatgccgtgtgaaaaatattaaaatctaagatcatattcagagttagccatatagaatgttggatcctagaatacacggagagctattaaataggttcataagtaataatgggtttgtagaacatagcaaatgtttttcaaagtgctgtatttccttgccaatttttattgaatcctcagaacaaacccttgtcctataattgcagcaccttcctattttaaaagttggagaaactaaggcatggcatattttagtgctttttatctgaggtgacacaggacaatagaggctgaaactagagcctgtgatttccagagtggcatcccatcgccatggaaaaccatattgccctttataatattctctgcctgtcttcctgggcccatttctgcagtccagatttattcctggaggtggatttttgtgccccttatgataatgtaatgttttccccccatcactgtggcgtctctattggtagcctgtactcgatttggttttgtaagagtgtttctgtgtttatctcctggccaaagcatgaatttctgaaaaggctgccctgaagctagatattatcatcaggagtgataataaaaacaacttctcttcatcctggtgcaattttggaaggaagaatgataagtcgttaattatccagtcctctgaatattgaccaaagggaggaggaagaaggtggccgcctccaggcccagtcttgatgaattctgcaatctgtctccattatttcatgcctgtgtaattttgtcaagagttgtccaatacctctgaatctttgtttttctccccttgggaataatagtgattcctgactcagaaagttatgagttaatatatgtaaagtgcttatgacagtgccagacatattgttactattctttatagatgtcttatttacgatctaaataatcgtgacggtggttacatactgtcttgttattggttagtgaccttagtttgaaatgacaaagaggggttggctctatcaggcttccagattgtagactccagttcaagtcagttgaactaaccaatcacagatctcgctttcaccaggctagtgggtaaggagaatttctggaacaagataagaagaaggaaactcatatatgttaccgccccacatttttgtcatcatcatttgagatctccttgttgtgtcaggttctctgaagttctttcctttcacatgagttcttcattgtttttcatgtcatggccccttttagagcctggtaaagcctatgggacccttatcagaacactgttttcaacgcctatgatgaaatacataggaataccaaggaaaacagttaaatcgaaatagctatgaagatactaagtaaatttgtgatatgtcagtacatgtgtttactatagagtgtaacaggctctgttaggttggtgtaaaagtaattgtgggttttgctattttttctaaaaaccactgtaattttagagtggtgattaatgtaaatatgattttgagatacctataaagacttaataggatatgaagatatttatgattactgttcatgacaaagtcacaggtacagctgatactactgcgttttatcacctttgttagtaatttaaagaaatgctaaatttcatctagaaattagcgaaaataaggatgtcatttttcctttccaagttcacaggcccctgaatttgacacccatagatctcaggttaggagcccttataggaactttagcacaacatctaggaagggaagggatattggaagttttttgttttgtttttgtaagctgactaaaataactttaacaccaaaaaaaaaaaagaaaaaaaaaaaaagctttcccagttttcaatcctaaatggattaagagaaggattgatttagctttttatggcagattaagattgggaatccagaatgcatctaaaaggactagttacagaaagtttagctcaactttaatggagagagttctccaaagagtcaggatcacaagccactactgtttatcaagtacttgcctttcttctaggcaatttttcagatagcactgagtcaggcggtgctaagcatttttacccattttatcttatttaacccacaagacaattcataaaattaaaagtattcattttgttttacagaagaagatactgaggcttaattacaaatattttagtgactttcccagtgtattagagaaagttttgggttttgacagaaaacccaaaataaaagaagtctaggagtagactttataccaggattggtataaaggttccatggagtacccgggcaagtctttcctttccatgcttagccattcctgagtgtaacccccatgtccatggtccaagatgaccaccaggtggatagccagccatcatatccagaaggcagggggcccttgcactagagaagagagggcagagggcacgtgccagctatattgtaaggaggttttcctgaagctgctatacagcacttacaacttagtggccaaaaccgagtcacctaactacagctagctagctgcaaaggaggctgggaaatgtagtcctaattgtgagaggccgtgtttctgtttttaaggaaggagagggacatattcagtggaaactaacaaatctctgcattacctaaggcccatggtggagccagggctaaaatgtctggctgtctctgacgtttgtgctcttaatctccatgccgtactgacatagtgctcacatcttaaaatggggataatgcacttgtgagccatgtatttcagaggtgattgggatcatctgagttcatataggtaaaaggtttttgtgagatggtactcaagttatcactccacatttcagcaacagcagcatctataagaatatcttctgttcaattttgttgagcttctgaattaacattattgactctgttgtgcttctattacaggctcgactacctgtgaagtggatggcacctgaaagcattttcaactgtgtatacacgtttgaaagtgacgtctggtcctatgggatttttctttgggagctgttctctttaggtaaaatgatccttgccaaagacaacttcattagactcagagcatcttcttgaagtttcattggtgtcctgcttccttgtgattaacactgctttgcaaactgtgtctcaggaagcagcccctatcctggaatgccggtcgattctaagttctacaagatgatcaaggaaggcttccggatgctcagccctgaacacgcacctgctgaaatgtaagagccaaaaaatttttcctttaggtcacgttttcccttttatttttctttttagagacagaaacccagatgttgagggttttcataacacagtttgaaatgtcacttggattctttatgacacactggtcaaatgtcatttctgtagtttattttcataatctcttgtcaccaaaaatacagaaagtttcagtaatatttcatacatgcagtgttttatgttatctatatgtcagtccatatgtccagttgcatagccctggaattattactgaagttgctggatgcccatacatttgaaaacaagctgagggcattgaggagggatagtaaatggcccttgtcttgcaggtatgacataatgaagacttgctgggatgcagatcccctaaaaagaccaacattcaagcaaattgttcagctaattgagaagcagatttcagagagcaccaatcatgtgagtataccctggccaggcatagaatcccccttctcccagttccaggtgtgtcctcctcctcaggctttcagggtgaggactaacctcccaaccccttctctcctaatcttaggttgcaaattgggcttcaggtaggggaagtaaagcaatggaaactagttctttctgcccagccctcctgttctgagccaaagaaggatgtgagattgagggggaagggtggagagttttgtactcactggaagtagaagtttccataaggatttgccatgtttcctccctcatctcaaatgctggtcacggggtcagtattttctccctctcacatgtcagggccatgcatcctttggagggttggggtgatgtgaactagaataaaagcatagaaaagacagcttgttactgcagtgaaataagccttctgatcaaacaagcatagccagaaaatggcagatagctgtcatgcccacaagccatatagaatgaagagctgtttgaagttgggagatccctcccagtgatttgggaagtgtgggggaatgaaaactcaaatccattatttcctctctttttaagcaagaattagtgatactttgactcagatttttttaagctgctttctttcctgggctgtgtgcttggagctatcttttctttcctaatagcacaccactgataatttttgggttaaagcttgttcttctgggtgtcaaaacatgtttcaaattgaacagcattttccacccagttgctttgattcttgacaagagacccctggaagggccgtgggtttcccagcaaattacattggttattgggttgtagttgctggagagatttacaagccttttaaataggtaagatagtgcttggtgcctggtgtgcccttttagaagagctaagcttgtgcatgttttgtccccacttcttgtataaagttatttccttggaaaaatgaagggggaaaacaaagcttatatttgttttgtcagtatgacttgggttttggccacaaagttcttggaaaccacttctctcttaagagtttccatcagttagttgtgatcttgacactgtaagtatgccttttgttgctatgttcgttgtagggactgctgtattgactatgggcttgttttctccagatttactccaacttagcaaactgcagccccaaccgacagaagcccgtggtagaccattctgtgcggatcaattctgtcggcagcaccgcttcctcctcccagcctctgcttgtgcacgacgatgtctgagcagaatcagtgtttgggtcacccctccaggaatgatctcttcttttggcttccatgatggttattttcttttctttcaacttgcatccaactccaggatagtgggcaccccactgcaatcctgtctttctgagcacactttagtggccgatgatttttgtcatcagccaccatcctattgcaaaggttccaactgtatatattcccaatagcaacgtagcttctaccatgaacagaaaacattctgatttggaaaaagagagggaggtatggactgggggccagagtcctttccaaggcttctccaattctgcccaaaaatatggttgatagtttacctgaataaatggtagtaatcacagttggccttcagaaccatccatagtagtatgatgatacaagattagaagctgaaaacctaagtcctttatgtggaaaacagaacatcattagaacaaaggacagagtatgaacacctgggcttaagaaatctagtatttcatgctgggaatgagacataggccatgaaaaaaatgatccccaagtgtgaacaaaagatgctcttctgtggaccactgcatgagcttttatactaccgacctggtttttaaatagagtttgctattagagcattgaattggagagaaggcctccctagccagcacttgtatatacgcatctataaattgtccgtgttcatacatttgaggggaaaacaccataaggtttcgtttctgtatacaaccctggcattatgtccactgtgtatagaagtagattaagagccatataagtttgaaggaaacagttaataccattttttaaggaaacaatataaccacaaagcacagtttgaacaaaatctcctcttttagctgatgaacttattctgtagattctgtggaacaagcctatcagcttcagaatggcattgtactcaatggatttgatgctgtttgacaaagttactgattcactgcatggctcccacaggagtgggaaaacactgccatcttagtttggattcttatgtagcaggaaataaagtataggtttagcctccttcgcaggcatgtcctggacaccgggccagtatctatatatgtgtatgtacgtttgtatgtgtgtagacaaatatttggaggggtatttttgccctgagtccaagagggtcctttagtacctgaaaagtaacttggctttcattattagtactgctcttgtttcttttcacatagctgtctagagtagcttaccagaagcttccatagtggtgcagaggaagtggaaggcatcagtccctatgtatttgcagttcacctgcacttaaggcactctgttatttagactcatcttactgtacctgttccttagaccttccataatgctactgtctcactgaaacatttaaattttaccctttagactgtagcctggatattattcttgtagtttacctctttaaaaacaaaacaaaacaaaacaaaaaactccccttcctcactgcccaatataaaaggcaaatgtgtacatggcagagtttgtgtgttgtcttgaaagattcaggtatgttgcctttatggtttcccccttctacatttcttagactacatttagagaactgtggccgttatctggaagtaaccatttgcactggagttctatgctctcgcacctttccaaagttaacagattttggggttgtgttgtcacccaagagattgttgtttgccatactttgtctgaaaaattcctttgtgtttctattgacttcaatgatagtaagaaaagtggttgttagttatagatgtctaggtacttcaggggcacttcattgagagttttgtcttggatattcttgaaagtttatatttttataattttttcttacatcagatgtttctttgcagtggcttaatgtttgaaattattttgtggctttttttgtaaatattgaaatgtagcaataatgtcttttgaatattcccaagcccatgagtccttgaaaatattttttatatatacagtaactttatgtgtaaatacataagcggcgtaagtttaaaggatgttggtgttccacgtgttttattcctgtatgttgtccaattgttgacagttctgaagaattc

SEQ ID NO: 36702 - DNA, 25862 bp, Homo sapiens
gcggcccaggcccgcaaccttccctggtcgtgcgccctatgtaaggccagccgcggcaggaccaaggcggcggtgtcagctcgcgagcctaccctccgcggacggtcttgggtcgcctgctgcctggcttgcctggtcggcggcgggtgccccgcgcgcacgcgcaaagcccgccgcgttccccgaccccaggccgcgctctgtgggcctctgagggcggcatgcgggactacgacgaggtgaccgccttcctgggcgagtgggggcccttccagcgcctcatcttcttcctgctcagcgccagcatcatccccaatggcttcaccggcctgtcctccgtgttcctgatagcgaccccggagcaccgctgccgggtgccggacgccgcgaacctgagcagcgcctggcgcaaccacactgtcccactgcggctgcgggacggccgcgaggtgccccacagctgccgccgctaccggctcgccaccatcgccaacttctcggcgcttgggctggagccggggcgcgacgtggacctggggcagctggagcaggagagctgtctggatggctgggagttcagtcaggacgtctacctgtccaccattgtgaccgaggtgggtgccggcccctgctggggctgagaccagggctcggaggacctgtcgcggtccttgaacccgagctcctctctcccagatgcgcactggacgctgtcactccccctcccccaacggtcaacaccctagcgatggagaccctccagccaggtggcttgggaacgcttcacgaggtgacctccagccacagtgtgctcctccctgcacaggtggtcagtctggcctcccgtcctgatggccactttgaagagggtaccaggaaggtcctggcggtccctgggcgatgctctatggccctgtgtgtccaggacttactctagttggggttgggggtggtaagtagcagagccaggacttgggccaggggctatcccgtttttcctctagtctcttgatttctttttagaagagaagaaatacttctctttcctgaacttttaaaagttaaataaagcatgtgtatacaactgcctcttccctttttcctctagttactccttcccctaccgtccacaacccaaaaacgacaatctggtcatgccctgtaagtaattgtttgccttttcccatggtcagttgtcagtcttttttttttttgagacagagtctccctctgtcaccaggctggagcgcagtcgtgtgttcttggctcactgcaaccttcgcagtcgtgcgttcttggctcactgcaatcttcgccttccgggctcaagtgattctcctgcctcagtctccgagtagctgtgagccacgacgcccagctaatttttgtgtttttagtagagacggggtttcaccgtgttggccaggatggtctcgatctcttgacctcgtgatctgcctgcttctgcctccaaagctgggattacaaccgtgagccaccacgccaggccgtcagttgtcactctttaagatccattcatctgaagatgggttcagggtgacttgttgacctggaatattttctcaggtattatgaggcaaggctgtcggccagatttagttaaagcatacagccttaggtcatagggtgtaggggagcctttctcatttctcatccccttggattttccctctgggtggttttgtctgtcccctccgaacctgttggagcagttgttggagctggatgtaggaacatgatgttaatgatgtatgtgttttgtgtcttttttagacactggcactctagctccctgaagtttcagcagcattgagtaagtagccagtgaatagccctcattgatagataggctcactaaatgtgcagatgaccaattcgcaggttagagaaggcttcccagaagaggaggcctctccgtgagcctagggtgttcagctcagcataatagtgagctgaaggccccagtgcagcagcaagaaaccacccagcaggacggcggagttcacagagaggggagagttcatagagagggagagtgccacaggccctggcacagcttcaagccctgctggatgttggtgctgagcctcccctcctggagcctcagaggggcttacaggggctctggagatcccaactgtgttgcttcttggcgtcatcacccttcaatggagtctgagagctaccctgggagatccaagtgtgtgtgcatgtgtgtgttttttctttttggaaatttgatgtccccagcatttggacctgctttctccacatatatgtagtgggagtgtgaccggagccccactgggatttcttagctagtgacatagcttcagtgtccagaggcatcatggcttgacaaaagaggcactccttggaggtagccaactgtgctttctggcccatgaatccacaggaaattggaaccttcagttgccacaaatcctgggtcctagcctcacaggtgggtgtgttaccttcccggaagccagtgagtactatgaaagcagaggctgtccctgaggttgcaggcagaggccacagaggggaacatgacacaggaatccctacaaattctacttggggctgcctaaagaagagggaagtagtgaagcaagaagaagcacatggcatctcttggagttttacattgacccctgagggttccccggcttactctagtcacttgttcctgctttgctgcctccatcccacattgggctgagtgatggtggcattgatgagctcccaaaggccagctgtgccagggggtctgaccttatcttgctgccaatgtcagccttttgttttttaatatttagactatttatttagctgtcttagcagtttcaaaggagttatgtgccctttcacctacttatatgttgtcagtctttgcagggaggccagattaatgcttagatctttgttttgggctactggaatgcttgacttgaagttcagagctgcttgttcccaggtgaacagctactgctggaagttgctgcatcaacattctaatggctttttctatggcctgttgtctttcaacccaaacctggcctgctgaccactgcatctagtcccatgcctgctaaatgtctctaagcctgccctctgccccaaatcatacataaaggtgtttgtaagtacactggtattgaattactagtcatattttttccactgaagactggaacctcaggtgtcctgtttggatttttttaatttgttcaagttaaagtacatacatgtagtaccaaactttgtggtggatttagatctttgcgtcttcctcaatttctgacacaattctggatgcagagggaggttctcaggaaaatttttattgaatgagttaatgaataatttaagaaatcatctctaaagtttgagaactaaagaaaaatagttcagttcttagaagggaaacttgagggtggctgaaaaggattgactggaattttttaaaggaaatgtgactccccctgcccactgactggggctttgatgccacatggatgtggaatgaggtgttgggattggcagagggaatctgctagcaattaataaataaatattggcagggcgtggtggctcacgcctgtaatcccagcactttgggaagccaaggcagcaggtcacttgaggtcgggagttcaagaccagtctggccaacatggtgaaactccatctctactaaaaatacaaaaattagctgggtgtggtggcacatgcctgtattcccagctacttgggagactgaagcaggagaatcgcttgaacccaggaggcgggctttgcagtgaaccgagatcgagcctctgcactctagcctgggcgacaaagcgagactccatctcaaaagaataataataatattaataaataaaaatgatttatgaggtaaaagagttttatgcccccatgttccaggaatagtttggtggtccacatggttctcggctggcctctcctctggcccctcagtcatccctggggtactggggaattagccaacccatcatgcagtgcttcttggccatggactgccccatctgctggaaacctgggttgtttctgaggttgtctgggctgtccgctctttggtttcaccatagctctgtccagcctatggacagacaggttccttgagaaacttccggctgggtgtggtggctcatgcctgtaaacccagcactttgggaggctgaggcaggtggatcacaaggcaggagttcgagaccagcctggccaacatggtgaaacctcgtatccgctaaaaatacaaaaattagccctgcgtggtggtgggtgcctgtaatcccagctactcgggagggaggctgaggcaggagaatttcttgaacctgggaagtgggggttgcagtagccaagatcgcaccattgcatgccagcctgggtgacaagagcaagactccgtctcaaaaaaaaaaaagaaaaagaaaagaaacttccaagctgctctgcatcgccttgctctccacctgtctgcttctaagaagccctcggcccagtcctgggtgggactcccactccctccccattgtcctggactagcttttctatcagccttatcttgtgtagagacagatagtcttagaagatgggagagccctcactgttatccccaaagctgcctggaggaaaagccagagcaacctgggagctgggaccggggctgactctgggcagcagagacccgagagacctggagcttgaacctcactgttacgcctttgttgatttctctcactcaggggacacacagaccctcatccagccttttgcagctatatggcaaggcagagaagccacttgcggggtcccgtggcccactatgcacgtacatagtagacacatctggccatgagtggtcagattgagccactctctagctagctgacacctgtaatcctgggtcaaatttctgacagttgacacaaagcagggggtcagggagccaaaaaaaaaaaaaatggccaggtgtggtggctcttgcctgtaatcccagggctttgggaggccaaggtgggcagataacctgaggtcagagttcaagaccagcctggtcaacatggcaaaaccccgtctctactaaaaatacaaaaattagccaggctggtggtgcatccctgtagtcccagccactcaggaggctgaggcatgagaatcacttgaacccaggaggtggaggttgcagtgagccgagattgtgccactgcactccagcctgggagacagagcaagactctgtttcaaaagaaaaaaaagagtattctggagattgaagttcaggagttcagggttcatctcgactttgggcagccaagcaagaactaaagtataccaagatgttgaaggttgatacctttttatttatcgattcattcactcacctatgtaccaaagagctcctgagcctctcttctatacagggggcactgccaggagttgtagaggatgtgatagcaaagataggaaataccttttctctttgctctgacaacggtggggcaaggattcatcattgatttcagcaggaggcaggataaaatgtgtgtaggaatataggaatacatggcaatcagtaacatgtggtacctagcagcatgtctgactgttgatacggtcaggctaggtacatcccctcagggaagaacttctgtcttaggggcacacaccctatcttttttcccttcctgccaattcacaggtaagaacatttagtcccagggaactatgtcatctctctacttctcataactgaaaaagcagtgccaattatgtatgaggtataggagacacaattctccctctttttaaaaatgtttaatagctttattaaggtgtaaatgacataaaaactgcatgtagctaaagcatgcaatttggcacacatgtatctctacacccttgaaaccatcaccactagaaaggtgcatttctccccaggaagaggggcaagtctaggccctttgccagagttgctcccagattgttttcaggttgggcctgcattcacagctcagccagctgaagggtgacagcattagactcgtgacccaaatcttaaacccacacattccattttaacattgatacctgtgatcatcagccagtatagcccatcccatgtgccaggcggaggcatcaataagctggtctgtagcagctttaatcacagctggggagccaggagctaaggaatgctagactcctttgtaaacaatttaagtagggggtacttagcctggactctatgtgcttctcatccacctcttctcagggagattctggccaagtcctggaacctactgcagtccatctggtggttgacagatatgtggacggattggcaggctgggacccaatctatgtttgcccttgtgttcagttttgagacctagcacctttcctgatcctgctcacagaccccctgcggccaataggaaagaagtgttaatgcatatttgcttttggagggcccaaagccaggcccagagagttgtcaagggcggtcagtggtgggtggatggcagagttaaccaaggagttacacacctgcctagactaaggacaggctggaccaagtagagagggtggggctaagggagcctgagagatgctctggggcctatctcaaaatgagcactatagtcaccctgtcccctgcagagattgtctgacctggttttaggtcacacccaaccttgccagccaaggagtctttagaagcctgatattgggagacctgtcctggggtctacaaccccagaactcactgcagaagcccacgtggattgctagtctagctcagccatatgggtccccaaccctcacctcatgatagtcctgtgagaaaccgctgctgaccctttgttcatgttttcatcttttccactataaaagacatgctagctgggaaatagagcccatcatactcaagagtggcaggagccaggtcctggcccctgaagcttggcctcacacacagaggccggcaccctgtcatcaattccctcagctttttctccgcctccactcccagtcctagatttagcagccatgtgtgggtgggggccactgcagggatacttacccacctaccagagagatggcctgtgggtgctggcccttctgaggctgtggaggttggaggctgtggcagcctgggcagtcaggctgtggtcctcccatgttcttgactcctgctagtctgggctgcctcctgattaggggttggatgctccagttcttccctgggttggggattgccaccctactcccagcccatccaggttcacgcttattccaaagcggagcaccagcagtgtgcctgctgcgggagttctccgtgtccagcctgagggttgcctgccaacccctctgagaggtgcccggaggctgtgcgcccacactgcccagcagtgcggagaagcaggcttgtttttccctgtcactggcttggaagagatgctttgttctagggagccgcatgtccccttgcctgcgttgttggtgaggagccagcaggctccgtggagggcaggctagcagcctggcaccagggaggcaagggtctgagttcctaggagggtggttgctcatgtgagaagtctgcaaaggttactactgagcaccatctctctgtctgaaaaacatttttcatttttctgtgaaccactaagtttcccgtttgggctttcttcctgcttttggctcttgtttaggcaggcgcagccagatccaagcgtctggctgcttccccatgtcttcagacctctttttctgttcatggtaactatagatggaaccacacattggaagctggaaactcaagcggtgcagcctattccttaccccaatccctgttttacaaatggggaaatcaaggcacagcatggggtgatgcttatctgaggttggaagagttttaatagtagagtgggagctaaaacccagtttcttacctccaagctcaggactttcagctgtaattgagcctagtatagttggtgtgcagcatcagggattccagctctaaaggtcacaaaaaggacccgggggtcattggcccagggtgggaacccgagcagagcaggtccagatggtgcactctgtgccctggccttagtttcttgctggatgctttggcccgtagagccccagagccctgcttccagaaccactccagtgacgttcatgccaatggcctgaaccccactgagcgagggtgccctgcctcttccacagccctgggctccgctcagatttttaggagcaagcgttagaggccttgctttctccagggtcagcatgtggacagaacacttactctctgcctgtctctcctcctcaaaatggaagcaagacagtggggcctacaatgctatgaaaaacaggatgggaaagaagcctgctctctgccttcctgcccaggtgagccatcacctgactaagtgagttcacactcagagcgtgtggggatggcaggatgttctgacttcattttccaggatgcctttgctttaaaaccttttaaaaagaagtgaatgatacaccccctttgctcatcttgcagtggaacctggtgtgtgaggacgactggaaggccccactcacaatctccttgttcttcgtgggtgtgctgttgggctccttcatttcagggcagctgtcagacaggtaaggtgtctgtcttctggagcaccaggggacctcagcactgaggaagaagcgtgtgcctggcccttgatttcagttggtagtattctttcagcgcagggccctgtattttaaagaagaggaagctatgtctgtgatatagactccatgcctagtaagaagagccaacaaatctgactccgtaattcttgctaagtaaagaaacctgagctgtctaagctgaatgtatctgtgacccggttgactaggtaatatgccatgattcacttctgcagtagcctggcttgcctcccctgggtcactgtgactctgtcatgcccctgagcatgggagaggttgacatcatgcacacatgcacatgtgctagattgtagatctgtagtagtgccacggtgtctgcctctgtagtcccaagaagaccagcattctctctgcaaagtgaaaggagctctcaccagccactagtggtatgaaaagcagaactcttttgtccacaaggctgatgccccttagctaagtggcctgtggttttggcatttactttatgacaggagggagaatagtgttttgatccatttcttataagcaggttatttgtataattctaaagcttttaactcaaggaaacattaacggcttagagaatcccaaacccctcgaaattatatgcacaatgttagagactacatgtgagcatttttttggagagaggtccgtagctttcatgaagttcttagaggggtccattatgttgtgtcttctttccctggagcttcagggtctgtcagagaagactgtgaagagagtagcagccttcagcaagtccttggccacatgacacatgtgagaacaccccacaaatcggtgggttagccggtggaaaggagtcccagcatcttccctggtttttaattcctggcctcaagcaatcctccctccataacctcccaaagtgctgggattacaggcgtgagacaccatgcgcagccagatattttttattgttgttgtttttttttggaaaaggagtttcactcttgttacccaggctggagtgcaatggcacgatctcggctcactgcaacctctgcctcgcaggttcaagagattctcctgtctcagcctcccgagttgctgggattacaggcatgcaccaccatgcccagctaattttgtatttttaatagagacaaggtttctccatgttggtcaggctggtctcaaactcccgacctcaggtgatccacccacctcggcctcccaaagtgctgggattacaggcgcgagccactgcacctgcccagccagatttttttttaaaaagcaggttaacctgtttattattcctactttacagatggagaaagtgagacagagggattaaataacttgcccagggtttcacagctggcaagtggcagagttaggatttggacccaggtagtcttgctcctctattgtgtatggactactgttctaggtccctgctgtcctaaaacttgctttctagcaaggtggaatgtattaaacaaccaagtgaggaagtcgttgttgtccttggccatggtaagagatacagagaagtgcagggtgccacaggagtgtctaacagaggaggtcaggggcagcatccctgagaaggtgaagcatgagcgagagtgggaagatgagtcgaaagtagccagctgaggggtagagaggagaaagaacatccaggcagggagaatagcaagtgctaaagccggggctcatgaaaaggcatgggagcaggacaaagtccgtgtggtagaggtgcggagagtggtgttaagatgaaggggagaggcaggcagagccctgggcagatgagcaaccagggcttagtggatcacagttaggactttgggcttcagccacagagcagcggtgggctactgagattttttaaagcaatagtgtgacaatcagatttgtccttttttttttttaaagatgctttgacaaccttgtgaagaaagaattgaagggaagcaaaaggtgttgtagagagaccaattaaaaggttgtcacagtagttcatgccagagatgatggtggcatggcctagcatgacggtggtagaaatggagggaagtggtaagaggtaaaatcaacaagacttgccgatgggctggatgtcggaattgggggaagaaagctttctggcctgagtaactgggtgaatgaaggtacacttctctaagacagagaatgctggaaaagaaccacgttcatggatattgagttcaatttgtgtgtactaaatttggggtgactatgagacccctaagtggagaagtagagtgtgaagctggctgtatggatatggtactgcatgagaggttttggctagagaaacacatgtaggatttgtcagcatatagaaccctcagcagagccccagatagggatgaggttgcctggggagaggggagtggggaggggaggggggaactgggggaggattgtgctatgcttagaggccacctgagtggacatgggagattccttctcacggagctaagtgacagctgcggctcagaagaatgcccttgatgtgaaaaggagataccccaagttcagagtagaaatgcagtgtatttttctgggtcagctgtgtcatgggtcagcttaagaaccttcttgccatgtgacacaatgattacctgaggaaagcatttaagttccaaaaggtctattcccagggaaactggaaacaaaatttgtgagtgtgtttaggaccactttagtctacagaagggctaatatagtgtttttcaaacctttctaaacattttggccacagaactttcattaaagtaggataatttaagtctagtaaatgaaatacaccctaagtggctaaaagtatggctgttctgcctgcagcccctgccttcaattcccaatgccctgcctcaagcctgtctgtgcccccttggaaggcccagggccctgtgggatggacagcttctgagtgcattacttctgagtaaaccagttctaaaacctaagctaagtagattacctgaaagcaatcaattcatgccctaacttgtctaggacatcaatgtaactttttatatagtataaaggtttcaccttctttctggcctatgaatatgtctgaaattcaagagcaattaaagtactcctgggttgtcaaagccctttatgtaacactattgagttatctttatgcgtctgacttgtaagagatgcacaactctaggaagaagtagactgctgtgtcctgtttccaggtatgtgtgtgtttgccattttgttgacagactttaaaagcaaacatttctggccccaaccctgaactgccaaggactggtgctatgtaaagggttctctggatctgtctcttccctaccatcccagggagctcttaggaagggaaagggcatagagattataccagcctgccttgtggttaggaaccaccccttggttggcatatagaacatgcttgttaaaaaaaccatgcaggggaaagtagagtctactaccaggcgagagtttctcaacctcgaccctattaacattttgagccaaataattttgttctagggcattttcctgggcattttagaatatttaacaacatatctggcctctactcattagatgccagtgaaccccaagtgatggaaaaaaacaacaacaacagaaaaaaacctcttttattgaggaaaaacaccaaactcttccacatagttgcaagaccttgtgcaatttgcctcctagccaccactgtactcttgaattgcacgcctgatgccaaccacactggttcctcatgttcaccatgccccctccagccatgggggtgtgtggtcttctcagagtctgaagcattccccacccaccccaacccaccccctgtggccttctttaaccatgctggctaattcaggatccctagttccttatgactttcctttaaaacgtctaccagaaattgggggaaaaaaagtgttattataggattaatgttggtcttccgcactatactgtgaatatcattgagagcttggtccctacaccttaaatcccccatcgtcaactattttttcccatctcagtgtcccatgatcaaggagaccctccctgaatgtccagttccccaacccttacccccagtccagggtagcttccttccttgtgcctctcattaacctgcatgccgatccttcagtgcacttgactcagtgtgtaattgtatattcagtagcgtgttgttagattaaaatgtggttaatatgtgtttcaccagttatactatgacactccttaagggcagaaacagcatcttttttaatttattgatatccaagtgccctctataatagatgctcaataaacattgaatgaaagtgggtgtcagccagtactggccagactcaaactgaacccactgcttcccactagcttgactttttcctcctgtttgtggcactctctttaaaacaaaccaaaataaacccaattttaaaaactttttaaaatgagcacggatacagaaaaccacacagaacaaatgtgtagcttaatgaatttttttcagagaaataaccttatgaccaccaccaagtcgagcagtagaactttgctgtccactaagaagccctgtccatgtgccccatcccaattacagcatcctctctctctccccattaagtaaccgctagcctgactcctgtaataatcacttccttgtgagtttttttagttttattatcgaaatatgcatccttgacacaaatttagtgttgcccacttaatatatttgatgtcttttagtctacttaatctatggattctccttctatcgccttctatgccttactgattatctatgaagaacctgagctattccacctatagaatttcccagtctggatttgttgattgcacactgatgatgcagttcagcacattcctctatgctctgcatttcctcaaaattggcagttggatccagagacttgagattcaggttctgattcaggttcagtccttttggccagaccataggaagcatgcaattcctgactgtctctttatgatgttaacagtaattagtatataatgcatagatctattaatccattgggggctataaatggtattattctaattttattaccttttcatttaaaagttagaatacttttgtacatgatactacctcttatctattattggttgctgttcacatagtttacaaaggaaaatcaggacaaatgtttctttctctttatttgccagttttcatttataatgaattgtttctctgttattctccaaatttggcagattcttttttaaaaaaaatatcattatgaatgtatggattaaataattgatgtatttcagtctcttgcaatcattatcataattgtagcattgctttttaggcaaccctggtacccaggctgtacatttgtcatggggagtggggagggggagaaatagcatgggcactgtgagaccgagactgtccctggcagccagtattctggcaacactgttcacacccacttactggatggatcttgagaaagccccacttggtggagcccattcctgctgcccttttccagctggttatctgtcactctccttttcttcccaggtttggccggaagaatgtgctgttcgtgaccatgggcatgcagacaggcttcagcttcctgcagatcttctcgaagaattttgagatgtttgtcgtgctgtttgtccttgtaggcatgggccagatctccaactatgtggcagcatttgtcctgggtatgaccatcaggttggagttgagtacttgatcctgtatttcaccatcatcccatcacctacctttctggagacaactgtgatgtccctcaagggggacagggtttctaacaaaactagccagagcttcctggtgaaccttacttacaggcagggaaactgagccagacatgagaccagcctggggtccccagcagcacaatggcctgacttctgatttccagttcttttctggcctctgggctgtggctccttggtcttagtacttgatggtcaatttactaggactcaccagagatcctccatttacaaaaagggcctgccactgcacagggctgagccagccccagaaagagggcggcatggttggaggaggaggggctgtgactggcaagcttgctaaggtagagaaccccttgtctgcagagcactgtggctggtgatatctacggacaagaataaattgataggaaggggctttcgtcaccttcagggttttaattcagagtgcacactgcagggctttgtctcaaatgtgccagcctgttgtcactgagaagctgccaggccggcctgtgtttggaggaacctgactctagctgataaggcctttgagttccttgggttgtattgttgaaagggttgttttttctttttatatttaatattctttccttgaggcttaagtcagcatgtgctgacttagtaatgacttcacttttaataaattcttcctcatgtgaggattaaagggggcctaccatggcatctttagcacatggcttcagaacatggcgaaattttcaagagagaactgttgcttgggggcctgagaggccacagggatgtacccccaggagacagtcagacaggaggggttcagaacgccatccgctccctagcgccatgaacttagagagagttctcgctgttttcttgtctgtgtattcacaaagataccataaaaaattaataaggaaggaacccaaattaaactgctaactcgacctcccttgttttgaacagggacagaaattcttggcaagtcagttcgtataatattctctacgttaggagtgtgcatattttatgcatttggctacatggtgctgccactgtttgcttacttcatccgagactggcggatgctgctggtggcgctgacgatgccgggggtgctatgcgtggcactctggtggtgagtgtgaccttgtgccccatgtgcccactggcaggatgatttctgtctggccttcactagagggcagcaacaacccatgaatccctattttgtctcccagagacaggaagcatagattataaattatttcagaatgttttctccacactcaaaagagccaaaacaaaacagaatcccatgacagcaacagacttgctctcagccctgtgctgggttgccccaagtgtggggaaaaatagcagtagctgtgagaagatggggtccagcatgccctgtaggaagttcccaagcctcagggcaggacagtgtaggccctagttctggctgtgtgctgctgaagcctcatgccacaggcactggcaccaaaagcaagagtcctcagggtagccacatggaggaagccaggctccttctgcaccaccaaggtagaggagttgaacaggcagagaagaggccattccagaccaagaggggaacactgcagaggtgctaaggtgggaatcaccccttgcaggtggagaaggtgagatcaccagcccaagtggagcagagagcatttcagggcatagtgggagagtaagccgcacatcatggggcccagtcatgaccgagggtggggggcggctacctggtcccagcaaggtggaaaataatatccatagagcactcaagtgccttgataaacatgctaatttttttcctttttttcttttctttttcttttctttttttttcttttttttttctcagacaaagtctctgttgcccaggctgtagtgcagtggcgtgatttccacttactgcaacctccgcctccccagttcaagcgattctcatgtctcagcctcccgagtagctgggactacaggtgcctgccaccacacttggctaattttttttgtatttctttggagagacgggtttcactgcgttggccaggctggtctggaactcctagcctcaaatgatccaccggccttggcctcctaaagtgctgggattataggagtgaaccactgcacctggccaaacatgctattttaggtagagtatctgactaatctgttggataaatcaggggtagggtgaggagagaagagaagctaaaaggccagtgcagaagcttctgttggtgccggggacagggaggagagtgtagcagggcctgggctgacatagacatgcacagaagccaggcttccggagcccatcttgcacccatctcctcagcccagcagatggcaacactgctcttcagaaatggaggtggccagccagcatggggatgccgtcagggggtgcagggctctcccatttttgtgcggtgtggggtacacataagctcatccaccccaggttattgctgcgtgtggatcagctctttgcttctggcttgtgatcaccaaacattccacaagctctggttctgcaaccttattcccacctatggctgtgctctacctggtctgtgggtctgctgttggcagggaggcctcactgagattggaccttgtactgccaggttcatccctgagtccccccgatggctcatctctcagggacgatttgaagaggcagaggtgatcatccgcaaggctgccaaagccaatgggattgttgtgccttccactatctttgacccgagtgaggtaagcaccatgtgggtgtgggtgagagggacagactgaccgtgatttgagagcagcagcacccagccctgaagtcctccctgctcacagcagcccagccctctctccgcccaagccccaactgcccattccccccatccccccactccccacccccacacgggccctgttaacactcagaagttgaggaataggttacagctgcctcactcttttcaccacgggtttcagattttcattttttacttcctttctaggcaatcatatattttaaccattacttctaacaataaatactctttttgagtaataggcctttcataaagtcagcatttgggaaaatcattgtttcttatacctaaggtggcttgtcaccttacaaagctaaccccaaacgtaaaatgtaaagcacaaatagatttggagttagaagtatttcatctcttgagtattagcaattattcattaaaaagaaaaaaaaagtgtttagtctctttctgccctccaatggttaattattgcatatcatcttggagtcaggtcctttttgatgtccacctcttccccctaccccacccctcccgtcagccctgttctcacacaccatgactcatttcttggctctacctagttcctggttcttgcttttccttcccgttccctctcctaccatctctgtagcaggcagttttccttggtctcgtgactatgagaggttagaagctgtaaatgctgcctggtggggttctggaatgtgtctgtggtctgactggaagatgaggggttgggtgtgggaacagccacaagcagccctgctgaagtgtgagaggcaggcatggttgggcttggaaaagagggaacagttattgtagacagcggaggccaatggccactgccagccctgcagacttcccagtgagtggtggcccagcagccactgtcagcatgcaccagaaaggggtcctgtgcgcaaaggtcaggcaggagtgtggcagagggcttttaagttaggtggttttgggggcttttaagtgaggggtcaatctgggtgaatgcataagccccactggcatctttgaggaaatgaggctatttcaggggatactttcagtccaaagttgaccttttgttgaacttctaactctggaaaaacaagctccaaacctgggtttgcttaagaaagcaacatcagtgtgtttagacgtgtggtttattaatggccttggctgtgctgaatttcataggaagtcactctgggtgaagctcaggtcaattttcctgtttttctatttgaattctttttccctggaagcacaccagtaactacatagtataaggactcaaaacattaacttttaaaaaatatcagaccaataaaccacacagccaggtactctctctgacccagagggcagggagccaggcttcgggaggaatacttagaggcctccttggaatgtggccaccgacaggaatatgtgggggtgcagtgaggaagctgtcagcctgggcctctgtcttcctgtacccttgagggactggtcacttacttttcctcattttcattcactctgatttgttactgacaaggcctagggaagttttcacagcctaaaacacagtcagtatacttactgttcttagaaacgtaacactccccgacgctgagatgcagacagctaagatgccagggattcaagtatgttattgtgtgctctgagtctctgaccacctcttcttcccatacacttatgatgttgttcctgcagttacaagacctaagttccaagaagcagcagtcccacaacattctggatctgcttcgaacctggaatatccggatggtcaccatcatgtccataatgctgtggtatgtaaaagagacctgcctgaggcttccagacaaagcttcttgaagtggccattgggcctcttgtttacagacatgcctcagacaaaattcaaagcctatgtcatcagagagtgaaaaggatatgtcttgtgttagatggaaaaaatgggcatgtcacaattcttaatgggatggaacctcagaaaaggagaatgaaaacaattgtggaggctgttgtgggaaatatggactcttgtggggaatctctccagatcttaagatgaatccttgcccaatttgggtcatttagttcccgtctcctacccagttaccgacagtggctgaggaggccaggtagggcttttaagaaggatctgagtgaagacaccatgtcctgtaggctgcagaggctgccagttactttctggaaatgtggaagtgggatgtgctcctcctgggatgtccataaacggtcctggagtcagggctatagcctagatgtccttaccaggttcccactaatgaggcaaagtatgtcagaaagggatttgtgaattaccagggagaggaaacatgtccaagtgcacatcgctagcttttgctcagcggccgaaccctgggattctaggcgacttctggagcctggtgggttagcggtgagaagatgggcgaggagggcggacttcatctcagagtccttattactagtctcatccagctttgaggcagtcagccactgtgcctactgagggagtgctatgagtcacccgcttccaaggaatggcccaggatccctccaggcagttcaccattccctgagttggcctcaagacaggagcagcatgtagcctgcaccacagacatgcaagcctgtgatgagtcacccacttttgtgttcacccaggctctcctccctgctctggatttcctggggactcatgcacatactctttttattgtaccagctgtgtgttccacctgcagatgagtcaaaacagtctaatccataaaggtctggtttgtcaaagagtgtgggtcatcaacagagagaatgcctactggggatgcccaggtcaggggtactgcagggcatcctgatgagaggcagtgtggcccctccattgggagccacctctgtgctccacaagtaccgcggggctggtgtcagctgtctctgaccagcctcttcctgactggtcaccacaggtagtgtgtgagggtctctctccaagtgtttgacctaatgttgttccttttgttatcttatcccccaaatcctatcacacctcacttgatgtctgcctcctgactcattctctagctccttctgcagttgctggatttgaggaggttcagcttaggatttttaaagctgaaaggcaggttggaatttttcttttcaatgaagtaaatctatctgaattatacaagcttttttgctgggacactgtctatatggaaggctctgagagcgcactggcgcagggtttacactgtaccacttgggctggggaaaattatcttttgatctatgaagtaagacgcagggttacagttactgctgccttactagtctctgcttaaagatggtttggaatttactgaaataattgcattgtaaaagttgtacaggttgggaaagatgtggatactgcttttccagctttcttctgcactctgtttcaggatgaccatatcagtgggctattttgggctttcgcttgatactcctaacttgcatggggacatctttgtgaactgcttcctttcagcgatggttgaagtcccagcatatgtgttggcctggctgctgctgcaatatttgccccggcgctattccatggccactgccctcttcctgggtggcagtgtccttctcttcatgcagctggtacccccaggtagggaccatgtgcatctatggtttggggtcttcactgagtctcttactgtctaccaggctgtctcaattaataaagagaataaaatcaagcccatcacagctcccttgcttatatacattcttggcctaaaaatcaatagaaagtgtcttctgagactagaacacttatggcctgggctttgagggagtgggaaaaagcagccattggggctgttggttaattttactctgtacccaagttaatgtgctcatactgttttccactgcagaagaagagggaagaaatagctatcccattcctttttttcctggccctgtcttctttatttattcaacaaatagctatggcatgcctaccatgggctgggcactgtgctcggtgataacgatacacaagaaaacaagccaggcagaaccccaggccctcatggaacgtacaccctagatgagaagacagacaacaaacaagtaaataaaatgcttaatatagttcagactgtgttaccttctaggaatacaaatgaaggacaatgccgagttagtttacatagtcacagatagtgtccctgaacagggggcagttcagtagaaatgtacataaagtgacagaaagccctgaaaaagtctaggagaacattttaggaagaagaaatggcaaaggcagcgaccctgagcaggggatgagcctggcatgtttgaggaggagggagaaggggaggggccagaccactgagagggcctcacagagccttagcaggattttatttctgaaactatcttagtatcccacagatgggtgggaggtagccatttccaataatttatagaacagttcatgggccctcatctctccctctccatcactgtgcccagagacttcagtgtacctgtagatttgggagcctctgatggtcacttttgggcccatcaggctgagaacactgcacgggaacagctccccatgggatgtggcaggaggagcccagaactgatgtagaggctcacagctgagctcagagtgaccttcaggtcacacatagctctcccatcagcacagcacagagagattagaagatcaacttgagattctgatggcctatgatttttttgaggtctgagtgggaggaaagcatgaaatgagttagaactgaattctccattcatctaaacatcatgagttaattccatagtgcctgcagtgtgaggttctggggtgacagttaatccctgacagacatgtctttaatgacttatagactgggaagcaggttgattggactattaaggagcttactctggtggtctccaggttgaggaaagtgcatgtccttatagctgcaggtcccagcctcctttcagcaatcaatttggagggaaatcttggctatagccccttcccccacaataggaagtgatagaaactgactccccaaaaaatttgggaagaaagtatgtttgttttgctctcaatagctgcatgccatgggttggtacctactcctaccctctttcctttgcttctccagacttgtattatttggctacagtcctggtgatggtgggcaagtttggagtcacggctgccttttccatggtctacgtgtacacagccgagctgtatcccacagtggtgagaaacatgggtgtgggagtcagctccacagcatcccgcctgggcagcatcctgtctccctacttcgtttaccttggtaagtcccatgagccaagggcacactagagcaacgggatggaagtactaactggcttgaatgtgagctggaggttgcgtgttaacaggaaaacaagttcatacagtacatgggctccatccagtactggatctttggccgggaagggttcttgtcccagtgcactggccctcactttcaaatggaaaacaacctatagattacctagaaattgatgagaatattagagggtttgtttctgttttagccatcccaggccttccatcagagactacaattcctttatcctaagaacctacagagtggtttagggagccagtgtgcttagttggagaaatttcttggaatcagagtttaaaaggaacatgaggggaaagatgtccatgcaagaggtctgatgaacggaaaattattataacctagagcactatagagtgattttatcttgtgtgaagatccaccccatgccattttatgtagcaggtctccagttttctcttctcagaattatgtcttcatagcacctgtggtttcctgcacatccctagccagtacctctttagggagggtggcacccacctgagagtactcagagtgctttgtgaacatgctatgtagatctcaaagcaagcaaaagcaccctgcctaatctgaaggcagatcacatgggctgggacacatctgcagaggtggaagagttatttccatccctggacaagtacctcaggttccttggaaacccaaccttggtaaataagaataatcagcatggcccagaaataggaataatcagcatggcccagctcttctactgcaaccgcccctttgtactcctcccctgcatggtggaacactgctgggctctgggcatgcctgtgccagctctgggttctgaaacctgtctagatgccagattctaatctgactgctcagactgtgagagatgtgagaccaagaaggaaagtgatccccttccagagtcctgggagcataaaggggtagatgagagaccaagtctaactgcagccctgggcctgaggctccgtctgctttgccataggtgcctacgaccgcttcctgccctacattctcatgggaagtctgaccatcctgacagccatcctcaccttgtttctcccagagagcttcggtaccccactcccagacaccattgaccagatgctaagagtcaaagggtaagaagacctcctctgtcagtgttgatgcactgggtctgggtctggccaggtctcaggagcccctcacaatagagctactcgcaaactccctctcacagacaccatggactagtttagccattaaagggttgtaaatggcaaggtgcttacttatagcccatcctctctggtctgttcctgtgtggacatgtcactatacacatctccatggcagtagccgcactggataactcagaggctagaagaaacctttcagaatctgctgcaggattctcttcccagggaagatatcctcagttcttgtttgtttggagactgggaggcatctttttaaaatgtgttactgacatatttttgcttgtttttatagaatgaaacacagaaaaactccaagtcacacaaggatgttaaaagatggtcaagaaaggcccacaatccttaaaagcacagccttctaacatcgcttccagtaagggagaaactgaagaggaaagactgtcttgccagaaatggccagcttgtgcagactccgagtccttcagtgacaaaaggcctttgctgtttgtcctcttgacctgtgtctgacttgctcctggatgggcacccacactcagaggctacatatggccctagagcaccaccttcctctagggacactggggctacctacagacaacttcatctaagtcctaactattacaatgatggactcagcacctccaaagcagttaatttttcactagaaccagtgagatctggaggaatgtgagaagcatatgctaaatgtacattttaattttagactacttgaaaaggcccctaataaggctagaggtctaagtcccccacccctttccccactcccctctagtggtgaactttagaggaaaaggaagtaattgcacaaggagtttgattcttaccttttctcagttacagaggacattaactggatcattgcttccccagggcaggagagcgcagagctagggaaagtgaaaggtaatgaagatggagcagaatgagcagatgcagatcaccagcaaagtgcactgatgtgtgagctcttaagaccactcagcatgacgactgagtagacttgtttacatctgatcaaagcactgggcttgtccaggctcataataaatgctccattgaatctactattcttgttttccactgctgtggaaacctccttgctactatagcgtcttatgtatggtttaaaggaaatttatcaggtgagagagatgagcaacgttgtcttttctctcaaagctgtaatgtgggttttgttttattgtttatttgtttgttgttgtatccttttctccttgttatttgcccttcagaatgcacttgggaaaggctggttccttagcctcctggtttgtgtctttttttttttttttttaaaacagaatcactctggcaattgtctgcagctgccactggtgcaaggccttaccagccctagcctctagcacttctctaagtgccaaaaacagtgtcattgtgtgtgttcctttcttgatacttagtcatgggaggatattacaaaaaagaaatttaaattgtgttcatagtctttcagagtagctcactttagtcctgtaactttattgggtgatattttgtgttcagtgtaattgtcttctctttgctgattatgttaccatggtactcctaaagcatatgcctcacctggttaaaaaagaacaaacatgtttttgtgaaagctactgaagtgccttgggaaatgagaaagttttaataagtaaaatgattttttaaataac

SEQ ID NO: 36703 - DNA, 8184 bp, Homo sapiens
cacacctttccaaggacccccaaactctgctccgtgcacgtcaaatgctcctttcccttgtgtccaaccccctacccctctccctaacacccctcttctcaacaagactcagcctctccccgaggtgggtgagcatccttgaggtttcccacccttaactgctgtgtccccggatggagccagagaaatgtggtgggggggccggggccagagtttcaacattgccccccagaaggaggagccagagatgggggtaaggagaaggaatttggggggtgtcggcaagagggtgagaacggggatgaggtggagataaaagggggaagcaaaggctctagaggaggaggaggagggtgtgtctgtctatcagcttctgctgatggagcctggtccgtctttctcagtctcaagttcgttgtctcattatccattaaccagcccctccctttactgtttaccagccctgttaggtctggagctccccacagacactgatctcagtttcccccgagagtgtgagtgtaggcctctacaggcagctgcctctggggagttggggagcctaggggttaactctagacccccctcaaccctctggaccaaagtctgtccaggaaaataggatgccggagcccaggagtcgtcagcctagcagttgcctggcctccagatgcctcccaggtaataatgccctatcactctccaaagacttccaaatttcatcctacgccaatcttgtttcatgccctcaccaaagatacccctgtgttcctctcgtggctcgaagtacgtctgcctgaggctcgctgtcctccctgacagcctctagagctggctgagagctggaccttgacattccttctgtttccttgaccctgttaccccttttcaaatttacttattcgatacatagttagtgcctgctatgtgccaggccttgttctaggctctgttctagttacagaaattaaaaaacatttatctttcctcataagcttacattgtagtgggctttggggaggattttaatcttccctatttagatctccctttcttggaggggtgggtgtatccaagtgtgggcaacactgggaacagtcataacagggcttcccttcttcccctttaggggagcagatcctagcatgggccccaggggtgaggaagggcctggaaccagaattgtctggaaccctgatctgtaccaactttagggtcaccttccagccctgtggatggcagtggaatcaggtgagatggttggggccacagaaatgacagctagtgggaaatgggtaggggagtctagcaggatttagacaaacattatgggttaagggctgtcttttgaatgtatcattgataatcagtgggaactctctctagggttgttgccccctagaaggggttggggctgccagggtaggaaaatgagggcgatttcagatgtctacccagtcacgtgtttcgtctaggacactcccttgaacagtgaatacgattttgccctggtcaacattggacgattagaggctggtaagttgggggggggtttggtgaaggggttcactggggttgttggaactccctcctcatccttcctctgttctcagaaaacagcagggatggagtgggatgggctgcaagagtcccttctggagagactctggtccatggttacactgttctgtacctcttgacttcagtgagcggcttgtcccgagtccagctcctccgtccagggtccctgcataaatttatccctgaggagattctgattcatggccgagacttccggctgctcagagttggttttgaggctggaggcctagagcctcaggcttttcaggtaagaggcccctaacctgaggctttctcctcacctcagaaccttgggatcctctccctgacaatttctgagactcctccagcccctgggatcctctcatcattccccctgcttctctcaaggaaaggctaaaaggctgggataaatgattgcgtgatgagagtaaagagcctgcgctctagccttactctattaattaccagcagtgtgactgtgggcaagtttcctcctctgaaaaaccaggattcctcccagaatcatcattctaggattctgtggttccagatttgttctcccgaccccagtccccatgacctgaggaagcccccttctctagggactgtcttcactgttcttcttcattcttggcaaagagagtggagcaacacatgggctccatttccttcttttcacttactcagcctaagccaaaaggatggaatgtcctttcctctgcaggtgaccatggccattgtccaagccagagctcagagcaatcaagcccaacagtattcggggataaccctgagcaaggctggtgagtgagagtgctttagggtaaggaagagtctgaaaaagcagaggatggctgatgacaaagagctgagaagctgtctctgattttctccttcctcctctatgtctcactcctgttctaggccagggttctggctccagaaaaccaccaattcctctcatggagacagcggaagactgggagactgagcggaagaagcaggcagccagaggctggagggtcagcacggtcaacgagaggttcgacgtagccaccaggtgatcccccagtgcaccccaaccctgctgctctcccaatcttcccttagttccttgatcctctaaagctaggacttcccacaaactccagcctcctaggacacccacaaagctatctcccttgcctcctagatccctaaacctgaaatcccttggaatggtccctctgaagcagcttccttgtaataagagctttccattataatgaagtcactgagccaaactgtaatatcactctcatttcacagcctcccccgttacttctgggtccctaaccgaattctggacagtgaggtcaggagagcatttggccactttcatcagggccgtggaccggtcagtgtgatggttagggtaatggctgtggattagagggtcatgtgggccagggacatcgtggagggaggaacctctgtgaggtcagtgtgggggcaagggtagcgtggagctaggcatttctcccacaatgaccctcttctgccccatgtgaagcgcttgtcctggcatcaccctgggggcagtgatcttctccgctgtggaggcttctatacagccagtgaccctaacaaggaggatatcaggtgagggaggcttgatgagaagaatcaagggttaggtgctcagggtagactccttatttcctgactccctcccctccagagcagtggagttgatgctccaggctgggcattcagatgttgtcctggtagacactatggatgagctgcccagccttgcagatgtccaacttgcccacctgaggctgagggccctctgcctgcctggtgagaataacctttgacccctaaccctcaccctcacccctaggtctgctgagcctaacctggtttaccctttgcttgctgtagatgagtagctctttagtccaatgagcccgttttcttttcttttcttttttcttgagacggagtctcggctgggcatggtggctcacgcttgtaatcccaccactatgggaggccgaggtgggcagatcacttgagggcaggagttcaagaccaacctggccaacatggtgaaaccccgtttctactaaaaatacacacacacacaaaattagctgggtgtggtggccgatgcctgtaatcccagctacttggaaggctgaggcacgagaatcgcttgaacccaggaggcgggtgaactgagaatgtgccattgcattccagcctgggcgacaagagtgaaacttgtcttaaaaaaaaaaaaaaaaggcagatgagacggagtctccctctgtggcccaggctggagtgcagtggcgtgatctcggctcactgcaacctccaactcccatgttcaagcgattctcctgcctcagcctcctgagtagctgggattacaggcgcctgccaccatgcctggctaatttttgtatttttagtagagacgaggtttcaccatgttccccgtgttagactaggctggtctcaaactcctcagatgatccacccaccaaggcctcctaaagcgctgggattacaggcacaagccgtcgtgcccggccagtgagactgttttctactcacctcccacctctcccacctctcccacagactcactggtttcctgtcttcttgaccccaatttattctttaaacagctttattgagacataatgtacataccataaaatttacccttcactgaagtatacaattcagtgagttttattatatttacaatgttgtacaaccatcaccacagtttaattttagaaaccatcctggccatttacaattacttttcattcctgttcttaacccagcaggctatcaacctgaatcctgaatcctgagttctaatctcttgcccttctgatctttctaccctctatcagattcatctgtagctgaggataaatggctttcagccctggaaggaacacgatggctggactatgtcaggtactccctcgcttcttctagccatcatttataattcaaccttcctcaaccttctgttaacttggggtcctaaatggcctttctttagttcttctcctcggtttcccaagaagactgccattttctgctctttagaaggaggaggggtaggatttggagtcggccttattccatcccatgacccatcaaaatcactccattcccctaggcttatcattcttcctccctcttcctcacctgctcctccagggcttgtcttcgaaaggccagtgacatttcagtattagtgacatccagggttcgttctgtaatacttcaaggtgagttccttggttaagcccattccattccttgcctcttttctttacccacctgaccagattgcattcagggagggagacccataaggcttcttcctctcctgttcctgggaactacctgcgagctctactctcatccttcagtgctacctctgcctccccatcacaacttgtggtccctgacactaggatggtcttagcccctttgttcctttccttccatcagcggatggagactggggttggggtgggaagggcagtgtggaagctggtttgagaattgtgattctgccccttacatgtgaaactgggtatttctatccgggtggagtccaggaagtgaatcattcaaggtctttgttttctcttcacttctatgtgctttctcaatcctcctaccccaaacctttcccctctgtgcctctcacttctccttgccgtatttctcttctcattctcttctgccctagtttcttggacccctcttctttgtcccttcttcctctttatcacccagagcgcggtgatcgtgatctcaatggcctcctctcttcactcgtccagctgctttcagcccccgaagcccgaacactgtttggcttccaatcactagtacagcgagagtgggtggcagctggacatcccttcctgactcggcttgggggaactggggccagtgaagaggtgagaatgattcgggatggcatcgggggcatattactaaggaagtaagagaatgagaaattattttgtataatccattggaggtgaatccggtcagaagggccccgaggttaggctgggacgaagatcctgatgagtgaggccttacaagcccctgctaccctcaattcagattttcattccctgacttccataagttccccctattccctgtgttccccattcccttatcatctcgtcatcctccctctttgggtcccaataatcccttccaacctcttaatttcttttcaggctccggtgtttctcctcttccttgattgtgtctggcagctcctccagcagtttccagctgattttgaattctctgagtttttccttcttgctcttcatgacagtgtcagggttcctgacacccttaccttcctgagaaataccccctgggagcgcggaaagcagagcggacaggtcagtgacttctatttttgactcgtgtttttttttccattgagatgtactctctgaagtttggtcttgatttgttttatgagaagtgaggtctgtgagtggggagggggagatttattctcattttcaggacgagacttttgccctacatctttcctagaataagaggtgagaatctcatgatttgtctctagatgtgggaggattgtgtgtaaccatcctttttcttgcttcctctgtccagttaaactcctatacacaagtctacaccccaggatactcccagcctccagctgggaactcttttaacctgcagctgtctgtctgggactgggatttacgttatagcaatgcacagatactacaattccagaatcctggctatgacccagaacactgtccagattcctggctccctagaccacaggtgaagtgtctaaacttcctaaattcccttgacgttcccacaggctcatgctactagacagtgagaagtgaaagacaaaatgtcttgagttccttagggaaagctactccactactcttctgcagctgtcacttatagtccctgggtgtccctaggaagacagaagacctagaatagcacagagggcaccctttttgtccttcctcaagtctgtttactcatcttcctgtctcgtgcacacataaggtgccctaaaatcaaccttaatcagtcccgaggcctagttgaagcctaatgaggagggtagaagagttctcatggggaggcttgtagttctagtcaccagtgcagtgagtgggtggcagcaggacaccctgtcctgatccagattggggaaactagggttatctggtctctctgttgccagttgattttcttttccttttagccaagcttcatggttcctggaccccccagttctgtgtggctcttctctagaggagcattgacccccctgaatcagctctgtccttggcgggacagtccttccctgctggcagtctcttctcgttggctccctcgacctgctatctcctctgaaagcctggctgaccaggaatggggtctcccctcacattggggagcttgccctttacctccagggctgctgctgcctgggtatctgggaccccagatcaggctctggagacgctgctacctgaggggaaggcctgaggtccaggtaagaagggaaaatagactgggagtgggacaagggacttgactctgctgaaccagatgaacaggagctggaaaggcaaggagctgaagcctctgggagtctgggaagtgaagttctactcctcttggcatcaaacaaggtttgggagtgtaggaggtgcgggaaagtgcttgtggcttagattaagtggaatttagggcatagctgaaaggggaaacagaattaaagacaccagaagtagcagagaagcagggggccagagctacaacagtattcttctctgttcctctttgcctcctccccagatgggcctctcagctcccacaatctctggcctccaggatgagctatcccatcttcaggagttattacggaaatggacaccaagaatatctcctgaggatcactccaagaaaagagatccacataccattctcaatcccactgaaattgctggcattctcaaaggcagggcagagggggatctggggtagaggagggttctgtctaatcttttttttttttttttgtatctgcacttgcagcctcagctttcacacttcagcccttaagttcactaagaaggtctgagtttctgctgcagatagtggtgttaactgctccaactcttgtcttgcttagtttctacaaatatttttgcttcttgtcatttgaaggattaagaaacaaaaacaatccagaaattgatcggtttttttaggccaatcccatcccttctggataaccagatgttaaatcatgagatcagagatgctgttcatcagtcccaacaagatggcctagaaatcgcattctcacctcgccttgctgctgctttaattccaagttctatttcttcccttatagttttctatgggaatgaggcggatacaggaaacaccctatctcctctgtatttttgtagtggaatttctatttaaggggctcattaaagcatagtatttatacac
